United States Patent 9,328,346 (POLYCOMB-ASSOCIATED NON-CODING RNAS) - sequence listing, part 58

SEQ ID NO: 12170 - RNA, 1099797 nt, Mus musculus
guaaugucaguaaagaggcuuuauucuauacagauuucugaacguggacauuacauucuagcucacuggaaacuagacuacucccccaaaucuucaauucauuuuagaaauaggagcaacauuuacuuggaguccaaguacaaauguuuacugauuuuggaggagguggccacacgcccuuuaagcuuagacgccuguuccaucucauccaaacauuagauaggcuggcgacauucccaagcaguucaaugugagagaaaccacuuccaugacuuauuaacaagccgagcagaauuuuuauaggauccauccauccagauuuauuacagaacaccauuuaauaagaaaaaaaauuaaacggaucgauugaauugaaguccuucuguaaagggagccauuuaaguuugccuuugauuaauguuagcauuuaagggcuugucacucucaacugcugguuacugcauuugucaaauaucaggcuuuuccuuuaaacaaagucagcuauaaaucccaucucccaugccugaguuggcuuuucugcuucuggcgugucccuuucguucucugccuugcucuggccaugggcugauccugugccccgaccuucgauuugggugaagaauggagagugagauuagaguuaccccugccuuucucucugagaugaaccacaauugucuguuguacccuaccaucuggaggggccuaacucugccacauggcuggcuuuguucuuacugcuucuucaaccuggugccagcacaagaagauguuucaccacuacgcuagucuugugucuuuuaauuuucccuaauuggagugugcuccguacuucaugcuggaaucauuaugaauacaaacacacaugugaugaacagagaaaauaaaaacaaagugaacaaacuggcccaguggaagcgucagaguggaaaaccccugccugagguaucccaggucccgggcccacuucaacccagcuuucauggguuuaucucuuuuggguucaaagucccaggccucugaaugacaggcagagagcacccuaagacuguuuuggguuuucaaggguagcagucauggauugggcaaugggugauggagguugagggaccugcagcaugauggucgcugaccacagaaucaguguagcucugacuagcccaucaccuacuuuauagcagguacacguuuuagggaaaaaaagaugaaaggacuugaggauguauaggauguucaggggauguuugcccaagcaagcuauauguuuuaugcuacauaagcagucuguuuuuuauuuuuuauguauuuuuuuugcauguguguguguguguggucuccucuguuuuagaaaugucugucuugccaauuucccccuuauaugccacuuuaaaaaagacaaugcaaaggcaucuuggcuuauggcuaaaauucaagcuucgggaagacaguguuucuuuuucagaccaugaacuugaaaaugagcaaguuuuuuuuuuuuuccucacugaucuugccaauugaaaacaagucucuuuaucuguggagagggcugggccuuuggucccggggcggugcucacagaacaaugccaggcaccagccacuguacaacuucuguuuuauuuugugugcuuuuuuuuuaauauaggauauaaauaaugacaaaaauuacaaaauuuauaacuggaagcccacgcuuauauauacauccgcuugugugucagcagagcuccuggaugcuucacuccuguacaagucccguugguaccauauucgaauguuauucucuucucuguuuacuacauacauaucaacagugaauaggcaaaauauauacaaggaacuauucaguucaaguaauuuaauauuguauuaaaauucuuccacacugaacucaaaccauauacauuugucaguugaaaugaaauuuaguuuuucuucaaaacucaccaacuggugaaugugagaaucucagguuuaaaauaauauugguuaauuaaaaaaaaacauuaagacaaguucacaauuuaucaauaucgcuauaaugaacuucaaaaugauucacaauaugauugguuagaacaauauacauuaaaguguuauuuuucuauaaugauauugauacuguuuauauaauuuguuucuacagaaauauacauuaugguaucauacaaauacuccacagagacauuaaaaaaauuaaaauaccuuaaagaaacguaaguaaauuuauuuaaucaaauaguaagcaaacauuuuuuuaaaucuguuucaagaaaaguuuuuauuacuuuggaauuucuucuuuuuuuguguuauuuauuuuuucuagaaaagaauuuugcaauagaauuuuauuaacaucguucucaaacaagguuuccuugacagaaaucuuggcagcaggagcccuagcuuuuauuauuuuuuuauuuuuuguuaaacauguucuuuaaaacaccccaaaggcuaaacaaaacaaaacaaaacaaccccaaauaaaccacuuaugcaggcuacagcugagucagcacuuugagucacccgaagcacuagccuguucugcuccugaggcaaagggcaucagggcuucacccugacagagccaggaccucagggcaaguagcaguaggaauguagucauuugaaacgaaaccagaaacaucccgcacaacaaaccuaguuuucuuaugaaugcauuaaugaaacauucuuuuuaauaaaaauauuuaauacaagacacauuuuuuucugugcauaauaaauuccucuguuuuaaaucacuuuuuaaauuuuuugaaucauucaauaaagguuuccuuuaucugacauaguugauuacuauaaaauccacaaauauagaaaucgaguguguggggggggacagaacuuccuggugaggguugcuuugucuuuuugcauggaauuguacucaaugauacaaugacuuuacagguacuuugggggugggguaguacuggucugacuuucccuucaaaacggcugaccugaccgugaaaacuuaaacccaagcuguuuagacuuucaggcaguacuggagacccucccucuccccacccucucacuuuuaaaaagguauucuccccccaacuaaagcaaagcaaguacggggcaguugagcaguaccucagaggaggcggugguagcggaguuggggcgccccgcgcagccccccucgcgccucuaaggggcgucaaagucucgcuggcagaaggcucccuagggauggccgucgcccuuccgcccgugacgaggccacgcgagcuggagcagucuuccucccggggcggguggacacggaggcgcgaaggagagccugcugcggggacugcugggcgagcaaggcaccgcgaggacggggcggcggguaucagaaaaucgugguuucauacuugguauuaaugccccucuuggcuucuugccccggcuccacaauccacggcagauuggccagagucuuuugcucagaagggucgaucugcuuuaaaacagaaaggcugaugcccguuauccggcagcugggcggcggcgcggccgcgugggcgccgcuggaaccccaccucgggccccgcucgcccagccgcgcugcggggcggccccggcggcguccgcgcuuucgcaccuguacugcacagcgacucugcaggggccugcaagggugacgcgagugagaccuggccccgcccccggggcgcagaggcaggggagcagcggugguucccaacaccccaauaucgggguccggaaagaacccuacguccuccgaggacauugcagcgccccgcucacuugccugaggccucucugagcuccagccaugccgcccuggggauggcccucgggcacccauccgugcagugaggccucugcucucucccgguugccuccuagccagugugguccaggucuuggcuucaacaccacuuccuauccuagaagcuguauuccccacacccucuacaaaauggcaccucaaccuuuuagcuccccccuuccugacacagacacauaccaccugucuacucccucuuccacaacggaugccccgcaaagguggggguuuuguuaacuuuauugcuauuuucuccaaaccugggaaagcucuuaguggcucaaugcaaggcaggcaugcaauaaauauuugucaauaaaugcuguucagacaaugagugcucggccuggauaagaaagguacuggaguggacaaaacgcagguacagauuccggagggagggcaaaguggccgagagggauguaccccagacagagggagggaagaggccagcaagggccugucaggcugcgccuuggcggacucuguccuggguucagauaaagccaagcaugucauucccugggcagcagcuaaagucugagcucugaugggccucaguuaagcucuuuccccaauggcuugcucaucccuuggccaucaucuacuuggcucuguaaacgggggccaaggaguuucuggaaggccugcucagacuuccucuaucagcuuuuuaaccuccuggaggcugcagggccugagccuaugugccuaucaggcugccuucugccaugguuucccuugugccuucauaggacgagggaagaaggacuuuuagaaagagcacuguguguguccugagaguaaaccacuggagcugaggagaugggaauucugaagccuggugagggccugcauccagagccagguagacuggguacucuccuguuucccagagagggugucuagaugaauauucuaugagcccuuacggcaucaaagucuuagugcuccucuggaaggagucugcguggaccgcaguacagcuggaaggacgugcgugcugugaacagacucauccagcccacacgagaaggaauagaguagucuaagcaacaauccccacaaacaugcugugcauuccuggacucagaagcuuaauaaucgcacucagagacacauucguuaaguccacccucaccaccucgugucucugaccgcagguuuguagugagugcugcuauggcccuggggugacagcaugccaguguauuucauggaguagauauuuuugugcaggaagagagacaacagaaagcucagucaacacuacgcggaaugaagagggccuacaaggugaccaggcaacuacccugguuaggaaaagcuucgugcagcuaaaaccugaaugguaccauggggccgugcagaauucgggggucaggggagguggaagagagcaaucaugggagacauagagucuccagugggacugagcaguguacucgaggaguggaaggccuaggcaucaccacgugugaucagagauuagguuuggguauuuuuagggugccaugguuuuugcuguaugaaaaaagggagucacugggaaggugugcacuggccuuggauuaggggggugauggaggaaguagaagaggagugggcagacuggagguguguucgaggggagcaaagauugaucucugcucaugggcuggauguggagguacaaguacaacagcaaucaaggugacuuggggacuuuggugacaagcagcauggugaaguguugugucauuugcugggcuggggacagaaggggguagagaagcaaggauuuauaguggcuaaacuugaaaguggagaugcuuagaaacaaacuggacagacauuucuaggguucuggggugugucaaggacuggggaauagagagcagggggcaugggcuggguaggugcugaggcaggaggguccgggauaggaguguagcaugggauuugagaggugcagcagccacugguaaugaccaaucagcggaggccuucugggaugcaggaggacacaauggacucucagggacucggagaggccggaugcugagggaucaucccguggguggugaggugaccaagagcagagacaggagagggggaggggccccaaaggugugauccacagaagccacaucaucccgaggaaggaaccucucuuuggagguuaaaaaugucuauuuuucucaugacacggacggaggcugagagcugaugggaggaggaggaggaggagaaggcagcagauggaaagauugcgggaugagggggggcaacgcauucugggggccugcccggugccaaucccagagagucuaggaugcgggauggaugcuggaacagagagcagauggggagcuggcugggagccuuccagcuuugggguguugcuacuaccagaggcggccgcuuugaagucauaccagccuguugggacaggaugucugcggagccugugggagggagggaagggaggaaguuccuggagggaggcagaugacagggaggagggggguaccaccuucuaacaguuacuaggcuguggagagcuucagcuguccagagggaaggcacacaggcuguggcucaggcaucucgaggcugaggaugccguggucuccugaaaggcaagcugugguaucuagcuuuggccaggaggguaccaggguaccgucaccuugagccucugcacaucucucuggagggcagaggcuugcccccugauugagugguaggcgaggccucagagaaggcugccuccacacuuuccuaggccuucuggugagcugggucaaaaccagaagcagcagcuagccauccaagcucucaaaaggcuauugcuagagguggcagagaaaaacgugguuuucucuguuaccuuugggcucuggggaaaggauucuuugagccugcgggaaugauggucacaugccagcaggagaccacaggaaaggacaggggaaggcaggcuggauucuaaaggccucccccucacugcaccagguccucuuugaaucccccuucccucugguugcaggcuuaaagaugucucugucuuguacuuaccacugacuuccgaaugcuaacucggggcuuugggauggguuucgagggcuuguucucaaagcuuucugggaguguggaggaauggcccccuuuucuugcuuguagggcuaguugguaagcgaccucaaaugccugucccagcgucaggaugauuucauaggcuaaauucugcaagagcaaacagacaagacaagaagaacauuuacuagaggcacacaaagggucagagugaguggauagcugaggagcagcguggaccuugaacugccccaccggcagcggcagugacucaggggaagucuguuagaacaaagcacucuggacgcuagucacugagguagcauccuuggagccaggcugccagaccuccucccccauuaauuccuuauaagcagagcccucaugcagcccaccagccccgggugcuccuccaggugcagcucgcuuguggguggcuucuuugcucaugagacuuggauggggggaagggguuuguagcagugaucccacacgcuccaugggagguguucuugagaacuuugggucuuuuuuaccucaaacaucugugauucagugaauauauacgaagcacaaucagaaucuaauuuaggccggggguagaggcauuagucaugcugguguggcgucucacaguugcagcagcgagcaugcaaacauuguucaaauagagcuaauuauccgucuauuucuugagguuuuuuugcacuccccaaggguucacgcucuauauuuuaucaucaaaucaccaagagacgagaguuugucagggcaggauaccauaccaaaccucuccugggacguacguccucugcacagagcaguucucccaggguuguucccgccuuucuucacauacuuauuuuuugacuucagcuuucucucccacacgcagcuuccccuucucuucucccacagggacaacaugacauuagcccacuggaaggugggaucggagccacaacauccuuacgccagaaagcaucauagaggugggugccuacuggucuauccagaaugacccugggguugaaccuguggcuucaugcgugcuuagcaaaugcucuacauugagccacagucucagcccgaggaugcucucagugcuacuauacaggcuaagaacagccuaccgugaccaucccuaccgucucucucuaugguuucuuucaaaaaugcagguagcacucugcuucugcugaaaguacaccaugucuuccuguucuuauuaccccccacuccuucccagcaugcuuugagaaauguuagggacucuguugcccucagcacucagugaggauggacuacaugagguggacucuuccauggggaagagucucaccaagucuggaccaacuggacuuuaugucaaaguccuaucaaguguccuugucucagacucaagccgggcaaugucuaugaucuugagagcuggugggacagucaaucucugugcuccucucagacacacauucgauucugucaucccgucccuugcacagccaggccaugcacuucccugcagugaacacuaagccauguuuauuuccacagcugagucagacgaguaaauuaacaacucaccaacaaaugauagugggggagcacugggaggcagcucugaccaucacuguacaaagagggcugagcccuuuccucugccuacuacucucugccuacacugugcacacgucauucauuggcagcuuugccucagggcaggaggggggccggggugggguggggagggugggagggagguggggucaggacggggaugggggcggggucuguagaaguccaacggggcuucugacuucccuggugucuguugugaagcuaacaggcagccucugcacgaaggagcagugagcuuagggugcagauuccuucagcacuagccucagacaaauuuccugcgugugagagcuuugugagacuacagggucuucacguggaggucagagcugcuccucugaguggcugaggcuuucaaaugguuacuauggguuacuuugggaaacuaaaaguuucuguaugauacgaaguuagauguuuuguccucuuuugaaaugagugacugguauuagaaaaguccccaaggaagaaagggagaccagaccacucagcccccaacuggcuuugaacuuguggcagucauccugccucagccuucccagagcugggaugacaggugucuugcuucucucuucucuucucucugucuuugccucugucucacucucccuuccucccucucucccucuucuuuccccucccccuucucugagacaggguuucucuguguauccugcccccccccccccauguucuagaccuaggucuguagaccaggcugaccucaaacucacagagaucugccugccuuugcuucccaagugcugggauuaaaggugugcacacuagcacaucguucuguucuuuuuuuuuuuuuuuuuuuuuuuuuuuuuuuuuuaauuuuaaaaacagaaugccuuagaguguuuuucuuuucuuuugugauuugggaagaccuggauguuguuaccuuucugucuuuucuguggccuuaauguuuuaaacacgaaugcuggaugggaggaagggaguggcuccugggcacugagaccugcagugagggcugcacuguuugucucaggguaccaggacccagcagggaacaggugcugucacagaggaccugagggcauuccaucaaucuucccuccaucccucucuuccuucuugcuuucuaccuccuuccucucucucuucucuucucuccucccucccucucuucucuucucuccucccucccucccucccucccucccucccucccucccucccucccucccucccucccucccuuccuuccuuccucucuucuuuuccuccagggauggaacccagggcccuaagcaggcagaugcuccuaccguggagccacaccgucacccugaccgagcacacaugauccaguguauuugcugcaggaucauucugccugccucugcuguugugucacccccacuaugcacaaugcaaggagaauuguucuccccagagcuggacacuguaaggccaacauagaaaaccauauuguagcaggacuuaauuacacauuaaguauauucauuauauuaauacacuaauuaccaugaguaaugugagggcaauuuuacuguuguacagaugggaggagucccacagccucugccuggcccuauuguagcacuugcuucgggagucaguacugugugaccacucugagaccacuaugcuuagagaugaugcugagagagccaggugguggugcugccuacuaaggacugaggcugguccaguccagucaccucacauuucccaggcuagcccuuagauguaggcuuuacagugccauccagcaugaaguacauggaggaaccucaaggccuaggcagaccauaagcugagcaucuacaacuguccaagcuggcccaaauagagaccccagauauggugggcaaagagcagaaccucagaauuauggacuccacaaacagcaaaggaaggcuggcugaacccucccuggcucaggcagugugugaagcagaucccucagucucugagcugugguggacagugcuugguaugggagcccaauccugaauucaccauaucaggggcuaccaugaaguugaggucugggguccaacucugucaaaggucacaguuauuccuuucuaugucuugaaccuuggaagucagcauggccaggcucaucuuguguaauugccaccugugggcauaaacuggaauucuuuuagguuuguauuaguuaccucugaacccuaaaaaugcuauguagucaugaccuaggcuccuccugcaucuuuguggcuuaauagaagacagucuccugggacuaaggacguagcucaaugauagaaugcuuagccagcacuuucaaggcuuuagguuuaaccuccagguuaccgguccaccauaaaucucuagggacacaugacaaguggcuuugaauguuuucuacauuacacaguccagcgaaggacaguaacaugcaugugcguuguguauuugguguggccauggggguaauuauuggaaggugcuuacucugacccucaguuuucuuaucaugcauagcuaucuaucuuaauggaucauucugagacucacuaacaauauugagcucaauggcaguaagauccaacauguauucuuuacugugugccacgcggcaugaaaagugcguuaucauuuaggauaaaggcagggagucccaauuccgugggggauaaaaauggggugcauauaaaaaaaucacacuuucacuuucuuuuucucuuucguaagggcacccauauguagauaagaaacuuaaggagccaucauaucucaaguaugaagucuaacaguacccagaaaaugcacauuuuuauuucucuuuugcaaacuggggguguggagguaacugguauccacuguggguucuuccaggcagcuuagcaucauuggaugcuuacugggcuugugguggccaugccccugcucccuggccugggucuaaccuguagugcccauaaagugcucauccaaugacggaggggccaaagguuccaccgagcuucaaaggaggaucgcagagaaacaaagaaauguuucucccugcuguccugcaucccaguccugaggcugaucuggcacauccuuccuuuugauuguaggaaaacuguagcauagacuguaggcaaucucccuccaccccaacuccccccagaacaaguccugguacccagggaauggaacauguaagaauucuccacuuaguuuaaaaauguuaggcucaaggguucgaugacauugagccuaggaguauucauuacaaugcauaaaaauuucaugaacaucucauauagcacacagugccauguaguggaauacuggguagccauuuaagaugaaaacuggggaugggggcacagggguaggagcuggagagauggcucagcaguuaagagcacuggcugcucuuccagagguccugagcucaauucucagaaaccacaugguggcuuacagccaucugugacauaaucugauacccccuuguuuaugcagguguacaugcagauagagcaugcauauaacauaaaauaaacaaauaaauccuuuuuuuuuaaagaugacaacugaaucacugacaagaacagguguguaacagcugggccuccuggugcacaccuguaaucccuugaguauucaggaaacagaggcauaaagguccuaaauucuaggacagccuggguuauauggugggaucauauccuaaagaguauguagaaacauaugcauagaaaacagguauaccuugaaacauuaauacuagcuauuauggcuguuaagcuugucgaagucucucucugucucucucugucucucucugucucucucucucucuuccccucccucccucccucccuccuccuuucccccuccuccucuccaucuguaaaugccaaggaucauacuugcacugccuugcaccugcuaggcagguguucuaucacugagcuacacccccacgguagaugacuuuucuuaaaacuuccuuuuguguucugaacuucauuuaaaugaagaugaauaauuuuuccaauuguaacauuuuucuauuuugauguucaaacucauccuauucaucccucaugcuucccccugggguucgaggccuccuccuccuccuccuuuggcugagaucacugagagugauuucccagcaugauccaggacuugcaugcaggugcucgucuggcucagcuccauguaccagcaggcuggccaucucuuuggucaugaaucuugcuuagacgcuuugguuuucgcauuggauuucaauucucacaucugcucggccgaauuugaaaauacccgguacuuacuguaaucugaagccucccaagacucuccuccaaguacaaaaauaaagagucaaaucaucuauggucuaacuucugucaagccccacugagaaaaugucgcucuguggauuuucaccuuggacacucuguccguccacucucauggccaugcaggauuggagcauagcaccaacucugaucaccaugaacuugggcuguacugcauuaucuacccccagccccauuaucauuaccaucuagaucuacaucuaugucuaaaucuucuaagcaacugccacagaaguguauagugucccagagacuaggcucuggacuagcaguucucaaucugugggcuuuggccccuuuggggaucccauauuagauauccugcauaucagauauuuauauuaugauucauaacagcaguaaaauuagaguuaugaaguaacaagauaauuuuaugguugggggucaggacaacgugaggagcuguaucaaagaguugcagcaucaggaaggcugggaaccccugcucuggaccgucuauggacucucuaacccucacaaugucuuacacaggccaaauuaucaccuccuuuccaucugugaggaacucaggaucagcaacacugauaagguuggucaaguuuacacagaucuaccgaggggcaacaucacauucaagucaagagugauuucacauuuauugcccccccccaagauaccguauuggggaacaucauuguauagaugcucauggagaaugggugcacaaugucacuucauggggaccagggggaaggacauccuuucugacucacugaggauuugcuuucuguggggaugguguauacagugcuuucagagaaauccugccauuuaccuugaccuccacaaguucagaggccuauuuguuacuuggucuugauaaccacacagagcucugugcugucaacaggcacuagaacuuugagauucuagaacucuggucuggacucuagucuguauuuucccucguucacauuuguguguccccauacauucaggccuauguaucuacuaaugguagcgcccugaaucuuguauagaaugcagcaaggccgcgugaccauacaaucauuucaacauuuaucaaagggguuuaacuuugcuuaacccauuccugauaacaugauuauaagaauguguuggauacggcauccauaccauuagguaagugugacaagaagggaagugagcuguggugggaagggccccuaggcaugcaggggagccaugcuuuaagagaagaugauucuggucuguccagccagaggccucauugccaugacugggaucaugaaaaauguauugguuccauagcauuggaagcuacagcccuagaccuggcuauuccuuaacagguguucagaucugacauucaggacugugccaucaccugggaggcgggagcaaagaauuguuacuaauuaauuaauauuuaauuaauaagacauuauuauuaguuaccguccugauuagccucaggucagcugucagugugcuccaaugguggaccaugcgcaaagcccuuagauuuucugcaucugcuacacacagcagggaugacaucuuaaccaugcucagcagugucgcucaagagacagacugagaagagggugugaaggcacagugguuaacagcucuuguuguugcaaaggacacagguuugauucccuagcacccauguggaggcucacuaccuccucagucacgaggcauguauguggugcacagaccuacaugugggcaaaacacucauggacguaaaauaauaaaaaugaaucuagaagaagaggaagaaggaggagggugaggaggaggagggugaggaggaggaggagggugaggaggaguaggaguaggaguaggaguaggaguaggagugguuuuuuuuuugguuuccuuccaucuuaggagcucuaggauucucuggggagaagcugaugucaguccuccacccaguuaguuagcaauauaaucacugaguaaaagacaaggggucccagaaggacgugaacaauugaagacacacuaaacaggaacacauuauucaaaggccagauggaggacugcaaugacucuccaguuagugcuucgagagguaaugaccaaggguuguugucaucuuagaaaauauuauuauuucagccuggaggcgcaggccuucaauucuagaucaucaaagagguugaggcagaaggauugcaacuuuaaggccugccugggcuacagagugaguucaacgccaguguaggcaaccagugaggucucaauuuuaaggccugaauuaauaaauaaaaagugcuggggugcagcucaguaauggagaccuugccuaauaugcucgagucccuaacaucaauuccuaauacugugaaaaguuuuuuguuuugucaugguuugaauaugcuuggcugauggagugggcacuauuagguguggccuuguuggaguaggugugucacugugggcauaggcuuuaagacccucauccuagcugccuggaagucagucuuucacuagaagccuucagaugaagauguagaacucucagcucugccugcaccaugccugccuggaugcugccaugcucucgcccugauauuaaugggcugaaccuguggaccuauaagccagccccaauuaaauguuguccuuaugagaguugccuuggucauggugucuguucacagcagucaaacccuaaccaaaaugcauuucaauaaucaccuccuuaaaacuauucccaacggccaagcauuuuacccagucugcaucccuuucucgucugcguuuuguacuuggugaauuacuguuccucuuuggagacaccuuccagacucgagcuccucaaagcucucuucgagucuccuuuccugucccccccaggcuaagucaagguuucuuucuuguagucccucaccucuugggcauaacuuugcucuuguauggcauuugccaggauuuucccuguguagcucugauucccuaguugacugggagccuugaggggugcuuguccccuucaacuuugcaagucuaggggcuuaguauaugguugguacccgacaggugauggauuaaauguagaaggaagcugugguaggccccuagguuaagggcucuguaccuuaggaucaagaugggucacccugucguuuuaucucuuuuccccaccagaaaggccugaugggaaaaugcugagccaauggcaucaacaugauggccucaggauggaggaaagggucuuuugucuggguugucaguauggccuccacacagaggccaugcuucucucugucuccauuuuguuugaauucuuguguucuaaaagcugggauaagcuuccucuauaacuugcuucacccacguccagaggcaaaaauaacuugagaauauucugggcauauucacagauucuauugacaucucuuuagcuuuaccuacagcuaauuuucccaaggaccuccuaggaaccacccaaauaguuuacagaaauacacauugccuaaucaugaccuucagcauuuggaaacaggaggaccuccccugccaagauguuuauccggaccagaacugacauacuggcuggccaacaugcagauuccuccucugcagcuaauuuaugcugagagaggagggagguuacguuuccuaauuauaauaggagaacauguagacaaagucggagauacagagaacccagaacaaaauuaaguucaccuguaaaauuccacugcugggcuauagcugcugcgguauuuuguugaguuuucuucuuguguuuguauacacauucauguacuuuauaaacuauaugaauguuuauuuacauaugugaauuuagauaucaagucuggauaauauuuuaugugcauuuuuauaaguugcuuuucaugcuauaucaugagcagcuuucacaugccauuauacguucuucaaagacaauacuuuggaagguggcagagcagcccacugcaucuauuaagguuuaaugucaugccucacccugaggauagaaggcuuggcauacucgcuaacacaugacuugcuuccugguaaaagaccagguuuccuuuccuuuccuuuccuuuccuuuccuuuccuuuccuuuccuuuccuuuccuuuccuuuccuuuccuuuccuuuccuuuccuuuccuuuccuuccuuccuuccucucucccccccccucucucucuuucuuucuuucuuucuuucuuucuuucuuucuuucuuucuuucuuucuuucuuucuuucuuuccucuuccuuucuuuucuuccccgagacaggguuucucuuuguagcccuggcuguccuggaacuuacucugaagaccagguugaccuugaacucagaaauccgccugccucugccucccaaguguugggauuaaaggcaugcgccaccacugcccagcaagaucagguuuucuauggagaccucacauaauggcauggggucagcuuguggauucaccuucuaagguuucugaccaaguauggccucucacacccacccuguggggacaggaccacuaggagaauguaagaccccccgaggaauuuggcaagagaaugggggagagacuuuccagauuucaucuucaucaucuccuucaacagcugauguguguaguggaagcuacaguaaacucuuaacuggcucaugaagccuugggaaugggacuuucaccaaauucaagacaaacuuaagaggcuugcuguggggaaagucuuucucaaaugaaugugcccauuuccuugacugaguaaacucaguacugccauccaucuguauuuggacugaacugaggaugcucaagugucuuauguaaaauggggugguauguguacaucaccugcaaacaccuuccuauaugcucuaugccaccucgagaugacuugaaauacugagcaaauguauauucuauccaaaugccugacugcacaacacugccuaggggauaaugacaagaacaauaagcugguacauguugaguauagagucgagccuuuucagagcacuuuugacuuguggcugguuaaauccauggauacagagcuggaggaauggcaggcugcuuauggccgaugcccaccuaaugccucaggcucauccuucggaacugaaugaaugcguugucaugccuccaaacuuaccacacguucucacaaaguaaauauucagcuucuaaccaagucuccucugggagaccccauccugcugggcgcugggacaaccucaugaugacagggauauaauuuuaguguaauuauuuguuuauaacccagcuagaucuacagugcuuagagagcagagaccuguauguggcucacggcaggcacacaauaaauauaggugugcauuuguacgagguuuuacuuuuucucucacacguggaacuaagggacacuaaaguaugcugaaaaccaagaccugagacaucaauccuaaccgggggccgauggcaagaacgucguaucacagccgucccccuguucuccuuagcagcuaugacuuaaugaaaacaugcguuguaaaguagguauguggugccucacugaauccugacauuagucucaggacacgggcacugcuacucucucuguuauaaacaaggaaaacagggaucagugguauucuugcucaaauuaugaagcuagggaccaaccuuggacucaaaacuaugcugacugcaaagcccacaccccuaaaugugauuguuaguuauuuuggaaggaugccuaaauaaaaugagcuauuagugauucuggaugggccggaaaaacugcauccugaugucuuggaauuguguggacucuucuccugugucuacacgaugggaagcauuuacauagcacugacacugugugcugauauaaagggcgcgugauacuguauauguaaauagcauauguaaguacuauuuuguuuuaugagugucaguggcuuugugaacccacacaggcuuuagaacgagccuuucucagguauggauggaugacugcacggauauaaaugccgugaagcaaucugcaaaaaaaaaaaaaaaaaaaaaaaauccaaaaugccuauuuucuaacuguccgaaugugagauuaauuuaauauaccacccauuacaaaaaggacgggagaaaaucauauuaaucucuggguauccacccaccauuggcucauggcuugguugauuuucagggauguauaaaggaaccacagugcugugguuuuguuuuguuuuguuuuguuuuaugggaagcaccggugugacaggacugcagggcuuguaaugcuacuuaaaaaaaaaauucaaucgaggacauuugcuaugugucucagcuuuuggcccagugucaacuggccgcauagaacagggucuccuaaaugaaggcggugacuccacccugucuguguaagaggagccagaagaaacauuacagugucaucuuagcagcugucugcguguucaugucuucaucuauugccauuuauuuucacagcaccagagucaaguagacucaagucgcuuucaguuagaagaaaugagaaacagaacaagaagagugccuccauccauaaauaauauuaguucuguugucaguggacaacucacaaaggaucaggguuucucuguagauuucucacuuuguaguggcuguggaagcuucccgcagccccuuccccaggaauccugacuccacggagaccaucucacacucuaggaaagggcuuaggaaauguaguuucauuaaauggcugggaaaaucaggaagugaauucaucacgcuccaagucacguguugacacagguccgcgucaucugcggugagagcggaggaaguccccaguguuuggccuuacaacacagcccuggccuuuucuacgcaucccuggugcacccgauuccuggucacagucuggaugacugcaguaugcuagcuccccuuggcaucuacugauggcggaguaguagugcacgccgcuacacagucagcugaccguguuuucugaauacuguuauuuauguuccuuuugguuuagauccuuucaggguucacaucuggccacaaaaaucucagggaagagggagcucugucucccacgugggcugauuuccagcaccaggguugcgacauuuccuacauguucacaagccaaucucagcccuaccacauuuugaacauagaagagcauagaacugcagaauuacaagaaagugaagaauuaagcauaaaugaauauaccagagcaugcagacauguucuuuauagggaacuaagaauuagcaagggucugucuaggucagugguucucaaccuuccuaaggcuuugacccuuuaauacaguuccucauguuguggugacucccaaccauaaaauuaucuuuguugcuacuucauaacuauaauuuuauuacugcuauaaguuguaauguaaauaucuaauaugcaggagauaugauauuugaucccugugaaaggguuguuagaaaaaaccaaacaaacaaaaacaaaacaaaacaaaacaaaaaaagaaaggguuguuagaccccccccaggggggucaaaacccagacugagaaccuguuggucuagcagagaagguaaagcuuuuuaauguucguguucucugucucucucucucucucucucucucucucucucucucucucucucucucucucucggguugaauauauagcucagugguagagugucuacuuugcauauacagggaucugaguucaaugccuggucuggaaaaaaggaaguauuuuaacauuuaaaacuacugaaugaaguucuucccagauucuuaaagcacaucugauacaccccuagggcaugaauguaucaacguauuuccaaucuaauuuacccauaccaacucacuacugagugaaccagagagggcaagucuccacauucccgugguuguauguauugccuaugcccuggagcauucucaggaagaugaccacgguuuggggguugggggugggguggggggaggucauggccacaaucucagaauacccuaucacucauggagguuaugagauaaggaauaaagcuaagcauauuuguaagucucagacuucuucucuuuccuagcauagcccuuucauaacuccuccuuccaugaugucacuacucagcuauagccugggaaaccccaucuagagauugagacguguuccaggucuagucagucauugagacgaacagaaaucagauuccacaagacuguggacacagacucuaaaacacagggugggcuuggugcugcugacccacaggaacaaacuaacuuaaaauggcagucuauggugauuaaucuuugcugccaacgcaacugaauuuagaaccauggaaggagacacaucucgguugagucuaugagggugcuucuggauagcuuuaacugaggagggaacacucacccugaacguggaucauaccauucaauagacugggaucucagacaauauaaaagagagaaaaggggggcggggaggaugucagcuaagaacagcacccacugcuuugugacuuuuuuuauggcagaugcaaugaguccagcauuuuuugaugccacauuuucucugccacaacacacugugagcagaggugaacccuucauucccuaagcuguuuauuuuaaagcaacugaucuauaacccucauugguuuuccucuauucuuuuuauuuucacauccaugucauuggaaagugaaaauauuaaggauaaacuuaguguugauauggauaacagaaagaggcugggcgauuacccaacauaacacucuccaaaccacacgugccacagaggugaaguacucuccagaaguagccuccaggaccaggugagccugggagacagcacaccccacuccuuccuccaaccugcgugcauccggugugccacaguguccccuaggacacaaacuguguucaauucagucugguuuucauaggaaggcuguguguuccccucucaggccacggcauuucuaugggaaacguuccaguuccuacacaucacugaggucuugaaggcagagaaaaccagaugguauguuauaacucuagguaaaagugugcugcccuucaaaggccugcaaggucaaagagcuguaaccuuaaacugggaaacaaaccacccguugggaccaccuagaagguuauauaugcacuugcaguuuuacauaggauuuguuacuuucuuuagucaucuggaguaacccaggggacugccucaagugaauuguaaagccucaagaucccgacugaaauauggaauugcccuacauaaagauacaaagaaaccuuuucuucagcaaagcuguugugucucagaauugcucagggguccaggugaaggcugauggccuuccguacuauuuucgaagucagacaaacuguguucccuuagaggggauuaaaaaggcagauuuguauaaaacgaaaacccuuuggagcagauucaagaacgcccaguucugggugucuacauuaagucaaacauccggaugaaagagaaaaaacucuguagcaguugggccacauguccuccaaauuuaucaagacacauugaucauaaaacuaaacagugauuaucccccgacccccaccuguccuguuucagcgccucauuguggggcaucagggcgccucauuguguggggcaucagggggccucauuguguggggcaucagggggccagauguccacaggugcugguucuaguuugguuuuugguagucuugugaaaggaaaucauauagaaucuuaauaaugcaacccuuuuuugaaagugaugcaucucuugggggaaaggguggagaagccucggacagaaacacgaggugaugaaagcagcugagaggcccugagguuuggggggcugggaugcucuguccaguguuugcuacuucaguuuuuaauuugugucuauuuuuccagaggcagaggggaaauacuguaugaugaauacucgcuggaaaaccgaucucaucauuuagcagaaaaaagcuguuggcugaugucagucagcagggaggaggucggcgaggaaccagccaacgccaaacucccuuauuugugagggguucuacacauacucuugcaauccugaugaaaaaucauggggcauaagucccuguucuccauuuuauucaucaggaaacugggucuccaaaaagucuaagauuggagaauagggagguagcaggccugggcugugaaccagaauaugccuguucuuagagaaagguguaacgugaaaaccaaacuccuugcagaaagaaugaaaucugacuuuuuaaaagaagcaaccaaguuucccaagaauggcuggugacacauacguucucgacaucaacaaugcaacauugcauguccugcaaaucccagacgaaaugacuuuaaucagcgcuuuaagucugugcaaacaauugaauuuagagaugcuuaaggcagccucggggaguuuugcuuugcaguccugaccacacacccguuuuguauuauucuccucgccucuccugaaucagaguagauauuuuaaaagcccacguguauccuuuccaauuuucaaucaucaggaccuacaggacugagugacacacagcaacaucuaaagguuauuaagcguaagccuggcugacacuugcauggugcaaauuugcgacauggcuggacuuggucuguggaauuuguuagagcuggaagaaaugccuucuuguacccaccacacugaaucauccuggauuucccaaaauguguuacacugauuuuuguuuaauucuccaaaucuguuuauuuaaaaaaaauuccagugagcagggaagaaaaauuaaauaaaguggcauuucaaauucuucugauuguaaauuauuuggggcucacagucacaucgguuguauuugcuuaaacuguggaacagccaggauucuaccucagagcuauggucgggcaacuugcaccggcuugaggguaguccuaucuuaagggagcaugugguguuaaauuuuuguuuuaauuuaauuuuguuuucguuuuuggaggcuguuauaacccaguuuucaggcuuacugacaaauucagcuaugucacgccucaaggaaguuguuuuaagacuuacucugacgugaacaugcgggucaaacuuuggggcucccaauugcuauuuguacaguaucuaacuacuagucaauaaagaaaacugauuauagaaguaaauguauuuaucacaucuaauacuuagacauggccacaggagaaauaugcagagauaaugaaggggagcaggaggcuggaagaucuuacuguauuuuuggcaccagaagagggaagggauuucucauacuggaaaagggcaagcagagaguugaauaucaauagcugagaaaucaggaaaguauagguagaguuccgacuugaaggggagacugaccauaugggaaacucaagaaaacuaagucugccaaaaggauuucuuuauggcuugauggguuggauugugaugaccuugaaaauuccauuuggagaucuaaucucuaguaccucggauuaguugguuaaacuauguagacugcaguguuucaucauggcagacugagcaaagugaucuaucuaucuaucuaucuaucuaucuaucuaucuaucuaucuauccauccauccaucuauccacccaucauccauccaaaaaggaugggaacucaccacaucaaaggcaguaaacacgugacaguaguggugguuggacuucaaaucuuuugugauauaggcaaauguugagaggucuucuggguccugggcagcacaggagauauuacgaauuucauguucggcgauuauauucuagaagaaaugacacaaugaucacuguuuuccauugagaaucagcacauuuuagaaucaggacagguaaugugggaacuaguugcuuuucuuuucucuagaagguucuaguccaaagugacucaaugagcugcccauggguaaaugcacaccaggucuggaaggaauacuuucauuuaauauuaauuaauaauaauaacaacaacaacaacaaccuaaaauagucauauccuggaucagcggcucuugccaggugcugugcauggaagcagucuggguggcgguaauuaccaagcauuuucccauuuccgauucccauguccagcuguagaugcacagucuugccuguugcuaauccugucuggcagugaucacuugucaugugugaggagagcugagaccaaaagcaucuguccagauccuucgagguuguguuugucacagggccuuuggcuguguuaagagaagugcucccacaguaagggcggguucggaacaaagcaggaggggaaaccccggugcuauccucucuccucaagguucucaggugacugaaggccagggagacacuacagugggacauucaccuucaccuucauccaucgccuugcugggugcaaggaccuauggauaggagauuucuauccucacuagacccacgacagaauauuggggugugugugugugugugugcgcgcgcgcgcgcgugggugcaugugugugccucaugcagggaaggugugaagccggaggcugaggucugaguuucuuuggagagcugacagucuuuugagcuuacugauuacagugagcuuuuugucuccccuccucucuguuuuaauggagcugcauuucuugugccuucuccuuccuagccucugaaaauaaucggugggaggaacaguuuugugccauuguccugcagcuuagccagagagcaucaucuuuacugcagaacaugcuggaaaucuccuuugauacacagauguauuuaaaaagcccuauuauaauacaaucuuuuuuaaaaaaaucuuauaauuucucacaugccuuuugcaguugucauagauauaaaccucccaaugcuucaguuacccuaauuacuuuuuaauugaguaucuuaaagaacccguuggcaauacaguguuccgcgucuacucaucaaugcuuaaaaacacuuacaaaauguccuucccugccagcacccuuggugaguacuucaugucccucacucuaccaagcucugugguuggaaagcaauuacaggauuaguacauaaaagacaauuacaugaagacauucuucaccguggccuugaaugcugacaccaugugcagcugcucugucaaaaauaacucaaauugaaauuggaaaccauaaacaaguaacauucuacugccagauagcuucaauauacuaagucacgguccucuuccuacacucagguagcauuucuuuaaauggaacacuacauuaggaacccgugagucuuuagaaggaauuuuauggucuguguagccuuuguaggugcuguguuaccaggugcagggagucuuggccaucauuggauugugguuguuggacucuagaaaucugggcugaguggcccccaccugucauuuuaguuagugauggaauccagcuucacucgggauaggcauuucugggcaugcuugugggggauuaucuugauuacugugcauugaagugggaagucuugcccacugugggcagcaccaauccaugggcccacuccuagacuaaaugaaagggagagauggaguugggcauaacacauguugcucucugcuuccuuacuguauacaaugugaccagagccucaugggaucgucccugugaccuuccugcaauggcugauggcaaacugaaccugagccgagauaaacccucucuccaucuugcuucucucuugcauuuugucagaacacagugacaaguagauaaaacaccuacccaggagcuacaaccagcagguaaguacugacucuagcuugaagcugccauuugcagucuugaagaccuuugccagcagaaggggaaugcuacaagcgcccuaugggguuugcugcacucaaucuccuagcucuugacaauucauuuccacaguguugugguucugugcaaaaccacaaagcagagagguuggcucuccagugcuccauccuccucuguccucugaacccuccuaggauuuuucuggaggucuguuacuucuuguccccaagaggccaggucuagcacggagagcccagaguaugccucacauucuuggcuaaugcuguaucacugaaguccgucccaggcucaggguuggcuuuccugcuucuuugagguaucugugaugcuuguaucauacaaacaucaucuuaccucacugcugaaaaugucucagcuaggaggaaaguaaugcuauuaagacagucuauagguaggcaggaauauacucacagaccuuugugauaauauccuugguaaagcauggugaggauuggggugucugacugccucccucacuaucacccacuuuugaggauggagaggccaguucucugugacacggauccaaggacucugcagcugcucuaugacuguauggaggcugcaugaucaacucaauucuucucucuuuagucauguaucaauuucugucuacucaauaaauuaaaaguuauuaugaacgauguuaucaugaaguacugucugcaguuccauguaagaucagacucuugucuguuagcuuucaugucuaagaauguuuguucuaaggaaggcagagcuugccaaaggcucaugagaagagcugggaagggucucaucuacucucauuuagguaggguuugacaacuuuaugccuuucaacuucugccugacugccaccucucaucauguagaaaaagagguacagaugccucuggccugguggguguggaauuaagcuguuugcuccagcuacuuaagaugauaauucaaagaaaggcaugagauuccaaagggguccagccacuuaauaugacaauucaaagaaaggcaugagauuccaaagggaugcagccuaggaaugugccccuccccacacccgucaucuuuacccuagaacagagagcuucucccaaccauuuccuuaggcuagacucuuuugcaucaagggacagaaauguuuccccuagagaaggaccaggaugcaggcagugcucugagaggacaggaaauguccaugaacagguguuccaugcugaagaccacacuguacaccaacucuggucucacaggacucccagcugcuucugagaaguguguacuuugaaaaagaaggagcacuuacugccauguuugaaacuggcauucaaagaaaaaaaaaucacaaacuaaagugaaaaagacucuacuccgauauucuuuuuagugcaaugguagggaaggcugaggagaaaaagcuggggagcguaaggugauccagaccuaugucauuccuggaugucugaacuggggucaccucuuggaagacccugcuaauuucaagaaaggucaauaaacaaauagcuggaguccuuguggccaggucccugcagagggugacucugggcugcugaucuauggaagcagauguaauuucucuaaaacauuuuaggacuaaaucuauuccaaccuucauuucaaaugcaagaucuccuuugcuucuuccuucuuaagccaggcuuagugauuaguuuccuaaguugcuaggcaaugcaucuaugugucuauaacuggucaucuggcccuuccccaugaacucagagcuacuuuauugacuagaaaagacacgcuucauuggagggcucgucuuuugcauucccuaauaggggcuaauaggaaaggaaggguaauuagcauauaauuaauuacccauuguuccuuaaacuaauugggugaagguagcuguggaguaguagaagaaguauuagguuaggcagcagaaaaauccaugguaaacaggcuaugucuuugggcagacauuggucaaaggacauggacauuggggugucuguguggauuagacaacccugcccaucauaccaguggaaggcagaggaacacacgguagagaaucaaguacacuggaagcacacuaaugucuuagcccaggcuccauggccacuagcaccugaaaugaugaauuccuuacauauacuucuaucaacaaguccuucaaaacaacguggcccaccaaggccauaugucccagugggggacaauccaagggauauagaaagcagcaagugaguucaccuuuucucccuucuggcacauucuucaagccuucugaggcuggcccucagccucacucaugcucuucagaucucaguggagccuuagacuugguuuugguuuuuuuuuuuuuuuuucugucucuuugaccaaucucuacuucaguuucucacacagcaacuguaagacuauccccuuaagacacccagucuccuccaacauugucaugcugaagaggagcagugucacacagccaggcgaagucaauguccuccagcucuuuagagagccagguauguguugugguaguuguagacaccuuguuaccacugccaccagacauacugugcuuuuccuccugaacccgaaaguugguuacaggcuacaaugcaaggacuugaaagauauucaagaugucuuuauucagcgucuuuauuuacacaaaauuaucuuuugcacacuuauuuuucugugcugaugcuuucaaggagguuggcaaggagucuacacagucauuggugacugagacagaaguuucucaagaggugcagucaagagguaucgaguuuauagaccuuuaugugucugucagcaaaugguaagcagacccagcuaagcaucccucaauguucugaugguggaggucuggucaaagaggauguaauaaaugcauacucagguggguuauaacacuacugaaugacagacaugacccuuuaggcuauaguaacuuccaaaagcaaagggcucauguucagaaauggucagagagugccaaauccaacauugcucuucacauucuucaaauucaauagggggagggaguugcuuuagauuuuaggguuguguguaugugugugguguugggagaagguccaagugccaaagccuucugugguaguuugaauaugcuuggcccagggaguagcacuccuaggagguguggccuuguuggaggaaauuugucacuguggggaugggcuuugagacccuccuccuaaccacaugggauccaaucuucuccugucugccuuugaaucaagauguagaacuucuggcucuucuagccacaugucugccuggaugcugccaugcucuugccuugauaauaauggauugaaccucugaaccuguaagccagccccaauuaaauguuguccuuauaagaguugcuuuagucaugguaucuguucacagcaauggaaacccuaacuaagauaucuuucuuucacacuggauagacuaaauagcaaugauaccaccaaugaacauuccaaccgaaggacucuucaaacaacucugauuuaaggcuaaggcaauuuuaaguaccagaaacuaaauucuccaagaaauagaaaagccaaucaaggguuguucugauuugagucucugcaacuguaaucugacauaauaacagccaacgacauacugcacagcugagccaucauuagagauaaugcacuuaauaucacuuugauuacugucagucaucaugauaaugcuguguuacaggcuuucuaccucaguucuagaaucuucccccaaacugggaaguuuuuuuauagcauaucugcggggcacuugggcuuauccaauugccaaggcaacauuuuuauagaaaaguaaucaggaaacuuucuaaagggcugguccagaugcuuacgguuacagacauaaaagggucaucgucccugggacgugucccugauguugcaaucuaguugcucuggcucccuguucgccacugcugaaguugacugguuucaugacucuacauuccacuucuuccaaauggagugcgucugggggcaagaccagcgugacugaugcagaaaacaagcacuacuuacaaauggccaucaccucaucucucccuuuaucgacugaaagggcaggagaguaaaacccuccaacagaccuuuagggguuugugagaagccagucagcuuuuaugacugugacaguggccacaccuuaagccuucuagguuaccacuaggauucuguggucuuggcucagaagggaauugcuaagaugaucugaaggcaaacacagcccacuuggccacauuugaccucagagcugccaagcguucccacugugagcgcaaggacacagcauguccucagcugcuuuccugauugaguuuguuaggaaaacaaacaguagcaacucuuuucauuccagucgcuggggaugaaaggcgguuauagaauacgaaaugucagggugugcuccuuacucauaccagguauucacgaccuauaccaaaagaggggacaaccacuuccuagcuuuuuuuuggcuaagaucaaguguaguuuccaaaggcaagaacuuacauauaauacuuauuuauuuuaaagaacaacacaaagaccaaccuccucacccuucaucuauucucaucuauucucauucuucuagugaaggaaugacucugugccuuuaaugagcgauuuguugcuguugucucaguguccucuagcuccaaagggacacgaguguuaaguggucccugucuacuagagaggacaaugugaaauguaagcauaaaacauguaugacaauccuagauuaagaucccaaaugaaccaugccuuucucuguggauauuugcagccauagucaugagcaggaagcaggaaggugggggaggggggagagugacaaaaugggccacgccaggauucuauguucccuacuucaggacuaugucugcaacuuggaccaaggagagguugggcaccuaccuuauuugccgcaucgauaaauuuuacuccuuuauaugagacggaaaggaugauaguggggacuuucuucauuugcucuguagacuucugaaauuaaauuuagaaugcuguuagaacagugugcuguugcguggcaacugaagcacauuggguuuuuuuuccucucgaaagauaaaaaugaacugaugcuaaaacacacacacacacacacacacacacacacacaccccacacuaucagauuuaaauggcugucucucuugccauuagcuaugccuugggcuuauaaaguaucuguugacccuacuacuucuuaugguacaagggcaccguuuucccuugacaucagcaggaggucagugaacucuguccauuuccuugagaagacuuaagccacaucauuugacaccaaugaugccaucggugcauuucaacagcaacaaaauauauggugccgcugauccuuccuccuccacacuuucauucuucaaggcacagggaauguucagauguggacucagaacagggauuuaaaauacaccccugcaauuuuuuccuugauccuggccaaauuccaggaguggauauaauauucauagccgcaucacacaggaccacacaagacuucauucugcuccauacagcuaagacuuccaggagccgaccuuguucagagucacaggaaaaaaaaaagcuagaccauagacaggccaggcaagugacuucauccucggcuauauuccugcagacugagcccucucuugggacggauguucccucuggcuucacauguggggucggcagcuucugccauuuacgcagcugcacaaggauucuguguaaucuacucugugacuuucuugccuaugucaccagucaccaacagucuugcuuacuccauauuccuccaugcauacccucaacagagacggacuuaccugacaguuagccugauggauuuuccacacaagccaggugggaacagaaugggagagaaaacacaagagcgggugugagcaagaaaaguaaccauuccaauaguucaccgacagcgggaguuaauuuaaaaaguaaagggagcagaaagagagcagguuucacagacggaggcagauuccgugagacuguuacuucagaaacugcggcaagcuuucgauggcccugccucuguuucucuuucucuguuaucucaacuuccgguucacagagcugcagagccuuaggacugacgugcaaggaagguccacucugagccuuagacagccagcugucuacuucagggcacucggggaaagacgggaacuuuuaaaguuaauguaugucacucacuauuccauuaaaaaaaaucugaaaugugaucagaauuaagcaaggcuuuuagugggggugauugaaacucacuggauuuggugguagugacuauugcaucucuugcuugaccccuggaagaggucuuuuacaucguccucauuguccugacacagcaucuuuugugagagcugccguaucuguuccagagaugaaggacuuuacuaagaauauuauuugaaaugcauuguucccaggcaauagagaaagagacucuccugaagugauuuuuaacuaguuuuaaaauuaccuagacuugccaauuuucuuuugcaacugccagaaaacaagucauucuagaaaaauggaagauaacauaauaugcuuucauauucugaauguuuuuccuaaccacuucuggaaaaugugcaggacaaaucaaaggcaaggcuagagaaugaaggcucaugcuguuugcugguguuaaagcaaagcaguggcugaauucaugaauagagaaggcuagggcagaacaggcaaucauucuguugacugaagugagugugaagaacucuuagccaagcaucauaauggauuucagcuagucaucucucucaucucuugccaugaguauuuuuuuuuuuccuggccagaccuauuuguaaccuaaaacaauauauggcuacauuaagaugaaaauaccaguauuuuauuuaguauuaagaaagaccuauuuguuauuuguucaacagucuggggguuauuuugggcaguccacucugcuacucaauggaaaagcucagaguccauuuuagucgugugaaacugggagugaaugucacugcuugaauuggccaccuaagugaucguccugcugagaaggauccaaaugggaaucaggguggggcaagaugccuccugggagggaggaagggcagggcagcauaggagugcauuuccgcucacauagcacauauuccgaguugggcauaaguuauggcuacaaggcugacacaugcagcaauggcgauggggacagaauacuuuuagaauagcaaacacggaaagguuuaccuucaaugaaaggguaaggcagcuauuacuaaaguuauucauucgucaagccugauuaccugcacugugcuggcucuggagggauaguuaucugaguggcaaaaagaagauaaaaauaaagugggguuguucuaagagcaaagucagguacaccuguaaaugagaacuuuauggugguuuagguaacuguucggaaaggaggguaauguaguagauuuggaaggugggacuucccgguuaagaucagacccaucagaugcuguuaaguagggagugaugugagaaagguguacugaagacggaggguaagugagggaccuaagaagcugcuguaaaauccgaagggcagacuauauggauugcaggguggauacggggaaggagccccacaaccaagggugaagagucgagaggcccucugugacgucacagcaaaugcaggagcgugagggugucacagaugaagcagccauuaccagagacagcaaugcaagagggagcauguuuuugcaaggacacagagaugccuuuacacagucagcuugguaaccaggaagaaacgagagacaaaacucaaauguuggaagugugacuauauggggguagaagcagauggggugucuuagggugugguaaggguuaaaaaggaccaugcccucaggggaauaugaaucacaacacccucccuuuuuaggacaggguuucacuguacaguccaggcuggcuuuaaccuaguuauccuccugccuuggccuucugagugcuaaguauacagauauaaggcuaccacaucugauuggaagauacauuccuuuuuugagacaggucucacuaugcagcccugacucaccuggaacucagagauuaccugccucucccccgccccccaggugcugggacuaaaagcaugcaacacccugccaggcaaaagaugaaaaauuuuuugaccagguuucucuguguaacccuggcuacccuggaacucuuucuuuguagaccaggcuggccucaaacucagaaaucuaccugcuucugucucucaagugcugggauuaaaggucugcgccaccacugccuggcuagauuauuagucuuuuauuaucacaagagaaacgguauuuggauaaguagagaugcugcguuucugaaaucuguaguuaguucuuaguuuagauggcccuguuccaccaagcagagcugagucauaauuucauaucuggaacacuucuccuaagaaguaauugagcacugucagauuuuuuuuaaaggggaguuuaagauuuaucaagaaaaagaaauaaugaucuuuucccuuuccuguuuguguggguguguguuccuauaugcauauguguuccugugugcaccuguacacgcauagagaccagaaaacaacuucauggcugucauuuugagagguccauucagacaggaucucucacuggccuagaacaagaugaucagucuagccuaccuggcuaguuagugaaccccagggauccccagggaucaacauaggugcaguacuuacugcaaauauuuccacugguggauacaaaacacguacccauggagacagccuaccagcugucccacuuccaucucugucucugucucaucgguguagcucaggcuagcccugagcuccugauccucccucagccuucugagccuugcgguuagaagucauaucucauuuuuuuaguucaggcacauuccuucugagugcauggacccacugagcucagagcaugcuuuuccugggugugaaugagugcagagaggcuuauggggugggguggaggcauuccgcuguuugacaucaggcuaggcgagaguaaggcuuguguuuaaucauuugugcaucagcagugcagaaggagggaaaagaagaguaagacagacucaguaagccuuccuccccuccuucuuuuccuuuuuucccuuccuuccuuucauguguauguguguguguaugguauguguguauaugcauauguuuguauguaugcaugcaugcaugugguauuuguuuauguguauguuuuuguggguauauguguuuguguguaugugucuguauauauguguguauauauauauguguguguguuuguguguauguaugcguauguauaugcauaugugguauguguguuuguguauauguguguguaugguauguguguauauguggauauguauguaugcaugaauguauguauguaugugguauauguauguguguguauauuuuguguguauguuuguaugugugcauguauuuauguauaugugugcauauaugguauguguauauguguuuguguguguaugauaugcagguguacucauccauuuguacauggguggaggccaaauauuagcaccaggugucuuacucugcuguuuuucucuauuauuuggagacaggucucucacagaaccuagagcucacuguuuugguuugauuaacugacagugagcuugcacacucugucugcaucugccucuccagugcugggguaugugccugguaugugcugggguaugugcugggguaugugccugguaugugcugggguaugugccugguaugugcugggguaugugccugguaugugcugggguaugugccugguaugugcugggguaugugccugguaugugccuggucuuuauguggaugcuggagacccagacucaggcccucaugcuugggcagcaagcccuuugcccacugagccaucuccccagcccucagccuucuuucuuacaguacccugguuacucacagcauaucugaagcacaggcuggggaagagauuuccauggcuacccugagaauacuuucuaauuagacuuucaguccuggaucauaacuauuuugccaucuaauauucucuguaguuaguugcaaagccuaaugaugauauucaguuucccagguauauguaaauaagcuuuaacaguacuauuuugaggccuucagugacuuucaaaaugguugaaaacuauaggagguagaaucaggcuuuaugcagcaaaacuagcuaggcuauggggagaguaagguauggaaggcagaccuuggaauacuuauucaaaaauaacccucgcccuguaaaacuuagugccaagauuguuuucugaggcaagacuuuuugggccuccaaugcugacacauuuguuucuccaccugugucaaugcuuggaauuucauggggucuuucugcuucccuggaagagucuagaggaccacccacagcugucuugacuccuuccucuauaaccauugguagacagccucguguuuaacccuaaggaguuuuuuuaaggucagaaguagaugauauagucauuucauaggguacucuccuggcugcugaagccaaaggcugaucacagcagagggcuggggguguagagaaccuuuacgagagccgugguaccccaagccagaggagaugugaugugagguuaucaagaggcuccugggguaguucuuuggugauaggugauuuuauagccucaaggaggagggcuagguuugcauuucugcaacuucacccugguucccgucauugguaccaggaaagguaggaaggaacucuuaggagguuagaaugauuccugguggcagcugggaccccccccccccuauuucuuuaaaaaauaguuuaggccuucaagugucacuaaugagugccucguuuggcugagaaauguggccacuuuuguggccucaagaacucugccccaaaggccgagggaacagagagcacuaaccaagacuaugugacuugaauagagugagcaguggccauuccaaacacaucuccucgcuuggagugugaacugcugaagaacucagaaauaaaguccugcccaaauuuagcauggcccaaagugaugcccuuaacucuguccuaggccuggccaauuuccaggcacagugacauaaggcaucuauccagaacagcugacuuacacaggauccucaguggaaugcccuggggaccaaggcaguggcuuuccaccuacggaguguaucucaagucugugaugguaucaugaauccagcaaaugacugauuacggggacccacucccagaggcucggcaaagugggcuggggcccgcacacacauuugcaauucuaacaaauuuccagaugcugcugacgcugcagguuuggggcccacacuuuguaagugcgacugcaguugaucaguuugauugagagucacugucagcgcuguucucugacgcugugcacguaaacccagcugcgcggcacccugcguucauuccgaggagcuaguuuaucaacucgaguuugacaagugauuuccaaaaaaaaaaaaaaaaaaaaaaaaaaaaaaagucugccauuagcauuuugcuacagcucuuggucuugagagcaauuagcaaggauuauuuaauccuuucaugguuuccagagggcuguaagagcugaaaacauucuucacaugaaauaaagaguccuaaagagauaccagaguuacaggcagaauagauagauguagguaaagacuagacggcauacugaagaugcuuggcuucuccugagguccccagugacagggaggggcacgucaaagacagcaagcaccggaggcugaaagccaccaguggucacggucccucacggcuugugaguuuuuagaaggcaguuuggcacuaguucugaaaaauuuugaaauggguaugcccuuugccauuuaguggcuuauucuagggacauaaucagggcuugccaaagaaccugcuuauaagguuuuuuuuuguuuuguuuuguuuuuuuuuuuuaaauuggaacuggacacaauagcccagggaacuggcugcaagauuguuuuaacucuggauuggaauauuauaaucaaccaccagaaauaguacugaggaugaagaguuacugaaauacuuaaaaaaaaaaguuucccaaauauaaccgugguuuaaaauagaccguaacacaacagguacagaacauucccagguuuuagagaaggagcaaugcccaggagggccuaaggaacgacucugagggagcacgcgugaacaaggugucagcaggaagaugcuuaccaccucuaggugguaaaauuaguucuuuucaucucuuccuucugcucucuguuuuggaagcagguaaugaagaauuauuuugcaauucugugcaauuaaaaaaauaaggcuuaaacauuuacgauuuuuuaagcuuaagccaauuuauugagucuucauacaugcguguguguguguguguguguguguguguguguguguguguggggggggguauucauggucagagggcaacuuggcuauccuuccucagaugccgucuaccuuucuuuggguuuuuugaguuuuuauuuuuugugcaugugguauauauguauauacauguacacacagcaguuaucuuacucuauugcuugacauuuaauuauuauuuuuucuuuuuuuagauaagaccucgcagugauggguuaaacuggcugucaccauagcccuguauugagucuuuaaaucuauuacuuguaaaaacaacuucagcaguguguauauauguguguguguguaugcguguguauguguguuugaauguguauacaugaguauauucgugugaguguguauguaugguauguguguguguguguguguguguguguauguguccaucugaauuuucugauccacugaagugauccuuuuuaugcaaggcuucccaguacagagcacaagagcccaggaagacagccggcugcaguggcacaugccuguagucucugcuaacaggaggcugacguaggagaucugagaguuggagccuagcuugaacuucacaguaagaucauguuucaacaacaaccaaaccaaucccaaaacaccuccuaaaaauggcauaggaggauacacuuggacuccuacggccgugucucccuagcuuuguggcuagcuacccucucuacucagcuacuucaauucuaaaauggcuauugcaacauccucuuuguacaguuaugaggauuacaccagauaaguccguguuuaacguguaguaaacacugguggauuucagccagugccaguauauucggaagaucuuagaaugugcccuucccccagcacaccaggcugcuaugcugauauucugacaguagugaaaugguuaaacaaugaacauuaaacauaacaauacauuugggucaaagagaacuuaaauuuauuugagacagagccuugaacuugcuacauagcucaggguagcuuugaauguuugcuccucccaagugcuggugcuggcccuauguggccaaugauguucaugaaaauaaacauauuuagaaagagacuuuaagacgaguggcgauuaaggcuaaauaaauaaauaaauaaauaaaccucugccaucuuucagugacuggaaaguggcucauuggugguugucaguuaugugguaggcucagucuucccaauaaaaagcccagggggccucagaagaagguggggaccugauuccacgauuccccccgccaccccccacccucccgaaggugauggugcauaaagcaaaccucagcugaaaugcugacagcagaucuuagccuuugcuaugcuugucccugcuugcuuccuaacugcagcucucccugcaaacacugcagaugacauucucucucagaaggaucuaugcaaagagcaacgaacuugcuccauagcucaggguggcuuugaacuuuugaaucauagcuucaguuuuaguuccuuuuaaggaaggacacauucuaacuuaaaaaaaaaaaagcccuuucagcuuccuccugguguugcuucuuugaaagcacagcaaagaacaaagacagugguagagcgcagaccaaagcacagacuauuauccagaaaucuacauauuugaaaagucacacguuagagguccuuccagcuugaaaguuuaaaaauuauacaaauuaaggagaacagaccuaaugaggcccauguugaaaguacaaagacuccaaaauuuuaacacucucugagagccugccuauuucugacuuucuuauucucucuuagccucauuaaaaaucaggcacugauaccuucuuguucuccucugccucucugucucucuucuacuucucuaacuccucucuguguuuguauguuuuugucugucuguaugucucucugugucuuucugucucugugugugcuuuuuugugugccugugucucucugugugucugccucugccucugucucgcugucgcucucucuguguuuugucugugugucugucugugucuuuguuucucucuauguauuuuugugugucugugucucucuaucucucccuuucucucucugguguguguguguguguguguguguguguguguguguguguguacagcaugugugcauguugaggcuaggaguuaacguuaugugucuuccucaauugcucucuaccuuuuuuuuuuuggagacagggucucuaacuauaacccauugauucugcuagacugguaggcuggcaagcugagcucugggggaucagucucugccuccauggagcuugugcugcuuuggcuggcauuuucuguggcuacuggggaaaucugccugaacuaaaguucucaugcuuacaaaacaagugcuuuaccaacugagccuauacccuagccuagccuccuuuaaucucccuuuaaagagcaauuuccaagaucacaaacaaacaccugugaauaaugcugauugccaacaaugagauucuagauaguacguuugcagaggguauuacauugaauauaaugcccuacauuuucuaauggcauauuuaaucgaauuagggaaaugauggggaucuguaucuuagugaugauuaaacuccaggcaaaauacagggguggggguacggauaagaccagagaggcaaaauuaaauagaucuucacauuggccagaacuacgucuuagcgcagcgaacauugaaaucuucaaaaugggaguuacacacaacaaaccccaaaucacacaauggccaaaguaauauaauuagagcucuauaaaacucaguccuauguuugaaaaagcaacuuccaacugauuuagggacaacggaaccaaauauacaauuguagagcuacauaugucaucucuuucauuuguuuucuccauuuuagaaauggacuucacaaaguggaaaugaaaguccaggauuccuaaaccuuagaauacucuuauauacuaugggcauagagacccgguacaaugaaagggguaccagccucagagcugcguuagaggaaaaaagaaaaaaagauucuaaagaaaaucuccccaugaauuuuacucaaccauuuggaggaagaagccaguguguuugagaugugauggaggcaggaacugugcauaucuaacaaucacaauaaggcaggugccacagagaagggcacgucacaccaucccugcugucgagggugagggguagcacgggcccucccccgcugccaucucuccagugucaugugaggaagccggaaagaaagcucucuuuuauggggaacccugccugaagggcaucauauuuagcacccuagaccuaacaauuucccuccagggacugauuaggaaauaaagcccguguuucagaacauggauuuagcuaaaccacucacacagaaggcagcacgaaaugacuauguuaagaugaaagagaucucuuuucugacucucccccaugucgguaguacauguuuuuguauuucuaaucuuaagugggaaugucugcaaagcugucagaauacaggaaauguacagccuggcuacuaugaagaagcaaaacuauggcuuaguaccaaagccugucagaugggcuuuuauuaaagaaaaucuaaaaggacaaagcagacauggcaauuuugcucaauaauauauuaucaggguucaaagccaguuccuacugauucuucacuacacacauugagaacaaagagggacauuauccagaguuuucauccaggggaagagauguuguacuuguuuaggaauguuuauauuuuuacagcaucuguacacuuuccaaaucaugggagcaaccaggaagaaaugguagacacauuguugcauauuuauagagcccuagaacucugcuaacaggaaggaugacuuuuaauauauaccacaaacuuuacuuaauacugaacaugaacacuggcccuaauugugacaaauauaucgugccaacacaggaguuucacaagaagagaagcuguaaauucagcagcgguagggggaguguaugugagcacuguaauuuauggaccauuuuucuuucugaaaaucuaaaacagcucugaaaaccagagaacugcaggguagagaaacuaucaugcaugguaaugguagacgcaggccauggucgguuuguccagauauacgggauguacagcagcaagaguuuucacagugucaaugugaguccaucaguuguaacaaagguaccacuuagcuguugauaauggaggagcaugcaaagauguugcuuagugggcuggccagguuaugucaacuugacauaagcuagaguaaucugaaaggagggaaccucaacugggaaaauguguccauaagauccauccauaaggcauucucuuaauuagugauuggugggcaagggcccagcccauugugggugguaccgucccuaggcugguagucuggguucuauaagaaaguaggcugagcaagcuaugacaaguaagccguuaagcagcauccuuccauggccucuguaucaguuccugccuccaggucucugcccuuuugaguuccugcccuggcuuccuucagugauugacuacaauguggaacuaugaaccaaauaaacccucuccuucccagcuugcuuuuugucagauguuucaucauaguaaucauaacucuaauuaagauaaguugguaucagcauagugggguauugcuaugacagaccugaccauguuuugggagaggauuguggaaggaccuuggaacuuugggcuagaaaagccauugaguguugagaguucagugagcuguuuguuuuguagaagcuuggaaggaagauaagaauguugagagcauuguagacaauggaauccuggcuugugaaauuucagaaggaagcaaagacugaggcuuuugugugaagaaucuggucaacugaagaauuggcugugauuaacuaagaagaggccagcaucauugaggugaucugggaauuguuuucugggagucaagaaacaagcuguguucuagagauggucaagggauguaccucaugcuggcagcuggacuugguaguauaugaguuacccagguggugcuaaguuuugaaggugggaaagggggucauggagagcaguugagaggcaccauguggucuucuucaccaggagaagcuacuggugaaaguguagcacaguuauagaagaccacaccauuuuugagaugucaagaucauggguugacuaccaagaauagcaguagcagaggaguggagagauccccagucuagaagacaauccgagugugcugcuguagaagguagagccagaaaagugacgcaagccuuuuggaggagcccagaagauugcgaaugagcucuagauaauugcuaguuacauuuuuggagcuugauuuugcuuugcucagauugugacugugcccugguucuucucccuucaagcaagaaaggguuuauguaaauuuuauuguauaggaguucucaguugagacugaauuuuaagauuuuaaggacagugaaucuugaaauauuugaauuuuaaagacagugggacuuuuaaaauuuggaauaauaacauugugauaauacauaucauauuacauaugauauauuauauauauuauaaugauaauauuaaugugugaucuuggcagugggaagaacaagaaaggaaagguuaugacuuaacaauguguuagugugucaaguugacaaggguucaguugugcuggcuaguuuuaugucaacuuaacacaggguaguguuaucugaaaagagggaaccucaauugagaaaauguauuaauaagguauucucuuaauuagauggggagugcccagcccauuuggauggugccauuccugggcuggguucuauaagaaagcaggcugagcaagccaggugaagcaaaccaguaaacaaccccucuaugccaguaagcaaccccucuauggcaucuguaccagcuuuugccucuugcaucuauuucugcccugcuugauugaguuccugcccuggcuucccucaaugauggacugcaauguggacgugugagccaaauaaacccgcuccuccucaacuuguucuuggucacggucuuacaucacagcaacaguaacccuaacuaagacaguuugggagcgagcauacaagaagcuuuugucucuucuuugaaugucuuucuguaaagcuaagugugcuuuaaaaaaaauccauuaaaaaccaacucuauuaauuaaagacaucuuaagauuguuuggaagagggaaaaaagacaguuuuaccugagcaaacaaagaaauuauuccauacuguauaauaaugugaaucaaacuaccauccaacauguuaauuuaucuugacagguuuuuaacugaaauaauacacacaauuaaacaccaggaaagaaaggaaaacuauuucuauuucagaccuugaggagaccuuagagauggauagauggauggauggguuuaagauauggaaaugaacuagcugugaauaucagauacuccccaugccucugagaaguggaaguuauucagauucugccuaagcaagaaugaauguccuaaagugaguacugugggagaaaaccaacuacuaagcaugcaacaggaacauggcugaaaggucagcuuguguuaauuuccuagagguuaucccauauuccuagagguaccugcacccagaugguuuaaucugaccaaugcagcacuugaggauuccugaagcacuuucuuagagacauaaagggcccaccuuuccagccauuauaaaauucaagacacuagauaccccacagcaaaccugggaugugcccgagccuggaacuugcugggacaaguuauuaaacuuccacuggcauuuguguuccgauauggaagcugaagauagcagugacacagacugaacauuccuggucuaaaaauauaaaaucuaagggcacuuaaaaugcugauacuuucugaaugccaacccaaaggcauucagaaaauucuacaccugacuuugugcaaugggucacaaucaacaaaaaaaaaaaaaaaaaaaaaaaggacaguauacuaaaacacugcauaaaguuaucuuugugcuuugaucacaaggugcaugugaaauuaaaaaaauccauaaauacucauuauguauauguaaagcuaugggaagaauuguaauucaaguuacuuccagacccacgcaucuuaaauaagggcagugccuacuucuugggauaaaugaaacgcuaugcaauucucuugggccaggcaugcaagugcugaguguucucagccccuaaugaacugacuucaggagaacacaacugucuucucagggucauuuaucaggaugcuggaggcugguggcaguuuaaagacacaucuuaggugaugcuaguccaggagagucacgugcuuguacguugcucccuuccagggaacggucagugcagugagaguaaaagccagaucucuggcaucucgguuaguaaacgguguuuaugaaaacacuucucuaagucgguacagacggacucacuucuuacagagaagguuucaguucagcuaaagugcauaguagcaagaggagaacuccuuuuucucaacggaacgguuaaacugaguuagguuucggucugcagugcuuuggccaguacuguuacuguacauugacuuucaagagcacucauguccuaaagucuguccccuggcaagaacucgaucauacuggcacgugaggcuagacagccaucaagguaccagcaaagaaaacaacaucuuuggcuucagacugaaaaugaacuacaguugaaauucacaccaucuuuagccggugaaaguucuaauucacacaauacgacagucucagauaacagcuccaaucugcacuuguagcuuugaagggcuccagccaaugcaacucgggugacuguaucuaagaccugaaauuuauuuaaucgagauagcaaauaagguuuuaugacaauucuaggaagcagugaacuugcaauuuucuuguaaacuaucgaaaauaaacacaaaagggaggcaaaccagaaaaaaaaaaugccccaaaggacagagaaaugguuuuuaaauaggcagauuuuuuuuucuuaaguuucauuuuaggccacagacaaagucuuuaacucgauuauucucuguugagacuuauuaaauuggcuuugcuauugcuaucaggaugugauuuuagauccauucaguuucgagaaauugacugaucuucauucacaucacaaaucugguauaucuuagggaugcuccacgcacauugccgugcuuacgaugacucaaaccccacaguaggugcacucugguaauuuagguaauagcaugaauugagagaugccaaauucauuucuuacacaggcuccuagaaaucucugaaaucaucaugaggcuggaugguuggaaacuuuucucuucuucucauuguucaguggcgaugcaauuuaggucagauauuuucuguucugaauacaggauucccagaauuauaaaaccagguaauucucacaaggucaucagaucucaagucauucuccaaggaugagaacagaggcuuuggagaaccaggggaccccguguuuuuggaggguucaugcucuugagucagacagacuuaaauucaggucuggguuaucaagcuauucucucugugaccuggugucuucauuuuaaguggggauuuuaagugcggcaggacacacuguaaucagucagcauuagcagcuguuguuguagugaauaagaagacgccaaggcaagaaaagcagcgcuaggucaucuaggauuaaaauggguuagugccacaucaagggucagacuacacucaagaucuagcacuuguauaccgauugauuucacggagauauacauauauuugguuccaaauuaacaugaaacacuuuacaucuaucuuuaaaauuguuuuaguucuccagguguggugucccgugccuuuaaucccagcacucaggaggcaggggcagcaggaucucuuugaguuugcagggcagccuggucuauauagcuagcucaggauagccaggacucugcuacacagagaaaccuugucucaaaauaucaaaaguaaaauaaaauaaaauuguuuuagcucaaguaugugcuuuuucauuacuucaguaacagacuauucacucacaugaaauuaaugaugauuaugggggcaaaaauaaaagcuagggcccguucuuuaaguaucugagauuugacuuugacuauuugcuguauggaacaggucuguuagccuuaaauuguuaguauagcuagauauuucaauaauauccacaggcuggcucuggagaaagcaagaaugagagucuuaggagagaaaaaguguaauguauuuugcuuaaaauaaacuugggguccuagcagccaccaaucaugggcauucagaauugcauuucugucaauauccacugcccuccaaugucucacgccacucagagucaaauguucuucuuacauuuaaaaaauuuuuuuugaaaagauuuauuuguuauuuauaucuaaguacacuguagcugucuucagacacaccagaagagggugucagauuucauuaaggaugguuguaaguuaccauguuguugcugggauuugaacucaggaccuucagaggagcagucagugcucuuaacugcuaagccaucucucuagcucccuucuuacauuuuaagaaaaccaagaacucugggaagaaucugcauaaacaaaguuagcuuuacagaauacccucgugguaccucugcuuuugauggguuuuggugcauuagaaaagucuuuacagugagcauucucagacugucaaauuggugcuuaaaaacguuuuccugaaauagacuaaagauuccccugacuccaaucuggagagcgaucaguguuuguacaguuaacuuucauucucuaaaaauaauuaaaagcaacauguaauguggucuaaaauauaucagagagacuuuaucauaaacgauugccagaugaacccaagcauaggcaccaucgaaaccaaaacaccuuuuuauguaacgccgaugugaucaacagaccaacgcaugaagaaaacagggaucugaaaggcggcaauuugcauguacacccaguacuuaguguuucagcuacaaagauaaaacaguuuggcaaacucacccgcaucuuugcacaagcauccuguguugauucugucccccucagcucuuuuaucagcauagaaccuaaauacuaaaacacacacauacaaaaauuggaaugacauauuaaaacaggaggauaaauaugaguaaugauuuaaaaacacacuguaggcaaggcuacuggcuagguuucuuggcugugcguugcugauaacuuaaaauccuuacggaugcagaggauacgaacaaagugagccaugacuucagagagcuaugaauugaucucuguaaaaguuacggcauuuucuaaagaugucaucuuucaaaucauauuuaacugcaaaauggggguaucuaaaaauguuuugccauuuuguuuucuggaggcagcaaugucugcaaaaauaaaucaugccaguaucaguguaauugcagggcugugugcgacagcugaggagugaggcgacaaggcccccguucaggcuuacucugcagcauagguaauuaaaguggggcuguucuuagcagaagaugcaguucuggacauuuaaaaaaauuuuuacagcugugugcccugugcuccauccaucugagaaugugugccauucucauuuuauagggacagagaugacucccuagugcagagugacacaggacaggacagauggaggagaggaaaauguccccagaaucauacgccacuuugugaccgaaucauggauuccugcuauauauuucacacccagucucuagcuucugauugggacaaagaauuauaagcaaaauguccuuugugucuguccucccccccccccauccccacauuuaaaaagaucaauucauuugucuguuuuuuuaaauuucagcuggcucuuuuauuucaccucucuucagcgcccuuagaacaucugaaccaugauaaggauuggggaagagcuuagaagacagugucccacucacaugguggcacuugacucaggcauccuuccugaagaccgggagaguaccggcccauguaaaggaggaaggcuagguugaagaggcuugccuaaggccuugugagaaagccucacaagccaaagucugaacuuuggaggcugccauuucaacaguuuucggacaauuguugaaagaaauccaggguugcaagaugaaccacaagggagggagacagcagagugagguaagcccagccugggaggagauaacuggaaggugucugcauuguuaaggaaaacaucucagccaaauccuuauuuuuuacuuuuuucuuuucuuucuuucuuuuuuuuuucuuuucuuuuuuuuuuuggaaaguuugcccuaaccaaaacaucucuuuuaaagagagucaguuucuagugagguucagccaucuuuuuccucccuguagucaugacaaccaucauccguuccaaagccuacaggacuuauugaauauucaguaauaagcaccuauucccuucacccuggaagaagaaaaagaaagaaaaacaaaacaccaccaaaccaaacuaaaccaauccaaaccaaaccaaaccaaaccaaaccaaaccauaccaguauugcaaucccauccuugagggcaauggagggaaucuugcauuuauauaaaguggcagaccugauguucugaggucggauagcaaacaugccuaucugcugcagguguauucaccucucuuugacguuacuuucugucuauggagcuguggguggaacccagggcacaggaauacuaggcaaucauucuauuuuaaauugugcuuuuaucaagcaggguggcagagguacacuccuguaauccuagcacuggggaggcagaggcagaggcagaggcagguggaucucugaguucagggccagccuguuccacacagugaguucuaggacaaccagggcuacacagaaaauaaauaaguaaauaaaugaacaaguaaauaaguuguguuuuaucacaugguuuuuaaacuacccaccuuuauacagagacauagaucaaaacuuagccuaucgggacuucaagggucccaaaacucauguuaucuagacauuuucaggaagggaaaggaagaaaacccuucagaaaugucagugauggacauuuugguacauuuucaaugaaugcagacuaaccagggaauacauccucugucccaacuugugccccaacaccgagucuaggguaacuuacaaaggcuuuguagucacaugacuggaagaugaguuuuuccggaugaugcugccaguacuggacgggaguugaggcuguggcuucauuaggaggucgcaaggugauggaagguucuccccaguccccugucuggaaaugacauuuguuuuagaggcagcacaagcaguaagcggguucauucuuucuagcuagccuggguuuaccuagcacaccugagcugaaaauacacaaugccuuuggguguauugugugugcauaaauauugauuauuuuguuuucuaugugaguuagugagcauuguguuuuccuaaagcugaguaugaagaagucaaaaugauucuauuuucagaaugaaacccuaggcuaacuaauuuuaaaaacaaaacaugaacauuuuagcaauugauuuaccaauccguaauauuuaauauucuguuacaauggaagaauacccuugaauuuuuuuuuuucaaauugacuggaaauuucaguuugaaaugcuuuugcuuuagaagaauccauacuuucauuaauuucaguucccaaauaggacauuaucauguacucugaaaaaugguauaucuggggaggaagguuuuguagauaagauacuaaacaaaaugcuaaaauaaacauuuacuaaugggugacagcuaauuuccccucaucagaauccagcugcauaggugcagcaucuuugugauggcuuuggauggacuuagcugccuacuucagaaugacagcagcccgcacuugggaaugcaggucugcuuguguaugaacgugggcauguaugugaggcuccugauccacaggcaugucacauaggaugcuauguccuaugacauacauacccacuaaaacugaccuaaaauggggcuuucuauccucuucuuugccacuuucauuuguuuaauacaaaccaaaacucuacccuggcagggcucuucuugacucuaaucucauuuauaugucguagcuggaguguuucuuccucuuuuccuugcuaaggauucugcucucucaaaauuuggcuguuuguucucaaauggacacaacuaagacuaaccuauaaaaagcauccccagagccuuucuauuuugacuugguuguucuucaagaauuaggagaaauuauuuucaucagguguuggaagcauauaagaagaucuuaacaggcucccaaaacaaauaaaguuuggcuggggaacuaaguuucauggaguccuagcuaaaaggccugacacacugugggauuucuggggagaaauuucaaggagucuauauaugcucagauguucguuuuuggagcaaaaggaaguguguagcuuucaccagcucccuugaaaggcuguagaaaucccgaaggcuaagaagcuagggccuccaggaaaggcucagaucugugcgugucugggagaugagggccaguggcaccacacucuguacacuuuagaauucuguuagaugggacagagggaacuaccaaagauagaaagcacgagaaaagggccuugccuuuuggauguuucuaacuggcuuugagaaaaaagaaaaaaaaaaaaaacaaguagaaaaauugugagcccuguagaaaugcaugggccuugucacagcugugcaccuggagcaugucuucuguaugugggucaccuagcaucacaggugagccuugcuagcaucgugcccagccuucagcuccuccugggaacaugugucuaaugagaacaccacaugccuuugcucuguucucagccauugucugcauuuguucuaguugguggcuugcuuguauugacugcuccaccuagucucagaugucuugacacauaucacuuaaaacauagcauaacauuuaagaacuauaacauuaacauuaacacuuuuccccuugacuuuauggcccauuccugauucauuauaaaauuuuaucuuuauaugaauuauuuguaaaaguaauaauggacugcaauuaacuucaagauuaagcuuuucucugauuuuauauuuuugaccuuugcuucucuuucuuucucucucucucucucucucucucucucucucucucucucucaaaugucugacuuauuauuucucuaguuuuauaaagcugguuaugcauugcccuuaaaaacucaugcagaugucaaccugaaugcucugaggaauucauuauuauuuuuaagcugagcauaauaaccuuuuaugacucuggaagcgcugcagcuaugaguucuucaaagcucuccccaaaucuagcaaacaucccucaguuuccccauucgacuucucucccucccguguucccuugagaaagcaacaaugacauagcaaacagguguuguacacuuaagucacaggugaugccguuaacagaacaacaggaguuugcacgcaacucuguggaaugauacaaaaggaagauuugggugacaucgaaacguccgcugaaccagugcugacaugacaacucgaccgagcaacagaacuucacacuggcccuauuguagcuagcugagguauacccuggcagagcuuggcaggcaaaagcuggggaugcugcuguaggggaaggucuggggauagagcuggggcaggagugggugcgguaauacuggggaguggggaugcuccacagguuaguaggucaggcaugcagaucauguacagauucauucucucacugucaacugggucacguacuuucauguuuaaacaugacuaugggucuggagguuuaaagcagagcugcaagccaaaugcugguuaaaacguuuacgucauccagaggcaucguaacggccauuuuuggggaucgcaaacccaagcacccucucucuguugguaaucaccaagaucacuuggucgccguuugaagaaaugcguggcacauuccacguaacuguuuagacagcgccaucaacugcucuccuaugucuccauuugguccaaaagucacaaaccaccugcuuugaauccggagugauuugauagcaccucugcuagaaguuacgggggaagauaauuauaggggaggggaauauaaucuuuacuuuauuuucauuguacucuugaaauguugcuccaguccaaauauuuuaaaauucaccacaggaauugaaucgaccuuucuggaaacagacucugaguuuugucaugcuuagugcuauuuccagaaacguauuuucagaaagcaaaguguucuuuggauugaauuuauaagaaaauaauuuuuuuucuuccuggaaauucaacguucucucaaaaaagaaaaaaaaaaaaaaaaagaaaaaccaaaaaccacuucccgcaacaccucauauguaugaguauuuagaggaauucugaugcucaguggcuguuuuagaguuaaugugaauggaaggacuccaguuagauuuaguauaauauccuauagauaaagauggaaaugacuugggucagucagucagcaguuguuaacacaauacuucuuaguauuccucugucauucauaugcauguuuauuuguauguauuucgcuuuguaaauauguuuuguaguggguuucuggggagggugaggggggagcgucugucucauauagguuguaagcucucugagagcagguuccuguuaucucaguccaucccacuauuaaauagaugaauagaugcaugauccaagcugcuuaaaaaaaaaaaaaaaaaaaaaaggugggaaugaccuuggccuugagcuaggauucagugaugcuccuuggcugccaggaaacacaaaagaguucagagaacaaggaugccuuaggacucaacacuccugagguaaagcagaaaggagcuugggaggagcugggcugaguauuuuugugcaguagcagaaaagacugaaaaaauacaggagaauuuuugcugcacauaugaaauaauuucaguggugaauccuuggguuagcucuugaagagcuggcuauagauucauccagacaauaucugucuuuguucaggccagugucuuaaguuaaauuggauaauuuuacauuuuaaaauucuaacuaaaaauuaauaauaauuaaaaaaaaucaaacagaccuaagaagucuuuugaaauggcuaccuugaaaacucuuuuuaaaugagaaauagccuaaccuuggaaacaaugaugcaaugauagcugaucaaaauaacaaagaaggaggaaaaguuccaugucgacauuugccagaauuaaaauuguuucuuuagagggauuccucaaguaauuacagaagauacacuaaaacaagucaaauaacuuuuaauaaguaucuuugagcucuuucuuuggcccuuagaauacauagaaaaagcccucuagguugaugaucuuaauaugcuaacaauuuagucauggcuuagaacuucauuuacuugguacuuacuauauguuuauacacacauguaaaauauacaaauauguaaaaugcuaggugccuauuauauauauaaauauauauuaauauauaaaaauauauuuaguaaggcauuuuauguuucauuguaaaauaaauacaaugaaggauauccauuaaacaagagaaaauauacaucauuaauuagcacuuuaacuaaaaauucaaccuuguaauauuauggaaaaauauaauuugauauuaguguuucaaauggagcagauucucuccaauagguaucucucaaaccccaaccauuaauucauacuuuggaugaguuugaaggacuuauacuuuagacaauaaauauaauaaugcaauuaaacuaaacuuaauuuuauaccacuaacugaaaaauauaauaccaguaaauguacuuaguuauguaaaauucacagacugcucucaguagauuuuauuagagcaaugacucagaaaugcaacuuuuggauucugugcuauuuuacaaguuaguacaaccugacaucuagggaaaguucuaagagagaccacuucacguagcaaaaacgaacauuucguauucugcauguccugacaauacaguggggaagugcuuucuauauuuuuaauuuucuucuaaacaaaaggucucccagggauauuagcaaaugauuaaaggccuugauuaugacauagcuuucuaacauuaauagagagggaggauauuuucuaagccuuguauaauucuuuuuuuuuuuaauuuaaaauugagacuuaauugauguuuuuuuuuuucccuuuuaaauagaagcuuuuaaauuuuuucugcuuggaacuauucccaccuaccugcuuauaaauuuagauuuggauauucacaaacauuauucuccauuuccucugagcaccuaauggaaaacuaacaggaucucaagggaccauugguacuuuggggucuaacuuucugacgggcuucagagaagggcuacccaagcauauguaagugauggcauuuaccuccggcagucauuagggcuguccagcgugccacagagagcucuacucuugugaccaauacauacgugcgucaucuggggaugaucauugggagggucuccuaccaacguucaugcgugggggaagccugcugcagaaaaccccugcaguaguugguuggaaaggucuccaagagcuaccaacagugcccuuguugugugguuguuucugcugaaugugugcuacugaggaggagcagagauggccacugcugaacauuuagaagcugauguuagcacugugcgcuugggaggacuuccgggucauagagcaccaggacaggcaaugcuuagaucgugguucgcaagaaccggaagucccaugcccagggagaugaaugugccuauuaugacagccuccccccaccagagggcuuuugcaugccaccccaagaacuuucagcgauucucaacggaaugucucaagcuuccagacaacaggccagacaacggagaacaaguuucaagggaugugaagguaggauuguauuuuaaaguacaaacuuaaaaaucuaugccagaauguuuacauuccaaauacauuuuuuuuccuaacauaugcaaaugugagacaugaauauuugaaucuuaagcagcucauaauaaaauaggucacaauuucgcaugcauuguaaagaucaacucaguacgggcaagugcaaaaaaggcugagaaccaccuuaaagcugugagagugcucccccacccccuuacccccgccccuuccguucuucuccccugacauuugcaucauuugcagggcaucucaugcaagucaaguauuucucauaaauaaagugcauggauccuuaagaauuaccagacacaaaggguugaauagaucguggacacaaaguacacaacggggagaauggcacugauauauacauguuucucuauguaucaauuuacccuuugucuuuuuccuuauaagagcaaguuaggacagacaccuggaagccaaaacucagacaggacagguuguaacuguguauuuccagaccaaguauguuucugguuuuaggacagcuguuuacacaucaccuagucacaaagcacaugaaguguaagagacaaagcaccucagaagccaccagacauuacagaguuuucgcauugcugggacauaguaccucgggagagugacacgacacugcgacauacuacaaagcgcaaguucaggaagagaaaacaaccguucguagccuuacauuaugaaccugauggaucgcugagaaaggaaauccagcguucugauugguccagauuucacagacagacgacugcugguauaaacagaaaacuaucuuaucuugucaauauuuaaaacauggcagcuaccaauguaucccgggggagggagggagaaaacagcagaauaaaagaaucacauuucuuuaaaaaaaaaaaaaaauuaaaagaauguguagggaauucaagguuuaauaauugacuuccaggucauuccuuuuuguuuaaaaguaucuuggguugacugcagguggggugggagggagugaggggugauggugguggggggaccauuuauguauuagugcuauaucaaggaaaauuagaaauaaauucacagcucaggaaaaggaaaacuauuuuuacuuuugccauaaagaaaagcagcaucuccccucuucauauaguguuauuuuccaaaaauaaauauuucacugaaagauggagaaggcaucuuuaaaaccagucaaacaucuguauuuucucaucuucaauggucaagaacaaaccaguacaugaugcuugugcuuucagggaucucuagggugggacucuguggcugauaacccacaggggccagguccuauguagcagaggguaugcuggaggauccccugcacugaggccaggggaacccagcagccuuuaugggcgcaaugacccagcaucuuuacugggcucgccaccacaccagcagacuguaaaguguguucagccaaccaacaccuucucaaggugccacauguaaccuguggugcuagggacccaucuuuuucagaguuuuuuuuuuuaaauguugucaccguaaaagacacugugauggacuugggagguccggguagaguguuugcugagcuacauagaaaaacugucaaaaaccagcgcccccucccccaccacauaaaauccaaacacuggaauugaauaaugggucuggacucacuuagcaaguccuguguguccccagaaaccccagaggaucugacgaaggucacugcagggagggaacccauauauccacaaugugccuuagaaaccuaccgaggggcaauuucagccauaaacaaauuauggaagcaggcuuguccccgauuaaaaguuuccucugcugccaucuuccuagagacgcucaccagauguuagcaccucuguccagugaggaugcuucuccaccauacuuguacauuugcuuucuaguccuccacugucugccccauguaaggaagacagacugcagauacccagcauucuguaaggaaguuauaccccugggguccggccaucucccauuuauuggccucuacuugaaacuucaagucauuuucuuuacaagaaggucuuccaaaaagucauucucuagcaagucaagucuuggggccacccgugccaccuucccugucccuaauaacuucuuucugauuuaaauacgcaguguccuucgguaucuaucggggagugcuucuaggacacaacuuuuauacaccuuccuguacaucacaaagaauauaacacauagguauuauacuauacuguccggggaaacgugucauuaucaugcagcauguucagauguuugaccugcuguuauuugcaucuaugggugcggaaagaaagggcauggaggaccuccuguacugagucuaagccaguuuggaucaccaucguuacuggcacuaaacauauucauaagauucccucagcccaguuagcccucucaccuagauuccugaguaaauuccaucacgagaaucgaagcuccuagcuuuugcauauacuuccaacaguaccaggagccaacaggccacccaucaccugacagaggaagaugucaacauucagagggacuaaauacuaaaugacuuacugagguccccugcgguggacacagauaauaguuucugagaugguuaggaggaaggcagggcuacaggaacuucacuaaaaggcagagaaccuagugagagggacugggauuuuugagguugcuucaccgaacagucucaacuccguaacugucugaacgccuaaguuugauuguuucccuaucauuaguucugaacaaaccaggcaugagagcacuaaauauuuuagguagguggcauaacuuccuggucacuuugagucacauggaauuccuuuuauguaaaaugcuaucucauugccgauucugaccccccccccccccccgccuuccucggcaugggcuagccuaggaauguaggacacuagaaguagaaagauaggugggguauacucgaucuucuucuaggaggaaggggugggcaguguggucucucuugguaugucaccucugcguuugguuaggaggaagacugagaaaaugauauaaugacaagcaggggaggggcucagccacccugcucucuugcaacaccccugggacucacauggcaaugcauacaucccugucacacaggaaaagaggacacaggcuuuugggccgcuguucucaagucuccacugggauucuuaggcucugccugcccucuuaggcucagaagguguuucaagcaucuaaaucuaugccagggaagaggugccgcucucccucuuggccaacacuccaauuccugauguacauuuucccugagacccuuuucaguccuagcuaggaguucauaagggcauacuguccuguaguccaaaggaauggaggaagaaccuuugccccuuccucaggggcucaggucuuuggcuuucccuagaccugaugauucucuggcccgaaacaggcccuggcauugggaggucaugccucggugacuuugggaaucagcagcuuuucuuuagagagugagguauuccauaucuguagggcaaggcccacgcaguacacugcuaccugacauaucuuccaacuacaauacuaccagagcuaagcaaggcccagggcaccccgugcaacacuuauuuuuacaaauguauucucucaauagagggagacaaccccucgccucuuccuucuuuaucucccuuucuauuuauauacacugaagaguuccuacauguuucugccuauagcagcugccacaauauccgguuuguauugauaagcagucuuaaaggcaggaggaguaaaaacuucaaaauuccuuauaguuguaugagucacuaggaauggcaaaaagucugauuuuaaaacaugguuuaaaugaaaggagguuaauuagauuuuuaguuaggaaaaauaguuacaaaaaaaaaaauagacaauagauacauuccagguagacaagcuguugugucagcaguacauaauuugccagacagaccugccagccaguucaggaggguaaacuuauacagauguauucuuaauaugagauggcccuucuccuagacacagggccaugagguuuaauggagguaagcuuugacuauggaaagucauuccaucuaugaagacacuauuguaacauacacgugcuaggauauaaaaacuuugagaaauuaaaaaaaaacuagugauaacauuuuaucuccagugggagguauacuagaagaaaauugaugaccugaaauuuaaaaaaauuuuuuuaaauuauggguucaugugugggcuugugcgugugagcacggagcccacaaaggccagaagaaagcaucagcuccccuggguuuggagucacaggcaguugugagccaugugacauggguacugggaacuuacauggguccucugucagagcccuacaugcuuuuaaccacugagccaucucuccagccccuacaacuaagucuuaaugagccuuuauuauuucucuauuugcaaaaagaaguucuagucacuuuacucuaaaugggagagggaauuuuuuuuuucacugcuaaauuuccagaggccuagaacacagaaggcuugccauauguauauggaaucuauugguaaaugggaauguacuauagaaccagucagcgcuguaauuccuuaucauuugcauuggucuacuucauuccugccguuuguaccacuaguaaaccagagauuagcugagagaguucuugcuagaagcauccucaguucuuccuaauggaaaccugacaaaaggcugccagcucugcuggagaagaagaaacgcuugucacaucaccuguguuagagggcucuugcggagcaugggggcuguugugcagaagauggccccucacucccuggcuguuucauuugcuucccaguguuuccccuaaacuccuguccacauaccccuugaaagcugguuuaguuuaucugagcugggauuacuaugaaauccaaauaagugggguuuaacuagagauaugguagucuuucuuuuucuuuuaauauuuauuuauuuguacaaguguggcagucagaggacaacucauggauuuuuggagauccaagucaggucuucagguuuggugccagggccuuuacccucugagccaucuugcccgucccacugcagucuuaaaauugucaugacaucaauaacaguuuuacuuauuugaugauuaacacccaucauaagggauauaauuagacuggguaugauggugcaugcuacuucaaucccagcagugcucaugagguagaggugaguuugaggccagccugguuuacauagggaguuagggccuucuggagacccuguuucaaaaaaauugaagagaaagagagagggagagaaagagagagggagaaagagagagagaaaugaagaagaagagaaggagagagagaggaagaaggaggaagaggaggaagaagaagaggaggaggaagaagugguguaagagaaggcacauaauuuucucuugguucaaaacuuucucuugacuccaacauguguccuuaaagcacucauuuagauugucaccuugcuguaccuugggucaccaugacuucccuucagaaaacaacacaauugcauucacaucuagucacaaaacagaaggaauucuaccaaucaccaaaguuuucuuccuagagauggcuuucuucucuacucaacugauagcagucuagugguuugcaguaaauuaucucucucgucuuccauuaggccuucccuacugaaauauuuuuuugggaaaaaaaaaagagcucaaaaucuucuauuacagagcagaacacuccucguuuacacagcacaaguuuccgaggccagcucaauuucuuguucuucagguaaagucuccaccugaggcugccuuacugaaaccaaaagaacuuuccaguuuacuugaccuacuugacguguuuaucucccuuucuauuuccuaucuucuuuuuguuccuauuagcuggccaucccuggaccacuggagucuggacuacucuauccucugugguucuccucggaggucauuccugguccuaacgaccacguuuguaucuucagucuagaccucucucuaauggcuauucccgauugucaacuugacuauaucuggaaugaacuacaauccagaauuggaaggcucaccuaugauccagaucuugaggcauggcgcagacagagcugagaguucuacaucuucauucgaagacugcuaguagaagacuuaacuuccaggcaguuaggaugaggguuguaaagcccacacgcguagugacacaccuacuccaacaaggccauaccuacucuaacaaggccacaccuucuaauagggccacucccugggccgagcauauacaaaccaucacacacauacucucucucucagaaugccacacuuggauauccagcagcugacuugacaccucuacuuacucaguuggcauuucaaccugagacaccccaacccaugcuuuccaucagccagaggcagccccugcuucuuaguccuuuuuuuucauuuuaugucuagccacaaauccuccugugcuuucuaaccuagcucucacucccugaggucagcccuaccuccuucaccugaucaucacuuuacauccuaacuaguagcuucaauacuucauuccuucacuacuuccauacuucauuacuuccuuuauuacuucuaccauuguccucuuaguguagauucaugacacaggagcgcaaaugacccauuuaaaaugaaaagcccaggcugugacccucagcuugccguaucugagaagaaaaccaaaagucuucacaguagccucuaauucucaaucuucugaccccugacaccucucacuucugcuccucuccuguccccuccuccagcucguucugcuuuaagcagccacacagacacuugcuuuaaagagucugccugugccccucugcuguaagagguccucuucguucacgugugccagggcuggcucccuuguacccugaauucaccuccaaugcucagacucggaaaggcguucucugagcuccgaagcauuuucugucccauucagggagacuacguuucccacauugccaaaucauuguucuuucaaucugaagugucaggucuggggaaaguuuagagcauaugaaacuaucucccuggcacucugacacucauccaaaagauagcugugggucaucugaggcaugcgaggacaggggcagggaccagccuugcuuuugauugauguuuauggagggaugguugcuacgggcaugauccuuuccauggucaccuucagagggagcagucaccugggguagagaaucugauggugggcaggguguugacagcuccaucuacgcagcccuuccaauuaggcucugcaaaccuucagggaaggcugcugauauggcguaguuaguuuaauaaggaaacgucugugaacacagcccuccagucagauucuauaugugaugaaaauuucugucuuaucuuagaccugaaaagaaaaaaggacuuucucuuguuucuuuuucuuuuuuuuucuuuugcugguauaauacuuucacacuugaggguguucagagauuggccaggaggacauaugaaggguucagaaggaaagcaacagaggaaucuauuccuucucccgggugacaacgcucuuaaagcaagacaaaacagguucaaaggcagaagcagggaaaaaaaaaaaaaaaaaaaaaaaaaaaaggcgguucuaccagaggaagccuuggccuuagccagugaucguggcagcuccuugagcagcuugcuuagaccugugccaaacaagcccaguccagccgagccucccaugcaggcuucccugcaguagccauagcucuguggcuccugcuucucuguguguacuaacuggaucccgccuggaugcuguaggucaggauccagucacuucuguccaucugcccuagacugagaugauccuccuccucccgcuccuucugugugagcugugagaugaacacuggucacccucacgguuggauccgacuuucacucuucccagcagcugcacguucgggguugccauguauuucaaguuucaaagagcgaaaggcaggaguggcuacauugcugauccucuuuaccaaaguuauggaugagugcuuuuuauuugcagggagcgaaagagucaagaaaacucgaccucccuuccuuuacccucuucucaagagccaccuuuccaaaacugcaugcccaugaccuucccguuaggucgauggggaagauucuuggaagggaagaaucaggccaacugguguuucccuggaaacaucuguaugugggacccacuguugcaggugucagcauuauaaggguuagcaaacucgagaggaagcaaacagcguguuuucacuggaauggacaagcucugguacuguguacucagguguuugccccaaaacucuccauccccuuccccuucuccccucugccuuguuaacucugauccugguuccaacagcacauuaaauaaucuuucgguguggcagaggacgauaggcucaugguauugcuaucaccuauugguugauagaaucuauaaccugcauuccccugaaaugacaguuguagcuguccuuggugugacacacuuauuuguaaaaucucuuugcaggagaaaaacagagggggauuagaaacgaaacaggaagcugucugugugcucagcguguagcucucuagaucucucuggaguucucucugcugcugugaauuuaagaaaauugggaucaugcuguuuauagcaacagggcuguuguacauagucuaccucaaagccgaaaugccaucucuacugaacaaauguguuucagaguagcagugagcagaaauauuaacaacuugcucagaaaagcaaccaucaacucuuuaucauagcagagacugcugcugcaaaagaaaguggauuuuugcaaaguaauguuuuuuuuuucuucugccaguaaugccucuccaacauauacauuacaguccuuucuugcagacugaggccaucauucucuuuauuucagcucauuuguuaacuauauguucagcauucauuucuugcuucugguuaaaaagaagcacugggcagggccauuugucagaggcuauuuucugagauuccacuguguccucauuuuaucuucacggagaaucugggaacaaacaaaagcuagcugaacccucaaucacccugaaugaugucaauuuaggaggguucugguaggaagcuacagcuuccccucagcuggacuuugcacaaggcuucacuugauucauugguagacgaccuaagagcuaugcuuucuucccacuucaguuuagcacaguacagaauugggaaggagcaugcugauguaccuagaccaaaccaaguuccacaaaugcuucaauagucuagggucacugacaaagaacuugauaggaaacaauaugaaugaaaaaacaaacaaacaaacaaacaaaacaaagcccagcaccguucugggcugagaagggagguguggcucaugugcauugcgagugucugggaacacgacaggaaaagcucggaagaacuuaugguacgcuaaugguguucaccaugaagaugcagaugugaccaaagcugaggagccaggcugcuguguagcucccauccugcuuauuagaaggacacgggcaaggaauuagauacggcuaauagagaaaggggaaggcauccaauugccuuuuauccuaguaccuuguauacaagacacagauaucaaucagacacaauacugaucucacaaauaccuuauaaauggaaauauauuucgauaguuuugaaacaugucauucauaaagaucuugacaugcucaacguauuuaagaacgguuaugcgucauaaauccuuucggggcggagcuagcuuauaacaugagcaggaacuguuugcauucauaaggaauaugauucccacaucauuggagagguuugggcuuacaagcuggaaaauagauauaguuuuguaaaacagccaaauucugcauuuauucuguugccguagaaaaggcaggaugaagaagaaaauuagaaauaauaagauauaugaagaugauccaaauguauagcuuuagagucucugaaauggucugacaaauaagacucuauuuguacuccaaagcaaugaugugugcuaggcauucguuacaucagucgagagaacuaaagagcugguucaaguugacagaagugggcuuauuuuuuuuuuaggguucacuucuuuacuucaaauuugggagucuaaaagcucaucaaacuaaucaugaagacugacaucaaugcccuuauaauguaacuaauuucuaauggacauuggcaggauuggaaaggucaagcaaguuuauccaguuggcuauugugacuauuucugucugcuuagaaaugaauccuguuuccuaccaguggaaucugacuguccaugcugagagucccuuuccugccacagcacacauagaaaaggacacacauaccucuaccucuguggcuggcuuagagagagacaauugaugcaaaccaggcugaucugaacugauuggacuuaaaccacacuuucaagauggaaggauuagcucucuuugauguaggaucaaacuuuugaggaacuggucaugaaacuccccaccugugggguaagccuauuagggaaaaggaaccaacggaaaggagcauagggagccucagagaaaggaucacgggguuggucagcaagccuacaaaacccacaaggucaguuccaccgagaugggguuuucaaagauuguccuguuucuuuauucagaaaauagaaucucuucaacagacuuugaaaaagaaaaagaaagcuuauggucugguuuuaauuggcaacaaucacuugaguaaaugccagcauguggaaggaagguggaaacaccagagcucaauaauccuggcauuagaccaccuggcuagaagaccaccuggcuauaaacaccugguuauaaacaccuggcuauaaacaccuggcuaggagaccaccuggcuauaaacaccuggcuagaagaccaccuggcuagaagaccaccuggcuagaagaccaccuggcuauaaacaccugacuagaagaccaccuggacuuuacagcaaugugacuaaguacagcccuuucaacauuagccaucuugggauguuuuguugcuguuguuacucauauguauccagagaguccucaccgacauggaacuuuagucauguacuaacagaauuaacuaagagguaugcaccaccagcccuauuuccucuauauugaaaaaaaaaaaaacccaaacccaaccuucuuuucuuuauuuuuaucacuagaagaagaaaaggaggagggagaagagaaugauagaauucuccuacccuuuaaaauugagcaaggucagauuauaacagcugaaacucugacccauggacucaagaacuggacugaauauaaugaggaacauuccaaaaaauuuaacaaguagaaaaauagccuggugugugucuuugagagcaagcugcucaaugucagcaagcccgaggcacuaugaaaaccacaaggucaguuccacugaaccaggguuuucaaauauuguccuauuucucuauuccguugaaaauagaaucuuuucuauugacuuaaaaggaaaaaaaagguuuuaauuucuccagaaaaauaauuggagggauuuaggucugacuaaagccugucaggacaaacuccaggcaucccauuugcuucuuugaugaacuugcugaggacaaaagauuccagauguauaauacaagggcgaaccucaaaaggcaacucuccccccuuuuuuucugauuauguaaagaccaauauggggauacaaaagacacuaaccacaugagcauuuuuaagcccaaaguugucggagcuaaaaaaaaaaaaaaaaggguauauuuugagaagaggcaaugaauugacuaaguuaaccaaggaagugcacagcacuucagguuuaaguccgagucuggaagcaccguuuucuccuugugcuuggugugagcccuucagcagcaggaguggucgguuuggcuucucagcucauggagaguggcagcuucuuaaaccgucuuggaagcugaagugccagcuuaucaacuuggcaagcugugagggaggaagcucuugaugucagagaguccauucucagccuugucggugacacauuaucugccugugcuucagugggaggagguccacuaauuuucuaaugcgacaacccuuuaacacaguuccuuauguuguggugaccccuagccauaaaauuauucuuguugcuacuucacaacuguaacuuugugacuguuaggaaucccaacguaaauaaucuacugggcaagauaucugauaugugaccccuguuaaagaauccuuauucaacccucaagagguugugacccacagguugagaaccacugcucuagacuauggaagaaaaauuugaaaccauggauggggaaaaaaaaaaccuuuauauuuaggagcucucugaggaaaaucuaaaacaaauagcuaacccacggacauuagaaaguauaugauguaauacaguaauaaaaacuguuucuuccaacacagcuauuauuuuucugaaggcucauacuguagacuucgaaaaaaugcugagcacuggacagaacgucuaggaaagaacaguuuuuucucucaggagaaauaggauaggguaaauaaauuauaagcuuucguccuuuuuagaaaaggguaaguguucuggggaacaccuuacuucucugguuuauguacugcuccagugccaugccugccugccugcugccauguucccugccaugaugcucaucagcuaaccaucugaggcuguaugucccaaauaaucuuucuucuauaaguugcuuugucacagcgauaaaaaguaacuaagacuauguauguauguaugcauauuucuauauauguauguauguaucuaacauauauuaucuauuuaucuaucaucuaccuaccuacuuaccuacccauccauccauccaucuauccauccaucauccauccauccaucauguguccaccuauccagccuuaauacuucugcacacauuaucugacacacacaaacccgaauagcaggcauuguucacaucuuaaagccaaguaaauuaaaguucagaaauacaaaaugacuugguccaaguugcauaggcagaaagaaaucaacucagaaccccaacugaagaaacuaugaaaaaaaaaaacccagcuuccuuauuuggagaaucacccagccaagaauuucuggguacagaguaauuccauaccugacacaaagcuuuuuguagacaugggaggacacaguggugccaagauggaaaagguuucuacuuuaucugcuauaaaccuugccacuuuuuguuuaacaggcuuccugacggcaagcaugaacugagccaugaaguuuccgcuaagcugcucauggugcgccuucuuuaucugcaacugcauauaugcaaucgacauaugcaacuacauaugugcaaucgacauaugcaacuacauauaugcaaucgacauaugcaacuacauauaugcaaucgacauaugcaacuacauauucacaaucuauuacacugcuacuuguugaauggucaucaaacuauuugauaggauugggccucaggggcuauuggggaagaaggcaggaguuauaguaaccugcuauuuauuuacaaggauggacuguuuggagaauuaaauaagagaaauagagcaauacccgguagggaccaguagggaaggugguagcagggcccucacaagaaugccucuaguuccuuccuuuuaauaauagcaaaugaaugaggacugugaaacuaauacauguaaaguacuuucaaaugagggagugaucaaucuaguuacagauauuaaguaauucuucgcagaucaagaaauauuaggcuuucagcugaauuagcuuucuaaugaauuagaaaccauuuggaaaaggccuucagagugucuaauaaaugcuccaggcaguacugucagacuuuguuucauuuuuguaacaacaagagcagucaaaacacaaagcauuguacacugugaguuuuccuugguagcauccaagccuacauugguguggaaggaccgugucucucuuacuguuuagagcugaucuuuauuuacgaagacacauguacuauuucauuuuuccuaugacuuucugcaaagggaagccuucuauaaauggccacugcauuucagccugugggggacucagcucuucucuuccugaguccagagaccaugccucccaacaccauaaacccagccuccucccugccucauuucaagaguacuuugacuccuccaaagucaagaaaaacuucuacauguugcaauuaggccuuaaauaguaagaauauuuuccuccaucugguguauagcccacauuacauucacugucucgucuccacagaaacuagaacauacugcugcucugcuuugugcagugugcacaucagccaugcgcagggcaccuucuuuaugcugugaggagauaaaacagaugcuaagauacccuggaaauuuaaaggcaccauacacauggagguauaauuaugucagugugagcacaacguuuauuuauuagggguagggaaauggagagagccauuuaguaacuuccgggcuaaugagcuuggucuagaagcauaggcuagagaaaccacauuucagcacagcaggaagaccauugucgagaugugccugcaucauugcacucacuuuucaaaguguuauugguguuggaaucaauucugcuuuucauauugaugccagaguagugcuuauauuggaauaaagcuaaacagcagucaugauauuugcaaagcaccuguauuucaagacagguauuauuuauuuacuuacauucugugugugugugugugucugugugugucugcacaugcacgugcgcgugugcacguucucgagagugcaacguaccacaguacacauguggagguuagaggagagauuggcuuggcuuucucugacuauaugaaagccccugggaugauggaucguccggcuuguuggugagggcccuuacccuugaagccaucgugauggcucaagacagguaucauucauauuguuuuacacuggaaacgaagaguacaauaguacccuggcauuacauuuucaauguccgccagcagacaaagcucacaggcagaaugcauauuauagugaucucaauaucaagcuuugacucagcuucuuucacuuaaguaaaguagaauuuucugggcaggaccugagaaggcaaaagucccaagaaugacugcagccacuuagaacuuaaaaggguuuuggucuugggcuggcauuccaaaucccccuagagcugaaaaggacgguguaggaggguuuguaagcaugagacccuguccugggggaaccuccuaccaauugugucccccuucucuagcaggaaagaaagugagcacagagguggacuucacuguuuuacgggaaauagagaggaauugacuuauauuauuguaagccucucgggagaaacccuugggaaaaccggacuggaaccaugcugcugguugagauaaugcuugcuuauagggauuuuaguuguuaguuccaauucuugggaacauaaguugauuagcucaauauacgaaaacaggggaaauaugauccgggacaaauauuucagacugucaaaaaaguaaacagacagcaaaugaccccaguuccaaauggggacgauuaagaaaaacaacaaaacaccaacugaguggcuggcuauaauuaaagucagaucaacuguucaagcaacaaaaucaccaaguacuucauauuuugagggguuaaaguuuuggaauggcaacaucuuacgcagcauauagucaccgcucuauggucuuuguccuugcuaacacacucucacaaaacaaauucaaagaccaaaaugaauccaaccuagagaacugcaaucccagagucucuuuuucuuauugaucggauuccaguggugcugucuucuauuuucucugcagcuaaagugugauauugaacugcaggauugcagaaggcuucuaauaagcucugggcugcugauggagccccugccucuaucggucaucugauugcuguuaguuggacccgagagguaaguauguucacagccucucuaccauggcccuucaaccugcugaucucacucugcucucugccuuaugggcuuuccucaccuggccagauaaagguucauucaauuuucucaagguaagacaaguccuaaagagaaaugcguuucaggaugaagugauggcaaaaagaugugagcuauuaaauguaccccuggcccugcuuaggauucagaaggagaaacuaagagaacgauuuugccccauuccuuugaguaucuucacaugggcagaagaauaauuaauuccucauugaaaagacugcccuauguggagaaauuuugcaaaugauagguagcugagacagguaauucuuuugauuccucaaagugacucagucaguaauaguuaaugcucaugaaagagcaauccugccucauucaggaagacaaggguccaaaaaaugacuaaauuugaaugacuauauaaagaccauaugguucaagguugaaagccuugucccugagauguugucguuggauaaacugaaccacauaggugauccacaaguacugaucuacaaauacuaagaucugggaaugaaagagcagcguggggaggugccuggauccuccugaguuaaaggagccucaguuggaacaucaaacagauuuaaaggaaauagccaaccucugagaauaggaaaaguauccuuuucuucccucucccaauauuccaucccacuuaacaagaaacaaaccuguccuaacacugccaccacugagaacaacuuaguaccgagacaggguaaagcaggccuucucucagcaacaacaguguaugcaauauagucaugguuucuagaacauucucuucacauauuucuuccuugaguuaaaaggcuuucaaaaccauaaucucacuuaaaaaaaaaaaaaacaacuaaggcaaaacaauuauagucaaauuuucaccucugaguucucagcuaaugugugggaggcagaaggaggaggaggaaucucagccuuucgggcugagcugacaauggggaagcaaagagcagauucugcccauagccauggauacacuaucucuguguggagcaacaaagcugcagaaacagcugcccaucugacaccgcccugugucacuguucagcuaaggcugacucaaguuucugggaagagacugggggcagaguagagugaacauuuguaccauggagggaaaacuggacaaauauuuguguuaggcagcguuguucuuucuaauuguucaaggagagaaugugggguggugaugugggaugauguaacuacucccccuaggguaauuguagguaaaguugggaggaaaugaccucacauguagcuaaucuuuucccccaaacuucugcccugucauccacccaauuggcacuuagaacuuagacuuuuauauucauuuuuguugugacuugauucugagccaguuuuauuaauuuccaaaaagauuuugagugcaguaaggugggauagaucuaauccacugagaaugaguggauucaaugggauacauauguauccaucuccuagagggggcugguccaagcuaguucaagagagcccagaaugcagcacacuuuauaaaaugguaacuucccacugaggcauggaccgguaggcguccaucaugagcugcucuucaguauuugaaugcauuacugcugcaggcaaaaggcaaacacaucacagaggcuucgaacaccuuaccugagccaucugccucuccagcuuugaucggggaauaucaucaaaguaguuuucauuucuucuccuccuugcaucgcccugcaugauaaugugaggaacgucuagggagccaccagugguguaagugcuuuggcuaagugauggagacaacugaggaggagugugauuaccacuggguuccugaauggaaauacaucaugaaauaaauaccaugcucuuuguggcuagccuuugguuucaaaaauugugaaauacgaaacacaacaagcuacgggguggggugggguggggcgggagugguuuucacucaucugcugggauugcuaacauugcacuguuuaauccuguaauggcgugaucaagucaaugacuucaggccaaaguauuuaaaauaucaucaggugucuuaaaaaaaaaacaaaaaacaaaaccaacccaauacccaggugaaugaucucaggaaggagguucaucucagagggguaccccaacuaucacguguuuaccagggcaggagcuauggggagcucauccucacugcaguggaugugccguuacaagaagcuaacaugggaccagaugggucuugauccucuaccaaaguguggugggacaacagggcugggaaguuggacacaguaugguaacauagcaugucacacaacguacagacugcagagcaaugcguauaaugacagaggaugcuuucaacagcaaagacaacccuagcugcaaacuggccggaaguaaggagggacagcaguggccgagccuugguguucacaagccacaagagggcuggaaucaucagauucagcugccaugucuuccccugacuuccuuuggcgguguuacacccauuuuuuuuuuuccuuuuggcuagacuuugccccaucuuuaauuuguuauuucuguaagacuuuucuugggagucagggugagaggcucagaagggaaagaccagggagcaaacuggaaauuucuauuccucugaggaggccucucagcgcacucauaacgauggugcucggaguucucccauccuuccacaaaguaagaggagggcaagauaauaaucccuuucuagccuaauuuuucuaauuuauuagaggaccccucucuuugggagccauaguauaagucuuacuucugcuucccuaaugcgucaaacccugaaguagccuacacauauccuagcauaucccaaaccucucaguacucaguucuuccuggcucccggagggagcaucuuaugaccuccugcgucucguggccucugcuuauuuuucucuucaaagcugaauccgacucaucauccuagaagcuucuauccuguccagccugcugccacgcucucuguggccugcgguuuacugaagucaccuaucagggccaguuauuccccaggagcaugcauacggaggccugugccuguguucaucaauuguggcuaccuucucugacauuugcgaugggaacacgauguaaacaagcgcaggaguaggaguaagcagagagcugagcuugucaaggagaccuuggcuuuccaauggacuuuagaagagagcacgugggcuuuguuaaaggaagggaggauaugcgcugucuuuaucaucuugccagggaaucggcuccuuuccccccacccccuucuuacucacuuuucuuuuuuguuuuaccuuuuauaguuuuucucuaguucuucuacccccuguuucuaaaauauagcugaaggaaccaauuggaguuuacuaacuaaaaauuuagagucuauagucuuaauauuuuugaaguggguaaaaugaucauuuuucaucucucaaaaaacagaagacccugagguuaauuuuaaaucgauuuuuacuuaacugugguccuugaucgauuucuuuuguuuuuguggguuugaggagucugacagaaaacucauuuccuuucucuugggagugagaaacaagagaugaagggggugggaguagggggagguccuaacaggguggugguuagucaaacugaauucuuuuacaaugcuuucuaagucucugaauuauauauugagaaaacugaacacagucaaaagggagauuguuuucuguacagguaaggcaagcauugaggagccggccuguguuuccucuuccacggcuucugccaucuuaucgcacaacauuacuuuuugaggagaacugaagagagaaaaaugaguguggugguacuuacccugagggugauggaccgagggggcuucuguggagggucgucgugcagccuaucucccaaagaugccaaaaugcguuuccuguggccaaucaaacugauuuuuaaaaccugaaacaacauguauccgaguuaacucuuuaguuugagacgaggaaaaaaaaaaagaauuuguauauacacuacaagacaaucaguacaaagagguauaagcagcauuagcccuacccuaugagagacugggaaugcaaucaggggcacguuuuggucuagacagguuggugggagugacagacagaaagccgggguagagaaagcagagagccccagaguucuacuuggcccauugaccaugagauugauucccuugaaaaccauaaaccagcucuuaccacugaaggaccaaaaacucucugaauuccuaaugcucuuagaauaaagagcucccuccuaacugcaugguuaagccugguggagucugucccucuccauccauacccuccacacaggacacauuuauacaggccugagugauuacaccuguacacacacacacacacacacacacacacacacacacacacucaucuucaccuagugucucuacacucucuccaccugcccucaccuccuuccacucugcuccagcaucugcuuggaauguuugccuggggacuucuagguaauuacacuucucucuguuaaauuacuuguguuuaugcaccaacccuucccauaugggcuugcuaagagcagggcacagggacuccuuuaccauuguuauuucugcaaugcccaaagcaagccuugaaacaaguugggaaggggaagaaggaggggaagggcgagagggggagaggcaagacucaaugaacaggaaacaauggauacaugaggauuaaaguaggccagucaggguucuaauaggugcuagugcuuucaaggacaguacugcagaggcauccguggaggagaaauccaaggagccuggguccccagucauguccuuuaaugccugacagccauucccuuccuacaucccuauauggaagggcuucucaccuuauagaugaacugcgguuuagccgagagcucaguuacuuacccaagagcccuugcgugaagacugugggaucugaaucagguuugucugauucucaagcuugcuuuacucaaaggaagaugcuguggagcuaugggcauaucucuaaacaccacuuucuaaaccaauaaauuaugacuacauucauaaauauauuuucccccuucuguauccaugcgugccccacgaugcaacagcucuugacacauaccuagucuuuagcuaugugaauuauuuuucuauuucuaucaaguuucacagaagaagagcuaaaauuuauuguauauauaauaaauauacacauacaaauauaaaauauauauuaugcuaccuugaauuuuacuuacuugcuaccuauuggucauuuggucauuuugcccaaguugucuuggguuuaagguuuuuaaaaauguuuauuuauuuauuucauaugugugcauguacgggcauaugggugccacagcacacauauggaggucagaggauaacuugccacacuugauuuucuccuuccaccaugugguuccagggauuugaacucaggaugugaggcuuggcagcaagcaccuuuacuugucaagccaucuugcccagcccucauuuagguuuuaaguagcuuacgucauauuccucuuacaugaugaaaaacuaaccaaguugacugacugccugaccugccccccagcccuaugcuguucuuaaauaagcuggcauuucccccaggcugaguuugcaagugugauucaauaaacgagccucccuccuaaaaaucagucuuccuggaccuucacgcacuuuauuaugacugcuuaagauuuguugaaaaagaaaacaaaacaaaaacaaaaacauagcucagaauauuccagaaaucuaccaaccauggcugucaguuuaaacaggaugcugauuucugcuuguaacgcuaucuuuaagauguuccuuugucaguacaccugacagaaggcugcucuuuuagaugcagcuccaacagaaauauauacaugaaacaaaggugcacagugacugugaaaucuuuuaacuuugcuguggcggauaguucaaaucccugucgucaugggagaacgguuuggauuccuucuccccaaaugccuuaucuuucaguugugcacgaaggcgcccaucugccggccuucugcccacucacaaagccuggcacugucuuucugcauuucuauuagccggcucggcauuucacuacguggaagagcacagggauuucacuguauccuccuugcagauuaugaauauucuaaugaaguauaguccugugcucaaaacucgcaggcagcauuaccuauuggcgccaaagaaauguccuuauagucuuguacuguuucauuuuucuaagcaucaagaucaaagauuccuccagcucagaaaauauaaaagacuaaccuuuucaaagauauuuugcaagucuaaacaagcuacauuuuauuuuguuuuauuuuauguuuguaguuuuaucuaucuaucuaucuauuuuuuuuaucugcauguauaucuguggaucacuugcacaucugguacccaaggaugccagaagaagaugaucagaucucuuggaucaggauuuacagaugguugugagccacugugugguuggugugaauggaaucugggaccucaggaagagcagucagugcucuuaacugcugagccaucucuccagccccuucccauucccuuuuauucccauucucuguuacuuggccaaaagcuucuacuggauguuauucuugcuugcccucaaauccugacuucuuuucuccccagcaggugacuggacccaggguucauguugcuauguuggacacacucuagagccuucaccuguccugaccaguguucguguuacuggaagguacuuuguaccagagaggaagguaacgugguaauguuaaagaacguucuuuggguuucuuuaauaaagauacucauuuuucccccugaaaaacaaacaaaaccacagcugcugugauuccacgcuugcgauuggauuccucucucaaacucaaguuugauugaagugaccugacuugucuggucucaguuuuccaccaacauaaggagauaucauuggcaaugaugacaaagaucaucagaaguauauagaggacagugugaugcugggugugguggcacacaccaguaaccucaauacucgggaggcaacggcaggagaaucacucuagccugguguauguaguaaauucuaaccucuaggccagaucucucucucucucucucucucucucucuuacacacacacacacacauacacacacacagagggggggagagagggauggaugaggagggagggaaggaaggaaaggaaggaaggaaggaaggaaggaaggaaggaaggaaggaaggaaggaaguuguaccaagagcuggcacacuuccuagagcuuucaccccuacuguucaugguacucugcacacuaccagagagaaaggcaaacaccaacccagcuacaaacccuucuaucugcaauggugacacaccuguaagagucccuaguacuauaguggcauaaaaguugugggagucaccaaccaauauuugauuggauguaaggcccacucucugagauggaaucuaucgcugauacugcucagguggccaagaaccuaagacuagauuaaccugagacuuaggagaaaacccuacauaccaauauuccacuaaaggaauauaguaauaauaugaccccuaauggcguucugcuauacuuaaagaucaguaucuugcucaguuauccucagagaagcucccuucugcaguaaaugggaauaaauacagaaacccacagcuggacaauguauagagagcgagagaccuugggacacucaguccuaaaagggaugucuccaucaaaucccuucaucucagggcuuaaggaaucuugcagaagaggaggcagagagauuguaagagaccuaggugguggaagacaccaagggaacaaggcucucuaaacacagcaggauagugcagagacaagcucacagagacuguggcagcaugcucaugcgcauggccugccuacacagguacaagccagaugggaucccagcacugacagaggaaacggacaucagcccucaucccuauuggaugcugucuccaauugauaacaguucccagaggagaaaugacuuuucuccaacaggcucaccagguauacaaacacucuuaaggcugggccccacgcccagugguagauagcuggcacaaaaugaacucagaggcauuuuggggaguucuuccaucuucuaaugcuuugauaggaaucucccccuccucaggucuuuuguguauauauuaugguuucuaauuuuguguuguaaugggauuuccgugagucucugcaucuacauguaugucuugagauuuauuuccuuuggcuucuuuucuucaguuuguucuagucuauucuguuucucuuuuuuuaaaaaaaaaacaucaaauuuuauuuuauuaauauuauugauuuuuuaguugccuguuuguauccuagugagagagaaaaagagaggguguggguuuggguggaugggauauuagagaggaucugagaugagaacccaugaucagaauauauugaauuaaaauuuuacuuucaauuuaaaaaagaagagccagcacauagaagauugcaccuacaaccacguguuugcuccaguaaacgggacccugaggaugcauagaaauccugaccagaagcaugcagacacggccauguucacagugcuagcccaagaagcuggggcuugcuaugaagagcuuugugagagcucucucaucgacaugacggaucugcuagaaaugugucagcuccauacugguccuauuuuauaagaaugcacacucuucucagauccauacugcuuggucuccaggaggagguuugcucuacacuacagcuccagacugccuucuccauagaacaaccaagaggagacucgguagacaggcagauaacaaaggguuaaauaaagaauggccacuuaugguaagaaccuguggauaaccuuauuguuuuuauuuuuuuuuuauuuuagaauuaucccaugccacagaagacacaguaacuacgauuuauugaacacuauauucuaguucccuauaauaucuguguuagaaaguuuaccacguguacuacguaugugcacaaaugucucaucuaauccuuaagggaaucuaagcauucccauuuucaugagccaaacuugagacucagaaauaccgaguaacuugugggcuguacugcccgcaggugucaaggcuggaacuguccaucacugcucacucaguauuggcuguuugccaagcucucuuccuacuauccccuuccaugccucuggccucacucaugcuuauacuuaauuauacuuaagagggcgcuucuuuuauugggucuccaucaucugaaaacauuagaacaacccauuucuuuuacaagucuccuagcagucuugaaaccuauggcccaugcagcaagaacaaccccguauuccccgugaaaauacauggauggaucaaggacagaaaaacccucauuauugacgauccaauccaaauuaacuaauaucagaguaauagagaaggcagauagcuuuuagcuucaaaacucucagguuaaucaaaaagaaauccagauggcagagcaauuacagacuguuccaaagaaagacugucaaaagaccaaggcagucuggucuaacuugagugcgaauagcuuucaucuuugagacuggagguccgaaguaguagaauccuggccacucaaacauguaaggcagcucuucuuuuaaagccuagcgcaguauuuguguguuagagaagaaugucauagcauucucaggaccaguuagcugaaugcuauuuugaaccuaauaaaaggagaaggggaagcaaaggagaucauauuuggcauuuguuuaagauauggagacuaauugguucaaaaguaacaacauauuaggaguuuugccacaaaucauuuggaggauaccaaggggaaacaacuuacagagcuuccaagguugaaaggauugagcacaaauggcugcacugucaaaccacuccugaagaaaaaauuacugucuacaugugcgugaggaaaugguucuaacugcagaggaaccuggacccagaggauacagaucgagacagauaaggaaucaaaggcagagaaggaagagauaacggaucaaagcuuauuacauguuuuaaagaugguuuguaccacaccugucaucguguccauggcgaggauaugguguuuaagcaacaugggccucuaggaguuuccuacagugucaguuaaagaggucagccucagaaacucugccccauaucugggcaauaggagaauaccugcacugggugacgaugcacauuauuauauaguauauuguauuauacauuaugucggauauaaaacccuuuauauaugagaauucugccagacagccaauaucaugacauggcauucuccuuguaccaaacagcaugaggauauaugucaaaguaaggcuggaagucaggguacuuagacuuuguccuuuuaaaauuaaugugauauaaauuaaacauguucaauuuaaugugguacaaauucaacacuaucuucauuuuaaaaauuaaacaauguuuugauuauaauaacaguguuacuuuccuacugacuauauucugugaaaugcacuaaaaagcaagaauauaaguuauccauaagcuauucauaucuagcgguacacgccagguuucaccaagugucggcagauaauggagaaguucagagaaaccauuuuucaggguggucauguuguaagcccauucuucaccuugaucguuucauuuaguaucaaagccauagaaccucucuauguacacaaguccaaacagacauucaaaguaagucagugugcuggguucacagaagcauuucauaauuccuaaauaccaaguaugccacgcgcuuuauaauauacguuucccugacaguuuccaucuucacugucacuuugaguagacacgauauggaaaauacuaauucaaauggcaagcaugcacaugagucgcagggagaagccacguggcaacagucugucuccaaguucugcugagauaucaauccacucagcgcaggcuggaccaaguccuccggggaaauuacaaacccacaucauguucucuaguaucaugccuuguguuugcuguguuuggggauucagguuuacuagacagaugugaggaagaacgugaaguuugagacuccuagagcucaugcaugcagugucguuaggugagugggcauuccaguuaucaccacugcgggcugugcucuuuuucuuucuuuucuguuuuuugguguguguguguuguuguuguuguuguuguuuuccuguaguuucuggaggggaggaaagagcuucauucugcauuuggaccuuguacaaugucugggugagcuguccucuguauccuuccuagauauuuccuaacuaaagggagaauagcuuucaugcaugucuauaggacucuguuucuugacuggccacuuccaaccaagugccaaguacgcugaagagggcugcuaggcauaagagccaaggaugggcucucagguggaaguccaagugucuuagucuccugaacagauccaagguugagauuaaaugugaaaguacccccucucuuaucacuuaauauuucccaccuacgcguaccaaggcaaaugugggcuugaguaucccacauauccagagauucuuauuugaauuugaaaccauuaggugacucugacauuuucucucacgacgacucagacuucaauaacacacaucuggaagaguaugaacguuucagggggaccgagggaccgcugaagcagaaggucauggcauuugauucuggcuuguuuucuuagcuacuugaccuuuuacaucuuggagaucugauauaaaggggacaauaauaauuguauucaacaaacauucccugaaugccuggcauauauaauuaccauguuauauacuuugcaagucacaaagaagauaaaucaugcaggucuuuaggaugcuaaauaugagaugggaaaaguacaaaauauauauguguguagcuaucccucuccucagaacuauccaucuaucuaucuaucuaucuaucuaucuaucuaucuaucuaucuaucuauucaucuaucuauccauccauccacccacccacccauccaucuacccauccauccaucuaaauauuuaugucuaucuagccuucccagccuaagacagauuccagaggauugguugaggaugacuaagaagccggccuagagauucgggagcauucugcucuacuuuaauuucuccuaaaguauuacagaaauuuaaaacuuuccucuauuuuccuuaaauaaccuugguagcauuuuuuuuuuuuuuaguauuaucaucauugcuucagugugcuauuauggauuucuccggauagauuuuaaaucagaacgaugccuuucacgucuccaaccuucucucguuagcuccuugcuucccguaugcacuucuccgcauguucuaaagccugcuucucuguucuaagagaaucuugcaaagaugaaaccaaggcccaacuaaaauuuuccuuuggacuauauagacgguguuucugaacuucccuucucucucucucucucucucucucucucucucucucucucucucucucucucucucucucuuucuuucucucucucucucucucucccucccucccucucucuucacacacacacacacacacacacacacacacacacacacacacaccuaaucaaguauacagcauccuugcaccuugcagucuuucacacaaguacacuuggacccuaaggucucaacucugaucucuuucaagguggacuagugaagcaggcaagaaaagauaaaacaaaacaaaacaaaacaaaacaaaacaaaacaaaacaaaacaaaaaaacaacaaauagucaaagaaaagaucacccaucaucuuaucucuccuucuuucuacucucaagaauuucuacucuucuguuuugacacauacagucuuaucacaggaagagaggcaaaccuuuccuaccucucaguguucuaauuccucuuuccucuauaaaaccugaacuuuauuuuccuuauuuauuacuuuucaaaauaauacccauuaacaccacaagaaaauggcccccagaaucaacuaaucaaggcucacggaggcucacagagacugaaccaacaaucagaaaccuauaugagacugacauagguccucugcauauauguuacgguuguguagcuuggcauucuugugggacuccuaagagugggagcaagggggcugucucugacucuucccucugcuuuugggacucuuuuccccacuacuggguuaccucaugcagccuugauauaaggggauaugccuugucugauugcaacuuguuaugccauguuugguugauacuccugggaagcccacccuuuucugaaggaggaggguguggaucugagggagaggagagguacuggggaagggacugggaggagaggagggaggggaaacugcagucaggauguaauauguaagagaagaauaaauuaacaaaagcuauucaguagcugcccaauaacaguuuguagaacagaugcccccuaaauacaacucuauuaaccugcaggaaggaaaagaguuccagguuacacaucuccggaaagagcaaagggugguaaagaagagcgagcaagagcuuugugcuucugaauacagacuggcucaauaaacaggaaauacuaaucauggggaaguguaauaaucuuuucauaaaaagagagaccuuaaugguauaauugccucugagcauuuaaggcuucuggaggcacaaagccuucuuuguaaucaaugagaaucuuagguuuauuuguaaagcguucugaaauaccucuugaugaagguaccaauuuccugauuauauuuuaccguaaacauugcucuagaagaugaagaaaaacccacaacaagcuaaccaaucaguuucuaauuucccuguaaguuacuuuuaaguaccgcuugccacaaguuagauuuuccacgggaaaauauuggauugcacugcucaaacccaacuacuggaguuauugcaagaaagccuuguuugaaaagaagauggguaauguggucaugcuccaagcuggaagcuguguuugggaugcagugauguugcugagcuaacagcauuugaaagcugaagcugcacuuuuauuaaugcacaaaaugacuuguaucugaugaaacagagagaccauuccuuugcuucaauuuguuaaggacaagagauuuuuacagcuacuuaggguauuuuccaacuucuugagaucaauuguauucaugguugacuaucucaguugaaaguaaaauuacugucaccagaguccauuaguauagguuugcaaaguauaaaaugaacugaaacaaauagcaaaaugugagacuauaccccuaccugcagauaguggcuuuuaagagaaacugaauuuuaaagagacaauugaggaauaguuuauucaauucuuggcuuacgaauggucuuuucugcugcuucucuucucauuguucagucaccugaguggaauguaacaccuuccaucggaggucagagagcgaaagggggcaaugaauccaauccugcaaauucucuuucuagucagcaccucugauaagaauuuguuguaggaggagauuaaaaaaaaaucuaucuaacgcuagcuaaaaugaaggcucuaaaaacacaucccuggauugcacuuagcccaugcacgacugcauguuaggauuacacaccauauuucagcucauauauguugggagguuuaaaaaugugcuuuaaguagauguugucaggcucaaggacaagaucaggaugggugaggaccccucgaguaaugacaguuaaaacucucuuauaauuuccuuuuuuguaucaucuucacuaucacaugacacuguccccuauuuccuggagagucacacaauagcaaaaaccagggaaccacuaaauagccaucagaaugacugaaaccuaaaaacugcagacgaugcccaaugcugguaaauuggggagcccacauguugccaguuggaauauaaagggcaacuguugcuuuugggacaaaacaaacaaacaaaaaaaaaguagcaaguucauucaggacaaacgggaacaaguacacacagagauuugugacauucauagcagccuggaacuggaaacagguucaaugccuggugguauagaugccuggcauagaaaugggggcagcaacugauuuccagcagacaugauaaacuuuuuagugacguuuagcguucuaaaacugggcuguuggugauuggucagcugaguaugguuacuguaauguguugaaauguauaguuaaaaugggugauuuuuaugaucuguaauuaaguugcuuaauaaagcuguuagagugaaaaaacacugggagagcuggagagauggcucagcuguuaaagccacgggucuaaacgagaauagaagaaaaaaaauaccagcagagugcauacaguauucagaaaacauaguauaaaugaggccauuucccaaagauauaauucaggcugcucuagagagacaccuguaauucuagaguauaccacuuaucugcggauaaaaagcaagcuacacuauguucaaugcaucuuaauggaauuaagggaacugugaccuauaggguggcuuugugcuaggaaccugugcuaauggauggugagcuuucuguuuucuguuauauguauacaguacaucagcacugacgaguugaauaugagcauauuucugaggauguuaauccaccaagccaguguacuuugguuaaaaagugcuuaugcuuucuaagugugguggguguguguuugaaaggugcagugaucacugagaccaacauggggucucuuugcagaguuauggguggugauaaugagaugguucuccaguccuaggacagaguaaauagagucacuguggcuuuucaguccacaaggagccauugggagaagacagaaaacugacugcagucuaauccaucuaaacaaagaaaguaugugcuaggagguggagggaggcaaugguaaaagcaaaugggaacagccagccccgccaguguugcuggcuaagaaagacccaguguggagucaccaaacucacugacaacuucaggcauucccuccuccauaaggcaggggacuguuccaucagggcacggacugauugcaaccuggugacccccagaaauuccuuuccuacuaugcugaccaugcuagcaaggagcaucaugaaaccagguuccuuggggaccagacgcuaggaaagggcacauuggagaugaauggugguggaggcuuuggccacagucugcaauccuccuaccacacaaugaacaggaaggcaugguauguuuuuguucucucuucaaucacaugaaaccgacaccccugaggcacagacucuucauggaggacagagucauugagaacaggucuuggagucaugauucugauacuaaggauauacaauuuuaguuguuuaacuucucucagcaugauccaaguucauccacaauagaggugauucaaaguagcauuucuuucuuucuuuuuuuaagauuuauuuauuuauuguauguauauagguacacuguagcuguacagauggcugugagccaucaugugguugcuaggaauugaauucaggaccucugcucgcuccagcccaaggauuuauauauuguuauauguauguacccuguaccugucuucagacacaccagaagagggcauuagaucucauuacagauggcugugagccaucaugugguugcugggauuugaacucaggaccuucagaagaacagucagugcucuuaaccgcugagccaucuuuccagcccuguagcacuuauuucuuaguaaaaccacgagagagaugcaaagcacuuaacacugugccugaagaagaaaggaccuugacagacgauaacgucaguuuugaucaagcccaguugcugaacuggaagagcuggcccuacugcuugaacuuaguggguucacugaugaacaggcacgaccaguccacagcagcuguguggcuggccacagaccugcucccugccaacaacucuucaucaccagccacucuucuuuccaacuuucaguggucucauuaaaaauaaguuuugcuggacuauguuaaguucuuuuuuuauuuuuugacaggguuauuaguauaagguuggcagacugagaaugucagauauauauugucuuugcucccaauaaagcaguugaugaagccucacauuaucuggaagacagugggcucugcgagugaaaacucaaguggauucacagcugggugugcagcuacaacccaagagguuugauggauggcucugucacaacugcucacugaaugucacagggcuguagcacugguuuggcuucauucaauauuuuuuauuaauggcaucaaaguagacauaagaggaacacuuaucagauuuuuuuuucaaugacauaaaacugugaaggauguuuaacacgauaauaggccaauauaaaagucaaaauucccucaacagguaggaaagcaggcuggcaccaggacaaugcaauugaagagggacguucauguucccaagggagucacccgugcaggauggaaacgggaaggcuaggucucugccaacaauguaaagaaaugccugguuuccuguugggcacacaaagaggcuuagaggaaaguacaaacgcaagggucacagacauaggugauuuuguaagacaucuuguuuacaucauuacuucagccugaugaggcugcuaaugaucugacacuuggggaagggaauggagacauuuauccucaggagcccagggcuacggcaggguguugcuguccaagguucugauuuucagaaugagcacucuuccuauuccucgugguacacagcugacauucucccagcauuccguggggcccaagggagacaguuuuaaagaaauaacuagcacugugcuucccccccccuccuguccccauucugcucaaaaguuguugcuucccugagagacucauguacccuguaaacugggugcuugucugaugacugacacuuucugugugauuguaggaauacuacagucuguucugaauccucccaaguuuacccacaaauaaaacgccacagaaaugagucugucagucugucuuucucugccuaucaccuuacaaaccguucccugccaaaauggcaggcuuuggccaggaaaagguagugggacacuugagaacaaucuggaauucacgucugucaguaaugagacccggauaauuaaaacuucucaaaaugaagguaauuuucuggggcugcauuaauggcgcgggguugcguauuuacaugagaaaaccucaauuaccuuuagauaauuggguaguguauuaaguaaccugacuauaaugguaugcacucggaaugcaugaaaauuucacuuaauucaauuauguaauuagcucguauuaugguuuaaauguuacuggagcccuucuuacaacccuuucugagcaugcauugcuaucucuuccucucuugguuagaggcagugguuuccuggauaucuggaguacuguacucccugggaagaccauuugucuccgggccauggugcugcagcuaagacuaguaaggauugcaaaguauccugggagacugcccuuacuuuaauaaauaaauucucaggagcagcugcuugucacuauugucugcacuaaaagcaauggcugacauuagcgauauaaaacuccagcuuacagagguucuaugguaauaggcgguccucgggugggggaaggugucaggucccucuuauguuuucuucucuuucuugucuaggcuuaggccagcuaugaucugccaagcuagagaauggagcuguuaaaaagauggaaggucacuggcugcugacagugcuaguuccaucuuggugggagaggcggccagucguggcgagugauuggguugauguguggugggcaagcuaauaaucucugaugucugcugucucauuaauaaguggagagaagacgucauaggggagggagauggggcugcuuugaaggcucacacacuucaucugccaccacaaggguagcaauuccuucauucucacucuuuuuuuguuuguuuguuuguuuuucaagacaggguuucuguguagccccggcuguccuggaacucagagauccaccugccucugccucccaagugcugggauuaaaggugugugccaccacugccuggcaugcucacucuuuagacaagaucucacuauguagguauggcuggccuggaacuugcugaguagaccaggcuggccucaaacucaaagaucuucuugggucccugagugcugggauuaaaggugugaacugucaccucagcuuccuucagguucucaguggacuuccuccugcgucuccuuucugaaaugcccuuccucucuucuggcucuggggaaccuccacacaccuuccaguauuucaagaccagguucaaauagugcuucuaugaaaaaauggaacuuccaccaauguccuuugucauccaccccggcccccuaccugucauacaacaccaaugaaaucuccaaacagcagaacguuugaguaacuguaucauauuagucauguucugugaaacaauacauagaacacagccgcacauauuuaauuugcaugaguuugugaaucugggcauaaacaggucuuggugaaaucagcaccacaagcaaugauguaaacauauucacugccccccagaguuuuccucuguccccuuuagcaucucccuuuuugcugguacagaauccuaaugagaucuaccugcuuggcaaauuuuaagcaugcaauaugguauugccagcaacaggagccacacuguauguacaucuuuagaacuugcuugcuuugugaagcugacacuuuguaucccaugacuaccccaucugaaucucucuccaucucuaccagcaaccuggcaaccucugcuuccgugaguugaacuguuuuagauuccacaugcaagugagaucaugugacacuggaugucuugccuagcugaguuuauuaaguguaauguccuccacacuaaccuugguuguugcaaaugcaggcuucucuuuuguuuuaaggguaagaaaaaaagcccuauuguguacauagauagacacuuuaaaaucuuacucacaaccaggcauagacgucauucccacagcuuggcuauugaaaccacagugauuaguguuucagugauuagaguagggcagguguucauuccagaccucgauucaaauucuugcaaauauucagaaguaagacugcuggaucaaauggauuuucugugcuuaauauauguuuuuccuaagaaauauguaauauugcgucaugugagcuuacuggccaaacuuaggauuccaacacggacaaugugagaaagagaagcauccauuucuaagaagcagcugcugaacuaucgaaugguaaaguaauagccccacuugccagcauaaccaauuacagucugcaaguuuccagugaaaauaauucaaugcacccugauguagugucugauuuuaaaaaaugaaguuugacgucugauugucacuaaacucaucagucuuacaucuuccauagugagaugcauuacucaugucucacuucaggacaauggugaaacugagcugcacagaacaacaacauaggaaggaaaguuggcaauuuauacauguauugccauagaaugacagugucauggagcuugcugcuaauuaaccaaugcauucacacacugggcacauagcaucaguaaaagguuugguuaacaaugagaaggccacaggacucauaccacauuacugauuuuuuuuuuuuaccacccaugcauaaauuuuucugaaucucaaguaauucgugacucuuggucaagaauuuaaauuccaaaguucacuucuaaaauaugaagaacacuuguguguguguaugugcgagugugcaugugcaggugcccucugaggauagaaggggggcuguuagauccucuggcacuggaguucugggcaguugggagacaccagacauaggugaugggaauugauccuccggaagggcagcaagugcucuaacaacugagccaucuccucagcccugugaucgcaacacuuuauaaagaauuuacuaccaucauuuugggauaaguggcucucagauuuuaauucuuugagaugaacucggccuccucuccauagcauuuuuuuugugucuucuuauauuuagcuuucucucugaucaggguucauuaaaaaugauauuucuaucucgugaacaugacacaauguguucaaggguuuccugugggaaaagcacaggaagacacagaaacccuugcaggagucuuagcuggagugucucuauggaaaggcugccuaggagaaaugcuaauuagggaggccacaggggggagaaaggugcuaccccuuccaaauacaacucuuaagacagaagcauuuauuaacacaggcugguuuguaugaagcacuuugaggcuuauguaaguaugguuuguuucuuguuuccaaaaaaaaaaaaaaaaaaaaaaaaaaggacaaggacuacauuugagcaaaacaaaaacugaauaauuuaaaucaugaaucugaguuuuaaaaaaauauucuucaucuaguuagggauuaauuuucaaacacccuuuacacauauaugcacauacauacauacacacacacacagaguaaguuacauagguauuuguaaaaucucuagcaaagcugaaaaagacuaucuggauauuagaaugcaacaugacauacauuuauagaauuuuuuuccagggagaaaguuccuuuuauuuuacugucaaucuuuuucuuucuuccaauauaaauaaaauaaaggcugauucuuagaaucagaaccuguuugaaaggcuggccugguccaacagcuuacuaucuuacugugaacaagaucaaagagacuaugucucugguuacuuugcacugacugacaagcaauucgccaggaagcugaaggagcuaaacugaccgaaaggacaauagaacaaacugguuuuaucugauuggcucuguuuacuugaugauuaaauuaucauuccugcaaaaaaauuuuuuuuacuaacuuuuaaaugagacaaacagacuuuccacuaaaggcuuauuauuugagccacaccuuccuuaagaaagggguggugguaacuuucacauucuucaucaaguaucaccugacccuuagucacugcagaacugcaccucaagaagugggguagcuucuuguugcuauacuucuuagucuagugucuuguuucccacagcuagaugcugcugaagacugaaugaguuggguuucaaauggcagcaauucuauguaucugcccuuccuuuagcagacacccugaauccagguagcucauuugaucuugaguuaagaguuagguagaaggucuguucugcuugcaagucauuuucuacguaauacaaaugacaaaaaugagagugacgagauuuaagggguagugguucuuucucuacucccuuuacccaugcgcacaucacccaggccagccaagaccugaucucacaaagaacaaagucuaucuccuuugaugcuuaagacaggauaaugaaaggaaagccuauuaaagaaccauagcauggugagugaacguuggucacuguguccuugacagaacucuguccacucuauguauccauguuuucuuugguagauuccauuccaagagucaugccuugguggagaacaaagaaauaauuuuuguucauucuuucauccacucaacaacacucccccacccccugagguuuuguacacuggguaguauuaaauugcugagaggcacucagaaauaauugagauacaacugccucaaggaacacuaggcagggagguggacugacauguuugaagguggggagguucagagaggaucggacgaggucucugggagcugcagauggccuccuggcauagaagacagacuucgcugacaguuucgagcuuucccacguggagaaguaaggggaggagcuuucgggaggagagauacuguguguaagaccagaggagcauaagaguaacacauguuggugagagggauuuuuagguguaucuguggucaguccacuggagugggucaagucagaugaagggcugucuaaaaggaacgugcucuucaacuuuaaauucuacaacaugcuaaaaaaaaaaaaaaaaaaccacacacacacacacacaaacauuuggaaugauguugggcagacaguaaauacucauuaaagacaagagauauuuauuuacguugcaauugaagggaaacuaagaucuaaaaggaaaaagaagaaaaagaggccagagcuggccuuguuuuuguuguuacaacaaugcugguguuaauagugagaauggauugggguggggaugaccacaggccagcaaaugaaaaguaggucggggacaggcuuuguucgcuguugcgcuccccguguccagcauaguggcagcacauaguaagugcucaauaaggaauuguugaaugaaaaaugaauggugaugggaagagacggcugcucugagagccaucuugucagcagaaauagcagggcuugugaguaugggguguaggcaggaaggaggaggagcucuguguaaggaggaggaguaaaaggaggaguaagaggaggaggaguaagaggaggaggaggaggcggcucuguguaguaaguacucuuugcaucugcuggguucagccucaagguguguugagaaagagaauggcugaaggaagauggcagggcagcggcaaaggcacugcaagcaucccgccuagggggcggggcuuggugccuuccuuguuaacucucugaacccggcuuuguaauccccauuucuaauggagaaaaaccgagguucaagaugguauagucaacugacuagaagagucuagauuuaaaaagcggauuuugggguggcaguguugcucagugauaguaugccugccuacauaggcacaaggugcuggguuugaucugagcacuacuccauacugaaaaaccuuauaaccacacacaaacacuacucccguucugcagcaaaugugcuuuuaagauuccaccauaccgguuuccccaagaaaacaaacauuuggauaugguguauuuuguauucagaaagcccagggguagguacuuugcggagaaaccaaagcauaauuucuguuaacuuugcuucauucguauucuaaaccuguugcccucauauaguuauugugaggagccaaaaauaugaaaaucuugugaagauaugauauaaaauagaagcaaaguaauacaagagcaaggagauacauucaggaucugguuaggguuugcuaaagaaguaccaaagauaacaggaauuggaggcucuuagggaccuuuggcuggcaaaggcacccaagcgugguccagagaacucacacagggucaauauucccagugcaugaagacugagcaaggaacaguuuugauuccagagucagaguccaccacauuccugcuuuguaauuguuucuccucaugucugcagaggucuccugggacuuugggacugcuaggagcuucgagagaagaaacaaugauacaugcugccuccuccuccuccuaggcaaaggcccuaacauugcagaagacccgugagauuguggugcugugccccggccagcgcccaaagcaagcacaccaagaagaugcuguggucguguucucauuucaguguccacacggaaaggggucacuguaugucauuacaaacaccgauaucauucugucuucuuucacucuucacuugucugugauuucuuacuggagucucagcauggacaccugucucuuuggagaaaccucucguagccacucuuuugaaauggcucccucuugcugucauuugcuacugaguaaugcccacuucuccaagggcucuuugaagaauuuacaagcauacgaauguuugcuggcuuacuugagcuucccacucaaguuaggcuacagaccccacgaaggcaugggguagcuaacggauucagccccguaccucgcauaggccuuguaagugggguguguuugaggacugguuguuuuaaugaaccauuaaaguuaagccuggcauggugaaguaucuguguagggagcagaagaguuaaucuguggugggggauggaguuccagagucaggcuuccagcacgaugugggccagagacacuggaguggauuggcucccguguggauugaggccaccacuccuggcucaggagcaagccaugcuaaccaacugaggcgacuggcccacacagugcaaaggagaacagaagcauccuuacuccccaacccuaguguaggugcuuguucuccuacuuaaauaugcaugguacauaaaaauaauuguacagacagaaggauucacaguugcucaaaguagacugggaaaguguuugaaccauucgguggguggcgcgacuccuaggggaaccaggaauguuccaggggugggaauagaaacuacuccaggaaacuguacuguaggaaacaauuuacauaucugagggcauaggagguucuggaacugagcuugcucugcugggauugucucacagaaauaagccauugggagcuaaaaaacgaguagaugguauguagagagauggcagaaaagucacauacaagugguuuacgggcuggauucaugcauaauucaucgcauuagagucuucccaccuguacagagagugaugucauucccugcuuugcaaaugaggaaacagguucaggagguuaugcaagccacugaaucuguuaagagcuuaacacugacaccuucuuugccauggaagccaagccuagaggaguggggaguguaauucuaaauugccuuuugcaacagugcuuucuauauauuucuuacgcaccuuuuaggggccaggaauacacuucugagaaugggcuaguguugcuaggaugguggcuuccuacagacauguuggaaacagggcuggguggggguggggagggguguagcuggucuuugcuaccuuguagguucuucuuuuugccacuguuucuucuccugguuucacccccuaacacuagauaagagagacagaaagaaagaagaaaaggagggagagagagugcucccaaaaucuaauuucuuuccuuuuguuucuucuuugagaaugacuacuaauaaacugcaaucauccucccuaaacaaccaacacucaccaacaaacccuucuccagggaccuagcauuuauacacccccugaagaguucccagaauuccaaacaucacacaacuguagaaacuaucuacagcuggcacaaccacaccucugcuagagcaugaggcaaaucacagucagcugcuguggacaguuggagcagccccauacuccuacacuugggaucaagaugaaaacacauucuuauaauauuucuguguuucuaaagaaaccagcaucccaauauugucacucugggcggguggcuugacuugaucugauccgugucgccuagaauagccaucacuuaagguccacugauucccuacugagcaauuugauuccaaacaaauaggauuuuguuugauuuagucucuuuaaaaacuaucagccacuuuacaaacacuuucuuguuccacagcaaauauauugguugacaucugaagaaagguucuugaaugauggccgaaguugccauauuuacagcuucacacucccucccggcgcugaauuuugcugaucuguucaugcaggagagcuucaguguauguacgguugcuuaaugugcuuagucaccaauuuuugaaaauagaagcauaucuugccaccuacuuaaucuucucauguugaaaagaucacuuacggcucaucaccgaaacugccuggagucaaaagcaugcacagcacaggugaccaguaagcacagcacuaaaugaagacaauaaauguagacugaaaaaaaaucccucucauaauucuaacaguguucaacuuguaucgaugcucugccuuaaaagccuacaaaauaaacagagcuaaugagagaagcugaguaaaagggggcccaaaauucaaaacuggaucuuggucaauuauuuauuuuuauuuauuuuuaagacaaggucuucaaggacuuguuagaugccaaaaugcuuccacuaucuuucccguuucugcuucauaacuugcaccgcccugugaacccacaccagccagucauucuggauucuucaguagaggaugccugcuccuauaagacacuugaucaucuuucucagaagccacagguuguuaagacuauauauauaugauauauauauacacacacacacauauauauauagucuuaucauauguaugauauauaucauauauaauaucauauauauauaauaucauauauauauauauauagauuuguauuugaagaucugugguaggguugugcuuuggaucugauuuguuuuguuuuuuguuuuuccaagacaggguuucucuguguagcccuggcuaucuuggaacucacucuguagaccaggcuggccuugaacucagaaaucagccugucucugccucccaagugcugggauuaaaggcgugcgccaccauugcugacuggaccugauuuuuuuaggugugucuauuauucuuuggucuugucaucugagucucaggauauccauguccucagguggaagguugaauauacaaauuaaguaaaugcgcaaugaauaauguccugccugaugcauguaugaggugguuagguauaaacugcagcuuaguaagcuacacguauuuuuaugaagcauauacaguguaguuauaaauaaucuaccacaagcuauacuuaggagugcaaucagcuauguuaaucaauucucccuguuuuugaaguaguuauguccauuggcuuugaugugaggcagacucaagacgaauggcuuagagguuggguuguugggaaggcguucaccuuccuuggcuuuauuuauucaucugugaacuugugaggaugauaaaaccaauguuguggauauacacaaagcacauaaugcacggauucuccacuacgguggcuugcaccauuccaagcuuaugcugaggacuuacucucccaauagguuacugguauuuggagguaggaacuucgaaugagucacgaagacucuccccucaugaauggauuagccuacucacaaccuaaaggguuaucaugagaguagcuuugguguagaagugaucuuucuguuaagucugcuuauguugccccuuggugcucuucugccacauugugaugcuggcugaacacccucucuagaucuccaugcuacucucuuagccuucccaggcuccagaacugaaugcuaaauaaaucuccacuacuuauaaacuaucuagccucagguguuuuguuacaacaacaaaaaauggacuaaaugaggggggaggaagaaaauaugcuaaucaauguuaauaaaauaagauaaucuuaaaaaugucuuuguauguacgugucuaguauggccuuccuaaacauuccuguucccucccauuacgauuuauuauuuaaugugacagugcagaauguggucggugguaucacuugcuuuuccuuuuagaggcuccuuauaaggagauauaaaaugaggaugggauggggguggggagggcaaccacaggcagauccugaguaaucuuuaugagccuaggaggacugaugagcccaacuaacuagggacaaauguuuuuaaaagcacauuuucuucuauaaauggaagaacucgcuagaaagagcaucgucuaaagcacguuucuaucuaucugagacagaacacaagaguuuacuuucauuaaguuguagcuguugacaggaaggaaaacagaaucgcggcccaaacauuuguuaaaauaucagcuaggcggcgaggcagccacacaaaggagaugaaacgauuccuaaaauguacucccugcaccugaugagucguaaguaaggaaacaugaauggacccaagaaacugcccugccucagcaccgagaccacagaucgggagaucacagaaaaggaaggauucugagggagauggggcuucuucaagggcaugaugcuuuuagcaagguuuucaagaaggcagaggaugcucuuaugucaaauaggguaggggacaaagacauuagaggccuacauaccugcauggguagggcauggcgagcaaagcuuggacugccauuacuggguaugggaaucucagggaccaggguugugaggcuggaagaaagaaccucuagcauuugggaaggggggaugggaacauacagagagcaugagaaucaccagcucuagagaggagggguggauacuuuugugagaggguaagcucagauaguccuugagcaaaucuaguguagaggagaaaguagauuugaagaaaagaugucuacaucuuuauacccuugaugugguaagcggcaaugggcauuacggcagagguauaaguauaacauaaauugucuacaggacucuggaaauggagugagugaagguuucugaacacaaggcauuuauuuccaagcuaguaggagggccaucacacauuuucuuuucaacauagagaauguuaaaugaauggcucauaacacaagaguguugggaggaagaaaaguaugauuaugaaaugcuugugaaagaaauuuauagcuaccuuuuauauaauacacuaugguauauuaagagguuuuaguuacauguuuaaaauguuuuuuaucauagccgccuaugugaccacaguuaaauuuuccguuuuauucccaucgcugagaacguuuggcacacaggcaaauuugugucaugguuuuagaagccuuuguaugugcucacacuccagucccucaucccuaggcucuucagggcauaagauggguacacucuacugaucccaagaauaagucggggugauuucaguaagucaguacuaggucguagcucugaaaagaaugaucguuuuuaguagcauacauuaauuacacagaguaagaaugugguauuuccaccacacaugcauuuacuaucacaugaccacauucauggccucuguuguucauaugagaaaauucuggaaucgaugaaaaaggacggccgagugcacaggcgaaaggcaccgagauuccgaggaagagcuaguuccagcuaaucuucgagauaaagcuggaagggguaguugggauuagacuaugaugcaaugcuuucccaaagauccuuacuccacgaauaagagggagccauggagcagggauggggccuuuacuggcacugcugaaaaucguggggauuggccuagacacauuagaagacuuacuaaauacaaccuuagcacggaccuguuuuccauacagccauagaucuuguaagccaucuuuucccugugagaugagauaggggugcaugcugcuacucacacgaagacuucugguugcucuuaagguuguuguuacuuucugagaacucagucaagugagcaaaggcugacuuuccugcauuuucuaucugcugggguagggaguacuggaauacacugcacacacagaagucucugguuauugugaacucauuuagcucuucaauaaaauuaggccugcauucgagaagaguuuuguuggugaugguguuuuuuuggggggauggggugggggugggggggugccaggacuucugaccuuacaacuaagaacagaugggaaugguagcucaagcucccaaaaaagauuuggcuacaaccgucacauauguggcggcaucagagucccagucuucaaagagaaauauuuugaaaauucucacugauuuuuggcaagaguagaaaaucuugaucuuucaguucuuuacaaaaacaacaacaaaagacuaacaauuuuaaaaccugggcauuaagcaacuauuuaauaaagccaaccaaugaguuggguuccacuauaacucaccacggggagauuaagggaaaccuaagagcugcaaacaagccauuacgaacaguuuauugugacugaacacaugauuaauaaugaaucacaagcaaagcuaugaauggcaaccaacaggaaggacucguuagguuaagaaucuuaucaugacuguguuauuuggauguugauuugauguccucaaugguaacaauaagaaaaguaaauuaucuuucacacagugaaauugaguuggucaaauugcuaauuauauauauauauauauauauauauauauauguauauauauauauauauauacauauauauauaauguauguguacauuuuaagguccuuacaggcaaaauagaacaggcuaagcccaucagggcuuuugauggggagggaggacuuuuaauguugguuacacuugggucuaccugcuggcuuuuugauuugugcugaauucucacacccucauuugcagcuuauauuuucuuugucgcauauuugcuuuauugcuuuauugcccagagacacagccgcugaacugaaucaauuuuacaagcugcaauaagaacagcuccuugaaacaaauacaaacggaacgaaccguucucaccauauguuucacguaggcccuucacguuuccucccaaccugagaugcuuuucaaaaccauucuguuaauguacauaugugauucugcaaucuuaaaagaucaaaaaaaaaaaaaaaaaaaaccaaacauacgcugucccacaguccugaauagacaaaugggcagcauuuucauaccuggaugcuaaacacagacagugaaacccuuuccaugaacaaagggauuugagagggaacaugggcucuuuuuaguugcaagccuaagcuuuucuuugccagcuccuugcggaaaggccaacuggagcaaaguccucugaauuuuaaggauguguuucagugagcuucaccuuuuguggucugucucuccucuuuagauacacaagcaugcuucaugcuuacugaaugaauacuaaugucuucauuaagcccucauagagaagcauagcacagccugcacuuucaagaugaucagaagaauccaggggcuggggagauaguucaguugguaaacaagcaccaaggcccgagucugagcuccagaaccuaagugaaaaagcuagauguguuggugaguguucauaaaccuaugcuggaccgugaaaagagacagguccccagggcuuguugggagccacucuagccuaaggauugagccccagguuccccugagagaccuugucucaaaaaccaggauggauggcuccucaagaaugacacuucaagggaaaccucugaucuccacguacauaugcuugcaugugcaugcuugcacaugcaugcacgcacaugugcacacacacacacacacacacacacacacacacacggacauggacaugacauucccccaccacaaaugcacaaaauuagaagcaaugagaagcccaugauguuuugggcccuaucagauaacaaagaaacaugagcugugaugcagcucuagagcaaagccugcuuucguuucuccuccaucgaccuaagucuguuaguggauuuuaaaccaggaauaaaaagaugggcaauggaucuguggcgaucugaaagauuaggcuccuucccucucagagagaggcaguggggcaggaucccagauucucacgccaaguucucuuuagguggagugcacgcagcaucuccuuuggaguuuaugugccuuuaccacucccuccugaagguguuacugcuaggagggguggauggggcucccuacccuaaccauuagcauuucucuuaucucauuuccagaaggaggcucuuggaguccaauuucugauaaaaaaaaaucaauuuagugccacugagaagagggagcaggauaugggaaggagagaugagguggcucgcuuagcauccucucugccaguuugauguuccauauuguuccagacugugggucagacgugacagugccaucacaugagaagugacauucagcagucucagcuaaugaccaaagagcugccuaugaucguggggcugcugugauaaguuaccagcgcuugaagguaagugaugccuguccagcuguuggccucaucaggaaagaagugaacacacacacacacacacacacacacacacauccaaggaagcccacaauaaucaucuuguaaaagagcgugauuaguugugauucugagauagcaccaggauacuccacaccugucucugcucggaagauacucaagaugaugaagaugcucaucagagcuggcgagagcuccgccaccucaguagccggucuccucucgugaagaaaagacuucugaguauucaaacagagacccaaggaagugagguguuuguucaaggucacuuggaauucacagaaaaacuggcaccaaaucugggacucuugaguuccaguaggcuauuccuucccccaaugcaaacuggagccucugagaaucacgcuuugaagaagauugguaaaguaacgccgccauuucuuuugggaucagccuuuucuuaugauaugauucuuuuccuuuuuucuuucuuucuuuaaauaaaaaggacuuucuugauuucacguguuuaaaaaugcaauuaacacuucaaaucuaauuuucuuuucugucuuuuagugauuuuuuuuuuugagagucggauuugcucuaucacuucuuucugaagguaggaguuuaagugcugguuucuuuaucuauacugugugcagccacgcuucgauguaauaagauuuuggucugguuaugcugacauucaaguuucuuucccuuaaagugaaacuaaugcccuugcuacagcagcagaagggugcaggccaggaggucagcuagcuugagcucagaauccauccuccaaccauuucucagcguuuccucaucuauuaggugagaacacuaagaccucucucucucucucagaguggcugggguuggauuugaagucacacaaggacuggugcagagucggcucucagcccugucagcagccaggacuggugagguuaucagagggaauggagaaguaacuuuagauaauugcuguuuccacuagugggccucagucagcuucacaaugcgauagguguaugagacaucaccucuaaaucugaagagacuuucucauccaacauucuuugcuugaguaaugcaugagguuuuagggauuaaugggaagugaguuaauagaaaugagccuggcauucuaaaaauuugcuaaauaaauaacccaagcguguuaauaugcucuuauucccaagcacgggccaaggacgagcagucucucugagccuuucauuggcucugcaggagaaccccaguuuauauguuacauaaauuuaggacauagaauucugaaauguggcaugggcagugagcaucuguaagcauugaauauuuguagagacacacuccccaugccauuuauccuuagggcuggcuucccuguaacagagguaccccugucacgugacaugcuuuaggggugggggaggacuuccagguauacccacauuccagucuguaccaaguguggacuuuacucccccccacacccccaucuuguuaguaaauguguauuaaccauaaugacuaauaaugaagagguuuuggccucuguugucugagaagaaccaaacagcggguguuuuugcagcucagcuggacccuggcuguggugaccucuguugcuaacgggcucuccacaggcggugagcaggaggcaucagcuaugcaaauuagagcaaggcuguucccugucagcugcaggacucacaggacccugaacgcaacccucgugagacuuugugcuccacuccuggcuagguggcgaccuugaucaugguuaugacauuaaucuuuuaacuccucuuagggaggcaugacaauuauuugcuuucuaaaggagguauuaaguguguuuuuauguauguucaacacuuaauggaggagggugcuauaccuaaaaauuaaauuuauaagucucaaguuaguucgguucauagauauuaaacaaaaaaggaauuuuuuuguuuguuuguuguuuucaaaacaggucacucuggcagguagcuggaaaagcaaaauaugugggcaggcagugaggaaggaaaagccaacaaagguaacugaaaaaccucuggagguugccaaacaguccacagauagcaguacguucuuuccccauggucucuacaauagucaucuuaacagaagugauccuaguaugaugguuuaacauuuguguuaaauaucgguaauauuuuaugcauucagguggggguggauguaugcagguguguguguguaggcauguguguauaggcauguguguguguguguguguguguguguaggcauguguguguaggcauguguguguaagcauguguguguguaggcguguguauguguguguguaggcauguguguguaagcauguguguguaggcauguguguguguguguguguguguguaggcauguguguguaggcauguguguguguguaugaaggcuugagauccacuucccuuuuuguuuguuugcuuguauguuuguuuguguacaacagggccucucucugggaccugaggggcuuguuaaccugacuggccaucgagucuccagcaccggccugucucugguuccccaguacugagguuacaggcgccuuccauuaugcccagucaugucuggggcugccgggggccgagcuucugcuugcagggacagcaauuuacggacugagcuuuccuucuacgcucccuauuguuggugauauuuuauguuacuuacacauaccuccaggauaucaaauuuauccugaagauaaaaaugacuauauuuuuuggaaguggccuacaucaugcugaucacaacacuaguauuaucugcuucaauacccaggggggaugucugucucccccacccucacccccaaaauacucccuauauuccuaagugggaggagcuugccugguuuugcuacuuccauauagagcuggcucuuuauagacaucugugcugguuaagcauauaugucaguuuacuugguacauggcauccagguauguggucagaagcuaugaggaggcucucugaggguguuuuugaacgagacgaacauucguauuacuagauuuugaguaaaggccuucugcacaugugugggcuccaugcaaucagcuggagacuggaauagaucagaagacugaucuuuuuugaguaagagaaauucugccaucagccagacucugggagugaccugcaaacguuuggacugucuagcuuuuauaacaccauagacagaugccuuaacacagagguucucaaccugugggccucgaccccuuugagagggcccuucacaacggguggccuaagaccauggaaaagcacagauacuuauauuacgguucaugacagaagccaaauuacuuuuuuguuacaguagcaaggaaaauaauuuuauggcugggagggucaccccgacaugaggaacuguauuaaagaguugcagcaugaggaagguugggaaccacuguauuaaaaagaauccaccuugaucauuuagucgcuguccauuaguuuugauucucuggagcaaauauggccccagucaaagucugcugaccaaaccguggcugcacgcuuccuuccagaccuucugcguuuacccaggaccacugcauccugcuuuauaacuuccccagacccccaugcgccaagcccuucuuuaccacccauuccccucccgguccaggauaagcugcggggugcugcuugggucuuaagcacaucccucccguugucuuuccucugacccaaccaagcaucuugaaccaaaucaggcaucuuccuacccagacccuguuguuucucugccacucuauguuaaugguggcuaaccauagcuggguccccagaucgcucaaaaacgcuuuuccaaaagucuuacuugggagaagacuucucuugucaucacggagcuuguacuuuauaaaggagaaggaaaaaagagagggggcgggcauacaaaacagacuugcugggucccugaggugaauauaaaggacuaaaaaccagauuucaaaaggaaugagaaaggauucagguauguggaaggcaagcauggcgugcagccuccaacagcuucaguggaaggagucaaugcuucuaagggggagaccacacagguaucuggaggcaaaaaucaccuuuaaguugagguaacaacaaggguauuuaguuaaucuuaguccuuuggggagaugauagcaaaaugcuguagacuuuaaacaauccauauguauuucucaugguucuggaggcugaaaauccaagaucaagauggugaccaugucuagcaccugaggaauggcagcuucucacagcaggcagucuuuaaucaucucugggauauucccuugcuucagucggggaaugaggauuuuaauauaugaauaggggcauaaccauucagacugccugcaggccauaggguaggaaccucuggaacaaagaccagugugacaggugcugucccuguguccuugagguacagcauucgagucccacugccaucuccaaccgaucccuaggaacaaggugacucacugggucuuuucuggucuuaucuccaucuauuuccuacacuuagguagaaagaguuaucaaaaacgcagcuguaaucauguuagggggcacccaagccuuccuucuaccuaucaauauuuccauguaccuggguuuagcucucgucucccuggcucuuguucuccgcucuaaccccuucuuucccgucuugggugcauggcuggagaaccugucugugacucugacugcacagacuucccucugauucuugugccugugugacugacacucccucucugggaacaaaaccccagcugccucaucacucacggcaacuuccucauccuaaggaugguucuaagcaaggauggggagucacacuuuucagaucugccagcaucuagcacguccaugcacaggagugauccauaaauacugcuugaccaaaugaacauacguaaagguugaggggaagaagagcagggugggugggggaaauacauguucgaaacugcauguaaccgccucuaaagaauuucuuguggaagccagccaauaaccauuugugcuguuccaucacuguggguuaggauaaauuuucagguccacuagauuaccugggucccucuuuagaggcauuggugaaucucaucucaagaagagacgacucugaugucauuugaacucuuuagugcacaggaugcgagaccggcuccaaaacaaaaacaaucucaauaguuuuagagacaaggaggauguaaucuacuuccugccucugaccacaagagaaacaacauaagagggcaugagaccguaauuauuauuauauaggcaggaaaaagcagaaccaagaugaaaugggaccagaugcaaucaguggauaagaacggggaaguggcggucauuuuuuuuucauuucuuuccuacacuucuuaaagaaaauuacguccagaagaauaaaagucaguucucugccugcauauuacuucuuaacacuucugccauggugaaugggaggcaaagccuucuuuguauccuccacauccaaagcuacuccuggauuauucaucggaguccgcccccucuuagcagacucuccagcagcuccaucugauaccucuuuuugucuccugccaccccugcuuaacacacacugauagaaugagaaaugggcuucagccgcuccaggugcuuaguuagggucuagaagaggagaaagcccuagacucagauccacgaaacugugauuuaaauuagagcacauuuggaccugaggggggccaugggagaggcgccaagugugggcagcacgcugaacgggaacacugguguuaggugugggcugcugggaacgucccaggcgcagcuugccucauguuacagacuaagaauccagcugucuggagguggauggugcauauugcuucaaaaccgucagcaggaugcacacguuggacaagaaaccucuaaacaaugucaugggagcaccggaguauucgaauccaggacuauguaggugaggcauuucccaaauuaucuuaaauauugaugaugcgacuaaaugccuacuuguauaaaacguaccaaaguuagaaaacuaacuuccucguauggaaaagaagcaagggcugaggagagcugaaaucacugacagggacagacaguguggacauacacugugugugaggccugggaaaagguauuauacccauuugguagaagaacaccuccaaaggcucugaagaugcuaagggcgugaccaagcacaugaagguaagugucgguaaaaaagugugguuggcggugcccagcagcaaaauccaucagcagggcggagaagccaccuccacagguccaucaucuuguucucuugaagcuuccucaaaccuuccuuugucucugagagugcguuccuagaggugcuuucugcaagcucuaccaggggagaaauuggguauuuccuuucugccuuccauggagcucaguggauacuugaugcucugcauagcagagauggagagaauggacaaucagugacuggcccaaacugagacccaucucaucucgacaucccaaugggcaagaaccagucccugacacuauugaugauacuuucuuacgcuugcagacaggagccucccguuacuguucucugagagccuccacccugaagcucauggaaacagaugcaggauccagagagccacagccaaccaugagauggaacucuaggggucuugaggaagaguuggggggagugggggaucugaagaggacaaugacuccacaggaagaccaagagaauccacuaaccuggaccuuugggagcuaccagugacuaaaccaccaaccaaagagugagcaugggcucgaccuagcucccugcucaccgcccacccaacucccuacaucuguagcagaggugcagcuuggccuucaugugggucccccaacaacuggaauggaggggcuaccccugacucuguugccugccuguggaucuugguccccuaauuggcugccuugucuggccucagugggagaggaaacacccaguacaggagugacuugaugugccaaaagugcuggugauacugggggguggggguaggggugcuccaucuucucagaggagaaggggaaggagagugggggaaggaucuucugagggaaaacuggaggagggcugauauugggauauaacgugaauaaauaauaaauaaauauugagggcccuagaaggaguuccugccuuuaggacuacuuucuacucaggugauaaucuguucugggguggaccagacaugugcugucacuccugggauggaaggagacuucuggcugggagucagggcuccugagucagagcaaaacuguccugaccuagguaacaaagggacugugagagucuggauagggcugugaccuggacacacagcuagggguggggggcagggcuuuuuuagucuuggaauugucaauuuucaugaaaaugcaaacaacuugaucccuuaacucuaggggugucagagaguuguagcagcuaucucuaguagucaguuuucaaauuaaauuuuauagcauuuuaaaacuugagcuaaaaagguaaauuuuacacugguuuaauuuggccuaccucccccucccccaacccuugucuugggggcaaguggaguuuuaaaacacaaugaaaucauauccacuaacacuuccauaauaacuuucuuuuuuugguuuuucgagacaggguuucucuguguagcccuggcuguccuggaacucacuuuguagaccaggcuggccucgaacucagaaauccaccugccucugccucccaagugcugggauuaaaggugugugccaccacacccggcuccauaauaacuuucuuaugcaaccaauagccuucauuugaaaccuccuucacaggaagaguuagugaugaaauaugcccaagucuugaaaaccagaguggugucauccagagagucuugcuugcccucuuuacuuuuguauaguguggcuaaacauuaugagcugggucucagccuugggccagccauaaggaauuuaagggagcccaugucucaacagagcaaagauauacccagguaucagguugauucaaugagaauugaucaauucgaggccugagaugcacuuaaagaggccggcacaagaaugcuuguuaugggcgugagccugcuuacaggguuaguguauagagagcuagauucuggucacugguguauagccagagcaaacgggucuuagagcaucaguccuccauacuacacacgguguguggagcugggagucuccagcaucaguagugccugcagagaguguuuggccagaugaagaacccgaaacagagaguucuggggaaugugugucuuuucuuucuccuuccacccauccucucuucacuucuuucuuuccuaauagaugagccauuucauucaggauggccugggggaagaucugagggccuugggagccuugcugggaacuaggaaggacauaggggcagggagagcugcuaucccacccaaccccucaguccucaguuaaguggaaugauggggugggagggaguggugucacauucucuuccugccagugauugcuccuacaacaaaugcaagcacacaaguggcucgacauccaucucccaggucacccucugcaucugugcuugcacccagggagcagggcccuuaggacaaaccuccacugugcuacgcucaauggguaccaggcucugacaggcucuacaggaugcuuuugcaucacaauaacaagacaagucccucguggguggguggcuuuacaguuuggugcagggccaugccagcccucugaugacaguguuggagacagggguggcaaagugccauuguuucauuuucguccuuucucaacuaauugaaguuuccugggaccucuugaacuaacugggucuuaggucugacucucucuuaaaaaucugccucagagaaguggggggggggguggaagggggaaggauugugauggggguaaucaggagugggguagugugcuggauguaaagugaauaaguaaaaauaaauaaauauagaauaggaaagaaaaucugccucagagacauccuuuccuuucugucaggaacgacuuuaaaagucugaauuuucgcucccuucucgggcaaccuaaaugaucuucgaggcucuuuacagagaacauuuucgaauuucaaauuucuucuuuuuuuccccaaaucaaucgcaucuuggaaagacauuacuuucuuccauauaaauacugucacccaaaguuuucuccuguccaccauaaaauauggcuuauauugauauuuuaaaaagcaggauauugccaggcggugguggcgcaugccuuuaaucccagcacucgggaggcagagguaggcggauuucugaguucgaggccagccuggucuacacagugaguuccaggacagccagggcuacacagagaaacccugucucaaaaaaccaaaccaaaccaaaccaaaccaaaccaaaccaaaccaaaccaaaccaaaccaaaccaaaccaaaaagcaggauauuuaaaguauaaguacuaaucuugcauauuaauucacuuacaguucuuacuaaggcaaaauacacaagcauauaaaagcugauagaagaaaaguugauagauaugauaucaguauugaaccagugagcaacagaagcccacugcaaugaaaaagucuugcacaugucaagaggaaaugugaggcccaguugaaauuacagucaacgucugaucguuacccuaguuuuucagugaggaccacuaaaaaccauacgagaaaaauuaggaacauuuaagcacgcaaacauuucaaacugucauauuuaaaaacaaaaguuuccccggaaaggguggccaagaagcagguagacguucuaaagaacaauauauucucuguuuguuuccaggucggggaugaagcucaagccuuagugcaagccagacagauacuaucgcugaaaacagcccuaguucgagggacuagguugugaaacaacaaaacaaaacaaaacaaccccuccccacaaauaccccaaaguacauucuuuaucuauaaacuuuguacaaucaaucuaaaugaugauaagugaacuuaucucuucagugggaauauauuccuggaauugaagcaauuuaaacccugaucauuuaugagugguaauuuaugugagguaguuuucuuugcaaugcuaaaugauucauuaucuucugucacauauucugggucuuuaaggagcaaaguuagguuuguugguuuuuuuguucuugcuuuacacgauuaaaacuuaaaaaaaaaaccccacugguauaugugugugagugugagcuugugugugugaaugaaggugucuguagagguuaggacaggcugcuggucuuccuggaacuggagugacaggcccuugugagaaacuugacaugcuaggaguuuaacaugaguccuuugaaagagcuuguucuuaaccacuaagcuaucuuuccagaugccaauguuaaggauuuaaugaaagaugaguucuguaauauuuuaauucugcacagagauguagagggaauucuaguauguuuacaacacuauuuaguuuaaguacacucuguauuuagcacuggacaucagagcccaucacacauccuguuaagccagugauauaauacuuccaaagauuauuccacgauccaaaauacuuccaaaggcugaauaaaacaguguuaaauucuuuucuuaaaauuauauauauugaagccccuaacuuuccccaguuccucugaaugggagaguauuuggaaacagcgucucagaagcaauuacuaagcuauaaugagaucaacuacaguaugaccaguguccccaucaagcauaugagcacauggaugccaguggcugggcacugaccuugggaggacacaaugcaggugaccaucugcaaaccagggagaccuguuucagagaagacaacaugcuaaggucuggacuucagcuuccagaauggugagcaugcacacccgaugucugugucuuggucauggucauggucauggcagcacuaguaaacuaacacacuucacuaaccaacacuugcucucucccucugaccucugugccgauguuucccggacguaguuucuucuuaaucugcuaguacugcaggugcaagaacaucuaggucuuaggauaaguaucuguuuuguacaaauacacccucccguguguaucucuuucuagucugcacaggaaacucaucccgauuccccuaauccuaugguuggagucuucagagcuucaaucuccuagggauggaucccugccuuggcuuacaaauccucccucucacauacagucacaccauguuagaacuguuuccauuguugacuucuucacaaaagcccguggaugguaugaaagguaagacucacacuguggcccagaauuugacaccuaggaucuacucaauuuguugaguaagaaacacagugacacaaaaauaaaaaaauuaaaacaaaucauaaaaucaguggcaagaaauggguauuuauucccgaguuuauuaucggggaagaaguagaaaauguagaagcagagcccuuuccaaguggagagggcuacaucuugacacagacuugguuaggcaaaugcucacuugggggaaggcaucagggggcaauuguuagugcccggcuuaaaaacaaugcccuccucaugaaguucaggaacucaaagacucaaagaauacuucauaugcugcugagaaaagugcacugucgagagauacaaauguaacuacucaucaauaaacagaagcgugagaaaaugggaacaggcaaccagacauggccuaauguguccuggcuucucaagggcagcaaaacccaggagcuaauguuagugguuuugaagaaccagccugccucuaucuucggcuuaaaagccaucuuauaguaaaaacaaacuaagguccauuccuguugauggcuaaaccucuguuucuuaaggauugugcuaugccccagcuguaaccauaacuaccaaugguucuguacugccuguuccaggaauggcaaucacgucuuuguuucaaaaaguuguuaauaaccaucuugcaacccuaccuuuguuucaaaaggucacuaccugggauuaccuuguuaugaucgccuguuguuaugguuaacuugucauaucugauuugcaaacauaucuuuguuuucagaggcuguaaggacuaacuuguuaugaucucacuuauuuucaccccagacccccugucuuagucaguguuucuguuccugcacaaaacaucaggaccaagaagcaagcuggaggaaaggguucauucagcuuacacauccacauugcuguucaucaccaaaggaagucaggacugaaacucacaaagggcaggaaccuggaggcaggagcugauguagaggccauagaagggaugcugcuuacuggcuugcuuccuguggcuugcucagcuugcucucuuauagaauucaggaccaccagcccagggaugguacccacaaugggcuagguugcccccuuugaucacuaacugagaaaaugccuuacagcugaaucucaugguggcauuuccucaagggaggcuccuaucucugugauaacuucagcuugugucauguugacacacaaaagcagccaguacacccccuauuuggaaccccgcuaccccugagccauagaagccuugccuuccucacauccaaagcucagacgcugaauaaaauugcuugcuuuaauuuggccaugaugauuugagucaguggucuuccaccucccaucuuugggauuuacaguuuguggaaggccggaaaaggccagcagucacagggcacugggacacaggagagcccuguggcuuaauaugagaugccaggugacaggcgaugggagacagcuucugcuucucauaccguacuacccuggccuuacacgcuuuuccucuagggggaaaaaaaacccaaaaaacgaaacuagcucauguaagaaacauagucaguaagaacccaaauauuuagucacugcagaacaagcggcaagaagagaacucccauguucaaacaaugaaagagacccuggcaaucacaauucggcaaguuugcaauacugagagcaaaaaaaaaguguaacaucuagcgguaauaaacccaaaaguaauaaaaagcugagcuuuuaugaagggaaaaaaaaaaggcacaccaaauuugauugcuuuucagauagaauuacaagauggcuguuuuaagagagaggagcagaugugauauauuugaauuuuauuagagcguucggaagaacgucucgcacaauuuccuucacaaaacacagugacuuuggcuugcacacagaccgagggcauaauaaaugaugggaaacaagagcaccgccagccucccucgagggaagguccuacagaggugacggggcucccguuugggguggacugaacagcuuuucuuaauggucugugaagaaacaguaagaguaucagacaggaagugugaagauuuauugggcagggaguggaaacuuguuuaaaaaaaaauaccgacgcuuggagaaaaaaaaaaugagaccuaacugcuuagccaggagaguaaauauauuuggaaggauauuuaaguaaauauaaaugaaauuaauaacuaaaaagaacccaggagaagcaguuuuccgugaacucaaacuggaggagguuuuaauaaucugugccacaugcugaugaagaugcaguauaucuauucggccccucaaguaggcuuuugggauccaagggacaaguuuuauucaucuuugggucuaaccaucgugcuucuuaaauagguuuggcaacacaacuuucagaguuuaaaugaaccauccaggggcagagacaagaggucuacagguccuccgagaugcggucugcacuuugaauuggguucugccgcacugacuucuggguaaaugggcccucuuuggcgcagacacugcagccuugaagaguucuuugggcauccguguagagauccgcugcuguuacuacuacagaagucucuccucaauguuaaauuuaaaaucacuuaaauaaacgguucuggguucgcagguucuggagaaagaugacuucuuccagacuugaccgcucaucgguuuaugaaucuggaguaaauuuguagucguucuuacugaagugauggagcaguggccuggggccaguuccaagggaacuuauuccaguuacuucacauuucagugccccaaauccuugucuuaagagggauaacauuagugucuaccucauaggacuacgaguuaauauuauguaaagcucacagagagcugucuauaaauacuagcuauccgaaauagacucccugugaguagccaacaaauuugagggauaaauuucagagaaaauaaaaauuuuauauauagcccugguugcucaucaaugacugugcacucaaaaccgaaaaaaaaaaaaugaauuucauuucauucagauuacauaauggaaggaugagccuccaaagcagaccaugaagucuaaacgucugagauagggaggugauucuaauccucaucuaucuccuuaguugugugcuuuugugcacaguggcucuguggcuacaggguaaggaugcuuccauguauguaaccuuacagcauuuguagaaaaaaaaugguaugaaagagauuuuuaaaaauaaauucacaaggcuacacagaccuuaaaaaggaacguuaggaguuaugauaagcauuccuuauggugacagcggcacgaccuucagacccguguguaacuccacggaaccacagaggaguccgcuggauaccuccaccaucuguggaccucaggccuccuguccuucuccuagccuccgaccuugcucaucuccacauaugugaggcaccagccucuagcaauccugcccucgucucucuuucagauccguguucacagcuuccuuccgcauaagccagcucagguacaguccuugcuggcguuccauccaaccucaggaggagagggaaccgcucccaccuuguccccuuucagucugcuccucuggugucacaauaaucuuucugcagagcuggcuucguaaauucucuuuaacccccucccccucccccaacccauguuucccgagcccuuugaaacaggccauggcacaggcauuggccuuugaagacugaaccccuucugaccucaacagcuccccacuuuuccacucugcccugaaguacuaccggcucucaggaaugucucuguccggauguguuuuaagacacgugucucccacccucuuccuuacuucuugccuaggaccccaaguccuguacgucuagaaggaagucuuccugguccccucucgacuuuuccuucugcuucauucaucucucuauucuggcuguuagcauacuucaauggaacuguuuacacaucuaugagaacaguugggaaggguaggguguuccuucucucuguugauagccuggggcacaucauaggcccucggguauacacugaaggaauugaucuggaccacuuaaacuuggagggacucuaaaggccaaccugggcuugugauaaaaaaaaaaauuagacuuguucugcgaucagcaaauaagagacgaaaauggccuauaaaaggaaggcagugguaacauuauguacaccuuuccacaacaagcuaaggaacuguuauuauugcaaagggcaaccugguggcugguggcugguggagcuucaauucugcuucuguaguucaucuggccuggaaacugugucggcuuaggucaaacuuuauaagacaucauagaagucaaaggagggacuguauuaaauaaaaauaacagcacaggaugaggaaacagaaccaaaccgacucuugccaaugacagacucauccauacccucuuccacuuugucucuugaaucauuucccaugaccaggagacuggaauccaagagccucaguucucacccgguucucacacucagucagccacacuagaucaucggcgccucucacugcuacagcacugaguggucuucgugccuucagcugcaguucucaacgaagcucaccuaauccuucauccuucccucaaguuuuccaagugaacucuuggacauguacucauucuugaguacaugucauaacccccacauccucuggggaaccucuccugagaucacucuucuauaaagcugacaucccugcucagugccaccgauguacuuugugauccauuuggucacaggguggaacauagguacauugauaucugucacuuucuuuccugugugauucuuucucacacaacaggucuucuaugacaugguacccugagaucucaguauaauacccgguucaugcuaagaauucaaauuuuguaugagguuguugaauucacauggaagagaacgcuuccucaaaaccuaaaagguaaaacugaucuuugguuugcucuggcagugagacaucacuaggaggaauuaagaugaucauaacugugcagaaaucaguagcuacaaagguaccaaaauuuuuuagguaaauaaacagaaagaacaaccacagaaaauaauuaucugcugaucuuaggguauagguaugagucacaugguauuuguagaucauuuucuuaaauguucaccgaagcguuguaaaaaucauaagcaaccuuuuagaaguggcaccaguuugcaccagguauuuaaacccuaccuucacugugaguuuauucagaguaauugcacaauaaagaaaagcacuuggcuucaggucacuaugcauauauagcuaaauuaugcaauuagaugacauguaauuaaccagaaucacaacacaggcaaucugagggggacaguuagggucugaaugacucauaaaaacauuccguaguuaagugcuaagccaaccacaaggacacugaauugcaggugacccacagucuaacuagucucucgugugacuaaagagauuacagaacaaggucucagagacggggcaaugucuaugcaaauucugcccaaggaggaaccgaagugcaucuugauucuaauuauccaaaucuuccaacaagacuggaaaccucuucaaacacagcacagccaacaaucucuggcugaccccgagccaagaacgagagagaaacaucaguaaaguuuuguuuuuuuuuaaucuauccaaagaaggugaugacucuaggcaguguagcagguugaaucuugguaagugcccgcuguccaaauuagcauuguucuuccuuuuccuccaauggcuaaaaccugagaagcaggaacagccacagcucaggguugcugggacuuuuguaaggccugauguuuguagucguaguuuuguuuuguuuuccugggucacugauuuuguuugcuccaguaagacaugaacucacuccgccuuggaaaggaccccagauauggauaagaagacauucuuuaggaacugcucaguuaccacgaugcuuccccucucccaccucaugcuccucuccucuagccccucagccuuuugugugucugcagagaauucuaggacccgcaaaugagagaacccaugacauguguccaucagcaucuggcugguuuugcuugguaugauggucucuggcugccucucucagugcuuauggugaaagaaaaccccauuguuugccacauuuucuuuacccauucaucugcugacaggugccucggccgauuccauaacucggccaucgggauuagugcugaagcaaaccaaguaaggaaacgauccuuuuuaucuuaaaauauugagaggggggagggaaacaacccaauuucuccucuuaauuauauauugauuccuuacucccugagccaggcucauuggaaguaccaaggcacagaagacccuacgugccuuuaaauaguuuccagucugcuggggggguuaaacucuuacucacccuucauucccuucuucaaaaugucucuaguguauauuuacuaguguaugauuuacucugaugcuuuagguaauaguuauuucauacacuguaaaccauaaauacauauacauguauuuuucuccuaucuccaguuucaaucaccauuuaaauuuuuuuuucuagcaauuugaaaaaccuugguugaaaauuccauaaggguaucugcaagcugucugagaagaugggccacagaaauauuuaaauauaccagcucauagucugagaaauuaaagauaggcuucaggcacucugaauauugaacaaaagguacuuauuaauacauuaccuggcagcagaauacaaauuauucuuuuuugcuuucuauuuccuauaaugaggaugcaugaucuguuuauaaggaagagaaagguauuuuagucauaaaagauggaaaauccuuguucuggguuguagccaaagucuggcuacacuggguaggcugauagcuccucuuuuuuugaauccuuaaagagaccgucagccugaacuccaaaaaggcccacccaagggcucugcagagagcaaagucuauuauaacugguggucaacucaucugugaggaagcccccggagcggggcgucuuuguccugccuggugcuagaacucaauguguaacgggguccagccauccugccugugugcaguuaguauucagaaagagagagcaggaguucuggaagaggggaugggaggcugcaggcacacggaguucugagacuuuugauggaaaauaaugucaucauuucagugaacaaaguuaaggaggccggaggcacagagaugaggugauugauacaguaaccagugacuucauucagcaauuacuguuggacagaaugccucuuaccagaaguggugcuuauaucaaugucccaucaauaaauccagucuacacuucaguuuucauguaugggguguuagggauccuauugcugugaucaagcacuauggccacaaagcaacuccaggaugaacggaguucuaucagcuuacaucugagguccagcauaaaggaagucagggcagaaguugaagcagagaccaugaaggaaugcugcuugcugacucgcuccucauggcuugcucaguuugcuuucuuauacaguuucucgcccaccuucccagauugcaccugcccacagugggcugggcccuucugcaccaaucauuaaucagagaaaaugugcgauaaucuugucucuacaggcugaucauauggaggccuuuucucaauugagguucccuccucucaaaugacucuagcuugugucaaguugacacaaaucuaggcagcccagaagagaaauuuagggaccuaaguauuuaaaauggaaaaaaaaagucaacagaaucaugauugaagcuucuuaaaugcagauaguaagaaagcaguucuaacaaauggggcauggguucacccagcaucugagagaggugcccacuggugcugugauacaguauucagccacucuagguuugcuucagacauuaacuucuuguucagacgguaauuuugcagaucuacauggucuuaacuugggggauauauuguccucuggggacuagggaaguguguguguguguguguguguguguguguguguguguguguguguguguguaggguguguguaggucaaaggacagcucguaagagucauuugccuccuuccaccaaguggguucuaggguuggaacacaggccaucaaugguuuggugccuuaacuuaaccugccgagccaucuugcugggccuaaccuaguguuuucugagcaccuacugugugucugagagcugucuguccaccuauguagcuguuaguucucagaauaagcggaaggcagacauucucacugucucauagaugagcaaacuaggccucagaaagguucuguucagcaguuuucgaaacaugucuagucggaaaggcguagagcuggguacaucucaaaggcuguagagggaggccuccucgcuccucccuuuccucugcagaauggcagccgccugcacccaguguucuguugacacgauuauguaggaaacguaacccuucagccugcuccuuagcaccuugcucuuccuccuaccccacucucagucccucauucucguguguuuuugcggcauuuaagaaaucucugcugaagacuccuuuguaauaucugcaggucuucugagaacaaaugccauacaaacaauauuuaaauaaaagaucacagagcaugcuuaagcuuuugguauuggacagauaaacucucucagaauuuuccuacucucucuuucucuacccccucucuuccucugacaccacacacacacacacacacacacacacacacacacacauccacaaauuuuuuucgaucuaaaauguccuuuacucuuaaaauuauuauuuagcauuucucuccccuccagccaugauuuucacagugccugacuugacaacaaggagagcuacauacugacccucccuggccuuuuuucagccaugaaaaggggguuaaaauauaaguuacuaaugcacaaaaaccgacuacagccacugcugugcaaauguggccugccugugccugagaggcuggccuucucccagcuagacaccagacucagacuuugccucuucuuugaccacagagcccuuauuauuacaaguuuuuaagcucaaugugagacaaaaacucccuguauucagaauuuucuagcuucuuuaccagagacaggccaagggagaaaaagaagaccaccauuaauuaaaaaaaacaaaaaacaaaaaaacaaaaaccccaucagguaucacuaauuugauugcauaaacacgagagaacacggacaucaacaagggggaugcuaauguggaugggugaggaagcucaggaggccuugacccuacacaaagaacaaccugcaacuaaggaaugcugagagccagagaaaguguacuuuauuuaggaagagcacaccaacugguuauccaauaccaaauggucagccucgauaauauacaaguaacauuauccagauggggcagguuguauuuaugcauuuaaaaauaaaugcaauuacauguauguauguauguauauauguauguauguauaccuguguguguaugcgugugcauguguguguguguguaaguauaaaaaaaacuaaugaaaaaagaggccaugaauuugaaagacagcaagaagagguagaaggaagggcccggaaagagggaagagaaggcagauaugauauaauuauaaccuaccucaaaacaggaaagaaagaauuuucaaaaauauauuuagaagacagaaaaggaaaacagaaaguucccauuuuaaagaagagcaauuaaaacaauguggcaaagagaacagcggaacacacagggugcugacagcccauucaaauacaaagcaccuaacugcaagaauguccuacaaaggaagccagcagucgcccagagcuaguguuugguaaugguauuccaguuggaaacagaaauaugguggugcaugccugugauccuagcaacucaggauucgggaguucggggcaagauugguucuugugagugcagggccugugugaauguggucauugugugaguguggucauggugugaguguggucauugugagacugagauuuguuuuaagaggaagggggagggagacgcacacaugcacuagcauacguguguguacgagugcacucguguauacacacacacacacacacacacacagagacccuuaacaacacacaaguguauccagcuuuagaaaauggcuagguuccuaugaaaucccguauacauguuuucucuugaauuacugaaggggagaaaaacccagugaagacuuacaguaaauucuaaauuauaacaagagggagauuaucuuaaauggaauacagauauuugcuuugacucugcacccuagaaggcuuuuuuuuuucaauuuauuaaaaaugaaaacggaggcaaagucacuucaugcuuagcauuuaaacacugcccugguagcuaaacaggugacacaaagaaucacagcaucaacguuaaacugcucugcguauuucccagccucgugguccacauccaggaagauccgccccuuuccgugcuuuacucaagacugcagaaauucaaagcaaucaaucaaugcggguggcauuuacagcuucccgggcagaaggaguuauguuuuuauugacuguagacacuuaauuaguagguauuauuaaaaugcaauuuuccauauuaaacuguuuucuacauaagcuagcuuucuggugugcugacuuguaauuucgggguuaucuugaguucagccaacagauggguaggagcuugucugauucuccgggacauucucucugauaucacuggaaaaaggcagcuaaacaaauauuuuuccaccuuuuucucauacaugauucuccuguaagugaagucuuuuaaagacuaccuugaauacgaauguuacccacugugauagcucuuguuuuaaaaggggaauuauaucgcacuaucuaacaccauacgguucauggacuaauuucagacaugcuucaaacgggcaagggucaacagacaccuuuuuacaugacagcacaaaaugcuguuuugaccuuuuauguaaaaaagaugguacuuugauccaccauguaaauucuaucccgugugagcuucagcgguguuaugaugggcagaaaaugaaucugaagcauuucacaggauuccuuccauauaucaugaagcauccgagccaaggaaucuaugagauccaaagaauuauuaaggaggaaagccaggaccaguagcaagacaguuucccuucgcuuuuguagaaauucacugguuguaauuuaaguggcagauuucucuucaauuguaacuuuuaaaaaaagaccuuaaggaagacaccacugcuacuuauguaacacugugcugugcugcaaagauuccucagcucugaaccaaugggguuguguguguguguguguguguguaaccaauacauucugugaaugccuuuaaagaauguuuucaaaaucaccagcaacuuccagaugucaacuacgguuucugagcaauuaugcuacuggggaugauaggugauauacaaaauaauacuguguuguuuuuuuuuuucccacucagacaacuuccugacaucugaauggauggcacagcaaauagaacaucucucucucucucuugaacagaagccguucugugugcugcgcagguauggcgaggcuuuugaugguggucagccagcuggaaggaugaucaaauaaacaaucuagccguugcugcugugcgaggaaaaugagcauauacgguggcaaagauuaauaaucgcuuuuggaaaggauuaggacaaggcugucuaugugaauugccacacacuuuccuguaagagcacaauaaauauacguguggucuguugaaucauuaucaauauggaaugcauuaauauuggauauaaauaauugucacugaaaaaccauccaccucauguucugaaaaagcuauagagaucugccucguuaccuagcaacugggcaaguaacugccauacugcagagggaaaaaaaauccuuauuuuucagguagaauauucauaaaacugcccaggaagguauuaauuaagccaaaguauauacccuagugcugauuauaagaagucaucucuaccuaugguuugcguuuuuaaacaccaggaggcauugagacugucaacauuuagauuuaggauuugaacuggcagcaaacaauaauguuuugucauuuguuaagagauccucucaccaucaugacugacuucucacucucagugccucauggacaaaggcuucccaacaaccaacaagcugacuucuauuaaaagcaugacucuugcuuauguaaaaaugcaauuguaauuaguucauuguaagggauuccaaauuguuauauuucauacaauagacuaauguguauuaaauucauaauaucuaaagggaucugacucaguagcugaucuaaguucugcuucuguuuugcugaaaaucugaauuguaagauuguguauaacguuucuccagaagagaaaugggcuuaguuacagggcuuuugcaaucuaaaagucacucaaggcuagucuugcagucucagucuggacucccuaaucuagcaacauggcaagggcuuacauccaaaaaccuuccaggucugugugaccuggcuggaacacaacaggcccuuagcacacauagaauuagccagggaaugaaaaggagacagaagauuagaauggacugccagaguuaguuugaggccaagcagagcaauucagugagaagcccagagaagccagauugaaucagucagcuuggagaggagcuugagucagaacaucugaacuuaaccagccagccagcguucagaaacaacuagaaagggugagcuuagugagcaguaagccucccaggugacauuuccauguggugaauaaaaguuacuuuuacagguuugugauacacaauuaaggaaauaugcuaccacaaggaaagacugcucugugggcaguaaagaucugcucuugacuuccaaggcauccgguccuacaagccuugugacacuucugucacaaugcauggugcuuuauuuguguucauuacagugcaaagacacaguuuagggaugcuuugcaaggccugacaugguggcucacaccuuuaaucccagcacucaggaggcagaggcagguggaucucugugguuucaaugccagacugcucucucugcuaaguuucaggccagccagggcugugcagugagaccccauuucagggaaaauguguuuuaagauacugcauggaauauauauauauuugaacuaacccagacagaaagcauuuaaccuguccuacauuucucauuguuuuuuugaguuccucugaaauuacuaccaagcuuacucuucuugauuagaaguauuacguuaagugggguaaauaagucagauuuauugaccaaaaggagaauuuaaaaaaaucaucugaguuugguguggguuuugugagaggguuaacaauugacaaaccccaguauuauuaucuugaagauaaacaguugugugucuuccuuuuaauauaagaagaacggaaauguuuucuauggcugugaaaccuaccucuauuuacuuauuuaguauuucuagagacagggucauauuaggcugaacugaaacccaguccaguauuauguagcccauguuugucuugaguuuaugaucucuuugucucuuccucucaagugcagacucuacagguucagcuauacauauguguuguuguuuuuuaaacaaggacuguauauaacguaucucauuuggcuucuagcucuguauguagcccagguaaaauacacacagaagcaguggcauuuggcugacaggaaacaacagccacuagcagguuguuugccaaaagccacacccacugauaaguaacugaaaggaagcaaggagugauuuuucacuucaauuuacaaacugguaugcuuucagauuugagggaaaucauuucaauuaacauauagacgucugcauaucauuugcuagaaugcacacacacaguacacagaaauacaaccgcaguucguuguuaucucagugaccauucaaaggagucauaaacgagcauaucacagacugguaaugcacaacagcccguucuugauucuuuauguuuugagcgcuugcagauuacggcacagucauaaaaguugcaacaucugcccugaaguagcugauggucucauggaaaauacaacacagcugugcaucgacuagaacaaagguacaaaacccugaggguuuccagagaagggcugggaauagguccauaguuacccucugagugcuuggagaaugggaaggauuugaaacacugugagaaaagcuugagcaagggcgugugcgcccccccccccccagucacagugguccagcaucucuacuguuuacaucccaugcccuaucaugcaaugcguucuuuacccuuccacaaccagagaggcucuauuuccauuugcuuuucuaaguaccacaauuaagaccguuuuggacuucuuggugaauauguacaauuuaagagaaauuaucuugaacuuuaaagugagaaggaaauuuugcuaauucauaccaaccauuaaccugauucauuuauauuaaaagaugucagacacuuguuagauuauaaauaaguuuacucauagggcuaaauaguccauaaaaacagguguuucugaauaauguagguuugucauacacgucccuggguacaggguuauagacuaaauguguaucuagcauuccugaguuucaugacugguagauccaaccaccugcuugacauuuuucacaucgauucuaaguuucuccaacuuaaaagcuuaacccagaacucuugauuucccucccacccaaaagcacagucugcuaucacccauccaguugcucaggucuuugaaagacagaagauccauuggggacuucuuucaaagcaacccaacagcaagaccuguuaaagccagcuccaaaauacaugacguuaucggauuacuucacagaacuuuuuuuuucuuaaauuucuagcaaagaugagaaaaauaguaaguguuggaggaagggagggagggaaggugggaaagaggagggggccacggcaugagagagggagagagacaaacaguaaccagucagacacaaccaccauccacauuggcagguaaggaaagaggcagaagguuccguagaggaugaaguggcuccgugcuguuuucuucuuaacccuguucauacucccuagagaggcgagucaacacaauucugagaauucucacuaauaaucguaaauuuagagaaaaguacacucagugaauaucuuuacccauuucuacuuucuaccaaggagcaauagaaacacaaaguucgaggggaaaaagaaaaccccaaagaagcccacccagugcaacugaagacuucaggcuguccacucuacugggggggggggggggauucaucaaguccuagguuuaggaaccuucaucuaaguaucaaaaagauauuccuggccucuccuccccacacucccaaaguggagagacgaaagcugguaacagaggcauuuaacagaaccuaagaaaagcacagggcauccaaccagggcugcauagagcuugagcugaaccauugcugcaauuucuuuggacugcaaaguagcugggcaagaaaccacaacuaaauggguuucccccaaaagguugggggagauguaagaaguugcucacaccauguuuaggcacagcugcccaggcaccagggagaccaaaagaaauagcagggcagauacaucaguguuugaaagagaagguggaugagaagaaggaaggggaggagcagagaugagaagaagggagggagggaggggggggggaaggaaagaaaauacagcauaaagguuaagcuuagaacuuugugcagcuacacagaaggaaauucuugcacaaacuucccaccacaaaagaacgcguucaacaaagaacugaaccuuagaggcagaagaaugaaaagauuugaaugugaugaagagggcuauuccagaccccaggauacagugaaggagcaagcgguaugauuuuagaauccauaagcuacuuagaagcaucaagaaauuagaguagacacuucugaaaacugacuugcugacagaagaaagcacugacugacauacuaugggcagagaugaggaugacgaaagaguaggcaauaaaggaucaaccaaugaggaagagauagagacaaaagguaagaggaagagaauuauggccccaagggaggcagcaauaugaauggauuauaaccuacguucaaagacauggucagggcugcaccaagcuuaaacagcaugccguauuguagguggugacacagaaccuaaaacagcuagacacucaaccgcacuacuagacucuacucagagaaccuucuagaucucgggcagaaaacuccacuauuuacaaagggcgacggcgaacuggucaguauuaaauauuauugaucacugaccugacggcugcaaaauuacaaggggaacauggcaggaaaaccuuacccucaggcacgcuauuguucaauaauaaaaccacccagaggacauccccagacuguuaggaaacauacaauucagaaaugcaguaucuaugacuuucccuugacacugauacaaaacucccaguuaaugaugacauugaggcaauuaagagaugaaccauagaacuugguuggaaugaagaggguucaguaggcuaaagaggcaccgagacucacaggagggucccuacaccagcucccuugccauuccgucauauuuccaucuucaauaucuguguguuuuucaucauuuacacaccauuuccaagucuguaccacuguagucacgacuacagauuacaaaguaacuguugcaagcauggugaacguaaguuaauuuaaauguacuugucagccaggaagggagguagacaguaauaagucauucaaaccaaagaacccauguaauguguuuaaaauugggaugugugguauuuguaaugaaauaccuucaaccguaaaguguguuuacuacaaaucuaacaaagcuuagcuagugaggcucuuuacuuacaaggguggugugugucugugugugcaugcguguguggucaaucaaugcugugugucuucccccacucaucccuaccuuacuuuuugagaccaguucucucacugaacauagcauucauugacugggauaggcuggcuggccaaaacagcccucccucuagggauccacuuuucuuuaccauuuccccccauacugggaauacaggcaccagcuguuguauccugcuuuugcuguggaugcuaaggauuugaacuuggguacucuggcuugcaugacaaacacuuuaaucauacaagugccccaccccccaccccucagcuuguuuuguagucucuggaagggaucacacugcuguuauuuuuguggaauuguaacauauacuccauuuucccgacaagguucacaauuugcaucacuugucuauugaaaucuuagucuaccccugcucaaaccuccuuucgaccccauuuuuuaaacauaaguauaaauauuucaggaaauaacucuuacaguaaagauaacauuuacauaaauuuuuucuuauguccauuuuucuaagcacaagaaacuaauuuugaugcuucuucuuuucuuuuuaauuuaaaaagacagugucuagagcaggauucuaucugggaauucaucuauaaauaugaauuauguguggagaaaugaugcuuggaugcuuauuccuaagugguaaaauguaaagauauuuaaagaaggauuuguuuauuuuauauuguauguaagugugagggucuaaguauggcaggucauguguauaggugcccauagaagccagaagggggcaucccaagauggcaacugaauuagguccucuggaagaacaucaagaguucuuaacuguuaagccauuuuuucuguuccuuaggauaacuguuuaaaccauuuuucauuaugugaauuuccuaaauauugauuauugucauauuccaaauauuucaaagauaauagcgaauuuuccuuugaaaaugccaauacauuagcaucuacuaguagagaauuauuuuucucauuguguuuucaauaguuuucaaaaguuuuucaagauaucuucuucugagauuucccacaucucuucucauuuugugaccacuaggccaucgcuguucuucacugggcugcuuccauggucuuccacaucaugucccugggucuguacuugcccuggcaugaucuacuuuucacaccacaaccaggguauccuuuccaaaggaaaugcuaucaacaucucugccuuacacugucugccucauaguuucugcaauaaagaccagacuguuugcagugauuagcaaagcugaccugaguugaccaugauccagccacacugaauugcccucagucuccaaacacacugcacuuguucccugcaagggcuucacugugaccuuuguccuuggccuggagugcucuuuccccaggucucugcaagagcagguguuucuggagggcucugaagggcccuuucucauggccagucucugaacagcuuucuaaacauggcaucuuuccccaccacaucccacuagaacacuucaucucacuacuuggcuuucagggaaaacacacacacacacacacacacacacacacacacacacacagaguuucucagcuugaagaggagggcuguccuuggaaagcaaucuuuugcgaugguguuuagaauucagaacauauauuauuucuaauaagucccggaacaaauaguaaccaucaaauuuagcccacugaaaucuaccagacccacaacaggcuccaauuaugcaugucagcaacaaaauacuagaaaaaaaaaucaacaugaugaaucaccacuaggaaaaacagagucuaaaagaaacagaucaacuuacaugaacaaauuaucauuaucuuucauaaugugaggacuuuggcagguggucuaaaggagacuuuggggcauuuuuaagggugacugaaguucuucaucuuggguuguuuguuuuuucccccugggucuaaguucauuuugaaacucacacguuuuggcucucucaucacagacccaucccgaguaccacugccaguguuucucagccacaguccuuguauaaaauuggauaggagggcaaggaggaggaaaggucucuguugcagcucuggggggcagaacacugcuggagucagggagucaggggauguguguugcagcucuagggcguaggagacggugggcggagucagggaaugugcuguguaaaagcuaccagggcuaaagccaggaaguggcagggaagaagccgccagugauauguggccaugggaaaacugaagaacucuuccugccacccacuggaaaauuucaucuucccagacagacuggcucuugucuggaguagcugugaguggguacauggagggagaguugguuuguaaauaacguugaaacuugggaggggagggacccuguauuucuaauuuaaggcuuugucccaaauuugguuuggcaugagcuuuuaugacuaaucugccaguauggagaaauagcaucauucacaugaagaguaccaaccagccacucucugggagaagcugggcaggcaaugccuagcugggccucccauucggaaaaaaaaaaaaaaaaaaaaacagacacacaaaauaguacuaacaguccagaaacacuauaggguuccccccuccccuggguaaauggauaaugaggauggagaggacauuuuuauauuuuauagguacauguuuacgacuuccuaauuuuuauuuuaugugcaugagcaguuugccugcauguaugaaagugcacccuggaagccagaagagggagucagaucccucagaaauggaguuagaggugguuguaagacacccauaugggugcugggaauugaacccagguucucugaaaggguagccaauguccuuaaacacugagccaucucuccagcccccuaguuaaacuccauguuucuagaaaauaacuauaacacgcuacugauuucuaagcggcacaaaacacaccauggucuguuguagguaugguuauacacaagucguucucaagcccuaacugaaaugaaagaagucauaaaauacaguuaugaaauacauuauucuaacugaaauacgcucuuaaauauuccccaaacacaauuuucuauagccaacaaaacggcuugguuuucaaauggcuacaaaaccuagcccuguccaaugcuaauggagcuauaggcaugagauucaucuagaaguauggccaaacugugcugagagaacccaguaauuccaacaucuuccuuuauagcucagagauuccuccauucggcucacuuggguaucuaggagaagcccaguguaguuucugauuuucagagcaaguucuuggaguccaucaugugcuccagagcuucaguugaguuacacuauugccaaacuccaacagggaggcauucuuaacacucauuaaaaugacaguucuguuaacaaauguuacaaagucuuuuaacaacuggggagaagagcacaugcauuucugcuuccugugcuucgaauuucauuuugguccucucugcaaguccuucgggccucacaucagaaaaccacuugcaagccccccucugcucaguaaaaauugagagauuuaucagacagacauaaaaaaaaauuuuuuuugagaacuaauuucagauucucaucuaaacaagccaauaggcuuucacuuaaaaaaaaaaaaaaagaagaacaagaaaagaaaaagacaugacucagcuuaaucauauuuugacaucuaaaaaagacagaaagaaagaaaaccaccaugacuucaacgagggacgagcagaagccagaugaucagguguggcuuaccucucacaggggaauuauaacaaagguuaauuuuuacaugaaaauuagaaccacacaaaaauagaccucugcagcaauguuacugacaguuacccgggaggaugagcagguccaugcaaauguucuuucucaagcaauuuauuaaauccauugccuaugcuguccuuugaaaacggccauuuucacagaaaccccaaguuaacacaagaguaaagccauugcagcugagaaacacuguuacucgaagcaaugugcaugugacaauauuuuuuuuuuccgcccggaaguguacuuacugaugcaugcuacaauuaaaucuaacaacaaacacguaugcuuuguuguugucacgguccacagaaggaagaaaaaaaauaaauaaacaaaaacaaaaacaaaaaaaaaacccaaacaauccagguaguguuacaccuggauucugugcaagugccuggugccuguuaauugcugaugaccuacagcagaucccagacuuugauugcugguaguggcacuuguggaggucacucuuccuucacaguuauaauagccagugugugggaacagaaaacacuuauggaagagcaaauguuuuacucaugaucauuaaugauucucgccgagcggaucuccuauuuaauuuugccaauuguucaauccucucaagacaguuucuggaaugauggcucuaccuaacacccguguggacaccaacaucugcucggagacagggaccucagugaacuguaccuggucuucccauugauuguaugagugcccaaaacacagaauuucaacuuaguguuuggagaccgugucugccuuucagagagagagaaagcauaagcaugauuccaaaugaauaggacucagaauugaguauuuaaugaauggggagcuggaaaacaccugugagcaucuucaggaagacagcagcaucauacaugucuuuccuguaugcacuggcacaugucugcaugcuauccuauauuaggauacgcagagcacuuuaaacaaauacuauuuuaacaaaagcaguucucuaaucuuucucaucaaauguauuaaaagcagcaaacagacaagggaggcuaccacugaugacuguguaugaauuugguuaaaccugcaagcuuugagacuguuaaucaccaacuguucagugauuauuuuagauugcugaccaaugaguacacuccuggucuuggagaagaacauuacucaauauugugccuuacuggaucuguauuuuuaaaccgucuuaaugucaauuuccaccugcaaacagagguaaauagcgguacucucucuggucuccaguagggaaugcagcauuauguagcaauguuuucaauaagucaaucuaauugucauuguugcaaauaaugagggaaaaaaaaaaguauuugcuucuaggaaaagcacagagguccaccaagcaaagaaaaccaacucaggagaauuaaguuuggcaauuagcaggugcagggcaaagcucccaucuuccaauagcgauaugacggaucuguacuucccccuccccccacacacauuguguuucuccugcauugugaaguugggcuuguguuugucuuaagcauugcccagaccaccaguuagcauacaucugauuuaauuucauuuguaagucuuacuccuuccugcccccugggccccccacaccucagcccaagaggaucccugccccgcaccaagcaguucucaggacuagguccgacaagacagaaccgaacacuucauaagaaagcccuuugcgguggcucaacgccagcacuagucacugcagcccauuuugucacagaaccgucaacacuauggacucaaauaacccagacacuacuggcaucucgucgcacaaucucaucugcagaauacaagaacaagcuuuggaaggaaccgcugggguuuucccaaucgcuccucucuuccauuaggcugggaacuucgggggaggggaccuaccuuaauuaaagacuccuagagagaagagcauagguccuuugccaacucgugccaacauuuagaugcguuuuauccuggacuccagggcuccaugcugugguaucauuacuaugucccacagucugucuucccagaagcaauuuuuccauacagccagcaucggaauacugguaaguguuuaagaacaguuaagggccccgagguucauuugcuuucagcccugugcacauaugcaggaauuuucacccucaaacuaacaucucaguguucaggaaggaaaaccaacugcggugaucuagccuuccuggccaagcgcugaaaaugcaaggcuuucccgagccucccauuuguuugagggacucgguguuuauaaacggcggauuuucuuggggaaauaaaugaacagauaaauaagcggcagugccagccuucuuauaaaaagaagcccuugacgggcuugggcaacuuucagccuggaguaaguuacaagcacagaauuuuggguuuuaauggaaaugcugacccgaccuuccugaaagcaguaaacugcagucucugcugcuccguugcugaucuccaaggcguagcuuggaggguccaugcccaccucccucucggacugaccaacguguacacacacacacacacacacacacacacacacacacacaaacacacacacacacacggagagacagcaagcucauuucauugccgacccggcuggccgcuuuuucugcuacugaguccaggagacucaaaacacaccugacaaucucaugguauuuuuuuguuuuuguuguuguuuguuuuuuguuucuaaacaacgaagacaaaugaccuuuguaaaagacaggcuccugaaagucaaaccauucggaaagaugcccggcacuuuaccuuuucaaacuccucagaaccccaagguugaggaaaaggaaauggagaauaagcccagcuccggaugguaaugggggaaaaacaaacaaauaaccaauaaccaaaacggguuacaaaaagaaaaagaaaagaaaaaggaaaaaaaagaaaagaaacccccacacaguagagaccgcuagccaaggcugccacaaacgccccgcaaaccgucuccgcagcccuucgcggcuuuccugccggacgcccucggcuucugccccggcugcagccgcacuucucagaggcgcaucuucgccagcgggggccacgcacggggggcgggaggggggggggagggaagaaaccgaaccuugcucguucgcucgcucgcucgcccgcccgcgcugcccgcccgccgccgccgcgcgcgccacucacccuagccgcgcgccacuagcggcggcugugggcuggccgggauccgggauccgagagggcugccgggcucccgccccgaggacgcggacgcgcggcucacgccucuugccgccccuuagccgucgccucuaagcaucuucccccuccuccccgcagagcccccuccagugaacgugagcaagcgagggagaggagggagcgcgccggcgaggguggugggagaggcgccggauccccacgagcuccggggaccggcgcgcucaccacccccccgccccuuccacgccgcgcgcccccgcccccccccccccgccgcgcgcccucgcuagugcucugguuccucgcggcgcgcgccagcagcgcgggcggcagcgcauccucgccccccgccacuccguccgccccccuggcggcgucuccuggcagcgggcggcgcucuccauuguucugcggccgcggagggcgugggcagugggagguguccgugccugggccgcccaggcuuaccguugcggucccgccgaacggggcgccgggccgcggggugccuagcugggccggcuggcgcgcgcgggggcucggugcucccgcucgcccgcgcuccgcgccccuagcauccucgguuacuauggauaucuugcgccuccgccgcccccuucuugcgcuuggagacaccgcuggggcggcagcuccgccggcgcccaggugaccaccaacuagcucgguggcggcagcagggauggcaagagccacggucacuacggcuggcugucacugcccuggggaugaggugguaguggacuggagggggugaaggcggguccugcuucacucgaggccacuccaguguuuccucccacuaagcaagcugcuuuguguuugcaccacagaagccacccgcaguguaaaacucaacuuguguggaucugggccauccugugugacuuggguuccugcagcguuugccgaccuaaccuuggcucaguagauuaaagggucucaguuaagauuugauaaggcucaaaucaucugcccuccuccguuuccaccaguaauaguugguaacuacuaccaacaucuguagaaauguuuacuuuggccaaggcuuuuuuuucaaaauuaugccaauuaaaggaaguguuccuguaacugaucuuaaacaagacuuugcuauuuugaaaaucccaggauggguuuccuuaacauaaauaaacagaaaucauuuugucuuagccugcacaaugcuauacuggucccauggacagcacaucugccaacccauacaucuugguccucagguucuucaacguugcaucugcaaguguuuuaaguugcccacauaggcuccugugggagccacagagucucagagaagagcugaggucugguggcaaaauaaacaucaccucaggaucucuguaaaaauucuaacagaauauuuaagggaauggcuaacaugauaaaucccuaacaguaugugugcagggcgauccacuuuauuuauugcuucaaagccaaggcaagcaaagguccuggucaggugcaaaaacucaaaagacugaaacaaaaaugcaacgcgcuucuuguaagagguaaguuuagugagcaccuacaauuccccagagaucuguguauccuuccuuucauccucacaacccugugacuuaggucuugucauuacucaaaagggugauguagccaguucuuucagcaacaccagacacuguuucuugucugcugcuaugucacugccuacuucugugggauucacauaguucccaggguucgucuauuaccaacacgcaggccccgggacauaaagcugggcauuccaggcgugugaacuaggggcaucuaaucauaugaaauucagacauauucccguuugcaucaggaaagaaaguucccgaaacccccagcacuggggaguaaauagggacaggcccugaugcacucuguauggcagagcuacaccaacgccccaaagcuucugcuucuacaucuuacacagguaaagaaagaaucagccugcaugcuaucuguacucuaaugaacggcaccugaauguugggaggagaggaggggagaggcgggggcauguuuuggguagcuucuuuugagauuagcaaacucucaguggcuuugaagguaggucauucccuucaguuuuccauucuggagcucagauaccugugugcugagguaaaugugucuucuugguuuugcagucacggaaaugacugaggaauaguauuugccagaguacugcucucuuguggauauuauuuucagguucucgauauagggcaaucuagagcuaccaucugcuaggaauaaacugcaggcuauuuaggagggaugugaacuauuguguccccccccucccaccccaaccccugaguugagugcucugcacucuggaaacauuugagaccucuaggucauuuuaugacugcgccaccucuagagaaugaaugaaaacuuaauucccugucagccuuugugccagcagguggaaaccaagcugaaaggcagccagacggggaaguugcuguccaugguggccauuuaccgggucuauucaguaggacuacugaauucacauccugaaugcuagaugucugugaauuaacuucagcacaauacuaauggaauuugguaggaaccuccagguaugcacacuaaaauauaaagguauggagcaggggguggcuagagauggcucagcaguuaugacagcgcucgcugcucucacagaggacagagauuugguucccagcacucgagcggugccucacagcuguguguaacuccagauccagggcauuugaugcuguuuuucuggccucuggccucuggccucuucgggcaccaggcauucauuuggugcauauguguauaugcacacaaggcaaagcacucauacacaugaaauaaaaaaauauaaauaucaacauauuccuuuacuacuugaggggaaauauuaaauaauucacagaagaaaagauguuuugcucuaaacucaaauagauccuacucguugaaguuuuggaaauuuuuauauuccagaaaagcuucaagauaugagcccuaggucccaaagcccagagaggccaagucucuugacuaaggaaaauccuuacuguaggcagcacaaaaccacagaccuuaucacuugucacagacacuuguuaugguauuaugauacuccaaggaaacucagugucagaauuccuucugucauuuuuuccccugcuaaaaagucauucaacuucuuguuuaugucauuugaaauuuggagacuauaaagccucauguuccucacuuuuaaaauauucuaggcuuuuaaguaguauaguguuccuugcaaaaugauucaauuuaggaagaaaaaagaaacccucaugauacuaaaacucagccugugagucuccuuagaggaaaacauggcaguugcuucaauauaguucaucaacaugaccuucucaacauaaacugauuauuuaagagcagucaguuucuaucagacagacuaacauuagagauguuaacguccuaaauucuuucuucguguuaaaaaguuacccagaggaccaaauagaugacucuagagcuugugauaauuuuuccaagaaacguauaaaacauugaucugaggugccuuuguagacauuuagaggaacaaugucuaauaccguauguauuuggugguagcagacugcacaguuugacaccaaaauguggaauuguauguguggauucaaguaagggguauuccacuuaaacgcucugugauccgacacacucuaccuaacuugucugagccucgccauuccaauuuguaagauggaugugacaauaauggaagcuaccucacagagcaguagcuacaaggaaaggaaaguaauuauguguaauggucuuuuuggugugguaacuuggcuggcugaaaauucccaguuauuuaaacacuagcauagacacugcagagguguuucauagauuguaauuaaaguccauugacuuuaaggagaccaucucagauuaucugacucaaucagaacucuaaaggcagaacuggagauaccccaaagaaggaauggaacuauuggaaccuguucccaagaguuuaguacccuuucugacugcccuguucuagacuucagacuuaccuggugagcccucuucacauaaguggacccuuugcaauaugucucuuagaauaaguaucccacuggacuauuuucugauuggacccuaauugagacaccacaaaugguuaaaaaaaaaaguaacgaaagugucuacaauaaaagaaaaacuggaaaaauuagcuaaauuaauuccuuuuuuaaaauuuuacuaagcauuucucacaguacugaguugaguuuuguuuauuuuuuuuuuaauuuuuauuuuuuagguagcucaaugguuaagaacacuggcugcuuuugcagaggaccuagguuugauucccagcacccacauuguggcucacagccaucuguaauuccagugucaggggaucugauggccccuuuuugaccucugcaggcacugcaugcauacaguuggugcacagaccuucauguuggcgaaacaccaauaaacauacauaaaccccuuaaaaagagcuuuggauugcacaggaguauuucucuauuagugucaggccaaucagaaauggauuuaagguuuuaguuuaauuuccagaacauggaaaaagugccaguaggauugugccaguagagaugccaucuggaacuguguguaggggcaggggggauuguauaaucgcagugugagcuuccugggggaggaaggcaaugaacagagagauaguuacuccucucccaacacacccugucaguuuacugccugaaaagggagaacugguuuucaugaaucaagaaugggauucugggagauaacacagacuuaugcacuaucuagucuucagucagcuaguauuacauacccaggagaauggcuuugaggucuuauagaaagauauaccugcauauaaguaugguaguacagauauuucuugucucaauguuagccuguccuuggacuuaacauauuugcaucuuagauucuugucauuuguuuugagcauuucuaaguaagggggaaacauuuccagaauaucacugaaaaacaugcacgguacaaacauauauauucagaacuguaucuguccuucagaauuacaaugcaaaauuugugaaaacaagccuggaaaugcaucagauaaacaauccaacaucauccagguagccucagaaauaggauuaaaaagugagagcgccaagaaaaggaugguagcuuucagcuuuguagcaaaacaagacccagucuuacaaauguauguuuuuaauacuguguguucaugcaugugcauuugugugcaugaaacccaggcaacugucccaggauucucauuggugacuuuucucaaagauagugauuaaaggcacguuuacucauuuaugauucaaaugaugaggugacuguucagugaugguagguuaagucagagugaggcucugaucuuguggagcauuuacaauucauccuauugaauuccaucuaacauguaacuuuccuuaggaauaguuuuguauuuuuuucccuuugcauuggcccaggaagugccuuuuugcugacaugguaagauuucgcccuuuaauacugcauucaucauuuaaaaaucacuauuuaaguuauaaaucuucuuguaagaaugugugggguguagugcccugcuugugugguuuuguauucauggacaggucuuuugauaaaugggcacugagaaauuuacugaacaaaugaaagaaagcuuaggacacgaugaauucuaguugcuauccagcuagaaauaaggcugaaaucagacaauagaaacauggagcucagaagagagauauaaaucuccuaucagcugauucugguaguuggaaacccugggaguggauuaucaucagccacaguugccuguucaaugaagucaggaacaaauguuuguggucaguacucuggacagcgaccacggagucccucuuucgcagugugauuuaaaaaaaaaaucucaguagauuagaaaaguugugggaaaucccacccacauuuuuuuuuucaacaaccuggauacauuuuucaggagacagauauuccagaacuacaacacugcagagauaagcauacaaucaauauggauuuagaaucuuugcacuguggaguuuugucuccugguauggagaaagcaggacuugggguuguguuagguuuugacagagggcaugggauacaaauaagagaagaagaaggaaacucaaagagaaaggagugggagcuugggggguggagacugugcaacaaggaugcaacaaaaugaaaguguucaggagagucaggcauuggggaaggcuuuggugcucaacagugguccuuagugaugugggcucaccauagaagcaucaaugugcauuuuuaaaugcaagauuuguuuaugugcaaugagacaaguaaagcucagacugacuccuacaugcguaguuguuaucuuuauugcucuaucaugcucuuuugcuguggggaaaaucccuuuguuuagguggcaauuuaaaaacaacuuacagaccugccuauuaacugugguauauuuacagaucucacuaccaagcugaaacaagccagagugagaagacgggaccugcacuuucuccugaaggcaagcaggcuuggaauccagggggaaugaauguagacacugaggcccaucugcuggaaauguucugccccagucuccugaauuaagaccuagggacuuuuuuuuuuuuuuuuuuuuugcuuuguuuuguuuuuuccauguuaacuacauccagggccagagcaacaugcagcuccaaugagccauagcuaagcccucugcuugcagugguugcucacaaucaacuccugggauuuaguuucagcugcgagacacaggugguaaauaccccaccuuuuaaaacaccuuuaacaaacaaagcagccagccaugcacaauagacacagcuacuuccaaggcuagcagugagaccaagcuucagguaaacucuuucacuaagugaccacauaccccgauuaccuaaggauauuccuuguuaaauaggucagacuauauggucugcuuugcgguagguagggaaacacagucugaggcaucccagagacucauuuggggaauuccuacgguggcacauaauacagaaaagucccucagucucugcacggcauuccaguucggcuugauuguccccacugcuaugaaccuugagcaguggcuuaaccuugaugcacuccuggccccugcaucuauaaaauaagggcagcugcucuuuaaggauguuguuuaagaaugaaaugugugcacgugugcgacacucuguacuaugccuacagcucagcaguuacccauccagagaauuaaugcauccucguauucagucauaagccuccauaaacccccucuacucuaucaccagaacuaaacagccaagcuugcccccagugccuucucccaugcucaucaacugggcaaacaagaagagccacaaacaccuuggaaauccucucuacuacagacaacagaaucucaguuuuuucccccuaucaaugggaucuggcaggggauaaaacaguuucaauauuuguuuguuauuauauacagcauuauaauuaucuagcaauguauauuaagcauguugagauauguuagaagaacaaaggaaagaagaguuacaaaauaacuauaaguaguaaauagauaugaguaaggagucaaucucuaguccacugucaggucagaggguucuauugucuauucugucuacuacggugguucauuuggggagggucaggacagagauucucuugaggcaauugagaaagaggagcccuucuuccacuggauuuucaggauuuauggauuguugaggacgcugucauugggagugucuuccuuugggugaaacuagugcagaguccaggaaaaacaaacaaacaaacaaacaaacaaaaaaaaacaaauagagagugagagacuaggugugguugugcaugcccaugguucuagaaucagggagacugaggaaggagagccacaaauuccaagucaacaaacacacaagcaaaaugaaagaaaaaaaaaagagguaggggugaggcaggggagacaguucagucaguaaagugcuuggucaagcaagcauggggacuugaauucugaucucuagaaccaaucagguauggcagugugugaugugaucccaguacugcagaggcagagguagaguccuuggugggaccgcuggucugccagucuagcugaaaucuacgagcuccaggcucagcgagaaacccucucucaaaauacaaugcagagagugacagaugaaggcauccaccauugaccuuggcaucugaguguguguuccaaccccguccgauaugaacaggaagaccaaaggaauuccacuuauaguguucaaggcucagcauauguugaugcuccaaaccuccaggcucccaucucauacaugagcuuauaugucucucaccuugcuugggccauacugacuaugguuucucaaacugcaaguguccugacugacucagaagaaaaaauacuucaauauaauugugacagucuuuucugguuggcaguguauacauacaaucagagcuuggauccuuccagcaauagaaagcuuacugcccacugaagaaaucuauuaggguguugggacuuucaccacaacaaauuuuugugcuaggugaaucuuucuuuucugaagguaccacuuauucuguacaccagacccauccaucagaugcuauguccuguguuauaauaaccaguacaaaauuaucucguuauucucaaaaaccaccuuaguauaaaaauacugauuuggaugccaaaucuuugcaaaaaucuuucccucaauucuauaccagcauuaggacugggaagaccccucuccaacauggcccucaacaaccccuggcaaugccagcuccccagugcagagaaugcaguagaaagagccuuccucuuucccaggaguuccagaaaaaucccuguucucaaccucccugaaugaacuccuaugagugagugacggagccccucucacuugccgguggaucacagauccccuccauccauggucagcuucugagggacuaucaggggcugaagcaagaacgauggaggaugaauuccuauaaauggaagugcauaugagugacggacagggaggcgggagcaaaaacagaaggaugcauucaaaugaacccuccauaugagccauauggcguaggaacagcaagaagcaacuugagcagguaaagaugaaugcucugguuaccaugguaaagugaaagauagggucaauaauuucaagggcacuuaauaaccuuauacaugacacuaagaguugaacugagacucauuccauauaaggaaaccaucaauaacagaaucggaugugcaacagaacauagauuuuaaaaggacaguuuaugcugaggccuucggucacagggcaagucagaauaacacgcugauguccugcacuacagauggcuucgcucuuugcaucuccuuccuguaucccaggaagcagaagagagagcaggaagcucagucugagaaugcagcccaguucucucacaccauaguccaggagccccagggaagugugcacugguggaagauguuucugaugugggaaggagguacucaaggauggacuauguuucuuguguuauauaccaggcccuucauaugccuugcuucaaugaugccacuauuuuacugcuguuucuuuccagaugaaguaagagucgugucccuacauaaucaucagccacgguggcuccuccugaucuacuggggguagauuccaucuuggaguacaucccaagccccaguggaugccuggaaugaaagcucauaccagccccguaugaacuguuugcucuccuccauauguaaauguacuaauugagcacagcaagagauuaacaacaauaacaguaaaauaugcgacaacgaaaguuauuucaaacuuacugauugcuuauuuauggaauuuuccacuuaauauaucuggagcgcagcugacugacggggaacugaaaccauaagggagggauuacuacuguauugagagauuuuuuuuccaaugcacaaauacacaagugugcacccagccuuugaaauaaucuaggaagucgggggucauaaucguacuccuguuacacagaugagagaauugggugcuaagaaugucaucggcucggggggcuggagagauggcucagugguuaagagcacugauugcucuuccagagguccugaguucaauucccagcaaccacaugguggcucacagccaucuguaaugggaucugaugcccucuuuugaagagaguggcaauguacucacauacaugaaauaaauaaaucuuaaaaaauaaaaagaaugucacuggcucaaggucacaccagguaaccagaccagagagagagagagcuaaaagacuuccaguucugagugucaugcauauucccauaacuccuugcuggggcgaacuguuaaaagcuggucuuugcccaagccagggcaguauuagcuuggcuguaaaaccacucuccccugaucuaucacccagucugaugcuugauaauggcugcuuucuccuucauugucucggagcacaaggacugcaacagaaaagaaaacauaggucugcagcccuggaguuucugacugcagggggaggggugagccuuacgggauaacaccguccuuccuauugaacagcagagugugaucugccauucaggguaugagaaucuguuuaaucuccucgguccauacaucaucaggucucuggaugaaaugagccuaaggcccuucaggacaauaauggcucuccgagcagaaguagcgaggggaagccuauuaacucuuucaggccauuagcccaucauuuaguaaauuacuacuucccucuaaaugguuccuaguggguaugaagggugagaauguccuaauuugccucuuccaucucucagcugcgcccuccaauuaugauagagcucuagaagcuguucaauaacuacucuauucugaaucauggaacacaggcauaggaaaaacaccccgcucuauugaaauguguggagucaaaccuuuauguacggugcaaggggcuggggguuucuucuaagaaguggucagggugcuuuagcaaucuggcauuguggauguguaugaugaagaaccuuugccagcuggggugggcggagaggagcagaugcugccagaagcccagaggcaggacuuccuuucucccuuuuagaagggaagagaagguuuugcucugagaagucggcuucucucccaggugccuuucaugggagaugcauuugaagggcaggguguucccugaagacuggcuucacccugucacucgcaauacacgggcacugucaacgcacugaacugagagcaauucuccucccuggcggggagauaaaagcgcuggcacucuccuuugcacuuguaaaucuggggcuacuaaguaaaagcccuauaaacgugcuagggaccagcauuauucuguaaugauggcgagagcgaugguacuuugcacuuaugcagcauuaaaacauuuggaagcacuugaauauugguuauuucugaauuuguuuuauuucccccuccccaacuuuauugggauauaauuggcaaauaaaacuugccaagguguauauggagaaaugacugccauaaacaaacacccaucauccugcauaguauuucuuccuucucucuugaauacuaacgacacagugaaguucaagugugugauacauuauuauugaguuauuaugcugugcauuaauuaggucuccaagucuauucaucgugugugugugugugugugugugugugugugugugugugugcauagugucuggcaacacaugcgugugcagguacaugccuaugugugugcaugagaaggccagaggaggaggccagggauccuccaucacucuccaccuuaguuucugacacaaggucuuuccaugucccagaagcucccaguacaggagagucacguucaagcuccagguauccaccugucauagguucuggggauuugaacucaggucuucuugauuuacagcaagugcucuugcccacuucccauuucccaucucccuuauucauccuguaccauugagucuguucucguagaccaacaucguauuuguguauucaugguugaucaggcuggcucuauggccaugcuccgugguuauuucagagggccuauaauggcuggucuugaucaucagugcuacgggguugagaauuaccuagaagacucauuucugggcauuucugggagaguguuuccagagauucacuagggauggcagggaggccugcucucaaggaggucugaggagaaaucagaguguaccugccugcuauaguuccuccucccugagcugucgguuccugcugcugcuguccuuggcugccauuagauuccagcuucccuggccuuccauuguagaugugauaccagcaguuguuuagggaacuuucagaccuucagcucuggcuugggaccauggaagcauccccaauggguucuguccuuccagugagcuauuacuggauuucuuaaucucuuaucauguaagccaaccaaauaaguacccuuuuauauuauauacacauucaaucuguuacuguacagauacaggacccaguguuuagauuaaugcccuggagucaggguccauuuauucugaguaauuucaacuuugaauuuguguuuuguuaagugaagucugaugggacuuggagccaccuguuggugcguggagucucaaggccuguguggucuugggaugagguucugguugccaguuuuccagcuugugcuccauuuguggccucuucucucuagcucguuccagaacaaucacugcuucuugccuagguaguacugaguuggcauuaaugggaguuagggagggauuggaccuguauucagucccuuuccugacucuucccuuggugcuaguacauauucuuuacauggagggagcccccacccuguggcuucuuggcuggguaguggcuaucuuugcccauaauuucagcaucuugauuugcucacuaggcagcucagcacagaccucucacccauuccugauccaagugucaugcauacgcaguguagagaucgcaacccccauagguagcuaguugucuacuguaggucagagagauagggcugugggaaggagaaacuagcucuccuaucccuggucaguguuuacacuggaccuugcaaacuauauagcaggugcuacgguugacauauguugucuguguggaacagauaggccgaggauguuauuggcauuauguuuauuucuuauaucacuucuagaggaagcugccauugccuuauaugucucuuguauuaggaccagccgcucacacgcuguugucuaauauaaucucuauaacaacuauucaaggcagagcuuuuacagugagauggugccuuaacugcucccuaucucuguuuccucaguugcaaaccuggcacaguaaugcauucucacgaagacagugugagaaugagaucugguggugugagggaggaggagucuugcuugccugugucaguccaucauuguauuuguuuggaagacauagcuugaugcauguuugaagcaggggaugagaguuugggaugauacagaggauugcuucucuugugcacaucucacauaagauuuguuccaagaugaaggaagcaucagugagggcaaggucuuugucgggggagaagguaguaaugaugauaugggguuguuuuugugaauggaaauauugaguggagcuuuaaaugaauugugagcauagaguuuauguugaacaaucccaccuggccaccuucacgaaaccuucaggaaaggcaaagaagcugacugcugcucucucucucucucucucucucucucucucucucucucucucucugugugugugugugugugugugugugugugugugugauuagauuaccacaggggaaggaggucgaugucucggagagaugcugagaugcacauccguguuggcucaaauggaaacagacagcaugugcuggaagguaaguguggagcugaugcugaguguuagccucgccccuggaccauuuccucuuagcgaucucugcauuuaggauggggggguccuaacaccaacucaacauguucuacuuccuuuauauucucuuacaagcuccuccaucagacacaacggacaccuaaauguuaaugccaaucaauaugaggaaugcauauucauggaaagaaacuaacucagcucugugaaaucauuucaauggcccugugacgcagggaucagccucucccauuuaggaagcucacagaggcuaagacacuaggcugguaucuacuaaaauagcuaaacaauuacacaaaacuguguucaauagaaauugcuucucugcuccuuuagcauacuuuuuuugaguuuugccauuaccuauauguguguguuuuaaaaugccacuaaaauaagaaaggugacagagagagagagagagagacuauaagccuuccuccagaacgaaggguagaggaauggaaggaagaguaagaaccgaagcaaagagacauagcacaacccagccacaccuuagaugacuguagagucaaauuaauauuagucgcuggacuguaauggcacggaaaaaggaaagugugccagguaguugcaacccacgguacaaggaaaaggugccuccagugugucugaaagcacgguucuuucuucagccaagucaaguucaaaggagcacaugaauaauuggcugcagcuacccuuuaagcaagugccaguucucucuguucaggcugauacaucuccaaaccucagggagccuggaaucagcugccaggagccaaugggcuugcgagcauucauaaccagaccaggugcugauccaucaaacuaauuagcagccugugggcuacaguuagcuggaaagguacaggguuuuuuuuuuuuuguuuuuuuuuuuuuuuuaacucuuuucugacagacucugugcguucugaacaauguuccgucagugggcccacacagaagaaagcaugcagaauucaaaaggagggggcuuaaaaggaaauacauguuuucuuucagugagacagacuaguaaaagaaauaagcagugauucacaaaaauagacacauauaugcacacauaacauuauauauuuauccccuucauuuagaacaccugucuguuaccacagaauggcuaguaggcaacuauucgguuuaaugauauggugauauugaaacaaauaauaaacaaggagaaaaugccacagaguugcaaaggagcaagagauguagcuuguuagcauuuaaaaugugucucgucaccugguuccccaaagagcagaggcaacagaaucagcuucuauugcaaacugagaggacauacauguugagaguucagaaaguggaagacugucuuuaaccuggggaggacggggauacaauacccuaggaaaagugucacugaaaaucgcccagaucuugcaaaucuacccaguguguagaucaagagagaauacagccugauuuacaaauuuguaggaauguacuaaauuguacauuuagaauuaguuuuauugucaugagauaacgguacagaauuagcagucaagcuaacacggcuccaaauaucuucacggauacaagggaaacauuccgcagccaauuuguucaauauuuaugacuuuagugagguuuuaucauagauccaauaaucuccaaaggaacuguuccaaccccaugaucuaaagacacaugagauaaugaaguaucccaguccuugagguagccagacaggaacaucugaggaaauggaaggaaggaugcuggcagaagccuucaaacaguauuaacauuuccagagaggucugcaugggcucugagucaacauauggagaacuggggaugggauucaacggaagcaggguuuucagaggcaccccuaacaccaccaucuggagagaaauucugugaaagauuaaaacaaccugugauaucuuacugauguacuuucuauuaaugacaagauagcggccaaagcuuuccugaacuacucguaauccaacgguuugcggcuugaugcugggauuaaaaaugcauuuaugcuuugauggggaacagaugccauuguguuuguagaauuaaagaacgaaggugauagaauugagaugcuuccagccucuucagggacccaaagaaagcauuauauaguuggaggagguuagggucuacugguggcugugucaauucugccacagagaaauuaaucgacauguugagauuaccggcacaaaucuuuccccaaauauuuacuaaguaaaaucuuauugaguguuuccuuagggagaacagggccaggagugggauuacuuuugcuguaagaaauuaaugcacuacccugacuguaaucaauuuagaaacugugaucuuuuaaauagacgguggcaggugauuuggggucaauacacuacuggauucaugccaaaugauaauuccaaauaauacauccugcacuauuguguaugaagugccgccaaagcacaagucuauucuaaggccaugacauagcugggcuguccgacuauaucaacuuagcaucucuauuuuuccucaccccuguaaagucugucugugguuagucugagcuaacccugagagggcuuucaaaagaacucauuuaugauuagcaaggggaggaauaaccacauagcacgauccuguucugaucuaccucgcuagccugggaugccuuaacugcacaccuugccuaugggaugcucucugccuuuaaccaauccucugccuggaaaccugaucuucgugucaccccucuccuggaaguguuucuugacaacucaaucaaacacugcaccuguuggugccugguagaugcucuauuggauacauuugcuucuugaugaagcucugugagggaagcuccgugagggaagggcugucauggucuccauuuuagaaauagagacauuuaaagaugggguggugugaaacuucuuuacagucacagauaaguuagcagaccugggggcagccuggcuccaguaugucugcucuccacuccucugagcacagggaaccuaggcuacaccacaguggacugagcguagaccaccagagaacaggcugcccgcauacugcacaccacagucccauuguaacuccucucuuucccugcucucuaacuucaaccaauccuacagcacucagcccaggcauuaguuuugcuccaauuaagccuuccugauuccaccgugccccagauuaggguacguguggauccucugcgguagaaugcuuguccaaccacacgcuugcuuguuuuucugcuguucagucucugaacucuugagagagucauagacagccucaucuguuaguaugcacagcagcaucuggcuauggagacacugcuuagcaaguaauuguccuggacaauagauggauggauguggcugguaaggcauuuucauuggacaauaaauggauggcuguggcugguaacacauuuucguuguauagcucuggcuuccagcguuuaaagauuuauuuuauuguaaucuauguguaugcauaugugucuaugugcgauuaugugagugcccucagaggccagaagagaguacuagauccccuggagcuggcacuagcaggcuauugugugugaggaacugaauucagguccucuguaagagcagcaggcacucuuaacagcugagccaucucuggagucccguggccucuccagcuucuacaaguaaauuaagagguccgccggaaaucccugggggaaaucccaacagacacuuagcucugguucagagagaaggcaggcucuuuccagcucagggggucaacacaaaaugacaugaaauucacuggucuucauggcucagagaaaaguuuccuuggagaucacuuaguucaggcauugcuaacugcuggccuuaguacuucuuuauuucacauaucauuauucguuccuacuuuuuuuuuuuaauuaggacuccuuuggcuggggcauguuuucauuucuccacauuccguaucauguccuauccuaaguacauuucauucacucggauaaucaaggcauucaguauaauuuaguacaacccacacuuuaccuucuacacagcaaagcuccauauagagaggucuccaccuuccucguuaacuuauuccucuuagauccugugaugguuuguauauguuuggcucagggaguggccccauuagaaggcauggcccuguuggaguaggugugucacuggguguaggcuuuaggacccucauccuagcuuccuggaagucagucuucuccuagcaaucuucagaugaagauguagaacucucaacuccuccugcaccaugccugccuggaugcugccauguucccaccuugaugauaauggacugacccucugacccugccagccccaauuaaauguuaucuuuauaagaguugccuuggucauggugucuguucauagcaguaaaacccucaguaauaaagauccuuaucucacucucugcaguggcaagauggccaguccucuugcuaaaucuaguuucucauuucacccaagacccucaaggcucaagacuauauucuguaggucucauaggugauacugaaguagacaugggccccuaauccaauaaaaccggaguauuuagaaagagaaagaugcauguguagaggggaagagacaggaagagacacaagaugaaggcagucaucuacaggccaaggagaggcauucagagcaccaauucugcugacaccuugguuuuagaacgucuaccuucugcaacugugaggcuacguuuugcuucucuguggcaauuuguuuugacagcccuggcaaauuaacauagugcucagaaacauucucaaaaaaaguguauggauaaggagugaggauuaauuuucccagugaacccucgggaacacgagaagcuugccagaaacauuaggugaguuagcagagccaagcuuuaaauccugcuucccucccuccccaaccuggcucucagccaccaccgggcauacaacagugcucaagaggucugcauguccagggggccuuggaggcucugccuuuuuaccgagcaucccccaaauagucacacagcccugacauuacucaugcauguuugcugauguuccgaucuucucucagaggaaagcccuguguaagacucuccuguuauuccggaaguaauagaagcuguagucauaauauauaggaagagaagagugauucacugcugagccauagagcccuggggagcaaucuaagguugaaagcagacaaucagcuaagauaagucaugaugaugucacaguggaacugacaaaugccucaguggucugaucugaaagaacagcacaauuaagucagcucucugcugaguuucccaucagcaucuguaaggagcugcuccccaucucgacagcccuauugagaggugauaaaggggaguggcagggaacagcagucuacccacaggcuccaugcagaagggaaggguuuucaaauugcuaccuagucagcaaacauuacaaagacauauucuagaaucuagaagauucagacaccaacccaacaggucaagauuagaguuuugucuucagaauggaguuauagagcaauauggugcacaugagacuaacagccaucauggcugauacucauaauacuuuaaaaauaugacagcaugggacaucaaauaccgaaacaggacagugaggcuuguaugaggcugggggagggagagcaagucgcuuggcuagagucaaagaugucuuucaccucccugacucuugauuuucguuucuucauuagagagcaagcaccacaucaccuuucacucaagugugaugagaucagugagugcuuguggcuguuguucucaugauaacauaaauguuuauaugccacuauugccuaugguuuuuguuuuuuguuuuuuagcccuuacgacaaccaaauuuaacuaugguugcuaccauuuuacuaaaaaaaaauaaaaaaaaaaaaguaaaccaacugaacauacuaauggagagagauguuaagcaauuuucucagugucacacagcuaacgugagccaaacuaggccacaagaagauucaggagguguggauuacaaugguuagguucccucucuacaauaggacagguuaucauucucucucucucucucucucuguuucucucucucacacaugcacacaccaacaugugcaccccugccuccaggagccagagagcuagugucccugcaugcucaacaguucugccucacaguuugaguuaaaggauggaggcaaugaggucacugguucccaaugacugagcacuuucaauuucaguuuaagugucaccugcaugaagagagaaggaaaaacuaauagaaaaaggcgacaucacaaguucagaagacuuguuucuuauuuguucucuuaauuaacacauaguaauugugugcacuuaaggaguacaguguggcauuuuaaugccuguauaaacugcagaccggccaaaccacgaacacugggacuuacgucuccuuaucuucuuguguuuucagcugucaagugccucucuucuguuucuucauaaaacacacaauagaucgcugugaacuacacagucacccuaugcuacgagacaccagaacuuguucuucuuaucacauugcggcuuuaaaaaaauuuaguaucagcugagcucauccauggagaauugcuuaucccagcuaaugaaucucaugauaacaaagaggccuuccugcuuggugaauaguuaugaacccuugucugcugaucauuuagugaggaaauacugcaugaaugaagacagaauggaauucgggagacuauggagggauggagacaaaaacuaacauuuguugaauaccuacuucaaguuagauguaggugucugggcuucacuacuuccuuuaauucuuguagaaacccaauuauuuaacaaauacuuucugaccagguuugguggugcauaccuauaauccuagcacccaggaagcagagacaguaggaucucaaugaguuccaggccagccugggcuacaaagugaaaccuuuguuucaaagacaaguaaaugucgugauacccggugcugcaagagauauuggggguacaaagugaaauaaaccaugguuucugaaccucaagcaaagcaaagggaagcaauaaagaaaagcagagaaacaaucuggggccagugugguaguuuguugagaauacacagauaggaauuuaggaauugugcuguaauugcuaagaugauaccugccgagucugugacuccuacacacaaggcuauauccugccugggcagcuguguccuguaccaaacaauaccgccacuacucccucauggagaguccuggagucccuucccagagccaguugugacucugcuucaugagugagucuucuucuuaggaguuuacauuuaaggagaggaagaaauugggcaguugguuacagggguagaaaccuagaaggugcuccaaagagagagaugaacuggggcggagggagaauuggaccacguacaagcagacagaaccagucagcaggagcuaugagcagacagcuauagucacagaaaacacugaagaaugcccgagggaugcuaaggaagacaagugugugaaaugaggaggugcucgacauaccacaguguauuuaaaaguauccugacaguagaucauuuuaguuuuccucuguauuaaaaugaauaccauaaugaauauccucacaugccaaccauuguggcauuucuaaucagucucacaaugaguccuuggguauaggguguuguccccuuaagcuuccugaggaaaauaugcaucuccaucuccuggugaauagcauugguuuucugcucccuucaguauuauauaagaguguguguuuuagcauauguaauaauaccaugucuuggucaguuuaaaagguaaaaagaagggggcuggagaaauggcucacuaguuaagagcacucacuggcugguuuuccagaggcccugaguucaauucucagcaacaacaagguggcauuacagugauccggauugggaucugacucccucuucugguguguauccgaagucagcaacaguguacucauaaauaaaauaaggaaaucuuagaaaaaaaggugaaaauagaagcuauuacuuuaauugcuugugugguuuuuuuuauacguugugggacaucugugcuuguucugugaauagagaacaucuuuuguccaguuggcuucuggguucuuucuauguuucucacugaucuauccacaacuauuacauaacaagagcaaugcuugcuggcuuauuuuacaaauauuccuucaaaauaugacauuuugccuuuggauuuuuauuugaggcauaggaauucuguuuucuaauauaucgaugauauauuuuuuccccuuugugauuuccuaggaaauaaauucuguucuuuguagaucauaaaaaaaaaaaauugguugccugcccccaacuugguucaguaauuuaaaagagauuuuagauucaacucuccuauucacucggaauguacuaugaugcguuuuaaucuuuaggaaggaagauuuuguacaagauaaaaacuaggauuaugugguucuauuucagaaauaucuaaucuauguucaagcuuguucccuguagaaacggccacuagugacuuccaacaaccacugcagagaguuagcgaggcacacacagauccauuuaggcacauaaggcgggagcacaaauacucauggguggggaugcugucauuugugugcucuguacagaacaugcucucgcuaaauggaaauuaucacugcugaauauuucaaucuaccuaaacuccucaauucuuagcuggaucuggcugguuacaaugggacuacuuaaacauacugugccucccugaccccaacacccacuucccaauugccugucuuucaaaacggaguaggcuucuuuaaaaagagaacauugugucauugggagaauuuuucucuucucuucuacuuuauacucauugaaaaaccagggaaaugccaaccuugugcuucuguauggucugcuucaaggugcacuggcugagcgaaagcuguguagcuggugaauuaauugucuaaggccagaguaauugguauguagauaaugcaucaaguaccagaggaaccuaaaaggcagggacacaccacacucuaaagggagacuauacucuuaucuuccauuucaguaacuugagggauuggggaaaguuacuacccaguuaccagaagcuggugacagauuuacuugugagggaucccaaagcaaggaccaagagcauccuuuaaacaggaacaucuuaacugccccggaagcuaggaucccuggaugaaaguauguuggaaaguuuggaaagaaaaugguucucucucucucucucucucuccauuuauaagaguugccauggucauguugucucuucauagcaauggaaauccuaacuaagacagucugcuucuucaacugcaaaaaggagauaggcaguuaugguacaaaguuacccaucaacucaacaagugacuauucuccuagggucagcuacauguguagugccuagcauguguugcccuuuuuuuguaccuggacauacauauagcauuaaaauacucaggaauauuaaaauaccacuaacuuaaguauuacuaacaaaugggagaguuuuacuuaauagcucucauaucagggucuaguuccauauuuauguuagagcuaucaaauuugauaugcuuuggagcuauuuuagaauugggaccauauucaguuuguuguaaagagauagaggcugggucucuuguuacacuucaauauacuuagcgacucuucaaauuuaaaagaucuuuaaaaguagcucaagacaugcaacauaauuauaacagaguauauucaauggauggauccaugguuucucccuaguauaaaugcagcuguaacugcaaucuguuuaugucauuuacgcuuacucuuuagaauaugugauccaaucucaaaccaacaaaaaacuaggaaucaauacuuuaagaagaucuguauuauuucuguucacuaaauuugauguuuuaauucacuagaccacuugcccugaaauauugcaagaaaaugaaauaucuuuguccucuaugauaggcugcggauauacaucuucagaugccucucaaacgugcuucuugggcauuugcucuuccugagagcagacaaucaugaucuccccugaaggaacuucuggaacaauuucuaaggugguugguuaaaaaaaaaaaaacauugucagcuuucacagaagagcauucauuccuaaagaaaccccacacacaucuuuauacugcugguucuggcugggagcucuggaaaucccuccuuaguucugcagaaugacagugcucacuggaacgcagucgggagagcggcuguguuuagagcuugcccugcagaggaagcaaaggcuuugugcucugcaggccucuaugguucagcccagugggaagcaggaaggacaggaagugacuuucaaagaagagaaaggcaaccacauugguacauaaguuuugugauucaccugcagugccuagcagcauugugaagaccacguacagguuucuuucccaucagggaggaaggaguuagucugaaacugcagagagagagagagagagagagagagagagagagaaaguguucagguggcuuuguuacucauugacaucacaggcuguccugggaggugccugcuuuuacuuuuauaguuaccugucacugccucuguauccugucuccagacugaugaugggggacuuaugccuacuucaguuuuacaucucccugggcuuaauccagcaucuugcuagcaugaucaaggccuuuacuguuugaauagccauuagcauauccggagcacuugcugucugagcaguucuauguuugcacgcaauuccaucuucacacaauucaaggaggucucuugaauuagcagccucuuuuuucacaaauaagaaccccagcacagagagguggagccacucacgcaggccucugagaagcagaagguucaaagcuaagaagcaugucuuccuuguauaguauaggaggacaucauuugaugcuuuuuggaaggauucccuugugccgggcacuguucuggguacuuuagauggcugcuuauuagagaaaguacuuuuucucauagaguuuauguaacggggcacucgucaaguacauaaaaugcaagcgcuuguucgaugcguggaugggaagaugguauuucgacuuuuacuaguuuuucuuguacuucuauuguauuguguuuccaucuucacuuuuacauuuucagcugaggugacagagucuugggggaaaucaaggaacuuucccaaagugacauagcucacuuguagcagugguagggccuggcucaauucgauccugucaucuucgagccauuucuuugugucaguuuaucucaacuacucaaagcaacacugguuagcgggagggaucuguacucagaagacacagauuucagagguacagauuucaggacaucugcuuggcuucuagccaggcauuugagcacacauuuuuuuuuuucuucuuaugaguuuaaugcucugugguccauaaguuuuaauauuauaugauaacuuggcccaagugcuacauggcucaguaaaaguuauaugaugcaucagguggagauguagcaucuuacaggaugccuguaucuuucucucucuuagccacccugcaagcuuugcaucuugcagaagagaggguuaacagcacuccguccuuucagcuuguuugaaggaagcacaucuaggcuuggcagcugcaguuggguauagcccugccagcuauuggcggaggcugaguggggggguggggggaugaacccacuccaaaagccaggaggaucgauaagcaaacagcacccaaaaaaguucggcuccaccuacaccauccuccacugauagccagacacagcuggcuggcugacagugcccucuccugacaugaaguguucuagccacccaucucaacacagcuuagagccgaaaaugugauguuuuccuaagugccaagucuauuagauucugaacaacaauaugaacuaaccaguacccgggagcucuugucuuuagcugcauauguaucaaaagauggccuagucggccaucacuguaaagagaggcccauuggacuugcaaacuuuauaugccccaguacaggggaacgacagggccaaaaaaaaaaaagaauuagaaaacauuccaccaggugauaaaagucaccgauagaagcaaguuaacaaaaacugcaguuuucacaugagagccaaaacuugccagucucagggagaaaaaaauaauuucuagcuuuuguugaaaguauuucuuucucaucuccccuguugucuuuccuuucguucuuccuucugaaagucccuaccuccccccucccuucucucucucucuuccuauuuuucacauauucaacagucaucuagagaacauuugucacaugucacacacauagcuuagaacaaacacacaccaugaaagcugggacaauaaaugagaaguccccucaacuccugaucuaagggaauugcaaauguuaauuuuaucuuugggaagguuaauguuauuaucaucuugucagguucuaggaucaccuauaggggauaagccuuuaggcauaccugggaggguuaucuagauuagguuggucucugggccaaucuaaggauuaucuagauuaaguaaauuaaggugggaagacccacccuccaggauuuaacuaaaaaggaaaguggaugagcaauagcagauagagcaacugcuuggggaaggcagaugcaauccaucagccaccacauucucuuuguuaacuuaccuuccccacuaagacaggcuuccaaaauaacugugagccaaaauaaagccgucuuuccacgggcuggaauuuuuuuuuccaauacuuugcuucaacagugaggaaaguaucaaaaccaaccacuguaaacuaucuaccguaucugguucaaaggacucaucucucagaugucuucugugccuuccaugauugucccucucuucugucauccuuaucugucuggaauucauuuuaauggucaaaauguuaacaggacucauccaagcaguucagcgugguuucuguuacugccacaaucucaauguucuaaugaggauccuuuuggcaggcauuuaguuauguaaggggucccacccacccacaucccugucucuguauaaaggguagaagggaugaacaaggagcuaaggggucccuagauggccgcugcuuugacguuugccugcuuugccugccaugcuuuuauuuuuuauaauguauguguccuccaaggaaaucauuugaaaggaagcuaucauaaaugaagauggaauccaucucuaucaggauuaacuugaaggaauuugggggcacuaagaaaagauccugcuuucuacauuguugugagucuugaauuuuaauaaauuacacagcccuugcuaacuuuuaaaguccauucaaggcagaucuuaaaggaaaacacauguacagcacagaaauauuuuccuccugugaccucaagcagcgugagagcugucacucuuacaacuuucauuacuucacaguagcaacacggaggcuaugauugaguuagcccucgcgccucacacacauccuggaucaugcugcgauugcucugugcccaucucacccucaaguggcagcucugcuucagagugauauuuuucauuauuuagaauuuucuguaauuuuauugugugacguuaauauuuaauacuaccacagccccagaggcaucuuugugcgacuuuaaaaugcucauauuuuguuaugcccccaccucucucuccucucucucuuuuacaggguuaacccuuucugccucuaguauccagaacauuugaauauaagagaauuccuauguuauucagggaggguucugcucucugauuccuaacuagcucucacaagcagacuucccuuugagaacaugacuccccccaagcccacuguucuuaauuacuuaucggcuacuacacaagaaaaaugguuaaauugguggaaugccuucuuaagauguuaacgugaacauuccaucuaugcacaucagaaauaagucguauuuauuuguagauuucugugcaaaauuuagauaucccuagaaaagcaugucacuuguuauugugugcaaaauaauugauuuccagcugcuucuuugucuuccauagagugugggaaggugucaauauauauauauauauauauauauauauauauauauauauauauauauguauguaucugauguggugaaggaaggcuuugaucugcucgaugcagaacaacuauagucaguaaacccaaaguuuccugcauggaacaggaacacaauaaauucagaguaugucaaaaccacucuggggauaacugaucacacauccgcugccaaucauuccaucauugcuucuaucuacugacugauauuuuaaacacaaaaccgauucccauuuaccugggagacuggaggagaaacagcacaccauuuuagcaucaagggaaagcgcgacccucuagacuuccuuaguuccugaagucacagucaguuccuauuuucuuucuuucuuucuuuuuuuaaauucgucuuucugacuuuucucaagaccauuuauuuucuucuaauaccuuguccuguuuuguguuuaaugccucuugggggaacaccaaagaaguuguuucuuucuacauucaguaaaaacagguuugugcuucccccuuccuguuccauuuccacucaggcuggaagcaggagacaagugucauaggaaauggagacugaggcagagcgagcccuaguuguggaggcugugauagaggccucgacacucuccauuucucccauucuucccuaggaaaggaagaaaaggugacagaaccuaauuaaaacagaagccagccacauagccauugcugcagggcugggauugcaugccuacaacacacagggaagcucaccaaguuaucuggagauuaaacugccaauauucccucuggauuguuacuuuccauacugcaggagagugaccuucaaugucuaaacaaaaugccaguguuguugcuauccucauggucuguucaacaguguugaugauaaaggcuucgagaaggcucaucucuuuccccgagagacuccuuucccuuuucucucuuggguuacuuaguuucuuuguuguugcgaucaaauaccugacaagaggagauucaagcgaacaaggauuuauucugccucuugauuugagggcacagucuagcacaaugaagaaggcuccuaggacaaaugagguggcggugagagucagaggcuacuugcccacaucugguggaucagccgagaaagaacuccagcauuucacuggcggucuccuuuuuguuuuuauucaguuugggaccccagugcagggaauggaugauaccauccaugucuagggcaggccuuuucccucugaaaacccucuauggacacaucccaagcacaaaugccucacuaacgccaaacaaaccaaaaugagaaucaaaauuaaucgccacaaccauccauuguauucuuccaaacauauucuaacuccaagugcuucuguguacuugacauuugcaacaaaguagcuuucuuuaaauccugcuauuuuguaccccauugauugauuuuuaucuugcccauauagucauuggaccaauucagggacacacugcaugagggauucacacaccgaacugauuugguugcuuuguacuaaggucggacaguuccucugaugacuauuaaagucuuuuauggugucaagagaaaauuuccauauguaagaaggcuuucaggauuuuuagaaaagaauuaauucagaaucaaggcuagauuauuuuuuccuuaguccguucucagguagccucuaucacacagggaaaccaaucuccccacccucaaaccgagacaucauuuugaagcacauuaucaaauaguggagaagauuacaauuuucguaguccaaugauuaggaagacaaacuacauuauuugcuaaugccagcucugagcuuguuccaaagauuucaauauuuaaguuccagaugagacaagaaggaaaaaaaaaaucugcuuagacaguuuccuaaaccaaagugaccugcgacacacaaaauacaguucuguuauguccuuugacgcuuucuuuguuaagaguaaggaacauaggcagaaugguagaguguggccccucagagcugauaggcucucugcauaagaacagaaagagacauuucuuauacaguucugugucuacugcuugccucgaggaagcacuuaauggcuauuaccguuaauaguaaccaucugaaguuaauugguuuauaaugaaccgguugacaauacugcugcugagauuggaauagagagagagagcuaaaauaauugaacuuggguuucaccaaagugacaacgaauguagcuuaaucuugauauucuauucacguuggggcagcguuggggacugaacaagggggugucacaccugggaggccaguucucugcuccuacacuauuagcuucagacuuuguagcaauucauaauaacauccuugcacacuacguguauucccuagauggcacaucaaaucccacuuugaaacccauggcucaguuuuuuuuuuacacccaguuccauccaaaacauucaccuucccacuuaacaaggacugcguuuauagagccagcaggcaugucaggcggugugacccagacaaaauccuugguuuugccucuacuccccucccccacugcuucuguuaucucugccuuuuugguugucaacauggucauucacugagaugcccaggcuuguagcauaggaaucugucuugauucuuugguuuccuggaacaguucuuugguauguucuacugauucgcuuuuaaacacauaucuuaaaccaagcacguaucacuaacucagugagcacacugauuuacgucucugggaaucucuccaaugugucuuuagugguuugaauaugaguagcccccauagacuuauauguuugaaugcuuggcucauaggucauugcucuauugaggaauggccuuguuggaggagguguggucuuguugaaggaagugugucacugugagaacgggcuuugagguuuccuaugcucaagcuacaucuagugacccagucuccuucugcugccuguagaucaagauguagaacucucagcuucuccagcaccgugucugaaugcauguuacccugcuucccaccaugaugauaacggacugaaccucugaaacuguaagccagccccaguuaaauguuguccuuuguaagaguugcuguggucauggcgucucuucacagcaauaaaagccugagacaguguccuuuucuuacacucuuguccagcuacuaccugcuaacauccagccaauugaugguuuacugggcauguaaauuagauuguagccuuccccacuuaacagcuacuccagugacuuccuuuacccugcccugccucacgugcgccauuuucugguccaagagucuucaauagaccucacccuguacaauucuccaccuccaggcuccacccacagagccugcucugaugcuuggaacugccuuccaugcuguccugucucaggaucauccaaauguguuguagcuccuuccuggauccauaggggcacagguuuugaugacuugaucucugacgucagugacugacuccuugucccuugacucguccugcacagguuccuucuuaguucuaaagcucuccccaauccuuucuugcuuccccaugcuuuaccucacugugcucauuccaacacacaucgacguuacauuuuacauaguuuuuccucauugugcuuuuacugcaaagaacauaagucccaagaaaguaggaccaucaucuuguuuacagcuauagcccagugccuagaacagugccuacuguauaacagacagaauguagucuuuuaaaagauguauuuaucuauuauauauaacuguucugacuguauguaugccugcaguccagaagaaggcaccagaucuuauuauagaugguugugagccaccaugugguugcuggggauugaacuccggaccucuggaagaacagacagcgaucuuaaccucugagucaucucuccagccccagacaaaauauuuuuuaaauaacaaaguaaccucaugaucuuucuacuuaaaauaaaauuggcuauggcagucucuagaugguccauccuuuugccauauccagggauccaucccauaauuagccuccaaacgaugacaccauugcauacacuagcaagccuuuguugcaaggaccgugauauaguugucccuugugagacuaggccggggccuggcaaacacagaaguggaugcucacagucaacuauuggauggaucacagggcccccaauggagaagcuagagaaaguauccaaggagcuaaagagaucugcaacccuaucgguggaacaacauuaugaacuaaccaguaccccagagcucuugacucuagcugcauauguaucaaaagauggccuagucggccaucacuagaaagagaggcccauuggucaggcaaacuuuauaugccccaguacaggggaacgccagggccaaaaaaugggaauggguggguaggggagugugggggggggugugggggacuuuugggauagcauuggaaauguaauugaggaaaauauguaauuaaaaaaauaaaauuggcauggcuuuucauuauaugaagaacugaagcuuaaguuuauucuaagacaaauacucucauggcucccaguuucaaaucuucugaagugaguauguaacauggaauaaucucagaaaccaugagagcauaaagggaccagggcagugggaaauagcaggauacaugugauaugaagaagcaaaugagaaaaaugggggaggcucuaacuggaggggggcaauauagaagaagggggaggauggagagacaaauaacaucaagguuguuugauaaagccucuugaauccuauuucauauauauguauguaugcauacacauauguaugcauaccuacauauuuaaauauaugucaaacaauguccccacaagagugacaaaaaaaccccaaaaccccaguauuaaacacgagacaucuccauuugaguuguuggucaggguaguccauguaacucccaagauaauguaggcuguugcuguugcucuuuguuggcuuucagaguugacaguaaggcccuauugcuaaagacuccauacacuuagaacacaggacucaggugauucuagguggaucuaacuugaaagccuccuucaugaugucuagcagccacaguaccagaaaguagaaugcacgcuguauggggauagaagcaaucaauagcacccaucagaagccaauagcauccaucagcugugaugccuaggaaccauaacaaugacuagcauggcaagauauccucaaaggugcaucaaguggcacuuggauguuggcuguaacuaacuggguuuaaggcucacucuaugggagugaaaucauugugguucuagaaacuuagccauagccauggggcucauaggucacagaucuuagaagagaaccuaugaccaucacauuacuagaccaguuccauuccuaacuacaggcuaaaacucauacccacagauaagcgcagcucucauucaucaucaaugaagcuucucuuuacaacaaauggagaccaucacagaauaccauaccuggacccaggcaguggccaaaggauugugggaagcacagccccaguggauacagcaacaguauaucuccugaacccaagacucagggaagagcucagaaagagaggguagggagagccagaggaccacaaagucugaugugagacuaugucuccucaaaaugguggccuacacaauacuuguacaaugcuaauauccauagauaugauaaugugaaugggggagaaaucucauuggguccaauuccuagacaagaacuauaggcaaguaauggcgauugagagagggagaguuagcuucuccuagggaggagccuccuuuucuuaggguuuuacugcugugaagaaacaacacaaccaaggcaacuaacucucauaagggcaccauuuaauuggggcuggcuuacagguucagagguucaguccauuaucaucaaggcaggaacauggaagcauccaggcaggcaugauauaggaagagcugagaguucuacaucuucaucugaaggcugcugguggaagacuggcuuccaggcagcuaggauaaaggucuuaaagcccauacccacaguaauacaccuacuccaacagggccauacccucuaauagcgccauuccuugggcccagcauauacaaaccaucacacuccuaauuaguuaaccaauacaaaguggucauuccugaaaucauauaugcacaaacaauacagaugggcucagcagauggcauuuauauguuuguaccugugcauuuacacgcauacauauaucaauaauaaagaaaauaaugccaucaauuugagaaggaguggcgaucaacaugaaaaggauuggagggaagggacgugggagaaguacaaggaggaacggggagggggagaugauguaauuauacuuuacucaaaaauauauuaaaaaucaaaucucaucuuaucaaacauugcccucugccggagucccucccagucccacucgaugcucucuccagcugcaucuuccuccaggaaucagccaccccacucuuccauauccuaacaauuucgggguuccacucaugugcuuuuauauuugucugacuguuugcagucucuucucuggcaagcuacaacccaucugccauguucuguaccucaucccccuccucacauucuucaugcugacuuaaugucucccaccaaauucucccauuuauuaggauaaauucccccauuauauuguauuuggcuacuuauuuucuguuuucauugguagcguguggguccuuguaggauauuuuaccagugcaguuugugcuugcuccuaauaccuacaacagugacugaccuacaguuaucacugaguuaacacuucauaaacgaauagacuucuucuguucauuguuuucuuuaaccuuccccuaucacucccuccuuagacauuaaacugaaaaaucuuguucucuaagacuaucugaaagauuuuaacguagaaacaauacgguugagagaaacacuuuuagaauggaaagaccuccaagagcuuacuccuuucuauaaagcaaggacacuagcaaaauugucaaaauuaggggcuuggaagguggcugagugguuaagaguauuuacuuauugcuauuccagaggaccaagguuugauugucagcacccacauaguggcucacaacugucuauggcucuaauccuguggcaggauuuuucccugucuaauuaguuuaaauauuagugcagcaguaggccugugauuggacagggaaaagggaggcagagcuaggaguugcagagauggggaugaaggagagagagagagaggagaaagaaacaagauggaggacagacgggaaaaucuugauccccauggcuuuaaauagccacagguaguuaugaauaucauacagggguagaauaauucagaugaccugucuagguaggcagcuuuuaucacuaucaauuggcucugaaauuauugcaugggcauuuugugaacugagaauguauugauacauaaaucugacuguuuaaguauaagcucauagagauacuggguuucacuggguuacuggaauguaggacugcuguccacagggggguuuauggcugagaaggaaauagcagcuccagagacaagugaaccagagcugggaauacugugaccagucgcugggggggggggggggcgaggagggaaauggugggagggggugcuaacuagagacagagauggcccacagggcagagaguugccggcaguaguucgggaacuugcuggucguuuuuaauaguucccgcaacauaauccaucaagauccaaugcuuucuuugcccuucauggguaccagacaugaccugguacaaagauguacagcagacaaaaacauccauacacauaaaacaaauaaaacugucaaaacucacuucuuuggaacuuuggaguagcgaguuguagggcguuuuaacuugccucagcuccagggcuucccugaaaacucucagcuuugugcaacuccauggcagcugugagaaccagcauccuggcagccaugggagagggcagaacagguuuggagcacccccagaagccucauuccaagagaaugcuugcuaguuaaccagucugggguuccgugaaagcugcauucccaggguuggccucaacucagaguuugcuggguaggagcaagccucuccuuaggacaauuguggaaacagcagcagcaacuguuuugcaucagaauuucuagaaaugaugauauuguugaaggcuuagaggguauaauaaaauaacacauacacacacacacacaggaaaaacugucaauuuauaugugggauuuuggcacaagagaugucuacacgggcuuugagaagcucugacauauuuaugguaacuggggugcccaugcacaugugcagggcuaugcaaggguccagggaccuagcaagccuuaaucacuuggcucugguugacuuugagguucuuugcaagcuugaugaaaaggcugacagcaaacagucacuagagcauugaagguauacaccaguacacaaagagcugcuugcaguggggcagagacuucuugguucaagacaaguaaggcauggauggggccagccaagcaucuacggagccauagguucaaucucuaaaacagagagaagaaaagagagagcagagaggagaaaggaagaagaggaaagggguggggaggagggagcaagaacugugaaaauuaccaugcuuuauauuaaaaauguauagaguucaauaagagacuggaaauauacuauaaaaaauaaaguauggcucacauaucaggaaagaaggcauuaccaguaacugucccagaagaugggcuugcuagaccaaggcuuuaaaacagcuauuguacuuaugcucaugugacuaaaggaaacccuugguaagccaugucuuguaaggaguuaaaagcuguacgaacaguagaacagaaguccuggaguugaguggaaugacaccugccggaaagugucccuguugcacccaacagaggaagaaagaugagaaaauucaaauacaguccacccgagaagcaagaguuugaggaacaaaggggaaaagaaugaagaaaaauagcaucauaaauaaagaacuggaucauaacgaagccuugucuauuaaaccggcuaaugaggucauugugggaccacucuagccaccuuuaguagcuucaggagacugaguccagaacuuccuacagaucccagaaucccacauauaaauggaaaguuuguguguauccuaugaacaucaucccguauaauuuaaauaaucugaauauuaucgcuaauacucaaauacaguguaaaugccacacagagagagagagaaagagagagagagagagagagagagagagagagagagagagagagagagagggagagagaguuuuguacucuguugcuuagaaaauaauagaaaagcaucugcccauauucacagaugaaaaagacucaaauauuuacuguccuggcugguugcauuuguggguguggaacucauaaaacaugagggacagauuguguguaaacauuaguuauacuacacuaauaaugaucaauuugggaaugaaauuuuaaauaaaauucuuaucuaauaguaccacgaauagaauaccuaggaauaguuuuuuuaaauuaaaaucuuucauauugaaaauuacugaacaucauuucaagaaauuaaauaaugccuaaucaaaaagaaugaguuuauuuucaugugugaggagaagccuacauauuguuagaauaguaaugguccucagauuuaucuguaaauuaaaugcauuccccuuggcaaaaaucucaguugucuuuauuuguaaaaauuuacaaguaauucuuaaaauacacauaaaaaugcaaauaauucaggauaauaaaaaaaaacuuugaagaagaaaaaaaaguggagaacucaaaauuucuaaucuuuaaacuuauuacaaugacacauuaauuagaauguguacugguacacagauagcuauauagugccaggcagcgguggcacacaccuuuaaucccaacaaagggaaggcagaggcagguggaucucuguucaaagccagccuggucuauagagugaguuccaggacagccaaggcuacagagaaacacugucucaaaaaaaaaaaaaaaaaacaaacaaacaaaaaacaaaaacaaaaacaaaacaaaaaaaacccaaaaaacaaaaaacaaaaaaacaaaaaacaaaacaaaacaaaacaaaaaaccaaaauaaacuaaugaacaaacaaaacaaaaauuggcuacacagaucaauggacuagaaacucaaguugagaaacugacucuuauacuccauuaauuuucaauaaaaaugucaagacaacuuuaugauaggaaaagugggcccaaaacuguucuggacaaaaaaauuaauuaaacaacaagaagagauaauauaaucaauaaaugaauaaugguaauaagcaaauuuuucaaaaggaguacaaauauacaauaaacacauggaaaguguugaauggcugagcuguuaguaaaaugcaaaacuauguaggaucaugaacaagaaaagccaaaacacacacacacacacacacacacacacacacacacacacacugagguuuuacucaccaauaagaauaaaauuuuacuauuuguagaaaaaggaauggaacuagagauaaucaugcugucuuggucaggguuucuauuccugcacaaacaucaugaccaagaagcaaguuggggaggaaaggguuuauucggcuucaccaaaggaagucaggacuggaacucaagcaggucaggaagcaggagcugaugcagaggccauggagggauguucuuuacuagcuugccucaccuggcuugcucagccugcucucuuauagaaccaagacuaccagcccagagauggucccacccacaaggggccuuucccccuugaucacuaauugagaaaaugccugacaguuguaucucauggaggcauuuccucaacugaagcuccuuucuuugugauaacuccagcugugucaaguugacacaaaacuagccaguacacaugcuaacugguaagucauacaguaacagauaaauauugcacauuuucucucacagguuaaagguaugggggaaacaagaaggccauggaauuaaaaggggaaauacuagagaugcaucuaggaaagaggaauugaguuaaauaaagagcaauaagaaaguggcuauaacaaaagcauagcaugcaugcauaugcagacaugcaugaaauauucaccacauuuuaaaaugugggguggauaugugacucagugcguccaaugcuugcugugcacacaagaaucugaaucuagauuuccagaauccacuuaaauccaggcauuccaucaugcaugcuguccuagaguaacaacacgguggagacaggaguauucuaggauucacuggccagcaagccuggacaaaacaguaagcuacagguucagcgagauacccuacauguauccacaugggcaaaugcauuugcacacacauacauaccacacgcacaugcacacgcacacacacacacacgugcacacauacaaagaaaucaucugugacaaauggauggucaguucagaggaacaaaaugaacccuugcuuccuaagauaucccaaaauuaaaacaagucauagaaaacacagaaguaaaucauuaggacauagacuggggcaacuguuucuuucagaugaccaaaggaacaaguaacaaaugauuaagaaguccauaacuggaucuaaucaaaacuagaaaguuucaagagucaaaggacaggauuaagaaagugaagacuagaaaugaagaaaauauauguaagcaaaauuaucuggcaaaauauuuuauauaguuauauauauaguuauauauaaaacuauauacauauauaguuguacauauaacuauauaucuauauauauaacuauauauauauauuuaauuauuauugcccaacaauaaaaagcaauccgauuuuuaaauaggauaagaauuuagacaaauuauucucccaaaagauaugcaaaugaccuguggaucuauaaaggcucaccuucacucaacauuaaagaaagaccaaagaaaaagcacaaagaaauaguacuugauuuccacugaaacaacugagaugaaagacaauaacaagcguuguccaaagaaauagagaaauuuuaagccccacauguuagacugcaaccgagcgaagccacuuugagaacucuuuacagcuguucuucagaaaguuaaauuuagcacgaccaugggaaccaacauuucuacucuuaggcacauaaccaggagaauugcaagcaacauucacaaaaauaauucauaaguguuccaagcagcauuaagaggcaaagaauguuaauagccaggacacccguccacugguaagcaaaugaaucauggaguagguaaauaguguugugucuguacaaaggaauagaagccugccaauaacauuaagagaagugcuuaugguacacucuaauguggauguacuuugaaaaauuaugguaugaaagaaaacaggaagagcagcuaucaaaugauucuauuuuuauguagaggagacagggaauggagaauuguuuuaauaggggguaugaagcucuuuuuuaggacguggaauggucuaaagucaggugguaggauucacaaaucugaaggacuauuccacggugacaugccuuuucauuuaaugguuaguggauucuauuucaccaaaguguuuauggaaaacaacaugguggacuuugagcauugguggcucucuccuuucuuauuucuccuugucuauuuggauaauucagaagguucugugcuacugguagcucugccagaaaaugauggugacagcaagugacauuucaggaauggcuuuuaaggggccaggagcaauagccugaggauaaugaguuguuagguuacucucuuauccugggaagggaagccaaccugauucuguccaucauggaccccagugacuuaaguuguugacgaauguucuauaaagcuuaacaaucccugcuacccuuucaggauucagcccaaucaacagcagcucgaagacucauguuuugaacacaccuaaaggaaaacuugaaaaucagaagaauuugaggucuucugcucaccggccaaagcagaacuccaauguccguaugcgugaccggaaaugauuuugaagugauuuugcaacagagaagaaaggggaagcaaaacaaccaaauucgagguucuggguaaauacuagcagcaaccagguagacacuucuauuuccuauuaggauuggaguuuagggcuaagcccuagccaggcauggcucuguagacuucagagauaaaccagccuugaagauuugaggcagaacaucuccuauuacuauuuuugugcuggugccuuguuuuaauuauguuuuugaccuuggaggagaagaaaagacccaaacucauguuguuaaauguuuucuagaugcuuguguguguguguguguguguguguguguguaaaaccucauuacugcuuccuuuuugagacauuacucuccaucacugugcuugcuccuccucuagcuucaccuccccaguuucugauuguuuucucaaguauuuuuuuaagucacagcaauauuucuuuaaaagcacaaggaguuccuguccccuggaagggguugguuauacucucaaaguguuccguguacucucagaaagagguacaucuuuacauugaucuuaguaagccuaaaucuacaucguguuccucagugguugcuccaaaaagcuugcucaguccaccaguuuaacauaccccaccgaucucagccuuuuggacccucauuggcuacaacuucuccgccuucuccucacuacaaaguccuccuacacccuccagcuccaggauuagcucuuccuggcuuugacugcaguuuucuuugcaguaccucgacucuagacaggcugugcuacccagucaaccugcaauggcacgcggagaaucgguuuugaggaucauguugucuucagucagucaccggaguaagaagggaaguuguuugguaugcuguacagucauccugucugcuccgagagcacacaacuaaaugggaucauuucauucccagaugcucaaccgcucaauaauaccuuugguuuuuuuuuugucuuccccaaaccaauuuuaaauuugugaaaggcaucaaguuugaggagcagcuaugggaaaucacugccacagaacagucuguauaaucuucccuggucugugccagcaaauuccacagggcuggaagacaugaucaucugcccguaguuuucugauaauacuacagaacauaccaaauggaagucauguuacuaguauuacuauuacuuuugauaaaaauuucucaaacuaucuuuuuuuacaauauguauuccucugcgauguugauaugucuucuugaaagcugcaaaaguuugcaugguuaaagacaucugagaaauuugggaugagucaaaacaaacugccuuuucuccugcagggcuuccuagaaucuucaauaaugcuaaugugguuugauauucuucuuaacagauugagguagaccacuuuguugcuuuuuuuaaaauuuauauuuguuuuauuuaguaaccuaaaaauugcuuuaauuaauuuuuuucuguguuuaccuacccaauauaguauauuuuuaaauuccagcuuauuaugguaugggaucuagcaugaguuccaccaaucagcagguuuuuaagcauguaacauauccccgcugcccacagguaugaugaguaguggaucucuaagccccgcucaucuuguauaacuggaacuuuggccugcugacuaguagcugcuguuuugccuccuggcagcccugguaaccaaccaccguugcuuacucggauucugugcauuggacuauuguagauaaccucaugcagguuuggaaucuugccugcuugccuuucugggacugccuuguuucccucagugaaauguccucaccacuugucuguguugucccagauugcagacucugagacagaucuuuuaagagccugaaugcuguccacaccgcacuuuacccuugcaucuguugaugacaggugcagaugauuuaccucccgugccuaucgagaacaggacugcuacaaacgaagacgagaucuuuuuagauuuugaugacaucuaccuauggcauaaauaccuggaauugggauggcuggaauauauuguauuuccauguuuaaguuucgggggacugucauauuguuucuacagaggcugaaacauuucugucauuuccaucaaaagugugugcaugguucaaauguuuuccuccucccugacaguacucgcuguuuuuucccccuuuggaaggaggcauccuggcaggggugaggugauagcucaugugguuuugauuugcauuuccuugaugguuagugacacugaacauuuuuuuuuucauacaccuguggucauuuguacacuuucucuggagaaauguccagccaaauccuuaccccuuuaagaaugcuauuaugcauuuaaaaacacugagaugugagagcucuaucuguguuuucugagaucaaccccuugucugaugggugguuuucuacaugccccuugcuagcucagcuggcugccuucauuggcugccugcuuccuuggcugggaauaagcucuccugcuuccuuggcuguggauaagcucuuuguuugauguacuaggcauggagcuuugcuucacucacccaugacuuugcuguugcagccaugaaaucaucgccagcacgacucucaggcagcuccuuaccccaugucuucuucuauugaguuuuacacauauuuuuaagucuuuaaacauaaaauaauuguuuugaugugauguuggugucuggguggcaagagucaguuucguucuuuugcauaucucagugccuuuuccugaagagaucacuuuuuuuuuuuuguauuguauuguauuaaguauuucuugacauacuugguaaagaucaguugacuauauauauauauggacuuauuuaacggccuuuuauucgguuuuauuaguuucuauuucugccuuuauccuagaaucauacuguuuugcuugcuguagcuuugugacauaucuugacaccagggaauauaaagccuucagucuuauacuucuuuuucauuggcuaaggguuuuagaauuguuuugucuacuuguguuaaaaauaguuauaucacuagcaucuuuauagaugcuaccuguaucucaggaguguaguguaguguuuugugaaagaauuugugaacugaaguuuuagauucaucuugugugaccuacuauaacauuuaagagagaaaacucaauaaguagggcucauaucuauuuguuggucaucuacaaauuuauuucacuuagacaauuagaaaaaauauucuugcugcaagugacauugggaagcuuaagugaaauguuauauccauacuaacagaauccuaggcuacaauaaaugguaccuacacuuguuuauagaaaaaagagauaauuuagucacucuuuuucaaauaucaagcaagcauguuuuauuuuaacuucugguuaaaucagcaaugucuucuagaugaucuaggaaagaugaaccuauaugcaacauucagugcaauuuuaaugucuagcaggguuuuuauauucuaauuguugagggagggaaugggaaaagaaaaucucucaagaguucauacaguauucauuagccuuaugaaguagaaauuacccaacuccauuucauugaugagugagcuuaagggaauccuccaaauucaugcaagucauauugaauggcagaacgaggguucaaacucaaguggcccaacucuaacacuaguguucagucuauacuacccaugcugccgucuuuccaacuuagaagcuccuucucaugugugcccgacaguucucuauugagaguaucucaucucuuguccauuuuuaauaagcaauuagccuacucaaugcaguggacuuaauucaaucuuaccucaguggucucuuugaucgaauuucucucaccuucagauacaagaaaagauuacauggaugaaagccaagcuauauuuugcccaaauccucuucacaccagguuguaguaagggaaggcaauauuggugagacacuggcuugaguucgaguuaaaagcccuaacaaacaggcucugagcugucacucacuccacgacaagacagggcauugcaggguuuaguuuuucucuucuggguggcccuuaacaauuuuacuggaugauuuuugacuuuuaaauuuaugguagugugcaagugacacccuuccaguagaaacuucagcuccaauuuugaucuuuucccuagcuggccauaugaaaugaaauacucucuggagaugcugggcagugggaagaugcugcagcucucagucggccacaugacuccuacaggaaacaacaaugcuuaucagugcacugaguugcugagcugugaugugcuguagguaggcauauuaagauacauguuugaccuaugauauuuucagccuguaaugggcuuaaugggcuggaaucucauaauaaguugaggcacauuuguauuugaccagccuccuucuccuucauggacucugcgaaagauagaauucaauaucuuauuggcucucuacagcugcaguuguagcacugaaguagaauguacagacuagcaauaagcaaaaugauucagugaggugaagaauacugaauuuccauuuauagucgugugugcaugugugugugugugugugugugucuucaugugugaaaaugucaggucaaccuuggguaucauuucucagacagcuuuuugccuugugucuuaagauaggcuuucuuauuggccuggguucaucaccugggcuaggucaggcuaggcagucagcaagccuccaggcauccuccuugcuucaacuccucagagcugggauuaccuguaugugcuauugugccuagcuuuuugguauagauacccagaaucgaacucaggucuuaaugcuugugugguaagcauuuuucauccugagcucgcuagcuagcucuauuuacaguaaguuuauggugaauuuggcuucacuuacuaguccguauaucuccgaggugcaauugcuuuauaugccuacauuuucuuuuuuguuuucccaccuacagggucuccugcuaugugcugcauaaauacugauuaauuaugcaaacagaaaaucaguuuugagaguacuguacauuagaaucauuauuaccagcauauguugaauuccgaugggugucagcagaaucuuuuaaaaucuuaaucaagugacaggagcaaaacgguccugacugacacugauaggagcugcuucucaacuggcaaccugucuccccugggaacugucuaaugagguguggucgagugucacucggggaagcuggacuccacuagaaugggaugagauucaggacucugugggauccauggacagaaagagaauagugucuggggaaaucugagaauaccugagaauuugagacuguaaguggaauugugaaagauucucuaguucccuguuuccugaggauugaagucuugggagaaaacacacacacacaugcacacacacauuacacacucauacauacauacacauacauacacaaagauacauauauacacauaugcacacauauccacacauauccacaugcagagagagguauuauuauuacuaugauuaugauuauuauacugggucccuuaagugaauauaugagcaucuaagacucccuagcacggguuuaccaagaauagaacaugccacagaaaccugaaaauuuccuggaaggaaaaguugaggauauugacaaaggcugagcaggagaugaacuuuuaaggaguuugaugguuaggagagaggaaaauucauugcccaugaguauugaaguggagaacaucuugguggaaagaccaaucguggagguuaauuguaagaagucuaguuugacagaguggucagugacaacacaagaaaacagcccacaaaaucaacugaccaggacucaagaggauucacagagauccaggaguccauaugagucugacuuggguccucugcaucuauguuauggcuguguagcauuggcguucuucugagauuccuaacaaugaagagcugagugucucuaacucuuuugccugcuuguaguguuagcauucugucuaaacucuaccccacaauuaccugguaacagccagguaggccugacccacuauaaaaggggcugcuugcccauccucccucucuuguucucuuguuccuuucuugcucucuugggcucuuguucccuugcucucucuucuccgcucucuccucaucucccccccaucucuccaugugcucauggccugccucuauuucucuacucucuuucucucugccuuucucugccucuaauacccucuuacccccccccccccccaaugcccugaauaaacuauucuauauuauaccauggcuggucccucagggggaagggaugccucggcaugggcccgcugagacauccccuucccuguaccucaccacaccucuauagaacauauucuucucuucaucuuuuuauaaacacaucauguaggacccucuuucuccuacugggaugccuugucuagccuuuggucugaugguaugugucugguccucuuguuuuaccauucgguugcugaccuugggaggcugcucuuuucuaagggguggcagggguaggaaguagaggugaggguaguggaucuggggaagaggggaggugggagggagagacuaaggggaaggaagagggaaugcaguugggaugcaauauaugaaagaauaaaaacuuaaauauaauaauaguaauaguaauaguaauaauaauaauaauaucauguuugaguuuuaacccaguggccugcaagaaagcauucuuagaacugugaacaauagugcauauauagucagugugagguggacuuucuucaaaauacucaugggcaaacagugggucuugguuggauuaugugguuaauggaaaggcacaacuuuauuagauccgauccugacuuuucgcagcugacccccacccccuuuucaccuuggggcuguuaaauuguugagcaauuccaaauuggauucaaacugcaucucuggaugagagcugugagugaucgcuggcuaaugaugaccuagaguauacggaauuugcacuuucuacaagaaugucuuugagaaaccuuguuaggaucaggcauauguuaccagcauuaaaauuuccagagaaucacaaugaauagcggcuaaauaagacaauauuaauuuccauucuaaaccucaauucuuccugagagggaauuaccuguccacaaugcauacaaaugcaggcgucgcccuccugggcuuccgaacuuuuagccuccacaguaacuggggcuucuuuugugcuaggaaagaauuugcugagcagaugcauagugggccaaaggucacugcaguuaaucuuucuaaaacagaauuucaaaucaucucagugcccugugcgacaauccuacaccucagcacucaacagucguacguguucacuggagucaggcaggcaggaccucuaguggcaauggcuagucagcagucagcagcauuacacauugcacuucucucaaagagugguugauacaauucaccuuuacucccugcaguaguucccaaagagccaagcuucgugcagcccaagcuucugacguucaaauugccacauguucgaucuguguacguguuucuuagaacacucacagagaaucacuucccacucaccucugcuaauuggacacuugagacuuggcuuuccuuuggaucuagaguguacccacaaaggccuacguacugugugccagcccguggcucuguugggaggcgguggacucuuuaugagguagcuccuaguggaaaaaagguaugcuagggggugugucuuugaagcagaugcugaaagcccaacccucgcccugcccccucuccugggcuuuccugaugcuaugaaugggccgcucugcucuaccacaaccucccacugugaugggcuucuuugucucagguuccagagcaaggcagccaacuacagcacagaaacaguugaaaccuuaagccacaagaaaccuucccuccuuucaggguuguuuaccucaggcauuuugucacaauaauguaaagcugacugacacagacaucuuaaaguaaugcugcccauaaggaauagauuaagaccaccaaaaaaaaaaaucaaccaacuaaccaaucagccaauuaacuaauugauugaauaaucaaucaaccaaccaaucaaucaauuagaaacagagcuuugcuauguugcccaggcuggacuccaacuccuggacugaaguaauccuaucacucuagcuuuguggguagccugaaacuacagacauggccaccuuaacugauuucacugaaugcuuccaagcaguucuuaacuuucacgcuaccaccuuguucuaagauugcacacagaugccucaguagucauuggucucugaguuugaucuuggaaacaguaaugaaaagugaguuugggaacuguuguaucuggaaaaggcacaugggagaaucuaguaguguuugugguggucaaccccgagcaggucuacaguuacauuugaccccucucuucuacugccuggucuccagagggucuacggaaugcaaaggacuggacugcauucaggcagguauucuucagccuaaugguucacccuucaauccugccagacucccuggggguugggcuaugugcaugcagcuagacaggggucugguccucaggguacugaugugugucucggcauggggagaucuacuguggggagauggacaggggaugaggaagagaagucucucuuuucuucugccucucgccugggaguugagaauauucgaguuccauguucacuaggugccuagaugagaaaucuuccuucaggcucaauacauacuuauuaaaugugcgaaugaauuggauacauggaaaugcaugagcaagaaugaucguugguaacaauuuaacauccacuaucaagagauagacagaucauagagauccacucaguggaaugaaucauuuuaaaaaaccauaucuuaaauacuuaaggacauacacagcuguucaaagugcauggcuaagugaaaagauuaagacacuaaaaauaaacagauguaggagagcucucccugggguaaagcaaaacaaguccauuuucacuuacugugguggaaucuagaaugucacuguagacaccugaguuggucauugcugagucacugcacauauggcaaauacaaggaauguaggcuuagguaccugugagccuuuugucacaauauuucuggcaaucaaucaaucaaucaaucaauaucuggcuuucuuuuuauuccuuguguucagucuuagguccuuacauugaguuauaccucaaguacucauuaucucauuuuaugugcauuucuguuuaagcaucuuguauauauguacacacacacacacacacauauauauauacauauauauauauauauauacauauauauauauauauauauauauauauauauauguacauauaugauccauuagcauugagcucaggcaacagcuguauaauucucacuuaaaccacagauauauuucucuuuaagaaacaccccagcccuuuuauacuuggggacacuaguuaacaugucagcgcugucuuugagugccauuuuaaugagugaaaucaugaacaagcuccacaaagaaggggacaggauggcacuaaguggaccccaagcaagacacccauccaacaucagaggagaaacaaggcaguguugccuuccuuaaucuccacugggaaggugaacauuggccacuugugcucccauggcucugugcacgcacaugcccacaagugaugaagaacacaagaguauuaucgauuuuggaguuuuuauuaaauuuuaaugaguagguaccguuguuucuggggcaucccugcaaugccuguggguccauaaaggacguggagaugagccauucuggagacaguuucaggggacagggucugcuuuacggcaugcgaacaaugacuuauauaguggaagccuauugacugugauuggugaauacauuaccuuggauuggacauugggugcucaugccaccagggucucuguguggaugaagaacaugaaaggagacauggagagugcaaacucguucacaggccagcuacuggcuacucauacuaccuuaaaauucaguguucugucuucugggaauacucaagaguguggugugcuacgcucuuauuuagaagagcagcauauaugucagguaggcugacccccaagucaugccugcauuuucuucuacaagcagguauauuugugaguguggagucuccagauaaugaggaaugaugaucuaugcucaaaaggcauaacaacagaagaugcucccagaauagagguauuguaggcacuuaaguaucaauauuuuuaauguaauuuucuaaauuccuaaaauuaauuuggcucuuuggcuagcugugugguguaguaagauuaaaaauuaaaaaaaaagucuaaacuccagguacagugguuccaacacauugagcuguaacuuugaaaaguauuuuaaauucccucauaguuuugaauggacaaugugguguaucgucaggaacacagugagucucugaggguggacucaguucgaccagaagggaguaacagaagcaugaauaugauuuaucucggcaaacaggagucaacucuugguuggcuucagcccuucaucauccacauauccugcuacacaaggcuaggugccccuccacaccuaccucagucacaguccuucaaccauuguacucccuagaguauaucucucuauguaucugcauccccaacuugaucuuaaacucuggaaagucaaggacucaguguggccuguuuacucuugaguugcgccguguauaguauugcuuguuacacagggagagucaaguaaguauuugcucaacacauaauggcacugucacgcacugaacaucucaacagagaacgaccucuguuagaaagguugucauuaaacuggaagccaaaccucauauaacaccaaaccucaugcaaaaaugcacaagagcaaaaacgagaaaguuucuucagucuuaauucaaggacaaguuuuguuuugguuuguuuuguuuuauagucaggugaauaaagauaauagaaguaagaagcuggcuaagucugaaaagaagcacaguucuuaaaguugcacacacggcugggugauccuccuggcuuaugauaacagggcaguacauagcaauuuccugaaguggccauacacagaaagcucaauuucugaaaucgguaagguggauuggauucagccuugaaucgacuucuuuacggaucuuaggagguuccauugcagggugugauucuauacaaugagaacugucuuaacuaucuguagcuguuacagcaaacggccacagcugaaugacugaaaaccauacaacuuuaaucuugcagcucuguccaucagaaaccugacacagaucucacugggcaaagaucaagguauuagcagggcacacaccacuccagaaguucuaaaacgagaagccacguccuuguagucucuagaggcugcuugucuuccagagcuaagggccagcauccuucaucuucaaaaccugaguuauuuucacacuaccagcccucugguucuugugugugugugugugugugugugugugugugugugugugcgugugugugcgcgcgcgguguaugugacauagcaugcauguggaagucagagggcaacuuaggggucuuggagauccaaccuaggugaauaggccuggcaacaagcauuuuaaauugcuaauucaucucccuggccccuaccuccucucuuauuuuuaaggaaauuuugugacuauacuggauucccuggggcaaaucagauuuuuuuuuaaaaaaaaaaguauuuuaaguguuucugcugauaauauuaguuuccaucuguaaucuuaauuuaccuucacuccagacacacucacagagugcagggaauuaggucauagacaucuucugcagccacaacaguacagcaugucacuuuagaaacugugucucuggggucugggagaugccuuaucuuuuaaucguaucuuaggugcuuaucuuucaagcacaagacacuaaggugaauccccagaacccauguuuuauaaaugccagguguccuugugcaugcuucuaaucucagugcaugggagguagaagaaguacgaucccugggcucacuggcuagccaaacuagucugcuaggcuuuguuuucuuuaaauugguagaugucaauucaaaaaccuuuguucugcacauucaugcauauguacauacauacacacacauguacauacacauauacauacauauacauacaccacauacacauacaaacauacauauacauacauacaccuguacacauauaacauacauauacauacacauacaaacauacacacauagcauacauauacauacauacauacauauacguauacacauaauacacauaugugcauauacauacacauaaaaauacacauacauacacacauaauacauauacauacauauacauacauaauacgcaugcauacaugcacacauauacauaauaagaauacauauauauauauauauauauauauauauauauauauauauauacacacauacacaaauacacagagccaugaacaugaacacacacacuccacacauaggaaaccaugucacuaacucaagagaaagagaaaaacgccaggugugguggugcacaccuuuaaucccagcacuugggaagcaaaggcaggcggaucucugaguucgaggccagccuggucuacagagugaguuccaggacagucagggcuacacagagaaacccuaucucauaaaacugaaaagagagagagagagagagagagagagagagagagagagagagagagagagagagagagagagagagagagagagagaaaagaaacuaccccaagguuaaagcacaagaaugaaauaauugcuaaguuaaaacuacacaaagcuccucuuuucuauauugauuuaaggacaucacaggaucucucacaugggaaaauacccgcccauagcuuguguucuugaagucucccccauagugugagcagcgaugagcaugcuaaaaccuggccacugcuggcccgagcuuggauauacagauuggcuuuaaaaucuuugcuucuucgucgucauuucucucucaggaaucuugcuuaucucucuaauuugauuaggcaacacuuuccuauccccucuagcuuuuucaacagcacagaagugagaguuaagaccaucucaggcugagugcucauugacuagaacucugcaggggugauaagccucucugccucccaguguccuuuaugcaaagucaaaacacugcagaaggaggaauaucagaucccuggauccauacacccccagucuaccccaccacacacucuacagacagacaguaacagaaccugcaggguuccacauaccagccucccugcuccaucuuaccgcaagaauacgcgacguuugcucuguuugcuuuugagcggaaccagaaucaauagcaaauuuguuuugccgucauuccuaaauauauuuacugugugaauauggaucagcagggauggugugagacagucacacuggagcuggccgucugugcaauccgcgucaaggcuuccaauaucucucagcaagcccaauaaaucacagggcucaagugcuucugaacucgggcuucuaccaucagcaaaaucauuaggacauuuucagggcuuucugccuuccuguuucaauucuugaacaaugucuuaaccuccccccgcccccaccucccauccccccauccccuaguucuuuuuugcccauccauuucaccuggcuaaugcugaaucgccgacauuggguuuaugcccuccccaacugugaaguaauccugugagugaggugaaagugauaaaugcagccaagguccaucuugucuucucuaucccucuucucucugagacaaaguaugauaacgcuauuucccccaggcaauaaagacuggcucaauuugggacacuaagguggugguagacuuugauggagcuccuaggcagugucuucaauucaaggaagagauucagagauucaucuucaaccaucacagauuuuugaggaugucuuguaauuacugaugaagacaccggccuaaaacugaggggcacagaacucaaucccuaacgucccaccuuuggaauucuguuacaugggauaauauguuccuugugcuuaagccuguuugagugcaaugauuuuuuaaaauucuguucuacacauagauagagauguuugcuaaguaccaacuacuacugcaggcauuugaggcauugcuugggguuaaagagcacccuauuguuauagcagaguaggauaccugucuguggguggagacaggccauugucuccucccuuaagaguuagucaauugaguaggucaaucaccuggccaagggaccacccacccuuaggaaaggaggucuaccuuaagcuaagcuaaagagagaagagaaaugauuaauacuuuaaugagauaauauaccuuucuuccaagaauucccacccucucaccuagucccugagagcugugaauuacagcuggguuugcaugccuuuccaaguccugacuuagaaaguccuuucuuuccucccucccuuccucccucucuccuucucucccuuccccucucucuccccccucucugaugcggaccaaagccuaagcauucuuuccuugauacuuuuggcuuccuuacucuucuuuuaggggucaccuccuagccauguggcugccuuuugcuacacggcugaccccgugcugacuuaacucaaugccacggccucugguuuuccccucugcauccuccuccucuagaugccgagauuuauagcucgcuuggcuucaaguuauucuuuuaaacucugaugaaaauuuccucaagcuuucauuugagcccaugcucaaauucuuuuaucagugagacuaaaaauuccacagggaaccucaguucucugcacucacuccuucuggaaggaagaauuacaaaaagcaaauaguaaauauacccgaauugcugcuaguugugguagcacauagcuggaauuccaguuacaggacgggugagccacacagacugccaguuccaggcuggcccgugcuacaaaguaagugcuuguuuuaaaaacaccaggggccaggauguagcucagggguaggguacuuggaaaguuugcaaaugauucuggguuuaauucccaugcucucugugggggaaaaggauacaaaaaaaaucucaaaaaaaccacccaaauacauaucuauguauagcuauauaucuauauauguaggauaucuaucuauauauguaggacaucuaucuaucuaucuaucuaucuaucuaucuaucuaucuaucuaucuaucuaucuaugugugugugcgcgugcacacacacuaaaucaaaaacuaaaugagucagucagaucagcaagagagacauggagcgggacaaaggauccuaaggacuagggagaaugaugggaguagcugauuaucauuuuaauagaacggucagguuucaccucaaugaaaaugugugauuugcauaauuggggaaggcuuugcagguggggaaacugccuaggcaaauucuccaacuggagccagagagagagagagagagagagagagagagagagagagagagagagagagaagauaggaugccagugcgguggagacgguguggggugggaguuaaggggguagcagcgaacccuggguaaguucaaggccagugcacaggauuguguacccgugacuaaguacaacggggagcucccgaaggcucugcagcagaggagugagacccaccagucuggagacagcacgggcagcagaugucagaugggcagaggaaaaugcaggaagucaauuuagcagcccgaagcuaaccuggguugagcuccgguuguugcuguccaggguagucauggagcugugagaagcaguguguucugaaggcagucccggcagcaugcccugauagagauuacgugggaugugagggacagaaagggucaaagaugacuccaguugacucacucacucucaaacggaccuggcucaccuauaaccuauuuauaacuaauggauguuacaagucaugaaaauguucacuugcaaaccagaaauucaaugcggaggauuuuuuugucuucgccaacuguaucucuccacuuccugacugucgucauagagugaaguuguuugccuuugagcaucagcacagcugugacuuagaguggcagcugucuugucauagccuauacaaacauacccccucuauuucucuuagugugaugcaguuucccguuacccgcagcaucuucuuucucuuucugguuaauggacucaacaucuguauacaggauauuccgacucuaauuuugcugaugcaucacugcaaaugucuggguggacuugucugucacuugccaacugguggagcauauucauucuuugguuuuuucaucuggaacaggaucacagccucuaucuuuagaaagaauaugugcuguggauuauucauguuuauaacuacgaaucuucuagcagaagcaugauuauuaaaagccuugggaagugacaucuugucucacacugcagaacccgccgcccuuuaaccaccauugcuggccuuguuuuuauguaauuucuaccucucuccaguuguaauuuaacauuaucuggcucuucuguaucugguuguaccucuuaggcccccugcuguuuauuuuuaaauacuuuccauucauccugaaucccucuggggugcuuuuuuuaguguuuacagccaaugaaaucccugcagcuuguugcuuugcaguaucuuguguguguguguggggggggggggcggcggcggggagggguggcaguggguuuauguucugccugaaaccaacgaaggugaaagcuggcaggagcuauggaggcagcuccguuuauggaugaaacagcugaagugcuggguggcuaacugaauugcucuugaccaucuggaugcuuaucgcgacaaauugcacccugagcaccgaguaugggcauaccuucuggcaucaauccuuuuaaguguuaacuagaaccuugcaguuuaaacugauuaaccagugacuuggauaacaaggcugggcaugggaagugaccggugacugcuuguucugaggcaggagcaaugcaucauagaccacuugaugaacacaaccucguaaguccagauuguaucuaucacacacacacacacacacacacacacacacacacacacaccacgagguguguguguguguguguguguguguguguguguguguguuuaacuucccauuuucucuaccaauuaggaaaagaauaauaauuuucuagagcaagugagcugugagcauuagggacuuguuugcuugcuugcuuguuuguuuguuuguuuguauuuugagacaggguuucucuguauagcccagggcuguccuggaacucacuuuguagaccaggcgggccucaaacucagaaauccaccugccucugccuccagagugcugggauuaaaggugugugccaccaugcccugcccgcauuagggacuuuuaaggcagcugugaugugaaagaauuugcaaaggggucaauaguccuggccucauagcaacugacaucuccucaggguucugaaccauuguccacuuuccuuuuacucugaauaaaaccaacaaccaaccaaucaaccaaucaaccaaccaaacaaacaaacaaacuaacaaacccaaccaaauaaaaaacccuuaaaacucggaaauggaagcccaucacuuaguuauuuccucucaacugaagcauccauuucuagaggaaggagggaggcucaucagacucaggaaguggagauagaggaccaggaagcucaguguuacaagagucacguggcucaagggcaccagauaccuuuuuugguggagcugccugccaguugugcaaggagcuucauggaugcaguuugugcucgagggcagcuucauggaugcaguuucugcacgaggugaugcugcugcuacccaugcuggcauagcuuuuguggguacaggugucguuaagucugucacucaugucccuguauggaacgccucacucauguuguguacaaguaaauccaauaucaucauugcuuugccaagucacagaugcacaaaauuguuucuuugaacuacaguauaucuccuauggagaugcgaauagguauuuccucauaucuccccaagaaaagucacaccacaaggagcuagcuagaguggugguagcucaaggguggaguagcugguuagcaugccugucuuccugaguuccauccauggaaacaaagaaaagaagcuagacucucauaaagucucacuaacaugucuauguaaccaugagaugcacauggauagcuccaauagauuugccaaaguggacagaaaaaccucauggggacucaaccccacauaaagaucuacagaaauuacugaaagcgggagacauagucuuccccagagaagaacauagcacauggcuguccaauaccaaacggucucaaaugacauacaaguaauguuaguuagacugagcagguuauauguagcagguuauacauucacauaugugcauguaaaaacaacuaaugaaaaagaaggcauggauuugagagcaaggaggguaugugggaggguuuagggugaagagaagggagaaacuuaauuauauuauaaccucacaaaaauaaaagaacaggagagcaagauugagaaagcaagagaggacgagagugagagacagagacagaaagacagagagagaggacauuagguucagcccucuguuagggaacuuucacaagacuggucuaaaaguuccaaacugcagagcgcuacacccugauagcacagggguucagacuugugacccgagccuuugcuguggcugaacuggaaccaaccagaacugccuuagucauccaguucagucuuugaggucuuuuguaaggcagacguugcuucacuggagauuccacgcacaguggcuggugcugacucccccaaauuguacgcugaccacuuuggaccguauucauccacauguuaugauuuacaugccuggagaaugcacauaaagcuacuggguguaacugaacagugucuucuccaaaguagagagccccgaagcccacaccccugcacugcagugggauucuaguuuuugccuagccugcugcccuguuggcccuuagcaguacaguugacaacccuucuuccuauuuuggucuaaagggugaauuuauucacuuacugccugacacugucuuucuggcuaccuguaguagacugaccauaggaaaaaaaaauuuguucaauggucaauauucaaaugaucaguuuugaugcuuuguggguauacugggccuuauugugccuaaaacugauaggaggaaaaggaagggggugaggggaagaaaaguggaagagaaggaagaguacaaggacgacaacaaugaugaugaugaugacgacaaccacggugaggaggugugaauugaaugacuaccuucugguugcaaaucccuagagcuugguugaagagucaagugauauggagguuaaaggucagccaagaauaucuaccaauuuucugaaguguggggcauucuaugcacacauucuucaaacagugagagagcauccauuagaaaccaguaugccucagucucaagagaaggccuuugaggaacuaggcccuagaaaugaggagucuuacauaugaugaggaacuagaacaagacaauaggaaagguugaggcugggaaaaacugaaggaaggagugagugucuucuaacaggccauuuuggccaugcugggugagaaacagagugaaaggauuggauaaauaauggcuuaaccccauaaggucagcuucaaguguuuuauccuaaauguucugcacuacauucacauguuggaacaucuggucuaccugccacugucugaaagaauguggauacauagcuucaagucauggucucuaaucagaauaauccugguuaaugaaaauuucagauuugugaguccugcuucaaaacccugccugacucaccaaagggaaucucuccagauaaugccuucuagcaaccucagagggaucacagggggcagaaaacccugaguauguaauuugugaguaucuauuugauaguucugcaauguuuaugaacuuucucucucucucucucucuuucucucucucucucucucucucucucucucucucucucucucucucucucucucucucucucucucucucucucucucucucucucucuuuccccuuccagcccagagaucuugauuugaguaccuggggcuuaauggauagaaaggggaucuuucacagguguucucagauacauguggucuauggacuugaguuugacauuccugcuggagggucuaaaaaacaauaauaauaauaaugaugaugaugaugauaaaagccuguaugugaaaauucccaugagacugugcucugugaacaaucucaaagguaccugugguccucaggggaguuuaagauggccacuucuacugucccacccagucuuccuuucugccagagacacuccguucuuagaaacuuaacauuuaaccaugagacauguuaacuuagaagagaggcaaucucuuccaugcuucucuuaaacuuaauuucuucagagggauaugccuguaacacuuuucacaaagcacugcucucucauccuaaugagcaauuugaacuuuaucucuuucacuaaaugcuguuaucuccaaguuaccccagaagcuuccuucuuagucagcagcucuuaagcagggaucugucaccucaccugcuugucuggcauuuucugaccuguucuugcucacaguccauagaauaaggccuuggcuccuuaauguggcaucugugcccuuuacaaucugacggccuccuguggcucccuuaauuguuccauguuccaagcuaacuguguuccucaaguccuguaguguccucuucccccagggcccgccuggcauucccucccucuccuccccaucugucacacuuuauccuuguucaaggccuucuuccugucuaucccuuagccacaaauuccucuugucagagcgucaguuguauuugguuaacauggccuugucaccaugucauguauugauuuauuauucuugacucucauuucucuucuuucuuacuagauuccaaaccuguucuugacauagcccuugacacaccucugcaucuuguagauugucuaucacaggacaaagcauagaaaaaccuuauaaugucuaaagaauauauuuuaaaaccuggcuauuuuaauucagaaaaacaauucuguuuuucuucuucuccaguuaaguuggcuuagcuuaacuacuguguucuuuguggcucagaaaguuuucagaugacuuguuggcucuguaguuuuaacuuuuuuuuuugguuuuuggagacagaguuucucuguguagcccuggcuguccuggaauucacuuuguagaccaggcuggccuugaacucagaaaucugccuaccucugccucccaagggcuggaauuaaaagugugugccgauggcucuguaguuuuuuaaagauuuauuuauuuauuuauuuauuuauuuauuuauuuauuuauuuauuuauuuaauauggcauuguagcugucuucagacacaccagaagagggcaucagaucuuauuacaggugguugugagccaccaugugguugcugggaauugaacucagacccucuguaagagcagucagugcucuuaaccgcugagccaucucuccagccccuggcucuauaguuuuaaagugcuuucauuuugcaugcuauccucaggaguccuguagcaugggaccagagagggaccacaagucuggccuucagaggacaaguucucaaugggugaaguacuaagaaugaagaacaaacccaaccaagcauuugccaaagccacuaaagaugaucacacagguuaaaaugucugacuuagauacauuaaaaggagagguucauuuuuuuuuucucuuuuucucagccuguuugguacccaggauaauuucuuucuguuuccuaagugaggacauggcugugaaucuaguccugagccuucugucucugaccucugguguccaggccccuagcgauccacuucaccuccagguuuaucaccauugugcugacucaguugcuuguggcucgucuaugguaaugugcuacuccaccugacaucucuucuagucuuucagagguuuccacgugaacuucugccuucccuucaaacuccagauagcugucgucaccaucugcuccgacucagucauuccuuucucaaccucugguuuucaaacaccauucaccucgucauccaaguucacaaucauucuugucuuuaguuucuuuauguagcauuucugccucugcuauuugugggacuagggauuaacuuagagucuguacauacucaguaaguguucuuacugagcuguagcaccagcccagacuccuucucauucuuaaauuaaauaauuuuuuuuuaaagacaggguuuaucuguguaguucuggcuguucuggaacucacuauguagacaaggcugaccuugaacucacagauuugccagucucugccuccugagugcugagacuaaaagcaaauaccaccacugcccagccuucacucuauuuugagacaggguuucaucaaguuguccaggcugaucuugaacuugugauccucacaacaucaaccuucuaagaagguagaaucauggguuuguaccaccagaccuaccuuauuugcuacauuuuauugauucuucauucaagaagucuaucauguucacuaaaggcucacguagacacuugucugccaaagacuacauccuucagagcccauaaccucauggguuccuugguauuucaacuuccacacucuagucuggaugucuguugccuugcccuuaaaucccugcaauaaguauuugcuaacuauuucugagauauacauuuugaaaugcuauuucucuccacccuucacuaauucuaugggucacccaccuaaggaucacauccauagucuucagucuggaaaacugcacuucucauagucugaacaauggaccccccggcuuuaaagucuaaugcuucgcuauggcaauccuuuuaucucaggagggcucugccuuucucugucccaugucuggcugccuugcucuggcauguacccuuccuuuccccagauccuccuuaggguucaagaucccagucaggucccauuccauuuaaauccacaucuaaagacccuuccaugccuacguaguugcuaaucagggugucauccgaggaucagcaagccuucaagcugcugagaaagacagaaacucacaggcuagaccugugaauccaaaucuacauuucaguucaaucacagcagugauucaugaagguagaagagccccagucuaucccacuuaguacaaacucuaauuuacacaccuagcgguaccccucaagcuucuugcagugugggaagcuguuuuauguuuugcuucuaucuccuggacauaauuuuguaacaaaauacaugcuucaaggauaggcuucaguacccauuccuuagcaacccucccaccaccccuguuuagaaaaugaacucaaaggcuucuagaaagugaaucaagccacuguauaaucaauuguugcugaugugauagcauuaagaggguaggacacugaugaggcguuuaggcucuacugcucaugaccuaaugagauggaagccccaacaaaagguguguugaugguuuagauagggaauaucuaucaaaaugacagugguacccggcuccuugcaccucuggaucacagccugggcagucaauauggcugcauauggagaggauucaucguggucaaccuuuaccuucauucagauucacuucccaucaagucgucacaguugguggugcuauaggaaggugauaucauugcagggugcuaaccucaucaauggauuaagucagggaucccuucaaaguucaacaggccaucagaggcuuagaggaagagggucauuaggguugugccuuguccucacaccccucuuuugcucuagcuguuucucguugcugggagguggacagguuuuuucacgugcucccugccaugauauucugucuccucacuucccagacacaguagaacccaguagucauggcuuugaaacugugaaccaaaauauaccaguccuucuuuuaaguuguuuucucugggguuaugucacagcaauaaaaagccgacaggaggcuucaggcagcugcauagcuuguuucuccaugcagaauucuucuccuuuguagcuaguagcccucuuagguaaccgaaucugccaguacacugaucuucaaauuucuggccucuuagaauaaauaggaaugguuucuguucuucauaaaucacccacuuuguuauagcccagaauggaucagaccccggcuguugguuuggugagaagcaagucaauugacgcacuauaacuucaggugacaaaggaagcagggacagcuugcucacacacagaucucguugagagcaggucuuuguuucuaguacaguugcaugcacaccacuaagacaaggagcuccugaaagcagacacuaugccacagucagguuugaaugaaacaauacccuacccugaauaaagaccuuagucaaguauucacuaguuggauuuauacauaaacgaagggaucacuuaugugaaugaacuagagagauuaaaccuaagccuuggguggacacuucuuacucuagucaacccagguauauuuaucacuauaucacauaauagguaaacugagaugauucucaagcuagagauacacuccuguguucaucccuuugacagcacacaugucaauuuuaaaggucaaaggucaaaguugagagaaagagaaaacaaugcaaaaaucauaggagaacauugaaauggccauggcauaaagccuaaaaugaaaagaauaucuucaacuauaaacaucucaaauuuggaggcuggagagauggcucagcaguugagagcacugacuauucuuccagagauccucaguucaauucccagcaagcacaugguggcucacaaccaucugcaguggggucugaugcccucuucuggugugccugaagacagcuacaguguacucuuauacauaauaaaaacaaaaauaaaaaaauuuuuaaaucucaauuuuuaaaaaauuuucuugagacagggucucacuuuguagccuuagcugcuuugggauuagcuacaaaucccaggcugaccuuggacucacagaggucugcuugcuuaugccucuaaaaugcugggauuaagugugugggccuccauaccaagcugggguuuuaagccuauuuacauuacagaguguuuacuacugacaaauccauccaacaaaaugagugcucucgguaaagcaugauagaacaaagcaggguuuauguagcuuggugguauauguuaucucacaguuuugccgugucuggaaaacacauggcuuugauggccucagaggaaggugacuuguguguggccauguggaacugauggugccaccuuauucuuucauuaaucuaaguuaaaaaaaaaucuaaaggaggagaugacauucagaaauggcaccuugccagagaaauaggucaucagccuuggaccucaagggguugaaggaaagaauguauuuggucuguguuugugugugugugugugugugugugugcgugcgugcauuuguauguggggguagggcagacgacaaccuucaggcaccagucagcuuauuuuauacagaguuuagaaauuauacaugacuaucuagccucaaggauccaccugcccuugccucccuacuauuggaaauguguuugccaacauuccuggccuacuagacauaggcucugggaaugaaauucaggucuucaggcuugcaagccaagcacugagaaaucucuuuaaccuuuauuaauuccuuccuccucaggauguggcuuauuucugucaacuuaccccagcaaagagggcaggaacauguguuguauaauuuuauacauaauugauaauacucaauauauacagcuuucuuccuuccuuuuaacuuucucuuccuguguguauggaaugauugaaauaaaauauugagacauuccauccacaggcuagaauauucuagugcuauuacacaugcuggccauacaucacuuagugaaauaaaaaacucuucucuugggcugaggauguagcucgguugguggaaagcuugccuagauuucaggaagccguagguucuacuccaagcaccacauaaaccugguugcagugguuaugucugaaauuccagcaccugguagaugacggaggaggaccagaaguucaaggccagucugaauuacaugagacccuaucucaaaaaaauaaauaaauaaauaaauaaaagaaaagaaaaucauucuuaccauagaccuugcauuuuaguagaggaaaaaaaaaacuggagaaaacaauaucacacaaaagaauaugugaauuccauaguuugguuaugguauauaguguaggaaaaaagucagagaaagguauuguaaggaguuuaaaauguucccccuuugagaaggugaaauuuaaguagaaaccugacagggaugaaagauagagcuuuuacuggcuagagaaagagaaccccagggaguggaaucaagagccaugggggccagugugugcuggaauaacagggaauagaaagagagcuuucuagagcugcaguaggagcuuugggaaaugagagcaaagaugaggucagauauuauaccauagguauuucugccugcuaaaauaaaaaaagagguguguguguguguguguguacgagcauguguggagggugcauguacucaagagcucaugcauguaugugugcauguguaugugugcaugugugugcaugauuaugcaggugcaugcaugcaugugcaugcauguaugaacacguguguauuugugugcaggcacuugucugugcauguguguaugugugugugugugguguguguguugaugguggcuugagcuaccgaagcaguaauggaaggguucagaggugguagauucuaaacgcauccuaggggcaaagccaacaggauuugcugacaggcuagauugggaauauagaagacagagaggcaucagaauccaggcauucaagauuugucuugagcaaucaggaagcuggagcugugccaugcgucuagaugagagaaagcugcagggugaggcuuuuaggaacgauaaggaacuuaguucuggcaaucugaacugucacaucuuuuagauggguggcaaggaugaggauguaggugacuguggaauauaggagcugaauauggaaugaaggaauacgcaggaucauauccuggacuugagccucugaauagaauucagcacuuuucaucuacuuuuccacgaugcaaagcaccuacaaaugugacccuggaggacagaccuuugugaccaagacuugaacuccaggccuggagcucugacaagccugugggccaugccccuggaacuugccucugucuucugaaucuuugugagggcagugaaugaaugcugcagcagacagguaaacaagaauugcagcauucuuccauggucucauucccccauuccccgccccgcauagcuacugguuaccaggcaagcccuacuugccaccacaucuagaauucauuccucaccuggauguauaugguaaccuuuuccuuuugguuucuguuucaaauacauucuucacauggguacuacaauguuuuguuuuguuuuuguucucuuuuuaaguaaguauauccaugcuauucgcuauucuuauacauauuuuuuucccuucaaagauuuuuuucuaauuuuuuuuuuugguuuuucgaggcaggguuucucuguguaguccuggcuguccuggaacucacucuguagaucaggcuggccuugaacucagaaaucugccugccucugccucccaagggcugggacuaaaggcgugagccaccacacccagcucuaauuuuguuuuugauuuauugagauuauucuacacacaccacaccuauucacuggccauacugugcugccugugaucggcugaucuccauucccagcuauaaauagagugcuuggcauguggugagcacaggguccaaggcuggauagggcaugcucaguucuugcuucaguguaaucacacuuuuucgacuucuauagcuuugauuuuuuuuuuuuuaaaaagccacuugccuucaauuugccaccaccugcuucucccuccacuccguccacacucccccccccaaccccccaccagccacuuagagaacaccaacucaccucugaggagucagcucacccaucaccuuacauuagcacuuuccuuaaucucucucacacaucuaaagauguuccuucccucaaauggcaugauugaauuuacuagcucugcaggugaggcuaacucuaaacacacuccagugucugcucagaauaugggguaguguuucaaagcaggggguuacagcucaagauauagaauuucuuucuugaguuuuggagggagaaagccuauuuucucuggaucugcucccuguauuguccacauguaggacaagacguguuaacugguuaggcaccauuacaccuggcuguacugacaguuguugguacuacagggcuuuccgauaggaaacagggucuaaugauggcgcucaugcugaaacuagggaauuuaacuuaaagcugagucauagcagguuugcaauuuucacauauauuaauguccuuauauuucugagaguuuggugggaaauuguaaaggaaauuguuaagcugaagggaagcuugacaauagaaugcaugccuaccauguacaaggcucuagcaccauggaaacaauagagguuacuuaaaaagagaaaacaaacaaacaacaacagcaacguugaaauccacagagaaccaaauaaaugacuagcaaagaagacaguucacaaauuaugaaauacaaaaagccaauaaacacaggaaagcuguuuaacuugacuaggcaucugagaaaugugauuccaccugaaacccaucagaacggcggcuaggaugaaaacaggcaacaacaaaaugcuagcacuucuguggguuacagaggugggcaaaauggaaccuguguaucagugauucucaaccugucccaaugcuuugaccuuuaacuacaguucauguugugguggccccaaucauaaaauuauuuucuugcuacuccauaacaguaauauugcucuuguugugaaucauaacauaaauaucugauucgugagauauccgacaggcagcccccaaaggggacgugacucacagguugggaaccauugccuucaauacuacugccaggaaugcaaacuagucuagacucacugggaaucaacauggaaguuucucaaaacacuauaaaauaaaacuacugcacgauccacuauaccaguccugguaacuuauuugaagggcuugaagucaguuuaucccagagauacuugcucauaaauacccgcuguaucacuauucauaacaucuaagcauguccaacaacagaggaauuggcaaacaaaugugauaucuaaucauauuaggcaaauuaaaccagucucagaaagacaaauaucacaaccuucccucucauuuaugcuuccuagauuuuauuuggucacaucaaaucauggauguucauuugaaaugaaaguggacaugaaauuguucagcagaggaaaggagacaagugagagagaagauaggaaaagaaaagggagaguaagggggauaggaaaaagauaggggcuaaaaaaaaacccccaaacccaaccccuaaugcuaccacuguacagaacguuggcagaugaauuccuguauguacaucugaccauccuuucugauauguccugagcugcagcucagagcaggcacacagcuucugacagaaaauguacgauggcucgguacucgaauuagaugcacccaucuaauggggacgggaaucaggaaaguaacacccuuccucauuuaucauucaccucacauaaggacugugcaugaauacugggugcauaucugugcaaugcaugcacaagcaaggucuuacucacgugguaagcagguaggcagagaaaucuugucuaucauuuauguagucucaaucucuguuucugucugcucgcucucucacuguuuuucuugugucucuauaccugccuccaagcucagauacauacauguauauacauucagauuuacauaugcuccuuuggagaccaacugcguuuauuaaauauuacagucaaaaacaaaaagccugaguaaaccucuuggucccugccuuuugauauuuacagugugcgugcggcauaucuuauacuagagcuguuaagauggacgcgauccuugucuugccucugauacaauuaggcaguuaacaacucagcugccacugaagaguuuuggggaugguucaaaaucacucugguuaggauaaaaguccagccuacagauuggucauacaggcgaaccugcugggaugcuucuucgcaugggcuuguucacauagcuccaugcaaaugcgcauaugaacacguauccugaacaccggagcaggguuaacccuuuccucuucuacuaagauuuaaaacugaaauugcaucacugacuggcagugucucuaaacuguaaacacacugacuuacaaaggacacagcuuaacugcagacaugagccaauacagccacugcuaaugugcuuaauuuauuuagagagaugccuucucuguuaguacuuaaaauguagugacaucuacgcgagugugauuauauauuaauuugccacagcauuuagaugucucaaugagacauuuuguaaauuaaaaucacaucaaccaaggggacucguguugauugugaagccuucuuauguaugauuauaagugccuuccaauuauaauaguuuaauaacucccaugguuauucuuuacaacaaaagccacacacuugcuaauacggguaaggaugguauauggcaggcagacagguugaaaaguauugauucugaagcuuuaaauuagauuccuauugaucugaugaaugagaguuucauugcuguaaguguuucauggugcucagcuccuauugcaugugucagcaauuuuuuuuuuuuggcuguguacaguaggcaaauuaaaugccagagccugggacuauccagagucccacugauaacuuugaauuacuacuggagauggcaagguccuugccuaccucugucccaucucuggucaggaggcugagcugaagauuucugcacauacuuccauacuucacccaugcaugagucaaagguggggugauccugccugcuaucuggcagaggauagcugaggauguguaaucccacagccccuuaccccugauuuagauaucugcccuaggccagucauuugggcagggacauuuguuguugcuuguuguuguugcuguuguuuugagauagagucucaaacaucccagguuggcaucuaacuuacuauauaaaaccaaagcuggccuugaacuccugaucuuccccccgccccccauaacucccaagugcuagaauuacaggcaugugucaccauaucuggcucaaaaccacauucuaucagaguauaauaugagggccucuagaguuaggcucauugauucuuuuauugaaaacagauuuguugagcacaaagcauccuaggaggugcugggaaaacugagauuaguaauggcuucgcagacuuccauucuaaugacugcucauguucaaauccuaacuagcauaucaucuugauuaagaugguuacugacagagcuccagucuucugauauguaccagauuuaugucuguuggaagaaucaacuguagggaugcacauacaacagacauuauucccacuacucuaaauaucaguuuuaauacugagcaaaaaaaaaaaaaucaaaugcaagcuauauuuaugccauaaguucaaguggcgaugaauguaauccauuaguugaaaugcccccaacuucaaugcuuuuagucaaaucuggguagcauuuauuuaccacauaguaaugagcaccugacaauaggaauaccacugccugccuuccucgugguuugcuuucucagaugaugcauaugagaugaacagccaagugucuuucccuccagagggcugagaauaagaauaguugaccuuuuccucucucucucucucccucucucucucucucuuuuuuuugagagucaugcacaaacuauuggagauucaaacauauuggaaaauuccccaaauuccagacaacaugcacuuuuuaaaauaucaaugcuguugcauuagaauccucggaucaaggauguuuaacuaauaggccuuuucuuuuguuugaagacauuucauuuuuauuuugucguuagaagaccucaaggagaaguuaagaauccgguuuguguaaaagccuaauuaacuauugagcggugugauguucccuaauaaucgaaucaguugcaucaaaaaaccaugaggugcuuucaaguguugaaaugaagguccuaaauugaucaccugaauuauacgcuccuuuaucaaaauguccagaaauuuguguagacugcauuaacaucacaccaucccagugaaugaugguuuguuuuaaucucuuaaccauuaggagucaccugaagggcaggcaggcagaagugguuaugcuggcuaugaacugcgguuaggguggguacucaggguaguaugagagaucacaguggaagucagaggaagugagcuuaagcugccuucacagacaagggaacucauuaaaaaugggagaccuaacagaugucagggaguuuagaacacaaucaagaggacugccuggaaagaauuuuugguuuuauuuuuccaaauauguacuguaauucguguguauauauuuaugcagugguggauuucauaaagucgcuuucauaugaauauauaguguauugugacugcauucauccccggacccuccuuguucucugaggaguuuacaauguccuucucuaugcuguagucgcagacccacuaaguaggugucucucggguugggggcuggcagggaauggauucuguauugccagggagggaaaaccacugccugggccaacaguucucaugugcauuccucagaccaugauuccuuuggcagcuugggaaauuuagguucaaggucccacccggacacaccagggugaaauccagguugcaugugauccuacugugugcuuacuaggagaaucauuauuugagauaagucauaucagacacucccauucaggcugaaagcccuuuaugauucccuucugcauuacaggaaaaaacuaaaacacaugacgcucacuccccacaagcaucucuucagaggagagggagucuaaccuuccacuguuaucuccauuaaacuuuguaggaggaaucauagagccaagaaauaacagacuucugcauuccaacugagacuuguuugcagaggggugauccuggaagucacugagaccaccagaagagacagaugcacugagguuauuauuagaggggaaaaaggcuuuccauacuggagagggagaaaucccuaaaaauaaaaagaacagaaaaugacuuaaaguaaaauuucauuuuccuuuuuccuuugagaaaacaguggcuuuuuugggccuguuucugauaugcugauagaauggaauggagguccucaguaguuaguauucaguaugaaaggagaacggcauaagaacauauucuaacguugcguugguuuucucgcaguaccauccagcccccagaacauucucuggcagcacccacacucuccugugcgagggaauaaacuuggcaggagacuggcaggcacaggagccuccuccuggugcuggugcugagggauaugcuugugacuagcuggagucugccgacucaggaugguguuagaggacgucuuuuggcuucagccagaugaacuggaaugucacaguggucuguguaagacugggaagagggccaggagccauagccaagcagaagaggaggcucacuggguuacucuacacagguuuacugugucgccuucuggccagugggcaggaugaacaaggcugaaacccguugaaggugaauugcuguuugugggccaaacacuuuaugggcauuuuuuaaaccuaucuucaaucaauccccucauacacacagacucuguacaaauauuguccuuauaagcuaaucaucaaaccaaauaaauuccuacauguaugugauuuauauauauacaacuaaauaaagauugucuacaaagucuaagauaguuaauuuugugaaacagaacucucucucucucucuccuucucucucucucucccucucccucucucucuuucucucucucucucucucucacuuucugccuaccuucauuucagaaaacaaauaccauaugagauuauuauuuuaaacacaaauugcacuuaacagacaguguucggguaaagccucuggguuguaaguuagccacagauucuacccgacucaaggcugugaaaugcauuucugugaauuauugugugcugagauccacugccaauacuugagcagacaucaacaggcucagggggaaaugagaucuccacacacucaguguaccucuuauuaaagcgaggugcucggugacccagccucagucuaaccacagagcuagauucucuggguuuacaaagaugagaugcugagaaggaaaaugagaagcagggagucacucgcagacacauaacuagcaauuugaagcugcugcugggaucauuuggucuuuacauuuucucuuuuucuagccucugagaguccucagggacuacuuguuauucuuuccuguccaguggccgcuauguucaauuauggcccucuguuccacuguagacuuuugcuuuccacgcuaggaacacaucuuggugagauauauuuacucccccagguaagcuccaucauuuucuuuguucuucacuagauuguucucuaaugaugucguucauuuuguuguugguaauauuuucacgcauucuacucuggaucuuauauuccucugugacaccccugcucacuccagaauacugccgagcgccucucugccucuuuuauuuacacagcacagaagcgcugugagucuugccaaugacaggcugcucugguuucucuggcaccugguacacagcagacccucaaucaauaucuguuuaauaggaauaugaauaauaucugcccaaaugaaugaaaaugaaugagccuaauaauuuugguauaaucuuagacaaaauuauaaacaaauaguguccaccccuuucauuguaggcaacuuaauuuuucuuuaauugccuugaaaaagaaaggaagagagaaagagagagagagagagagagaggaagaaaacugggucacaugacauacacuauguagaugaaagaugcuccccauuuugauaucuuaugcucuaaugcuugauugguuccuggauagguugugcucagcauaucauggaaugacugguaacagagucccuucuaauugcagcucacaguccuuuauucuacccuuucuaccuugaaaggcugguuauuaagaauggugccuuuugaacaaaugcccaucaucgaggguucuuuaagaaagcccugaaaaacuggggcuucgguaaggaagauuaggucugaaaccccaccucugccacuaucugucuggaugaaacuggcuaagacuuaaaagugucucuaaaccucagcucuguauuagcuaccgaggaugauggugaugaggauauugauggcagagccugaauuaaagccaaaguuccuggcucugaagcucaggcucacaauaacuuuuaucuucccaugacuagaugagauaaucaguacaaaaaugcuugacauggagaaaauauuguuaaagcagcaucaaaagcauguauguaaaacaccaccaccaccaccaccaccaccaccaccaccaccaauaacaaggagggccccuugucccuucucuaguccuugaaaccucaugugugacaugcuccuauguguggauuuuacugucaauguuuuuuccaugauuauuuaugugauugugucuauguauauauauguaugcauauauucuuuuccuucacauuuauggggauugcuuacaccugagaagaacuacugaguagcacgugccagagguugaaguccaguucaaauguugaaggacggccucacugagccaagagcaucacuuguacccacgguguucucagcaacagcaaguuccugcaguggauuuccaggcaaaaccaagacaggcacucuuggcugagacaccaagaggugguuaaagcaauauuagaacaccaaggugguaaaccgcuaggaaagcagagccaucacugugagacucuggucaagcuuacacugugugcgaauagccugcauuggacccuuauuuauagcccuccccccaaguauuaagggucuugagauuuuaccguugagaacagcuaugguggaacagcagucaugacuaugggacacagcagcaagaugcugcggcccauugacuauacaaugagaugagauguauccuguaagauggaagaaucuucaauggcaccuuuaaggcuuuugacaagcauauguauuugauccucugucaaagaaugcaaaacagcuagaaugugaagaaaaaaacggguuuggggucuggucuuguuauguggggagaacuugguuucucugauuguggagaguucaccuccuaaagaugcuggcauuacucaugugccacuugcugguguugcaggcggcccugggguuggaagggcagcuggcagaggagugccagcugauguaccuacuccccaagcuccugcuggauuagcaggcccugucugaggaacuggaggcucaucccagugggucaugacuccacagggaggaggaggcacgguagcaauagcugcugcucuugcuacugcuaacauugccagagccccaacucaguacucaccaggacuuggaacuccaccuucacuuaaaggaagagcaaccccaccucuagguauuauggcuccuccaccugcuaugagaccacccauggacccacaaauuggccuuccccugcuggauaccaauaggcacccccucuccaggaaugagaugcucucaccaggaauuagaggcccaccucccccaggaaugcaucuaucaagacccuaagauacacuugauaaauauuagaccuucuuugucccugcaaugcaucuugugaaacuguguagccuguaagcuuuuugaccccucuuacaucauuaacuauagauaaggaauaaauagaauaauugggaacaaacaaacaaacaaacaaacacaaaaaccaaucaaccccccaaaacaaaaacaaaaacaaacaacaacaaacaaacaaacaagaaaagcaaccaugggggaaaccacccuagaaauucucuuuguuuccuaaggaauguucaaauucaaaauugcuauugugauugccaaaucaaugccagaaauuggggagagagaagauacaaacagcuaugcagauugaauagggauuuuagagucggggugagcuggugacauggguugggcagcgacuaggcucaccugacauccagacagagggcaguguggcucuucagcucuggaggagguugagcucuaaguggacacucaagguucuuagucugcuagcacucagugggaguuuuguuuguucuaaggcuggaauagaagacuggaaaaucuucauggaacgugacaguccuggugcuguccauuuucauagaguaauuucgugacucagugcagaggaggccugccuagcucuuucuggcaguuucgcugucaguaugaauacaucuguagaagagguauuagcugacucacuguauugcuccccgaaaagggguaagacaggaguuaaguuggauuacacuggaaugaugaucuuauuauuuuuuuugcuuucgacuuagacuuuuuauggguuaagaugaacuuauucauuggucuagagaaagagugaucuguguuccuuagagucauaucugacaagauuacaucaagagagcauuccaucccaugaagcauccuaggugaugugcggcuggcuucaacaacaagguugacuguaucaugauguucauuuaucagauaaggauacacaggcucugaguuaacucuaaggugagaacauugcuggugagagaugucaaguuggccugagacacaagucuguuguuucugguuuuacauucuagucuguguuaacucugcuacacauucaugaaagaagaaaguauuuugaaaacagcauucugaagaucaaaaauucagaugacaguagaugcuagcaaggauguggagaaagagaaacacucuucuacugcuggugggauugcaagcguguacuaucacucuggaagucagucuggagguuccucagaaaauuggacauaauacuaccggaagauccagcaauaccucuccugggcauauacccagaagaaguuccaacugguaauaagagcauaugcuccacuauguucauagcagccuuauuuauaauagccagaagcuggaaagaacccagaugucccucaacagaagaauggauacagaaaaugugguacauuuacacaauagaguacuauucagcuauuaaaaacaauggauuuaugaaauucuuggacaaauggauguaucuggaggaugucauccuuagugagguaacccauucacaaaagaagccauuagguaugcguucacugauaaguggauauuagccuagaaacauagaauauccaagauacaauuugcaaaacacaagaaaaucaagaagagggaagaccaauggguggauacuuccuccuuagaagagggaacaaaauacccaugaaaggaguuacagagacaaaguuuggaguuaagaugaaaggauggacuauccagagacuaccccacccagggauccaucccauaaucagccaccaaacccagacacuauugcauaugccagcaagauuuugcugaagggauccuguuauagcugucuuguaugaggcuaugccagugccuggcaaauacagaaauggaugcucacagucaucuauaagauggaauacagggcccccaauggagaagcuagagaaagcaaccaaggagcugaaggggucugaaacccuauagguggaacaacaauaugaacuaaccaguacccccagagcucgugugucuagcugcauauguagcagaagauggccuaauuggccaucacugggaagagaggccccuugguauugcaaacuuuauaugcuccaguacaggggaaugccagggccaagaagugggaguggauggguaggggagcaggguggagggaggguauaggguacuuucgggauagcauuugaaauguauauaaagaaaauauuuaauaaaaauaaauuaauuaauuaaaaaaaagaaaaagaaaacagcauucugguugccugaaggugacaaagacaaggacccaagacaacaauauuaucaauggcaaucuagacuugccagugaaugucucuaaugucacaaaggagguaguauacacacaaagaaauaggaacaucgaauggauaccucacuuaauacaaguugauaggacaggguucuggcaugcagccagagauuccauuuguaacaugaucaggugaucucuggugacuccauguccuuuuaagcauaugucaagaugaaggauagcuguugcauaucccacacuacgguagcaaaauuacaggagaacuuggaauuucuuguuuuagcuuagaaaggaaaugcgugguaguaaaaguuggaaacagaccuccacauuucuugacaccuauucuuuuuaguugauaacaugaaugucuguaaggcauuuaaaacuuauaucuagcaaaaauaagugaaacaacuuuuacugguuauuguccacaugcuuuuuucaaaccucuuuaacgcuuugagaaagcucuuuuauuccuucuuuccuuuuuuuucccccuuugaagcugccacaacagaagacaggagcuggcuggcaggagauacaaguaguauaggaaauccauaguuauauuugaagauauuuccacuugcauuuuucuugaggcaacucaugauaaaccaguacuaccuuguugguauaacagagucuuugaccaguguuuuuauuugaagaaaguacauuuuaaucuuggggcuuugucaaacaaaacuuuguagaucaucuuguuauauagccuaaucuggcuugagcuuccuuauggaguccagguuggccuugauuuugugauucuccugcaucagccuucuaagugcugugauugcaggacuugccaccacauauaguuugauuuaggaaacucaucucaggccucagagcuagcaacagaacaaagacaagcauccaugccuccaaaaugccaccucagaacuauuucuguccaguagguacugaugugggcauuagagccacucuauccaucuucccauucugucuguaugacugagaugaaauugccucacuucucuagaacuugauuuugucagauguuaaaugaagauaauaguaugugauaagguugacuaaauaaguuaauacuugcaaagggcucagagccaugauugccucaauaaauacgugaugaguagguauucuuguucccaccaugcuuuuugagacccaaguccaauguaggaacuuccagagagaugaauugaagaauuacuauaaauaacauagaaagguaacauuuaaaagaacugugagccccuuucucuuuagagauaauauggaguagaacauacuuaaaaucaagucccacagagacucaagaaacuaugggggcuagaggagaccagcauaggcuaauguuggauaaaagaagucagggaaaaaccagucacucuauaggauuaacugaagggagcauucuacuccaaaccaggguaauuuauccuucugccuuccugucucauacucaccaaacacuuucggaaucacuacugugugcucuacucuacgguaaagguauggaggagacauaaauauauacuauuguuauaccuuuaacgaagaaauuauuauuuauuuuuuuuuuagagaaaguagugucuuggcucugaggaugugguacuugaacagagacccaagcaagaugaaggaaucagcccugugauuauccagagaaauaauauucuaggcagaaacagacaccaaccuacaccgggagagaaguggacagaaggcuaugacaaagucuagcgugguuggaaugaccuuacagggagagcaggcagguacuguucacaugacacucaugaggugagauuuggguccaacagaaggaagcuucaugaguccaaagccaugugcaguugagguuacacugggccaucugccuugacaacuauaucucaguacgaguaaaugaaggacggaguuagaaaaaugaagguuagucaacuguugcauucuuuuuuuguuuguuuguuuuugagacaggguuucucuguaucacccuggcuguccuggaacucuguagaccaggcuagccuugaacucagaaauccaucugccucugccucccaagugcugggauuaaaggcgugaacuaccacgccuggcuaacucuugcauucuuaaggugaaaaaaaaaucacugugacucugauaaaaggagaaaauauacuugauaugcuucaugugcauggauuuguaucauguuaauaacaugguuaaacauaguauuggucaggauuuaacucaggcagaggagcuuauuccuaaagcaaagccugguggugggaguaggaagggauguagacagggaacuuuagacagcuacugcccagaggcacaguuggugggacugggacuggagaaucaaaccuagauucuguagguccuggggaaaucucaugguguuuguuuguuuguuugcuuuuguuuuuucccucuuggcuucagaagaagaugcuuaggcuaaaccuucuagaagugaaaaauaguugagucaaguaaagcauagggaauagcuuagcaggcugggacuccacuugauuugggcuaugcacacaccccucuucuaauaauguacucaguagccugagacccucacuucacuaaguguacacacacacacacacacacacacacacacacacacacacacaccucuccaaauaauucacuuaauaacuuguuggaaacuuaagaccugaucugcaucaagcugcauguauaccuacuuuauccaauagaaauaaguuacuucccauagcaaccucaugauaaugaucaauccauuucuagucaaacuugucugggaaggcauccugaaaugaagacagguaggcugaucuggccucaaaccaucuugaugagacauguacuauccugauuguacuuuuaggguuuaccaucaguccucuguuuaccaucuuaugccuuaugcacaaucggacauguauaugauuaaaaucagguacauugugguaagggccauguacaauaaaaaagagguuauguuaguugaagagcacaagucaaaauugagaacuacucucauuacacugauauuuuuagcaaccaaagaucuuccuuugagccacacgaaagaaaaccucaugcaauaauuggggcccuugaguucccuuacucauguggcccacugccucucucucaacaguaugacagacaauuucugaucugugcuauugcuucacauuugaauuguuuuuuuguuggcuugcaaaucugcaucuagucauuauuuuacuuccuugacuaaaaaaugaagaaccuagaaacaaggggcccagaccuccaaccaccaguaaccaaaucacagaaaaauacuaggcauucuaugucaaaggaggauugugugcaagacagaaaacaaaauaaaacaaaaaaaccccagauguuuucuacugggaaaguuaaucagcugacacacccaccaaucuguacccauuugagaagaaagacuucucugacaccuuuagguaaaaaacaaacaaacaaacaaaacaaacaaauagcaaaaacuaaggccaggagacacacaucacauaaagaccagaacaccaugaaaucucacuaguuaacaacucaggaaaacaguuaucguuagaauggaaauggaauaaguuacaagagguuccaucacaguucugggguuaaaaacagcagagcacaaguugaucaacuuuucaaccagaaaauacuugcugauauguaguuagagacuauuguguuucuuuuccuucucuucucucccuuucuuuuucugaauuaaugacaagaucuguuaaauuauggucaugucagggauuuuugggagacgaauaacaaaugccgcugaugggaaauauugacauuucucaagcaaucaaugaaaauaaaaugcaguagccuguaugacauguucagcugcugauaauacaacggagcugaugcaagcaaaagacacagcguuguuggcuauucucaauccaucugcacugauauauuaucaaauucuagugguagaaaugggguaugaaugaguuuaguuguaaauacuucaaaauuccagcauaccacaaaauuguugguauguguuuagcaucuuagaucuaaauuuucaaauugcauuuaucaggaaaaaaaaaaaaucuugcucaaucuuugaagaaauuugcauuucuaugcaaagauggaacacaauauccuuggcugaguuacgaaagucagcaacauuuuguggaacaugauuagcacauccagaaaggaacaauucuagaaaguuuaaauuuagccagaaaaaaauccggagguaucuaucuauucauauguaggcaugggaaugugagcuucacuauggugcuuaaaugucacauauuaucaugaaaauccuaagagguaagaucacuggauucugauuucacauuucaaaaccaaauacuaaaagaaguacggugguuuauaauuagcaaaacaaccaaauaaaaugguuguuagggaaaaagaacuuuucuuuaaggauaaguaggauauaauucuuaccugguauucuaggccaggagagauuagagaauccaaaugcagaaaguuuucaugacagccuuaagcuucgaauuuucaaaauaaaauuuaaauauugagcauaaaguuuguuccuuguauuaguagucaguaggccuuguuugauagcuuaggaaagaacugccuagguggucgucuggcucagugguucucagacuuccuaaugcugggacccuucaauacaguuccucaugcaguggccaccaaccauaaaauuauuucuguugcuccuauauaacuauacuuuucuacuguuaugaauugugauguaaaaucugugcuuuccuaucaucuuuggugcccgugaaagggucauuucaccuagaaggggucacaucccacagcugauauagagugacuuagauucaguaauauuuaaguuguaauugagaagccuaucaguuagguuuuacuacggaacgugagagagcuaucaaauacuuauaaagagcuuaauacucaugcccggaaacguucaacuccacuaauucacagauaucucacauuuaaaguagguuuuccccauugcauagagcuggauauuccuuuaaauugcuuuaauuaaauguuuguuuucuguguugaggcucaaacccauggguuuguuuugcuggguauguguucuucucugcagcuagacucugagcccccaagaucuguauuuuaauuuauauuaauguaguuauuuacaagcugaguuuacaucuauuacuuuguuauuuguuuuuacuuguccucuuucucucuucuguucuggauuaaguauuggcaguaauuuuucuucugauucuugauagguaagguuuugagauaacuguaagaaaagaaagcaggguguuuaaagggccuagccacuuauacaacuggaaugugaugucaaacaugauuauuaaauauuuauuugguacaaaagaauauucacaaaauauauguaaauuuuagaguacuacucuuaaaauuuuaaugugcaaacaaaccaccugggaucuuguuaaaauuguagauucugacucagaugaggcggaugggcucccguguauccaacaaaaucucauauuccugcuuugcagugcgaccuagccuuugaguuacaagaauaaaggcagaguuaauacaaccucuaccuguagccgggcgugguggcaaacgccuuuaauuccagcacuugggaggcaaaggcaggcggauuucugaguucgaggcuagccuggucuacagagugaguuccaggacagccagggcuacacagagaaacccugucacaaaaaaaccaaaaaaccaaccaaacaaacaaaaacaaccucuaccuguggaaacccccggacuaucacugaugggcccuguauacccuuuucuuccugauacugcccuuucccucccucugucucuugauuauguuuucacuaucauauugcuuuaugaagcauuuuacuguacaugguuaucuccccaaguuauuuaguuuacauguaaggaucaauggaaucacuuguauauaagcauucauucauucauucauucauucauucauucauuauguccugagguucguucauauucuuuucuucccauuuuuauucauauucuuaugugcaaccuuaguuugaucauuuucauugcuauauggaauucuucucuaugaauacacacacacacacacacacacacacacacacauauacacaaacaugccuguuuucuagcugauaaggguuugaaguuucaguuucauauggucaggaaaauuccuguucaaauucccgaugcacauauugagaccuaaucauacuauacacauagauguugaaucacucacuauuccucaugauaugcacauuucccacuuuagugccgguucugaugcugaacuauuuacacaguggcugacugcuuucuacugccaccaacugugcggaucuguuugcucucaucuguguuguuuuauauugcugcaaaagaaacugucacaugcucaguggcuuaaaucuauaagugcauugcauguugugguucuguagaucagauauccaaagcgggcuugucugcauucuuagcuuaggguccaccaggccaguguugaccgucacuuugucugaaagcucuguaggagauucugccuccaaaccaaucagauuguuggcaaaaucugguaauucucaguuaccugaucccucauuuucuugugacuuguuacauggcgcuuguuaguagcgccuacucuaaaaaaaaucagcggacauguucacaucauuauccuaaauagcccuuuagucauccguggagaauuuaaaugcaugacauuccucuuaacguuucaauucccucugaacuagagaaaacucugagcuucaaacauguucguaugauuaguuuaggcauccucagguagucucuccuuugacaguuaggaugcuguaaucacaggaacaacacuagcgaugaaaguaacagaacgcacccauggaauccugccuaccaaaauccacggguagccaagcuggccucaauaauucaccagaccccauccgcaccacaaaaugcauucaccacuucuccaguucacagccuccguuugcagcucagaacccuaucaaaaccucacaucacaauaauccaaauagucuaagccaggugauaaacaaagacgggguaaucguauuagguccuuuucuguugcugugcuaggauacccuaauggaaagcaacuuagggcagagaagacuuauuuuggcuuacugcuccaaaagggauacaguccaccggggguggggaaggcaugacaccaggagcgaggcuagccuagcagucacaaaacuaauuacauuuuagucacgaacaggaagcagagagggagaacccggaaguagaccaugcugaaaaaccucaaagucugcccccagggaugucuuuucucaagcaagguuaacuuuucuaaacaguguuagggccuaagaaucacugaaggaagacccccaaauucaaauaguauacaaaggcaaagaaugcuuauucugcagaaaucaccagcauucgggggucaaccacucaucaaaauggugaccagaggcacucacaggcucccuuuucugcaagguuagggaaauuuuccugaaggguuagguagccucuaauaugauugguagggacaaagcagugacaguacaauuuugauugauuugcuauguuaguuucauuauauuugguaagaccuuaaagaacuucagaauccaacccagcucugggcuccuuauggccuuugguuagaugucccgggagcugacugagccccagagguauccuucauaaaucagggucauuauggacuaaugauccaucauugcuggccuccucugaggaacccuguuugcuucccuggcuggggcaguugaaauuuuuuauucccaaggguuuugaaccucucaacagcacugccaauaugggaccagauaucuaaaugaacgagccuauagguguggcauuucucauccaaaacguaauaauuucugauucaaaguaguguugaaagcaaguaccagccagggaaaauugauuccuuucagacccuggaaucagaaccacuaggauucagcucuccucuuuaggcuccaggcuucaucugaguggccuuuccuuuuucauaguauuggaauaguuuuauuugccuucuuuuuaagaaaguuuaauuaauuaaucaguuaauuaauucauacauguuuacaagcguguccccugugugcgcaugagugaaugugucugguauacuugucagaagagggggcuggaucccucauagcuggaguugcaggcagagcuggagauauggauauggcuguuaggugggaucugugauacucugugcucaugauugcacguuaagugcacuuaacuucugauccaucucucuagaaucagucaguucuccucuuaugccuuuaugagcauuccagagacccggcucagaucauccggcuuaucugugggaaacacuuuuacuagcugaaacaucucccugcuucucagucuuucugcagcagagucugggaagucugaggaccgaccccccccccccuuucauuggucuuguggguagagugugucuaccaauauaauuuccucaauagccuuuuggaucuccuguggaugucacacggguucacuaaacuauaccgaggaacacgaguacaguuuucaagcauugcuaucacauuuuugcccucugccaaucuacagccaugaacacuuucuaaaggacuucgaggaugauuggaaagaucuagaagaaucaccuaaucucuuggcaguguguucuggaacuauuuacucagagaguuuuuagcagaugucugcagaacacauucagacuuuuccugcugccucagcauuuauuucugacuuuuugaauccuuuugccaccugggggaaauuuuucaaaaucauuauccuggguugcuuuuauuuuaagccuccccccuuauuuauuucucuccucccacaguuuacuguaagcagcagaagacagaucucagcuucaauaguuuuccuggaaagcuccuuagcuauggaucaaagcacagcucguuguuuaagguacauuucaaagagugacucugucgacuuggacuugucuguuuccaacagcagguuccuggcucuuucucacuccucccugcuagcauucuuuuuauuuuauuuuauuauuaaaaaucgauuuuuuucauacagucuacucugauuacaguuuccccuccccaacuccucucagauccuccacacuuccccucccacccaaaucuacaccauuuccccccuuucucucccuuauuagaauacaaacaggcauauaaaaauuaauaagauaaaaagaaacaaacaagaaaaagagcuggagguaucaccaucuuccauguacugcagugcuauggucauaaaaacagccugauauugacauaaaacagacuuacugaucaauggaaucuaauugaagaccaacccagauauaaauccacacaccuauagacaccugauuuuuuaaaaggaggucagaaauacacacuggagaaaaaaaaagacaacaucuucaucaaaugacacuggucaaacuggaugucagccuauagaagaaugcaaauagauccauaucuuucacugcagaaaacucaacuccaaauggaucaaagacuuuaacauaaaagaauaaacacuaaaucugauagaagagaaaguggagaauauucuugaacucauuggcacagaagauaccuuccugaccugaacacaguuaauuuagacacuaagaucaacaauugauaaaagacaccucauaaaacuaacaagcuuuugaaaggcaaaggacacugucaaccaaagaggcagcccacagaauggaaaaacguuuuuuuuuuaaccaacccuauauacaauagaagaaugauaucuaaaauauacuaagagcuaagaaaaaaauggacaucaagaaaacaaauaacuccauuaaaaaaaaugggguagaaaucuaaacagaacucucaaaagaugaaacacaaauggcagagacgcacuuagagagauauucuauauccuuagccauccaggaaaugcaaaaaaaaauccaaacaaacaaacaacaacaacaaaaaaacaaacccaaaaaaccaaaaaaaccccaaaacacaaaaaaccacuuugagauuuuaucuuacaccagucagaguggccaagugaauaauacaagugacaggccacacuggcgaguaugugaaauaagggaaacccucauccauugcuugcuugugugcacacucgcauagccacuguggaaaucaguguggcaguucuuugggaagaugggaauagauuuacugcaagauccagcuagaucacucuuaggcaaauccaaagaacucuacugccaauauucuuaaagucuagcuucuuacucauuaucauuauguuugggugguguuuuguguacguaaauaugguuaggucuaacuuuugaggggcccuagaaggcccaagcauggcaaacaugguucuggcaggccuugcccuucccucauucccucugccuugcuaaacuguuagauaagauuccuaaagcuagcuaccaaggucuauuccuuuauuuggccacuucauccucuuggggcuauuaagguucagcuaucaauguacugaaaucccauaaucaaaagcccccuuuuggcucaccuaauuaacaugcacgaucaaaauuaaacaccucauccuaacacaggguuucuucuuguucuuuuauaaacugccauuuacugauggcccacaucugucucuucucuauccagagauggucuuuuguccuuccagggcaaauauuccuugucccuccugccuuguucccuuacccuucuucaugcuucaacuccuggcuuuugguuuuguuuuucauuuauucccugcucucugauuuauugcucucugcaauaaaucuccuuugugcugagaaauugauauuguuauaccuugugacaauaccaguccuuucaauuuuuacuuacuuucauguagauaaauauaguuaggucuuaauuuuacaaagggaaacucagauuuuuaaaaggauauuuggccacuuacauuuaauauaauuaugacuuacuuuuuaaaaaaaaaucugucaaucucccaauuuaguuuuugcuucccccuuuuuuccuaacuucuuugagaaauaacuuugugaauuuaaucuccauauuugaagaauguuuuauuauuuuuaguaauugcccuacggcuuacauuauucaucuugacuuuaagucuaguuccaaaucauguuauuucauauacaguauaaaauccuuguaacauuaauuuuccacuuccuuuucuguuucuugucauauuguuauauagcuuucuucuaaugcauuacggacuucuugaauuguuuacaacuuugcuuuagacauucaauuaucuuuuaaaagcaguaaaucaagaaacaugucccaaauuuaucagauuuaauauuucuugcauuuuuaaaaaaagauaucaauuucuaucuggggucauauuucucuugcccaaagaacguugguguuucccucagcagcacagguuucggcaaauguucccuuugugugaaacggucucuauucugccuuuaccuuuccuagauuuagcagauuauaagguuccuuguagccuucuuuucuuucagcacuugaaagauguucuuccauuguucuuggaucccaauuuuuguuuguuuguuugcuugcuugcuuuuuugagacagagucucucucuguauagccuuggcuguccuggaacuuacuaugaagaccaggcuggccucaaacucacagagaucuacccgccucugucucccaagugcugggauuaaaggcacgcaccacugucugaucacuuuuuuuuuucuuagaaaugagauauacagaguuugugggaagaaguaguuuacauaauaaagugaaggucucagcaugcugaugaacuuaauuagaacuaaguaacuucugaaauaaaaguaagaauaauucagagacaaauguuccugaaguacuugaucacacugaauauuuuagagacacaguuaugauauuuacaaggcauaugaacagauuuugauuucuuuuuucccccugaaauaguaguaaaacaacaguaacagcucacgguuacagagcgucuuacaaaaggcucaggagaaaccucuuccaugcacugccacagguaguagcugucaccaaggaagcagcuuaagagaggaaggguuagucuaacauggugggguggggaggucugugcugugacagcaggagaaagcagcuugcucacaugugggaggaaugugaaggagggugccaguccucugcugacauucuccaccucuuccucuuuauucagugcaagacccuacccaaugggagagcaccacuuacacacagaguguguccucuuuccucagccaauucucuguaaaagaccuaacagacacaccccaaaguaucccccacuaauccacucuuuuauuuuuuucagaccaaucaagcugaccgaugaagaauuagauguuuuauuacagcuaucagcuguuucauuuaguauuuauuugacacauacuuugccuccuuguugugguagacauugaaugcaaaaaugaaugcuguauuugagaagcucacagaccagucaaggcauagcaauagccccuaguuuguuuguuuucauagggaauuuauccuuuagauauuaacucccuauagggaggguacuuagagggagaauuuuguuguuucauuuuugguacauagaccuguuuaucacauaaauuagggaaauucuauguguuaguauaauaaaauaccuacauuuaaauuaaauuauuaaucuguauuaauuggaauaauauaaagauucauugaaaaaaaauuuuuuugagacaggguuucucuauauagcccuggcuguccuggaacucacuuuguugaucaggcuagccucgaacucagaaauccaccugccucugccucccaagugcugggauuaaaggcgugcaccaccaugcccagcugauucagugaauuuuaaagaugaauauaacuauguagcacgcauuuuugauucuuauaacccaacuguguaucaauuaauaaucuaauaauaaugauaaugcauaguguugugugugagcauuaagugccaugcaaauugguaaacuauuuaauucucacaacuaucuugagaagcagguacaaucuguccgcucauuuacuaaugagaaagccaaaucaccgggaaacaagcuugcugagcgcuaauaagcuggucagcgauagccauuaaguaauaaaagacaauauuuaauucuaggcagcuuggcuccagagcucaaauguguacccacugaucuucaucuuuaucagcugcauuucacacauguugucauauguacauaaacacacaaucucaggaacacaacaccuguaaacaaaauucugugagauuuuccauuaaggacagccauugggcugguaggggacuuacaccauagggggacauacagacuguuucuauguaaaaggauaacauuagaagacagugcgcacgggggcuggagagauggcucagugguuuagagcacugauugguguuccagagguccugaguucaauucccaacaacuagcaaguacacggaggcucacaaccaucuguaaugagucuguaaugagagaucuggugcccucuucuggccugacggcauacaugcacgaauacuguauucauaauaaauaaaucuggaaggaaggaaggaaggaaggaaggaaggaaggaaaggaggaaggaagaagacaaugaauaaacaugagauuuagauagacuacacaaucaugcccucucugcccuggcagucaugggcaugcuccagcaguaggaccugccuaugaagccuggcucucaugcaccucucuaaacuuguccuggcauucagcaccaagacacacaagcacccuugucccucaucaaucacacuuccuucugccugugggucuucacacuuaugguaacugguagcaagacuguuccuuuagcauucacuacucaggucaaaggugccuuccucaaaggagugcuucaccaccaccgugcuuguuccauguuuccuaugagucuuguccuugucugaagguauuuucugaccugcuuaugguccaucucuccuaacuagagagccccacagcaagaauuggccuuugugucuugucucugcuuuugucauagguccuucaaacaguuuuggucucaucugaagaaccuuuccaaguuuaauagcugugauagggugucucucuuuggccuguuuuuaggucuguagccuaugauuuuguucauaagaggaaagcauuuagguuuuuuuuccuucuucuuuucaucuucagaaugcacagugaacucaguggcaugcuugggcucgugagucuuugugguuugugguccucucccuugggaguuaccgaugaguaacagugaacucggcucuuugcaucugagcuccuuucaaagguucccccugcuucaugggucaccacuggcaugaccuucacacauccuuucccaucauccaucagcugucacagggcuggaaacauacaugagugugcuaggcuucugaaaagauuccaaggaagcagugagcuucagggacgguuuuauucuucauuuauaauauauuuagacauuuaaagaguugacuacugggcuaagugcugagagcaaaaugaugaauaguguguagcauaaagcugugaguuauaggcuacuuucaacucuguuuuaaaaaucugauuuacauuaauuuuuacuucauuaauuugcucugugaaauaaacacauauaaaaugaucuuuaaucuuccuccugaacgucuggcauauuaauuucagcccuguucagaagaacaugaucuaaaauggugaaguaagucauaguugcacugaaauaauauugguuuucaauuaucaaguaauuuuuauucaaggcuacuuaauuagcuaucacauuauaauuaauuaaacuacuuucuugcuuuauauaaugcuccugcuuuuaaagugcuuuugugugggugugugugcuuggguggcuagguuacagcugcauccuuugauuguauacaguacacucuuguggggaggggaguugagacaggguuucucuguguaucccuggcuguccuggaacucacuuuguagaccaggcuggccucgaacucagaaaucugccugccucugccuccagagugcugggauuaaaggcgugcgccaccacgcccagcuuacagcacacuuuuaaaccucauuauuugacuauaaaccacaugaagcuuccaucauuuuuacaaugggggcaaauaauaaugaugauucugcccgcacugcagggcauuguggggauucgugaguacacacaugcacauaguuguguaucacuuaauugggucuacauaguugagcacugcaccagucagugaugacuuaugugugcaacaguggucccagaagaucacauaucacagugaugucacaguugcuuuccuuugugcuaaguaaacugugacuauuguacaacgaugaaacuccccaaugacacacuucucagaacgaauucccaucguuaagugauacaugaccacacgcauauggcuggugaauucucagaauauccuagaagacagacaagauuguuauuaguguucucaugauagauauaguggaggcuuccugagguugaaaaaucugcuuuaauacagaaggcuagcaguuauggagauuggaacuuuugccuuauuaaaauugucccagcgauuagugguguguguguguguguguguguguguguguguguguguguguguguaguaaugcagaguaagguuauuuagcaggugacagcagggguggcucuccugcauguacagauguuuauuacucucuugcccccacaaacccuucccucugugauuuuggauuuuucucuaaucucuucuuuuuagaaggaugccugucaucuuggaguagagccgaccccuaauggccucauuuuaacucacugccuguuuaaagaucuuaucuuuaagcacagccacauucugggguucuaggccuuagagcuuuggagaaaugaaauuugauccacagugcuuagggaaauuacaaagaaaaugguaauuaauauauaacaugucuuauuuucuaaguaaguggaucaaagagguuauaugaaauaguaauugcuauauuagucacgaaacugauuccccagcacauauggcuuauauuuaaaauuuugaaauauaaaaaucccuugaauacauuuucuuauuuaucucauuuuuaguaauguuaugaccaucacuauguugaagauacugcuaacauacauugaguuuacuauguucuagaguuucuaauaacauauaugaauaucccaacuauuauaaaauuaggaagcaaaagacaaaggagcuaaaugacuugcucaagguuuuaugguuauuaacuagaauagcugaaauggacuccaacugcaucaguguuuuuuacucuguggaucuccuaugugcuaucgaguuucugcacagauggaguaacuugggucagagaacaacuggaaaauccagacauauaugaagggauggauacugcacuuuacaaaaugaaggucagcaauccucaggaaucagaagccacaugauugguccguuuuacugucuaggcugaauacccagacagaaccucaggaaggugguaccaaaagucuauguucuacucuuaccacauccccaccagcucaaagggcucugccaacuagaccagcugagacagaugauauuaagcaauaugcgaguaaagaccuugauauacuuggggacuauggcuugguugcuaagcaggguuugcuugucauaucucuugguaugcugccuggaucaacuuuaauagggauaugaauugacagagcggguagauguuuaguaagaacugcacauauacaaaggcuagcacaauagagauguuguguucauuauuuaaaaagaaacacaugacaucuuacuaaaugcauucuuaccaguuuuugaagcaugaccuacacaguuagaauuuuuagaauauuuagaauaaacagccauuuagaauuacugaaagacauauaccauccaucuauucuuacaagguuaccugcuaccucuuuauucacagacuauaacuaugugggaagaagauggcaacaaaauuacaaagaaucucccuuucuauacuacucugaauuguuugaacuaauaaaaacaacuaauuauacccugucacuaaaaaucaaguauuaacaaugauaacuuuccuguuaucagcuuuuucaagguuguuggcuuauguuagaaaaugcuuagggcuggcuguccccgcugccucagagagcuacaucuuguuuagucuuuugccauucagauguugucauauaauuagcaccaaaaggcaccuaagcuucuaugcugaaacgguucaucucaauauucauuugagauuugaccaugcuucuuuucacuuaaaaugaaggaaaagaaaaaaggagucagacuuucaagugaucuauguugaugcuuaccaacaccucuuaguugcucccgguugguguuuucaagggcagguggauucugcgucugguguucuguauggaaccuguccuugugccuguuuccgguagggugggaagagaacagcugucaccuguccugccugcucugagaacucagcacuguguuuggcaccauggggauuuucccacagugcuuugcaggaaaacaucugacauuucaugaugauacuuaaacauaagcucgacgcgagcuggaggaaguaaugcgaaacuggaaaacagauuaagaauuugaaguggucucuuaagccggggugacccggggugguuuaaaaguccgcuuuauugacuauuguacccuaaaguguaagaggagguuuucugacaaggauuaagagaggaguucuguaaaccugaaucauguuuuucagagguuacugaagaucacacugagaacagcugcugggaauguuaaacacaaccguggagcuuugaauggaagaaaagcuucacaaaagaaaaauauaucauuuuacuggaaacuugugccuuugguggugaagggacuugucaaagcagcgaugagaaaauggcagcgcgcaugccauccgaacacagggacaucaauuaauaugguuucuuaaucauaaaaaaaauaagguuaaaauauagauguaggcuucacaugcaucuauguaaaaaggaggcaaggaacgaucuucaugggcucagaugaauggcuaccaacaauaauccaucccauguaaucuaggaugaauauuaaaaccacagccccagacacauuuuccuacuccccuuccucccccagccccccuccuccagccccccucccccggcccccccuuuuuaaaccuuugcaacaagaaagauggagccagccuuccuggugccgccugcuuucugguuggaagaacaccagacccaccuaguggacauuucaauuacugcacacaacuuuuaccuucggccaccgcugcugaauuacagcgcugacagaagccuugaagugagaucauugguugcggucuccuugugggucauagcagaaauaguaauaguuaaucuccaacagauaaagcugucucuggcuccugaagggaagcccgugucugccaaccccccgccacccccccaaagcccccagcauacugcugcaagcggaaggaagcaccaacagucaguuggcugcagagacaagacacccgauaggcaucuggaagcuuucaauuuuccaggaaagucaacgagcaaggugaacagcuuggcagcuguauccaccgcggagcccagccuuuuggugagcagggugaacuccacagagcacagcugacgaauuacacugugaccuuugcgcgaaucccugggcacauaaacuggguuuacauucaauuucacuuuuuggaacagaguagcucauguggcuacauuguacccaguguccugucacugagccagcucggccucuguaucuugguagucauggcagauguuacauauauuagacuguaauuugggucggagaaauaaguguucugggagaaaggacuuuggugaaauacaaaagguuacaaaguacaacguuuuagcaaauucggcugcuaggucaaaggugacauccuucuacacaugauuuauuuauuauuaggcaucagaagaaaaggccggacauaaggggugcagagagauguuucuguccugacuuguggguaguugaaauaguuggcagaugguggcuucaggcuaggagugugcucuguggcuagcacugccugggaagggcacauggauggaccuggcggucugucauuagaagcaugugaugugcaaacuguugcucccgaguuuacuaacaguuccugcucuuccaucccacccuuccucuuccacaucaaucucauugucugcccccuacuccccauguuucucauuaguacuuccaucuucagcucaucucguccaucuucaacauccucaacagcuuccuucuuccguuuccucuuucuuuccucuuugucccuccuuccuccuucccucccucccuuccuccuccuccucuuccucuuccucuuccuccuccuccucuuccaugucuauggcugcaucugacaugguagggcagccagugagaaagaaauccagacucuagcuagaaagcugcuguaguccacugcagaggaggagucaggcacaaagguggcugcagccagcacagagcaagacucaggaacaaugagcgaucacucuuuggagcaagugguagggccaaagggcuucuuuaaaauaauauuuaguguuaucauagcauauguuuuaauuaggguuuccaaugcugugaggagacaccaugaccaaggcaacucuuauaagggacaacauuuaauuggcgcuggcuuacagguucagagguucaguccauuaucaucaaggcgggagaauagcagcuuccaggcagguauggcacuggagaaggagcugaaagcucuaugucuucaauccaaaagaagccaggagcagacugucuccauguggcuaggaagagggucucaaaagccuaccccuacagugacacacuuccuccaacaaggccacacuuccuaauagugccacucccugugccaagcauauacaaaccaucacagcaaagaacacuucuuguccgguuaacuuucuuaaaaccuucuuaagcauccaggacaguauugcuaacgagggucccaacacuugcagaagauuucuagaguucauuccucuaacuaauugaaauuuuauuccuguugacuagcaguuuuuuacgccuuacuccauaucccagcagccaccacugaacaacugugugcauuaaacuauuucagauaaucucacaaaggcaaaaccacauaugauuaaguccuuucuacagcuuauuccacuuugcauugucuucgaggcucaccuaugucaugucuuuccauagaugguaaaaaagggauuccuucuuuuccaagaccuacuaauauuucauuacauaugugguaugugugcaugcacacgcucauacgcgcgcccgcacacacacacacacacacacacacacacacacacacacacacacagacacuuuaugcauacauucacugagaagcauuucauugugacagucucggggagggacuguauauaucagauuggucuauagacacgucuguaggaaguuaucuugauuauaucaguagugggaagacagccacguagguaguauuaguccuugggcaggggacccugaaugaugugaguagagaggguaagcugggcaccgguuugggggggucauggauucaucucucucuucucuuggcugugggugugauaugaucaaugguuucaggguccugaugcugugauguccccgcuuagaugacuguagccuggaaaugugagggaaaaauagacccucccuccucuaacuugcacuuggcaggcuuuuuuuuuuuccacagccacaggaaauaaauggagccuguuuauguauuucucuaagauuuggauuucagugauuuugaauaaauauccuaaaguuggauugucaaaucaugugcuagcucuagccuugugcauuuguuuucugacuuuaucaauagagcggacaaauaaaagcuacauccgaggcccacagugugauuaauuugauauacaaugggaaaugacuucuacaaccaagccagaacaccacagcacacguuaaucuccuuuuaaaaugaagaaugcacaagaucuacuuucuuagcacagaucaagcaaaugaugcuguguuuuuacuacagcucauuguuauacauuagaucucuaaaaguuaaguaucauuauaacugauuauuugacucuauuuuugggggcaaggucucaugcacccaaagauggcugugaaugcauuauauagccaaggauggcaauggacuugauccuuccaucucuaccucuugcaugcuaggguuacaggguugcaccgcuggccaguuuagcaacguacagauugaaucaccauuacucugcaaccuaucugaagaccagauaguaaguacaaugcuucaaguuuuuuauuuccuaaaaaucaucuugauaauuugugaauuuuauaagaauauuugucuacuucucuaaaaaauaaaaaccauugauauuuuaacagggaauauaacgguauaaguaauauaauaauuguauugcuaagucuucuaaucuuuaaaccaacugaagacuaauuccauacauuggcugcagggguucuugcagcccauaaaaauaauaucaagcaauugcuaaccauuuuaaacauuuugaagaucuguuauucuaucuuuuagcauuuaggggauuuugaaauccuguguuuuguggaugguuugugugugucugucuacggauacagauccaugucccucuuacucaucaaggaauguccaguaucacugcagcacaggaaagcguaaugguuagagcccuugcgugguuucccauccugucuaaacaguuaugaccuguggcacacacacugacaucugacuggcaugacaagcauucuaggauuccguugagcuuguugccuucauuauagagguuuuuuuuuuuuuuuuuuuuuuuaauugccuuuuuacccuuccaguuucucuugcugcugguggaggccacacaauaugauuuggcuaauaaaagguaacaggaaagcuggcagaggauucugggaauguucugaauucccacugagagggacacaagcaggaugacaucaucccucuucuuuccuuaaccuaaauguggacaugacuccucaaugcugggcagccauuacugcccaugagacaaagggaagcugguucucagaggugcuagcuacagaaauacuaggagauaguaacugcucagcugagugcuaugggagaagggcuaaaugacaguuucagcuauaaguaacugggugacuuuuagguaaaagugauuuugagccuaguucuuuuacuuaguuuuaaaaugggaucauagcaaccucuuccucaugagauuguugcaaagauuaaaugagauuucauauauguacguauacauguacaggacacaaaauauauacaaaaaaccaauaggaguuaauugucauguuuauuucuauuuuuuggugaugggggccuuuguaaguaaaucaugguugaaugaguaggucacaguuaaaagaugcaggcucaacccaaggcagcaaaacgaugcugauguuuuuggaaaaaaaaaaugagaaaagggggggaaaagauaagguagccagaggcaagcgacaaggcuauagaggggucaugugggcucugggccggggcacaguggcccacgagaaaccucucuuggugaaggaccagcgugugggugcugaggccgcaccuguggucccaggugugccagcaucaagacacugaauagacguuuguugguucccugauuaacugaaugaacagugaggguauuaacugaaaagaaacugcuaucucuuccuuaaggcggaagagcuggaagcggcaggaagacuuuucuccagagccaucuguacgcuuuuuauaauauuugccuggaaucgugugggugaagaugcagcgcucuauaauugccugugcccuugcgaggagccgauaagaacauccggugggggcagaagcagaggcagaaggaacagauuucccacagaguaaaauguucuuuuucaugaggggggaaaaaaguuccuugcuaugacaagaagaggagacccuacagcagagcggcagaugccuccuaauagagagagauugccagaguugcccaccaggagccggcugcucauuacacgaggaacaaacgcaggagccagcauggccgcccucuccucuguucugugggcuggugcuggaacuguagcauggacagaaagguggcucgcuuucauugcuguggccaugggugacagcgcgguggucgucggaaucgcacugaaccauccccuccuuuucaucuguucccaccuuacccugcuaugacccuggcauguuucuaauccucacuguacaaaacaugucuggacagccaugggaaccugagaccuauaaaaaggcuuagucacaugggaugaagaggcagaugccuccacgaggggaccagcucugauagccacguugcugagcauuauuuauaucagaacuuagcaugaaggcucccuauuuuauccgcugucccuuccccgaguaucucaucucuuuggauuauuuuggcuuuaucuuguguguacuuuaaaugugguaauaaaucgcaagcaguucugcauuccgaugugauuugggcauacacauuugcaccccuguucuaagaaaugaggcccauaaaagucuuccaugagugacaugcacauguguacacacuacacacacacacacacacacacacacacacacacacacacaccagagaggaguuaaaagcauaugcugauaacugaaucugcugaugacauuuugaguagugagcccacuccgcacagcugaaggguuuggcaugguacuuguucaugggaacaaagagcuggaauaaaacacagugcugaaagucuuccagugacuggagaagccgagagaaauuaguaucuuccccccacccccggccucccaacagagcugcugguugaggcuuaugaucaucucagugagaguuucauguggcucuguagggcagacuccagcuuagugacacucucacgcagaguccuuggggcugaggagguagaauagauaaacauucaaaagcacggagcuugggccaaagccuuucucacuuuaagacuaugccagcuggagauuaacaacguggcuagaauguacggcguagaaccggcacucugagaacuuaacacauugauucucgucagugacacugagugucugguacuagcaaugggcccaugguuccugcugggaaggauccaccccucauuagaaagcuguuauugguuagaugguuuggauuugacugauccguaggagaagcucacuaccucuauguccucauuucuguaaacaucuauuguaaguccaucuguacagagauuguacugggugcaaugcucaggggcaaaaauguccuauucaaauaggucagagacucgaggucagaaacagaccucuucucucuagcuacaaauccugccuugagugaucucauccccaaguugcuucuaaggucucagaagcaagagaaaccugagaguuucaauuugccaagagagaaauugguaucucuuagaugcuacuacuagaaaauggauaaggaugcuauuuacaaacccacaaagccaacaccguguguuuauuaugucucagacacuguucuaugcaucugacugacuucucauacucuuacaucauuuccuggaaacaccauuaucauuucccaucuauaugagaagagugaggcacuggguuaaagucacucacgugcaacuuuuugucugucaguugaguuauuuccauaggccacaugcucuauuuuuugugcguuuaaugucugcacacgcgugcauaugcagucaugugugugauugugccauggcggguauacggaggucagaggacauccuuggguguuacuucucaugguccaccuuguuugcuacagggcgucuguggcuuguggcugaguaacucaggcuaucuggcuugugagcuucugggggaauccuccagucuccacguccuaucuggucauaggagcccugggacuauagacgggcgcugcugaucccaguucuguguguuuuucagagacucaaacucaggcccccuguuuacaugguaggcacucuacccacugagcuaucuauccuuccagccuuauacauuauuaauuauugauccacgcuaagcugugaccacucugcuaaaaacuacacgacuaguucuguuauuaauauaaaacuacgacaugauacagcauaaaaaaaucaggacucugcccuuguuauugguccugcguuaaugcuuuucuccaaacgauccccaguuuuaaacuccauuaaucaucgugaggcugcgccgugggagcuggggccgccugccuacccauuagcuauuucugagguaggcuuaggagcuaguuaugaaagaaucauauuauuuaaccugaugccgcugaacuugagaaacaauagacuuggugaguuggaaacuagguaggcagaggugaugucucuauggaaacagaugugaagcuccaaguaaauaguaggccuguuagguuuucaccaagaaacaauagauugugcuugcuuggcuugcuuuucuauaaacuguuuaucguggaggcugaucacagccagggguaagguagaaacaugcuucucucucagucacugccccggaaggugccaacucuucuaggaaacuaucucuuggugacaucuuguccaggugccagaucuuagucauuaaaccuugccuuuucuugguuuuaaagacuuauuucuuauuuaugaaaacaugucucuguguguaugugcauauguguguggaugacugcagagguccaagaacucagaugcuuugggaccagaguuacaggcaguugugagccaucugacaggggugcuaggaaugcagguccagacuucugaaugagcagcccgugcuuccauccauguggccuucucucugaccccuccacgcuguauucucuauagucuuccauucaaccaaaguuuuccacuguuucacugaugaccagaguuguggcuccaggaccugaucuggggagcuguaagggugauucugucaccuuggaguggcacugugggcuguucugguucuaggcugucuucuacacgacacaaucccuuuaacugcugaaguauuaggagagaugagaugggccugucuuccuuagugucuauagcucaaaugguucagccuccaagcugccuccaccauccuaucagccugccuuaccugacugccucauaagguaacugaaggaagccugucaaggcagcagaaagagccuuguuccuucuuaguacaugcuauggagggaguccucuaagugcccagucugugaugugagaugcugaaaccucuuucccccaucuuuggguccuauguucagacaagaagcagucucuuuuuauaccguacuagauguuaaacuagucaaacccacagggauauauaaauauuaugguguuuuucugaauaccauaaaggacuccuuccuucccucccucucucccucuuuccuuccuucauccuuuccuucuuucuuuucuuucucccuccccuccuucuucccucccuucuucccuuuguccuucccuuccuuccuucuucccuccuucuuccaucccucucuuuguccuucccucccucucucccuccuuccuuccuuccuuccuuccuuccuuccuuccuucuuucgcucauucucccaucccccauucucuuucuccucucuccaauaagagcuaaaauuugaggaauaaaaggcccagcaaaucauuauugucuuaauuccaaugagacaacguuagcagagcagaggaaucauaggaaaccauuuguuuccuaagaaacuggaguugugcuuccccauguccagggcuuucagcccaaucaauacugaaaccagccacuggggacuucaagcucggcuugcccuucugcucugagcuugccaguugcgagugccugguucaagaaugcugaacucaugacuuucuuacaaaugccacugaaauguuccaaagguuaaaacagcaaacaaacaaacaaacaaacaaccuaaaggaacuaaggaaaacgugauauuccuaugcuagacacaugaagggguuuuuguauccuucaugcagaaggcugagagaguguaaagcaagcuugaccuguguuuauuacccaagcaggagaacuuuauuacccaagcaggaccccuacagaaauccacuggcagggucaaaggugagggauagcaccccgaggaccacacaguugcuagggccugccugcagagggagacgacaccaguguagugguuucuuaccuacagcaaggaugagacacuaagcaauguguggagaguguguguggcuaaaauuagugcuggcagucguucuuuaugaggacaccacugaguuuacuuugcaaagcaacagcaagcguuuguugguuucaccguucagcuguuuaacaacccagaugcuggucaauccucauaaugaaaaauaucucaaaucugaaaugcuccaaaauuuaaaaaaauuuuuugagugcuaacaugaaaaagucuacaguugacuuuguaugaaaaaaaacaguuuaaaugaacaaaaucauuuaacacauuguauaaaauuaccuuaaauauauguguauaagguauauauucauacauacacacgcacacgugcacacacacacacacacacacacacacacacacacacacgugaguuuuguguuuagauuuggguccuaucuccaacauuaccuuauuauguauauuauuauguauauggauauaaugguccaaacguuuugagaaaaagauagucacccugugccucuuaaguuauccagggguaaagaaagugagauauaagccuuucccuucuucuauuugagccuaagaguuuugagcacgaucuccccguagagucacuuugaaguaccagaaucccugcaaggacacguauguagaaacggcugggcacgugaaaugguuuagcucagggcagagaacuaguaggaacucuuggagcuuuguucugcacacuccccucccuguggucuccugcacacucagcgcuuucuucagacuccuccuccuccuccuccuccuccuccuccuccuccuccuccuccaucuucuaaauacguuuuauuuugugugucuguguguuuugacuguguauguauuuauguaccaugcgcgugccuggugccuguggaggccagaagagggcgcuggaucuccuggaacuggaguuaccuacaguuugugaccugcgauguggguucuugguccuuugucacagcagcaaguaagcacugagacaauucuucagcucccucccuuacucuuugaggcugcuaggaagagagguaaaagacauuuuacauaaacauaacgcggcucucuagacggccauccaucuccuguggucaaggguugcggaguccuuccccaggcucuaucuuuccugaaggggaaaucgggcauguggaaaguugugggaaacuaggccgaacuugaaauaagugaagagaacugaagggcgcaggaaaaaaaaaaauuccaucaaaauuaaauuuccucccccaugcgauuccgccauuagguaaucagcccccuugguuuuuagaggauuauaucacucuuuuuuuuuuuuuuaauuuaagaguugagucaucaacuauucaaaagaaauacugagugaauuaaaaccagacgucuuuaugagcuacugccucaaaagcaauaacgcugcugcaccauuucaauuaguacagagcucacccggaacguguguaggauaaggacgugucgugucggagguaauggcacggaaggggccagaaacuuagcagguaggaggcuccccgagacucugccuguugagaacugugaguggggcucugaccugcccucggauguucugucacaccaggggaugcaggggagggcgcugaggagaagugaacuccacagcaaggcugcuggagguuggaggaugggcaagccggcuccaccucuuccuaacucaggaaguaggaguaguuuaacuccucuguguccuaguuucuucacacgccagccccugccccagagggcuguugugaagcuuaagugaggcagcacaaggaagggugagagccugucuguggcagccacagagccuagucagucuugguauguucucuacuucacagagagacgucugcuggguaaaacgugagagccaggguauucugaauaucugugcuccaggauguuguauacaaaagaccugugcuccuagauacuguguguaaaaugcaaaaucauuuaagcauccuguccuuaugaaaugggucuucucacccuuaguuuuccgguugagaauauugagcaucugaaagguaucccaugaugcuuuuuacgagguugucuuuagaagggauuguguaucuuguagaaccuugucuauguaggugugggcaggaucuguggcuaugagaugauccucacucuugugauggggccaugagacaaaggcggaaaggcuugcauauauaauaaguaaaggucucuagucaguugauuuacuuaaucagcuugggugauucauuuaaguggacaagaguguucauuuagggaggcuacucugugggacuugaugagaaaauguaguaauuuagauagaaaggaacggauaggguugccggcucaguccuagaaucacauggaaacuuaguucugacagugcugcuggaguugggaagcagagcaugaccugggggugggggggaauggggggggcucagccacaagcucgaccuuggguggaaaagcuaccucaauggggcccucaguuguguucuaacuccccugagaacuaacccaugggaacugggaagcaaagucauguggcuuuaagcugcuaaauuuguaguaacuuguuauacagaaauuaaaccugagacacccaccuaaagaguugggcucugaauuguuacagagguguugcauaagggaaagaugaacgugugugagguggaagagcugacauuuucacauggacagucaggugugacugaaauaaucucagugcagcuuuccuggagucuaucacuggauuaaugcaagagggcuaggauuaggggguguaacaacggauucuaggcugcccaaauuuaucuccugaaaagugcagaaaaguaagaauugucacuucgagaaauagugggagaaaacuaaaguaacgcuuuuagaaaguguuaucaaacugaaauauuugcugagagugucaggaaauguacugaugucuguuguuuuacagccccugcuuucucauugugagcaccaccaucgucuucugccugugugggaaaauauacaccaacauguuucccauucgagcuaucugaagcugaguaguucugcggugcugagaauauccacauaguuacacagcugucaacaugugugugugugugugugugugugugugugggggcugaaugacccuguaacuggggucgccuaagaccaucagaaagcacagauauuuacauuacuaucuguaacaguggcaagauuauaguuaaaauguagcaacacaaguaauguuaugguugggcaucaccacaacaugagggacugucucaaaggcucauggcauugagaaccucugagguagaacuuucucaucuucuugaaugcuucucaucaacuuccuauccagcccuuggcagcugccauuucacuuuuugucuuuauaaauuugacaauuaauuacuucauagaaguuaaauugugcaauauuugucuuuuugcaaccaacuccucuuuauuaacauaaaagcuuuuuugucuauuauuaauuagaccugguuagaagccugagacauugacagauguuuagcuaauuaagucacgcggcaguugacaaaccucugcucaaauauaagucauuuauuuaaaugagacaggauauucagaauuaaaaacccgauaaagaugaugcaauaaaccuuaacucuaguuuucuguaauguuuuccccacagucagugguuaaaauguauuuauuagcgauuuuaaauuaauuuauguuaaaucuauuguuuuucaucuaaagaugaaaugauccucauuauuuuuuguauuuagcacgcggauuaaaauguauacuaaaauagucuauaacuauccuacaggcauaucacagaaaaauuuaccgggagguuuaacagauuuauaacaaccugauuuuuuucaucugaauuuggaagacuggaaaaaccaagaaguaaaaccuaagagugcauccucagugaauagugagcgucaggcccacucugcuagcugcggccacuaacuugguguggcucacagcuaucugacaguuccagcugaaagacugccucagucagauuacccagugagcauucccuugauuaauaauugauguggugugguuuguauaugcuuggccuagagaguagcacuauugggagguguggccugguuggaagaagucacugugggauugggcuuugagacuuuccuucuagcugucuggaagacauucucuuccugauugccuuuggauuaugauguagaacucuuggcuccuucuccagcacugugucugccuggauacugucauacuccaugccaugaaauaauggacuaaaucucuaaagccagccccaauuaaauguugucccuuauaagaguuaccuuggccaugguguuucuucucagcaauggaaaccccaacuaagacaagcguucaguuaauuguaggcagugcaauuccuaggcuguggauucugggucuuauaagaagacuacuagcuauucagggguuagagagugggccaauaggcaacauuauucaauagcuucugcuccagguuccugcucuuacuuuaaugaugaauuguaacccagaaauauaagauaaaauaaacucuuuccuccccuucauuucuuuugguuauucuauuuaucccagcaauagaaaagcuauuaaaacagaaguugguaccagaagugggguuguugcugugguggacuugagccuguuguuuuagggaugaucaugaaagagucuggaaccuugagaaggcauugagugcucagagacuaaugaguaguauaggagccugaaagauaaaacugcagagagaauagguauccuguggagguuagcuaugaaguuucagaguuaaaggaagacucagucauggcugcuuaugugauauucugcauuaagaauauuuggaaguggagcuuaugauucacugggacaauggaugcugguuaagcugguaccaaagaaucaguaugauuaauaagacaucaguaucauucaguugaaaaauuucuuuagugucagcacacagagccuguaauccaagugggccaagacugaaccucaaccugguuaucuaaaacaugggauacugguuuuaaaggcaugagagauguaagagugaucauguggaucauggagaguggaugaagcuuggcacuguguggagagaccaggauaggccacugguuaaaaugcagccugaguuuugguguaugccccaggauacuggagaugccagaacugagggacaacugugaaggccagcauuagguguggagugaaggcaggagccuguuacaaaagccguguauguugcagagcugaagaggcggaauuaccuaauccuuuuggaggaauccuuuggggguucuucaugaaucccaaugccggacacugaacuacgugaucuagauuuacucagcuggaucuugguuuugcuuugauuggauuguaacuaugcccugauucuucucucuuggaauaagaaaacaugaaacuuguuuuuuauuuuagaggaucccauugguaagagacuucggauuuuaaaagagaacuuagacuuuuaaaaucaguggaauuugcugaagacuuugcgguuuuaaaauuuauacuaucaauguauaaauuuuauauauguauaucguaucaaugugcuauauuguggacaguuauaaguuaggugauguaguuguguaucaaguggacaagagguggagucuccuagucaucuucagcugucaacuggacauaacccagagguaucugaguaagucucaguugggugauugccuacaucaaauuggcccaugggcaaaucugugggacauuuucuugauuccuauuugcuauagguggucuguaccaucucuaagaaggggaaauaaauccuuucuuccccuaagcuacuuuugcucaugguguuuauuacagcaauaagggagcaacaucagaaagcucaggaacacaguauucgacucccuuacgggaguggcagucuggacugugaagaggcgcugugaacucacaagguccacaaugcagaagcacuaauuccuacaaccguucucugaaagacacauuuucuuuccuucucgaagaugucaaagaaaaagguagaaauauuaagaaacuugucuaagaugcccaaacuagugagcgacacgccagauuucaacaucaugucuguaacauuccagagcccgugugcuucucacuacaucuaauuguaacucauguuuccccugaagaacuuuuccuuaacaauuguacuggcugguuuugugucaacuugacacaaguuggaguuaccacagagauaggagccuccuuugaggaaauaccucuaugagauccagcuguggggcauuuucucaauuagugaucaagggugggagggcuucuugugggugguuccaucccugggcugguaguccgggguucuauuuucucaauuggugauaaagcagggagggucucuuguggguggugccaucccugggcugguagucuuggguucuauaagaaagcaagcugaucaagucagaggaagcaagccaguaaguaacaucccuccauggccucugcaucagcuccugguuccaguccugacuuccuuuggugauguagaaaguauaagcugaauaaacccuuuccuccccuacuugcuucuuggucaugaugucugugcaggaauagaaacccugacuaagauaauaauacuacaccaguaaaauuuuagccacacuuauugguaccagagauuaauaaaauguauuuugaggauauaguucaaaaucauguuuuugaaacaagggaaguugagaacuauuagguuucaacucauggacaagucucacccaguauccaugauuucucacagagcuucucgcccuguccccuacccuagaccccucccuccaaggggcugggcuucacguccccuuccccagccugauuccuauauaucagagccuuuuggcuacacuggacuccuagcucaggccgccucucuuggucagcugcuccucccuccauccccaucucuccucucaugguccugcuuagucugccagccaaguucagccuggacucuuucuucugccugcuuucucccuuacaucuacaguaaaaaucuucuccauaugucaagaguaaucauguccucuuccuuuuacuuauuuauuuuuauuuucuucauucaagaauccuagggacacuacagaagacaguuuucuuaggaugacaagaaucaucugaggacagaacucacuuggagacacacuuagaagcaccgcaguuuacuacuggaaagagucacugaaaauaagggccaauagaaaacaaugaaugaagucagauaaucugagccauaagguggaaccauuacuuucacagcugagaauucugaaauaagaaguucauuauggcggcauaggcuuuuaaucccagcacucaggaggcagacacagguugaucucugagccuaggccagccuggucuacagagcaaguuccaggacaaccagggcuguuacacagauaaaccuugucucgaaaaccccccaaaauaaacaaauaaauaaggagagaaaagaaaaaaaaagaauucagaaauaaggaaaaucaaauugcccaaccaauuugucuuauaaucagccaaaaucgauccgaguagaguaccaugaguuucuuuaaagacacuaaauaguuguagcuugauugcgcauauguauauaacaaaaauaaauaaugugucaaucaaagguaauauaugagaguuccugcuuuagcacauucugaguugguauuaugagcagucugcauggcucauaaccuaaagaguaagcaaucauccagcgcuguuaucuccauuuacaguuuucuaaugacugucgccgagcguccuuuccuaugcucaucagccaucuggguccccucuucugugagcuaacaguucguauauuauguaaauagccagccuucagcaucuaaucuuauugaaguuuucuaauagauggaaaaguuuggagauucuuuugaaguuccuacccagacaacaagggaaagacagagaagcugacaaaaccuugcuuccucuucuucccaagucugcagauagaccagauuucccagucuuccucccaugaccuuugaucacgugacugaucgaauucuaaaugugcaauguggaugaagauggugcaauaggcgcaccaugaaacuuaccugcuuccuuucauuauuuucuggcucauuaagggaaggcuaugaagaucuucuagggguccuggauaaggcaggaggaugcuucgguuuuggguaaccccaugaaagacuacaugucuguaauaugagcuuccauacuaggcuaucauuugauggagaaauuaaucuguuggguuaaucuacugcaaacugaaauuuuaucuuccauuguagcuaaaguuaucacuaauuauauauuaacauauuauuugugaauuacuauccuauuucuucuuuuauaauauuuaauauuguuuacuuuuaucuuauuagggaaccaccugggaacugauucaaugcucaguaagauuuggauaguggccuucuuggucuuuuacagauuucaagggguauugaagauucuuuguagaguaagcuucauauacaaaugccaauaugcauacauacauacauacauacauauaugccuacauacauacauaaacauuuuaguuaggugaauaaauuaccuuuacauuccuaaccuaauacaaguauuuucuuaugaauauguuuugaauuuuguccaaagcucaccuacuucuuuuacuaucaguaucauauauuuuugaucuuuaaucuuucaauguaauagauaacauaauagagcuuucucauaguaaaucaucauaaauuucugguaaacccucucuuauuauguauauaccuauauacauacauacagacauucacacaugcgcgcgagaguguguguguguguguguguguguguguauauguagugcuggaguucuagagaauuccuagagagcugcuaaucuucagcauauaaaggaauccugaagaagcaaguucuaauaccagcaaagaaacaccugagcaucagcacagaugaguuugucaguaagagcgagggaagaggguaaaggcuuccuucuuccaaguccuuguauggaggugccagcagguguggcccagaguuagggugcuucucaauucaaauggugagaucaagaauguccgucaugaucuccucagcggcuuggguguucauggauucuagagggagucaaguugacaaccaagauuagccaucgcacuagggaaaacugauuuuggguuuguccucaucuucucgguaggugucuucuacacuccaggcuugguugugugcugcuccaggcacaccaagugucuaaggcugauuugggauuuggaaauggcauccuggaggcaucucuaggcugaaaugaauuuucaugugaaaucuucagucuagagcuucccagauacguaacgcaaacugacaggaagcauuugcuggcccguggggucagagcucuugggaagaaucuguauaccucacucucaauuuagacugagaagauaaccuacccugauauuuccuuuugcagaugaguagauuuguccuguggcuguuuguccaaauccguauggucauuuaauguggaaccacuucaggguugaugcuuugcaaaaugauuucccuucucgguccucuuuggcucagaagaucauuauuauuauuauuuuuuaauuuuaucuagauuuucccagcugucucaauagguauuuuuaggcuaacaaguuauucugaauguugcccgaacaggaacugauugcuuucccagcuaagaacuuaaaaaaguaaagggggcuuagcaaacucggaucuacaggauaaaaauuauacauaaacaaacagaucaauuagugggaggaaucugcauaauaaaagguuucaccgcaggacugcuuaaaauagcgaggaucccagggugugcuuggagcaucugggagacagucuauugugucuuuugucuuuguggucugugguuagagaguggaugguaaggaaccuucuguaaagccgagaauccuuuuuacaugugaaugcucacucuuuaauuugccaguuugugaguuugggcccuuguauaucuaaguuuugucauuuggcuucaauaguagacaucuagauaaaaguccuuuguagaguguauagaauuaagucuccugaggaugcuuuuguauuuugacauuagauaauccaaacaaucugcauaucuaaaggguggaguaaugagaucuuucaaauauugaauaugugcauuuccacaucauuucccaugggucuuguuaaucgaaaucuguccaagacauuucccauucaaugauuuauuucuuuggauacguuugcuuaagcacacaacaaacaacaucuuuaccagaccauaauuguucauucauugcguucaacauuagugaugaaauuacugucaguauuacagggugcacacacacacagacucguucauuacuuuguugaaggccaguacuauaagcacugaauagaacagaaauauuuuucuucucucuagagcaaacaaugaugauuagaaagcuuaucucauuaucucuacaaucugcuccccgaguuccauucugauacaucauuaaauauuuuaauagaguaggaugugaaugcauguguucugaaggaaacaggaagcaagcauucacugcugcugcgcucuugaacaaaaucugauucucagccuggcuugcauaguggagucucugcagagcucccaauaauuccgaugccuggcuccuacucucaagauuuugauuuaauucgucuggggcgaguccgacaguggacauuugaacguguagccuguauuaagaccucagcgucuuuagucagaucucaauuagucagagucacuuaaucagaagccucaaccaacugacccuggggaggacuguaggacuaaguucuguuucugagagagaaaagcaaccauuggaaaaagcucuggguagcuaacccugauucccucuaggaagagagggcccacauggccuaagcuucugauucagaguucucaauagaauagggugaagaaucugucauugaggaaacgaggcuaagugugucuuucucuguuuaccucucuugcauccaucauggagaaaacaagaguuaauuuuaauuaaaaagacacaauagugucuugguguacugaugguuggguguauguauauacugauauaaaacaaguauauuggaugugggugguucaugguuauaauaucccaaggcaacucucucuuccccuaucuauuacuucaaauuuauucaaugguacucauuuaguuucuccuugccucugaaucaaaacuuaggcagucuuacucacuguucgaaguuauaaaaaacaaaacaaaacaaaaggcugugaucauuuuagacagaaaaccagucucaacuugguaaucaaauauauucaucuuauccgccuguggaaauugcaaucuugagaagaaguugaggccccucacuguuccaaguuaggcccuugaaauggaaggcuggucauagaaggugcgcugguuggugucuccucccucauaagcaccagacucuacauaucuuuagguuuaagcuauauugaaggcuuagcauuccuuuaucauguuauauuacaugauauauaaugugcagcuagcuguuucuaacuauccuccaccuuuaugucugauacaacaaauugacuuuuaaaccaaauccauucuuuuauauuauguguauggguguucuuccugcacauaugucuaugcacuauauacauucauggccuuuggagaccagaagggggcgucagauccccugggauugggguuauagacaguuguaaacugccaugugaaugcugggaaucgaaccuagguccccuggaagagcagccagggcuuuuaacuacugagccuuucuucaucuucccagcccuugcaauuugucuuuuaaaaccacuccaggagccuggggagaugguuuagcugguaaaaugcuucucauacaagcaucagaauuuuagcucagauucgccaacagccacagaaagguuaggugucaguaugccucuguggccccaguguugagaagguagcaggauugcugguccuaguugguucaccgcucuagcucaauuacugagcuuccuugagagagccugucacaaccgagagagauacccaacauuggccucugccuccauacauauauauaagaacacauauagaacagcaacauacacauacggauguagaacauacacguggguacauacaaauccaguuuggaccuccaucccucacugaguccaucauuaggcagauacagccaagaauuuaauaaggaagcugucaggaguaauucagcaauaaguaaacacuuaucuggggccuucugugguacugaucagagucagaguuccuuagguggcgaguguccagacuguucauuuuccagacgagggaacucaugaggucaaaugacuggcuggauaauuucauggcugcucaagggacugcaugaaacuuucagcguaucauauugcuugguuuaauagaacggggcaucccacuaaauuaaaaagguugucaacuccauggaugaaaaacucacccaaggaaccaugacucagcucagaggaugcuagucggguccgaggcauggugcagagagcagagacaugcaaucagacaggcucagggcuucucgucaccuaccagccuuaggcaauuucuuuaacuuuccuuaacugcaguuucccuagaugcgaagcagaaaacaaaugcucauccuaagaguguuguuggcugaguccgagcauaggaagguauaucucacugugagaccuccgaggugcucuaagaaggccagguguuaccaccacugccacgacuacucuagaaaaugcauauuucaaaagccuuuaugggcuuucauaaauguuuuacagauuaaucgagcaguguguuguuaagaacuuguuuagcagccacgaagaggaaacaucgagacauaauugacuucuccugccccagagucucucuuugacggacccuccuccacuugauccuuacccaauucagguggaagaguccguucccauuucauagucgcaguggccacauuuuauacguguuauaguuauuucaguuugcagcaucauuuguaagcauccauaugaauguguguuacuuaaacacacuugaagugaucugucuauuuaaagcaauuagcacacuguuuuguaaacaguggaccauaaggcuaccauuacugacguuaugaguauauccucggacuuuucuaccaguucuccucugugaaaacaaaacauaauucuccuggacaccacuuucucgauuguuugaaacuccaaggaucgugggucaccaacaucagcucaaacgguguuuguacucacuagggacauggagguguugcuugagggagggagccuuugcagguguugguaacaauuucagcuucagagagcgguuuguuuuauaauacaugcacacguuacacaucuuuucccacuuggcuuuugucacaaaagucccaagacauuuuuuuuuuaaaaggcuauauucucuuuagaaaucuagauggcggggagauguggcgaccaccuguuagggagaacucucccaucaaaaagucugaaagccuuucccugcugaauucuuaugguaacucaugaagguugguuucucucaggagagagaaugcuuagaugagaaugggcacuucauccacagagaagggcgguagacuggaggaugcaacacaucuguaucguauccgcagcuugcuugccccuuauccaaggcagcccagaaaggacucauuacguggucauggcagucaguuuuuuacaugccauuuagcugcuucccuaugaaugucacuuguuuuuucaaagaaugagcagaaaagguucagccaugggauucuuauaacuuuuuuuuaaugaacgcuaaaugacguuuuaucuuugaaagggaccauggguacccuugauuacaaccaccuuuauuaaaauaaacaucuucauacacaaaacgauauagaaagaauucagaggaaaauccagacuggggauuguagccaucaucugugcucaguaaaucaagccugcuuauaaauaugcauaauucuuauuucuuuuaauaaaaagagaaacacagauuuugccggaauaaccaacugcagguaaaguaggcuuuuuuuuuuuuuuguacugauuccugcugcuucucuucuaggguaggauuaucagaaagaaaaagagucucugucuccccagcaagguauagauuggauaagacacagagccaucauuagccugguaaauauccaauaaaggcacccuacuuuccgcugcuccuccugaguuaccugcugcauaugaaagugcuuaauguguuuaggacacugccacucaccuggucccugucacuccucauguuagcagaggagggggaugugauggagaggagggaggcuguucaggguucugaugcugcauagcgguccaaggguucucugugagugaggcuggaucagucaugcuaccgcccaccuuccccucuuccucguuuucuugucuaacagcgcaacccauguggcaugcuuuuccgaagaugcauugggggaaagucucaucaugcauagcagggaguuaauaaaccccugggcagaggcaggcucuucuagagaaaccuaacagucuccaagaagcacauucgagacucaucauuucuccaguaacuggcaagaaacccagaagcgugaggcgcacugcguguuuuaacagauauucugggagauggcagcguugaacaugauguagcuaaguuauaaaaagaucggcugaaacaugcuggaggggugggguggggggagcacucuggaaagagacauggaguccaacaaacucaggcuugaguccuagcccagccauguaccacauacccugggugugcugaacauucguuggucuccagcccuucuguugugaaauccggaggaaggauaacgccuacgucaucagaccuccaagggauagaaaugcuuugucaguuacagagcuaaugagaacgcuuugggaaaguagcagggaccuuauccuggucacuucuccuccgggagcugucaaggaaguggaauucagcccugguccccaucacuaaagaaacacugggucuccccauuuuggccucaauccuguugugcaauuggccagguuguugacaugaguccacucuacagcccacugucagguccaugugguugccaaucaaagaugccccagggaucgcagccuucacuugcaagugggcaggguggagggcagcugcaguccuugggaacaggggauauggcuaccucccuugacaguggcuauggugaucaucuuggagauggcuggaccuuugauguaucuuauuccugaccucuauuugugggucaacaucggaccaauaguccagugcaucccgaaugcccauuucucuacucugcaucuucuuguagcuccuggcuccuuuccuucuuuucugugugaggaguaagauugugagcccaguauccaccccuauccacuccugcugcagcuucuuccuccaagcagagucugcaaaaccuuccuuuccaccauguaugugagccuccuccaugaaguccguccugauuccuucccuccagggcucaccuuuuuuuuuuuuuuuuuuugagacuggguuucaugauguugcccuggauggcccagaacucaucagaccaggcuauguuuaaccacacagaggugugccagcuucugccuauccacugcuggaguuaaaggcaugugucaccacgaccaacccaccaagucucacucaaaaauuauguuauauucauuaguuauaauagcuucauuaguguuuugagaauuucauaaugcagcuauguauuuuuacaauuugucucuugcuucuucuucuccgaacuacuuccagauuuaccccccaccccacagccuccagccccacccucucccaacuuuuuguuuuaaauuuuuuuuuuuuuuuuuagcucacugauuccaauuugugcuccccauauauucagucuuggguccacauauuagaguguuguugacuuaaccagggauucacacccuuagaaaaacaaggcccuccuccuccccaaagccacagcuccccagcuaggguggggucaugugcuccuccacuuucuaugcuaacucacuugaucuuguguaggucuuacacaggcaccaauaggcacuguaguacaaaagcucacuauaucgucaucuccagacaacacuguuugggucugcuucccggaagccucuagguuuuacauucuuucugaaaggcuuacuuuaaggucccugucagagugucccuaugagacucucgaacaugacuagcaucacaccaugcuguucucauucccacuagacugugagcucuucaacagagagaucuaagucuacuuacugaucauuccccagcaauuggggcagagccuagcacaaggaaggccgguggcaaauggccccuaaaugggguggacugggaccucaacugccacccacugauuuacucacacaaggaaaggucauuccaugauguaagcaagacgcacaccugacuccucucuuucugaucccucuucccuguuccuccaucugcaggugagaagggcccaagagagaauaaaacccaccacacacugaauucucuuuuguuuucauuuauauuuugacccuuaaaaauaaccucaugacuggcuguuuuccuggcacccuuaaccugaaauagccagaaauaugcuauggauaaaagaauuggauaauuaaaagauugaugagguuaucaguaaaaauuuuugaaacuguucuauacuuugaagacaugagauugaagaaaucuguuuucuucuuagcuuuacauagcgugccuaggaauugagaguguaaggaucuucucacucaauauuauugacaacaguauaagaucuugccagaggauauacugucgucugggcacugcuuucagagggcugauacaaucaauugcccaccacaagauccauuccaacauccccucugcugccugcuugucccuggagagguuggggaaggcucagauccauucucccaucuucuugaaguuagacagugggugacauauggucaaagagguguuccuggaagucaugaugaaaagguuuggauuuccucuggcuguugacccccccaccucuuccucuaccugugacugcugaagcugcugaagauaccuugucgucaaaaggcuuacggugcaaagacaaggcaccaugaugcaacagagagugaagcaaagacagagaggccuggguuugaaggaagcuuaauggcaggguacuugccuaacacacgcgagggugaggcucuaaccauuaacaaguaucuacuuccucucuuaaaauuaacauuuauuaucauuauaacuauuauuauuauuauuuguaugugugucugcacaugcuacacuguguguguguaaaucagaagauaacuuuugagagaguugguucucuuuuuccaccaugggaucugcaagauaagccucaggucuccagggcaagcaccuuuaccagcugagccaucuugcuggccgauacgaagcacuucucaacuucuuguugcccaacaccacucaugccaacuggucaggguuugguucuguaaacaacaacacuguucuaaugaaacaguucccauccuccccaggguaauccucagcaguugucucuuugcaucacaucugccugcuucugcauccuuuaagcgugaacuauugucguucccuccagguggagggcgaugguccuuccaauccuccauagaggucauggaagcuuaugaccugacugaggcuuauggcugacugaggacuacuuucauuuaauauacgguauccaaguugggauuccuuuaacaaccaugagaccauaacauuaaaacugguuccguagauacugauucuagaauaucacuguauggcucccauagguugcuguauaaucuaucaaacuaaaaaaaaaaaaaggugggggugaggagcuuaaucucauauaauacugauugugagaagucaggaguuaaggugucaggagggcugugccccucagaaggcucuaggggagaguccuuccuugccucuuucagcccuggguuacuccaguauccauggcaagacuacuccagucuaccucuucccacguucagcaucucacuagucuguguucuugcuucguuuauagacacaagugggauuucaagucuaucuaggagaacucucaaccucccuaaugcugcaacccuuuaauacagcuccucguguuguggugaccccagccauacaacuguuucaucacuacuacauauaaauaucugauauguacucucuaaggggucgagguccacagauugaggacugauggucuaaauaaugcaggugaauuuucuccugagucuguaaccuaauuacguuuacaaagaccuuuuuuuuuuugacuacugugaugguuuguauaugcuugacccaggaacuggcacuguuaggagguguggccuuguuggaguagaugugccacugcgggugugggcuuaagacccuuacccuagcugccucgaagucaauauucuccuagcagccuuuggauaaagaugaauaacucucagcuccuccugcacgaugccugccuggaugcugccaugcucccaccuugaugauaauggacugaaccucugaaccuguaagccugccccaauuaaaugucgcccuuauaagaguugccuuggucauggugccuguucacaacaguaaaaccuuaacuaagacaauuacuaaggucauagcuacagguucuaggcagauauaucuuagggagucauucuuauaauuacauauuauuuuucuucacauccuagaaaaaucauucuaauugucuuauuuuuacaucacuggucuugugaacuuugaaugcuuuuagccaguauuauaugagauuacauuaaguagcuuuuaaagcaacuuaaguuuuguguugggucagaauuuaaggguguuuuaggagauaccagcuagguuuaauauuuuaaaguaaccauuuuguuauauccuauucuuuauuuuccauguuaaguaugacauagaugacuuaagauggacaaaugcaucccagguguggcggguacaaaggugagcacaccauuagcaaacagaggcaaacaaggagacucggggcucuagaagcaaauacucgccaggguaacaugaaguaugcagagacauuaauuagucugcaugacaaggaaaccaugguccaaggcucaugacagccgagcugaaauaauguagaaggagaagaguuaaguuguacauggagugacccugucagugggacagcgaguuuaauggcccuaaggaaagggcaugucugacucuucuauugcugugaagagaaacuguggucaaggaaacucauaaaagaaagcauuuccuugaaggcuugcuuacagggcgagccauuaacagucaugguggggagcaaagcagaaagaaggcaggcaagcaggauuagugcugaagcaguagccaagagcuuacaucugaccaacaagcaggaggcagagagaaggggggagagagagaaagagagagagagagagagagagagagacagagagagagagagacagagagacagagagacagagagacagagagacagagacagagagacagagagacagagacagagagacagagagcuuuugaaacuccaagcccuaugcccagugacacaccuucuccaacaaggccauaccucuuaauccuuuugaaacuguuccaccaacuggggaccaagcucuuaaacaaagguaccuguggggaccauucucauuuaaaccaucacaggccauguuuggaguuugccuaaucagaggauauacagcccagaaucagcaagaacaugucaggaagaagcagaagagacaacaagggccgaugguaagcaagucgccagugccugagcuuccucaggguuuucaggauuuuccauucccaugucaaagggaccacgguucgccuggcugagcugcucgggaugcauccuggcauaggcagccugucauuucagacagaggcucuuugauucuuucagcuccaaugacucucugugucgacauccucggaauauuccaaucacgcaggcccacacauccguccccacagggguuuuuucauaguuuugcuaggugcauagugauuuuuaaagugggagauggauaagggaccccagcagcauaacucgcaauugccagcacccgacaaaugacugugacggcaaaagucagauaucuggagagacuucacuuuugaugcugcaucccgacagaaucugaggucucucuugcuguaugcgacacaauaucauccugaucaaugggaacaaaggcggggaggauuuucuuuuuguaauagaaggaagacauuaaccccugaugagacucuccauuuguucccucucacggugcuuugcuuauaugguauuuuacugauuauaaagcauaugcuuuuccuuaagaaaagcuaaggugucguaucagcgcugccucgugauugcuuguggccugccuauguaguuuguacacauauacucaguucuagcucucauggguuggguauaacugacauggaagcuguauuuaagccagguguggaucaugcuuucgaucccuaccuugagaucuagaaucaggacgauaaggaguucaaggcuacucucagcuacacaggaaguucaaagccagucuaggcgacaugcgauccuaacucaaaaaacaaacaaccccuuccccccaagcaagcaaaccacaaaauguacaagaccccaugaggcucaguugaugcucacaaaguaucaucaagagauugcuguuccagacauauauauuuuuuuucuuuuuaaaagcagggaacccuaaugcauugaggcagaaugaagagauucauaguaauaggcagcauauaaugaaugcucuguuccuaccgugcaugaaaaaaaaugacaugauauagaugccaaagaccuuaagaaaagcagaaaaaaaauccacaaggaucuuuaagugggagaaacagcaauggcugcugggaggugugugugugcugaauggacuuauuuguccuucucggggcuauguaaaaucacagccagcacaacuuagaauagacacccuuuggaauccaugaagcccaguggagccaacugcaguuuuugucuuuaagaugaccaugcaaacacuagauccugcuuauuucauuacaucugaagggcccuaccgucccuuuacgggcucucggcgacuggauugcuuggaaacucacauccaucaauugucuccagccugggucagacugagcuaauucacugaguggugagugaaugcaggccaauacaucuaaauacgcuccucacuguggaacagagguagaagauugggaaaugaguggacuuaaaauaaaauagaauaaaaaaaaaauuauugugcaugcaugugccucccccaugccguguguguguguguguguguguguguguguauguguguguuuguguguguguguagugccagagcacauaugugaaguuagaggagacuggcuuugcugaucgguccucuccuuccacacuggcaacugagaauugaacuucucaaauuuagggacaggcgccuuuaucugcugagccaucuugcuagcccuaaauggucuugguaaauaaauagcuuuucuggggcaauaaauuuuaaauucaacugaaggaaguuauguuugaacguuuugaguuugaaaaaucaggccgagugacccuggggucuccccacccucuucccucacuguaccuggcucucagauccacgugagagaauaguuugggaagccagccagcuggaacaggaugaaauauuucacacuccugcuguggacaaguugucaaucacugugugugaaguccagccuuguuuucccucaggguuaacagucauucgcuucuaucugcucaagauaucgucuuaaugauggagucaaggggcucuacaaauagcaggucaauagcugaggacgagcugcccagugugcgguggaggagaaagggcagcuccugugcuccgagccccaggcugacugcucuaauaucugguuguaaaaacaaagagcuucugcuagcaaagauggccucccacaaguugcagggcacagagaucggugcuggccucacagugucuuuuuuuuccagccuuggaccacggugccugucgguagcaucauuguuucuaagguagagaggaguugaaugguuacaugcuccuacagacaauugcuucuguacuuuguaucagaaaggcuugguagguaccucugcuuacuacaucucccugcagcucccgauucuaauuccccuacuuuccaucucaaccucuggaaauaguuuaggcuacauaaaccgguacucacccccuuucauuucccuuguagcugguuucuaauucagcaagccugucuucauuguaaagccuggaccaaauauucccaccucuucccacaaaugccuuuaggacuggcucuaccaccuugcccacacucagcaucuguuccuuccguaguagccacgcccaguacucacagauacuccaagccaagaaucucugccauuccaaaucccucuggugccuagacuccuacuuggcauacagcccagucucugcauccuuccgggccugguccuuggcuaucucucugacaucauucgugaugagccuaaccuguagcucaugauaguccucuuucccuuccucuucagugaccacaggguauuugcuugcacuguccacucccucagccuggaaggcucuucaagcccauauuuucuucagagauagcccagugaugccaucuccuuaaugauguccaugacaacuuuucuuaagaccugaucuauuuguuagagauuaaaacauuauaaaauauaaaacauguuuuaaauuuuccuaucugauauaacauuagcuccugccuacugauugucuuucucuuuagaacauuauuccaauguauuguuuuuguuguucuugguuuuuuuugccauuucuggggauggaacccaggguuucacauaugcuagauaaguauucuauaucaaggagcuaaucucuuucucucucucucuguaugugcaugugugcuguguguaagaacacacaugcacaugcaugugccacagcucaaaagaucagaagacaauguucaggaaucaucucucuccuuccaccaugugaccagacuuggcagugagcacuuuuauccacugagccaucucacaagcuguccccuccccauguugggcagucugguuuucaguugagcugaugucugaaccccgggacucgguggugauaauucaccuacauaggacggaagaaguucucucaugcccauggaacucuggcuccugucuaaguuaccaccucccucagcccccacaagagaagcauggcuauaagucauguaggcaauguccaaagcuuaugaccuucaggcuaaauuccuccccauuuaccuagcaacauuaaagauagcagcauaccauaaaaggggauguuucgccccucuucccucuccucuccucuccucuccucuccucuccucuccucuccucuccucuccucuccucuccucuccucuccucuccucuccucuccucuccucuccucuccccuccccuccccuccccuccccuccccuccccuccccuccccucuucucccucucuuacucuuacuuuuucucuagccuuucuucucucucucuuuuucuaccuucucucuuucccccugcauuucuacaauaaagcucuaaaaccauagacagucucugcucaucaaggccuacugcucuuggaggaugggauagguuuucuccuaaugagccauuucuaaucucgugauggaaggcuuuccugugauccagccaaagucugcugcgcucacucuugccaguaugggaaccucucuuccuuaugccaucucucccauaaccccagggcuacaggguauaaccccagggccccuuuugguuucaggggaugccccuuguccaccccccaucaggugggucagaggcuuggaugcccaccuggggcugaguggaaagcaucuggcagcccuccugcguccaccuauccagagcauagguggaacucuagccggaugugggcuauccucccucuccccucccccccugccccuuauuaguucccacacccccaccccuuugauuguuuauuuuuggacagugucucacuauguugcucagacuggcuuugaacuugugauccuucugucucagucucccaagcacuuucugaguccuuaaaggcccucacaaacacccucgugucuggucugccuuucaaugguaagaauuuuacccagcauuccaggcacccuggcgauagcaguacccggagguggcaugaggauaugagucagguaaguggcugcuccucuuguacccucugcugccaaguggguauaguucaucucugaugaucuuacuuccuauggcuccuucugugucuuccuuuuccacucuuccccuggcagcaggucacccagagacuccguaggaaaaucacccuugggugcacaucuagcuuagccuuuacaaccagauccuuaagcagucugaugucuggcagaagcagaagaacacaaauaaacaggaagguugcuaugguggucaggugucuugcucuaggcuauguauggaaccagaacuugguuuuggcucaccuaacuucguccagccucuuuuucacucugcuucccugcaagccaccaccguuugcuuccuguucaugucuuucuguauuccuggauuuguccugaaucuuuccugccuguacuggcugguuuuaugucaacuugacacaggcuggcguuaucacagagaaaggagcuucaguugagaaaacugcuuccaugagauccagcuguaaagcauuuucucaauuagugaucaagggugggagggccccuugugggugguaccaucccuggacuggcagucuuggguucuacugcaagccaguaacaucccuccauggccucugcaucagcuccugcuuccuaaccugcuugaguuccaguccugacuuccuuuggugaugaucagcaguguggaaguguaaguugaauaaacccuuuccuccccaacuugcuucuugguggugauguuugugcaggaauaaaaacccugacuaagacacugccauuuucuacccucacaggaccuaacccuucacucggcauugaggugcaaacaguccacugcauagugacuuaguucacucaggugccugcaggcugucacuugcucuuucaggcuggggcaguugaaaggagacauacaucuaaggauuuacauauuucuuuaggggaugugggagaacgcauacuaccuggcuucugcuuauuuugcuuugagguuuuccacuuaaccugacucuuuagacuuccaaggccuuuggcauuugcaggucaagauauggucuuuucuuguaucuugcucucucugugucucccuuacacacacacacacaaacacacacacaaacacacacacacacacacacacacacacacacacacacacacacacggacggauggacgugaucacguauagcaauguuccuccuacaucucaucugcauucaccguguuaccuaguggccaccugaagauggcaauaucuaugcauggcagccaccccagccaguacugcucaauaguuucucuguaagccucauggauguugaaccuguugugugccuguguuucaagaccagccuggugcaucuccuuucacaacauaagauauucagggauauaugccaucagggauguaugccuuuugacuuuucuccucagaacguaaccagcccucuccaucuguaaagcgagcagcacaacagagcccaucucccagggacaaggagcccugaacuaugaggcugauggagaagcccugggaacugugucucccccacaaacaucccuaggucaguuagaaauuauugcuugguacuuucaauguguuauucugggagcaggagcaaguaacagaauggaacacacacauccugacccugauggagucaccaaugguuuagcaguaaugauuaccuucaacugucaaaaagcaaagcaaagcacaccaaaccaaaccaaacgaaaccacaguaaaccauaccacaccauaccaaaccaaaccaaaccacaccaaaucacacuacaccacaccaaaccaaaccacaccauaccaaaccaaaccaaaccacaccacacuacaaccacuccauaccaaucaaaccaaaccacaccaaaucacaguacaccauaccacaccaaaccaaaccacaccaagccaaauugcaccaaaccaaaccauacugaaucacaccgcacuauaccacuccauaccaaucaaaaccacagcacaccaaaccaaaucacaccaaaccaagccaaaccacaccaaaucacaccacacuacaccaacccauaccaagccaaacuacaucaaaccaaacaaagucaaaccacacagaaucacgccacgccacaccacaaaccaaaccaaaccaaaccaaaccaaaccaaaccaaaccaaaccacaguaagcaaaaugaaaccaaaccaaaccaaggcagacgggguucaaauucuagcagucugacucuagagcccagcuuccucaauggguccagaaugguucuggagaugcuaaggguuuaugcauagucugaauacagauuucaggaagaaagccaaacgcucacucacucuuggcagcauucugcucagaggugaaaaggcugcuuggggacuugcccuaugugguggugucaccacacugacauugcagguggaggagaaggaagagucuagggacaaauucuagaggagaagcucgucagcgaagagagacaggcagaaaugagguguuucucuuagugcucuaaucgguguguucccuggaacaugcccagaagauucaguuagcuccuagaacccaguuccaccgagaacccgcuggcugcaccuccacuuugcgcagagucugcaucacauaguugaaugagcacagaauugauucuccacgagaggagacgucaggauuucaucuucuaaaguaggcuagucugauggccaauggaccuaauaaauaaacucucagcaucucacaggucuggugacuccacuaucgugcagcccguuuaucauccaagucacuguacauugauuuugacauucuugaucccaaacauuuaagagucugauaaaguuuucugucuggaccuuuuacuucuuaugucucauguucuuaaagaugauuuucauuaaaaaaaaaaacaacaacaaaaaaccugagucagaggggcuggagacauggcucaauggcuaagagcacuggcugcucuuccagaggcugaguucaauuucuagcaaccacaugguggcucacaaccaucuauagggggaucugauguccucuucaggcaggccuauauguauauguauauguauauguauauguauauguauauguauauguauauguauauguauauguauauguauauacacacacacauauauaugcagcagagcacucauacauuaaguaaaauuuaauaaauaaauaaacaaauaaaacagauuuaaaauuaaaaauaaaaaucccgagucagagcuuacaaagaaugaucugacuacccauaauuccaaaugccauucuccuuuguuugcucaucagagcuguugugguagacugauuggcccguauucuccauccaucccugugccuauguaaauuuacagcuuguucugugaagagacaggucagauccucuccucccauguugauuuggguauucaaaauaguuccugucggccauuuguuaggagaugagcuauaaguagagguucagcacagagcaugcccagggcuggagagauggcucagugauuaagagugcauacugcucuuguagaaaacuuguuggguacaccugccucugaggccucugguccucaugcaccugcauuccuaugcacauaugcccacauauauacacauacacauauacaauuacacauacacacaauacaacaaaacaccuucaagacaucucagugcacaccuguuuuuuguuguuucucuucuauuguaaggaugcaugcuagaggacugggcagagaaauaaauccuggucaugucagcugugaucauccaagaccccgacuuuucuaccccaguagaucagagccagcuacaagugugugugugugugugugugugugugcgcgcgcacgcgcguguguggucggaugaaauugggagaaauuuccagccuagucuggcucauaaaccaaacaacugccagcuguuuuaggguguguauuuuugcacguuuugugcaugcggcagaauggcaaucacucacaaugcuucugucaaucuugggaacguggaaacuggaugguugcuuagucuucuuuaaaggagagaaccugagugcaaagcgcugugaucauauguuccuggguuauuucuucaaacccgugagcgguaucaucaggggcauagagaagguuauuaacucagauuucagggucuuggaaauggaggguucaggguuaagugacuugcccaaggaaggcuuguggaggagcuaggaucuaaagccuugaagaauucuuugugaaacugugauuuuuuuuuaaagcacgguuacuaaucauuuuccuuccuuauucuauuuuaaggcaucuauaaacagguaaacagaagugugcuggugaguaauauaugcauauuuaaaggagcccugucacucagauuaaucuaaucuguggacugcacuguuuccauuuugguaaaaacaauuuuaaucaugugguauuugaaauuuguguucgaaugucuacaaaaaaauaagagucuaaugagugacaaagagucaggaauagggaaugguauaaaacugacacagaauaaacuucaguucuacucgaaaaaccaccaccaccaccaccaaacaaaaacaacaaaaaaaaaagaauuugguuuuucauuuaguacccuguccuguacuuuagguacauugccaccagguggcgguagagcgucagacaaaagucuguacaguaaaacugcuuccaauucugagguucaagcuaacaagcucuuugccugagaucaaaaagcauuugagaccacacuuugcaguuuaacauaauacauucuuuaaaaaccaaaauagcuuaaaauuaaacuccuggcaauccuuacacaucuuuaaaacagauaugaauucuaagccacagaaucaccgagcucauuacuauucguucaagguuuccacugauuuccauaauggcgaauaggaaccuuguacccuaccuugauggcuguguugaccuuccccguuuucucuggcacauuacuuacugcccgucucuggcaggauagcaugcauuauagguuucaaaauucuuaauaguuuuucuggcuuucuuuguccuuuaagcauaauaucggauugucucuuaaaauagaaacggaacgauuucuccaguggaucaacaugcaagagugguuauuugcauuuauacgcauuugcauguauggaggacggcuccuuuuuauuuucuauacucuauaggguauuucauuagguaugucucucaaaucucacgggagcacgagcaguuugucauaauuuaccagcgacacagccgaauuucuuuaguaacaaguuccguccuaaaugucuugaaaaaggaaaaagucucuucaagaaacaaacaaaaaauuaucuguuguauuagaaaugugagaaaaccagcaaaacaacaacaacaacaacaacaacaacaacaacaacaacacaaaccucacuggcuucacuacaaugcucuuuauuauaugaugcaaaaguacagucucagagaauagggacuacugagcugcuuuggaaaguagagguucccaccauuaugggucauuacauuuaaaauuuggggcaaauuccagacagguuuagauuuguuagguucauggcucagggcugaacgaagaauccaaggccucuggguaaagccgcuauucugcccuccguuucaagaacaaagaucugggugccaccaggucgcugcugagggucaaaugucggugcacacauagcugcagguaaaagcucuagcaguuuuguaccuaaaaaucaacaucgaagaaaaggggguugggugggagacccucagagacuggaguugcggauaggaaaggacagagagaccucauucuugcagacuggcguuuauacgucagaugggguaaccugugcucccccagcccccacgcaccgccccgugagcuguggguggaagaagcgaacacugcuagcuaugaagaugugucccaagggaccgguuuccagccaacucugggaaagugaucuggggaagucaccgagaaaaggcaaaagaaaaauaaaaccggagagaagagaaugggauggguaauagcaagcugucauuugagccucccaggaagccuagcaaccagcaggccagauauuauuguccucuauuuauacaccagaaaccaagucccagagagggaagugacuuaagaccacauacugagugguggauauaggcuucaaagcaaagugacccgauuccaaaauaaagaugaaagaaaagagggcacauuugaaaccuggcugcacggugugucuuucucuuuauaaacaguaaguaaaauuuccaucggacagaagcuuagccuccgaggggucaaacugaagccacguuagccaccaucaaaagcuuccguggaaugucuaauauuaccuuguuccuuugaauacugacuauaauuuaccguccuuuugauacaugggguuucgauugugaaaaccgacucuauuuacugacuucuaauuuaggcaugcccucaaugcuagaggcagccaaugguguuuuuaucaucaucaucaucaccaucaccaucaccaucaucaugaugcccaccauggccucugugccugauauagacauagcuggaaauggcuauauuacagaguugcugacucagcuacuucucccuaaguaugccagcuucucgccaugcuuaccuuuuuuuuuuuuuuuuuuuuuuuuuuuuuugaucaugcuaugcuccugguuaaaauccuuugaaugguuccccacuggugacagaggcuauacauugaaaucacuugggaugcuuucaagcacuucacgcccaggugccucaugugagugagccccugccgcagcuguuuggaugugggguccacgcuuaggggaucuggaggagcauggaauccaaguuuugcucaagguggaaucccagcgcgcgcgugugugugugugugugugugugugugugguggugucggggaaucacgcugacuuuccucccugaaacaagcaaccauaaaucugcaggaagcucuggcuuucaugcuaugagagacaagagaacaaggaccgcgaggcccagggcaguggaaccaaaucaagggcacgcgcacacucaucugcaggaaagagggccucagaagcagcugggaaagccgcuagagaggccagcauggugagaauuugcugggcaguggggagagacugcuaagcagcucuugcuugugaaaaaccuuccagagggcagacaaugaagcgccccgaaagacuggugaagaaaaccuugagagccagaaucaggcugguaauaguuuccgugcuauucaggcgggaaaacucccggauuucaaggauacaguuugguucaaguacucugcaccugucuccaagcaaacgguguucuagucuuaccugaugaagcuuaagcacaagaugaggacuguccuucuucucuagagcaccucugaagcgauauugauggagauacaaaauuauccaucccucagcaggauaaaaggcgaaacgucugugugcaaauaaaaacuacccuagcaugcaaagaacgaggagaaaaucagcagacccuaaccaaccuugagccgguguagauguuagagucguaaggguauuaaaggaauuauuacaacugccccccugcacauuuaacaaguuuagaagaaggauuggagauguuaaagagagguuugaggaacgggcaaagacucaagucugaguucuggagucucaaccaugaaaauguaauggauagagagagagagcaauuagcugcaagaagaaaagaguagugaacucaaagacacaugaguagaaacuauccaaaggaaucaaagaaaugggguugaggguggggagccugaaaacuauuuuaagaaaaaacaaggggcuggagagauggcucaguggugaagagcauguacucuucuuccagagguccugaguucaauucccagcacccauaugguaucucacaaccaucugaugcucucuucuggugugucugaagacagugcacucauauacauaaaauaaacaaaucauuugcccaaaaauuucaugaagucaucguuuuuaauagcugcguaguacuccauuguguaaauguaccacauuuucuguauccauuucucuguugaaggacaucuggguucuuuccagccucuggcuauuauaaauaaggcugcuaugaacauaguggagcauguguccuuguuaaaauaucauccugagugagguaacucaaucacagaagaacacaaaugguguucacucacugauaaguggauauuagcuccaaagcuuggaauacuaaagauacaauucacagacuacaugaagcucaagaagaaggaagacaaaaaagugguugcuuugguccuucuuagaagaggggaacaaaauacucacaggaggaaauauagagccaaguguggagcagagacugaaagaaaggucauccagagacuguuccaucuagggauccaucccauauacagccaccaaaccuggaugcuauuguggaugccaagaagugcuugcugacaggagccuuauauggcuguuuccugagaggcuuugccagagccugacaaauacagaggaggaugcucacagccaaccauuagacugagcacgggguccccaauggaggaauuagagaaaggacugaaggagcugaagggguuagcaacccauaggaagaacaacaauaucaaccaaccagauaccccagaacuccuacagacuaaacuaccaacaaaugaguacacacggaggaacuuauggcuacagcugcauauguagcagaggauggucuugucagguaucaaugggagaggagacccuugguucuguuaaggcucgaugccccaaaguaggggaaugccagggcagggaggugggaguggguggguggguugguggcauccucauagaagcaggaggaggggggaugggcuaggggguuucggcagggguuugggguuggggacugggaaaggggcuaacauuugaaauguaaauaaagaaaauaucuaacaaaaauaaacaaaucauugaaaaaaaaauaaaaaggaaaauaaagaccauaaaaaugauaagggucauuaaaacuacuagccucauaucuaagaagcuaaaaaaccuuaauacauaagaaauaugaauaaaauuaccucaguauacaaauaauaaccaauaguaaucauguauaaugggcccgacaugccugcauuucccuaggguauuccccaaaauaccguaggaaaguauuuuucagaaaugaaggcaaaauaaaagucuguuccagagguacagaagcugacagaaguugccacuagcaaccucacguuauuuaaauguuagaggaaguccuuuaggcaggcagaaaaaugauacccauagaaauaagaauccacacagaagaguggagaguaggguuggcuuccaggcuaugggacugacguagguuuaguauacaagcugcugcucucugagacccucuguacuuccugucaugcacaggggucacuaucgucacauuuuaaagauauuuuuugaacaaggaacuugauaccuacagcauuuaaaacaauggagcaaauauuaucaaagaaugggugagaaauuagaaaguuuccuuucuaaaacauucuuuuguuuugcuuuuuuaaaauaaauuaauuuuuuuuuacuuauuuguucuacauuccacucacugcccccuucccagucaccuccucccauagcccuuccuccaucuccccuccccuucuccucugagcugcaacccgcugcguauccccccacccuggcacuucaagucucugcaaucugcaaggcuaggcuuuuccuuucccacugaggccagacaaggcagcccagcuaguagaacauauccuacauaugggaaacagcuuuugggauagcccuggcucccgcuguucagaucccucaugauaucugcuacauauguacaaggaggucugggucuagccugugcuuguucucugguuggugguucagacucugggagccccaaggguccagguuagaugacuguuggucuugcuguggaguugcuauccccuucugggcugucccaccacguccuuaugguguuaggcuaucauggaaugccccccagaaagguagaaauuaaaucauuaacauugaggaaaccuagaggagcaguacaccaguccuucaucaaugcaagcacacaguuccagaaggagcugggagagaagcaaaugacaaacgaaucaauuugcugcugcaaacauaaucccaaaugcuauccgugggagaugagaaacagcuuucacaggauacauggggguauugcugccuucgcuacuuuauuaacuucuacccagagguauuaaaaaccaaacacggcauuagagguuuuuuuuguguauuuguuuguuuguuuguuuuucuuuaagcaauucuguauuauuaugagcaaggauuuaagaauguaccgaaaccugauucauuuuauuuuuauuuuuauuuuuugccuauuccauaggaacauuugucauuauuaguauugcaggauacacuaauccuggguuagaaugauuuccuucguaaauaauagaaaagucaaugggaagaaauuaaucacagguucuacaaugagauucacaaguuaauggauugaacaguguucuaagguauuuggguguacccaagucucuuuaguagacacacagggauaaaaaaaaauaacauuuuuuuuuuuuaaacaaugugugagcuguugagguuguggcuaacaguagaaacauuagucaaaguggcuaauaccauaugucaggccugaguaaccucugagaggagaaaaaaaguaauggaacuuugaauggcuaacuagucauuaauucccuuaacaagccuucggagggacaauaacucaaagcagauguucacagagcuagcgucugcagaggggacaauuuccccugcagucacuccuaacauguucacacuuuaacacuaaaaugcagauagaaaggucggauugugaugucaucaccaauaguggcccagaugggaauaaaucagccaaugucaggaucugaacaugaaacucagauugagagcuaaaaggggcaaugguuggccucuauuucagguuccaauuugagacaggacugggcccacaaaaccaacagugcuuccugcuuuaaaacuuucucccugcuaaugguaagauguccauucuuuugucucugcccaacauuuuggguagcucugugaccaaaucgaauauuuguuuacucaaauaaucucuauuuucaaaaccaauagagacuaucauggaaaagucuuuagggacuuuccaaagauuauaauuucaaauaagcauuuguaauguucaaaucaaaaacuuggacuguuucauuuccuccaaaaaauagguugcacaaacuuauacuuaugugaacaaccgagagcauauuaccaugugcucuggguguguccccucuagugccugacgauaccugacauuauuuacaguccuaccaacagcuauccugcuuguucuuucuucuccccucuccacagcuuaccucugccccucugacagcuuggauuugcauuucugcucucacuuuacaaggagaagucuggcucccuuaaaaucagcuacccaugccgugaucccggcugugaaccauccgccccacagugacccgggauggggaucaucagcuagcuauaaugaucugugaugggaaccagccaguuacuguagugaucaaggacagcaaucagccacucuacauugauccaugcuaugaguucccuagaagccuuuacuuuaaauccggaucaccgaacguccccuuuaucagccaggaaacaacaaauuaugugugcucaauacaauuaugaguuggcccuacaucacauaagggaccacucgauaccugucuucauuaguucagauaaacgaaggucauaacuuugucuucucccuucugaugacaucaaacagucuugaauuugagauuacucaaaagcuuugaaagaccuucucacauuaacuaaccaaccaacaaacaaaagcaagcaagcaaauucuaaccacccagccccucucaguucuuggugcuauaaaguucuguuuucuaauucugucuaaagacagaguuuuuccccccacaguagcacgucuauugagcuaagucuugcaaagccuucccauuuagaaugugaacuucccauacagaugucacagaaacuuaaauccaaugaguuuacuuuaaggaaaaaaaaauuggguugaugguagacgcacagguuagaggaggucuugaacacagcaaccuugcuuucaaauuuuaaagcaacuucccccuagauuuuccaaggcaaccuggaauuuagcaagugcaacuagaagagaaacugggaaagaaucagcagaggcagaaaggcauuuuauuuuucccgucugaauucaaugguguuugugaguagucucuaagcccaggcagcaaacagaaaucuuuccaacauuaccaaccucaccaucacccaauaggaccguuacuauagaguucucccagaauccacccuguucacccggaaguacugccuaugccaccauguuacuuccugucaacucuucaguagggaacaacuguauucugaggguauuauguaggauuaguuuucaaguuauaccacugagcgagacacauuucaacuugaaaacugauucagcuaaucuaugaaaaguggccucguuaacaaguuccuacaaggugcuaugagcagagggucaagucucacacagaacugaaguccaugccuggccggagcaaaacccaaggcagcuucaguuuguucuuuugccacacagacccaagaacaaugcuaaccagagcuucagacaguggcuuucuucugguaaugauagcuuuugugagggggauuaaaaagcaaaaggaguuacgaauggcaagccagaagccaagauucuaucaaugccaugugaguuuuuagucucgggaacaauuucuguaagaagcucgaggaaagauguuauuuuuaaagauacauugaaaaaaagcaaaggacaauuagcuaauaguaauaagacccauuaaaauaauuaauggcacagaauauguagcaaccagacucuugcaacauaaaaaagcaggagagagcucagcagagguggugauagcuguuagcuuuauuucuauuuacaaaugccuccccucccccagucauuagcauauaaagccaaacaaaccucugaaagaaugauuuauuacuguccuuaaaaaacaaacacacaaacaacaaaaaacccgaaguauuuacaacaccaaaccauagcaccaaugcacuugggcauuuucuguuaccuuuuuauuucauuccuucacuuuauugcauuaggaaaaaaaaagagagagaguaaaacggaagugaggaagaaccagagucacuuaguaagaugggguugacugcuuugggcuugaauauauggugacauaugcuggucagcauuuauagaaaauuuaugccaagugucugaauaaaacggagacaacauacgauuggaugccaacuccagaagauaacauuuugaugauuuacagcaaccuguuuagcaagagcagaagcagucccuucaagcauggggguuuggauucuaauuaaggaauaaagaugaggaaacucgacaaagcccugaaaagaaagcgaugaaguaauucuggcuucuaauagugaacaagggcaaaggucacaacaggaguuuauuuuaccacccuauccauagugauaacagaaaaagccccaaggguccuuccgcucuucaugucuuacuucaccaucucaaaaugucaaaagacaaugaccucagaccuaacucgagcagaccacacacacacacacacacacacacacacauuuaaucuguaaauccuuauuagauguccaaauaguuacaaauaaaaaaagaggaauucuucaucugcaauaaaaucuuaucaaaaguugaacagugaaggugucagaaagagaccaacuuacauuaauaagcucaagcucccagaucuuuuucaacagguccauggacguguagccauugaugagaaaggcuuugguguaaucacccagcucaauggaauccagccacucggcuacagaggugggaugguagccaucauggccgaugggccucaucuguaaugaagaauaccacauuaggaauuauuuagacugguucccuucuguuccaauaacaggaagcaucuugccacuugcaaauuaaucugauaugaagccucagauauuucuggauggagaaguaaggaagaaaagaaaaugcuccaugaacaauucuaagucaucaguaauuuucacgcugaauuaguuuucgaaaaacacacccagaaauuuccaauucagcugcuaaauuagcucuguguuugagaggaugagauaugucaaacccccguuaaagauuuuauugguauucuguuggaaugggauuucaagggaugucgguugauuuaccaggguuccaugcgcggaaggcuggagggacggcauguucaaaauagagaugguaauucucauaugcgcaacaucaaagugugugaaaauacugcaugacuuaaacguuccaaagggauucaugcuuaugcaagacauguauuguagguggugcacacacgcuggagaaacacagcgcuguggugaacaguuaaaaagaggcccugaguguuuuaagaccauguguucugccucagcucuacaguauguuagacaugaauagggaacuugcuggcagacaagcuucuauuuuuugucagcuauauacagauuuuuuuuuuuaauacuucaggggaacaaagaagugugacaacaacauaauguuucugagucuaaauuggaaugugaaaauaauuuaagcaggaagaacuucuggguugaaaaauuuuauauagaguccucuaaguccuuuauucuuuauuugaaaucugaguugaauucaugguucuuggcuuugacgugacucacuucugaaacuuaugcugccugcaugcuaaggcagggucugguacugggguuccucaggagagccugcccccucaucagcugacgucaggcaacagugagauggcugcugggaguaucccacagggcaaggugcagaauggguuuuccucuuccaucaaauuuaaggagauuaaauauuaauggaaaucuauaugagucugguuugugagcagagaaagauuuguucaggcacccaggauucagauauuuagucucggcaucauuagcuuucugucacacacagaauccuccauugagauucuccuugccuuucucccuuccacuccuuccugcuguucugcuccucaaucuaacuuaaaaacacgcucgaguuuaaauguccacuauaucaaaguuauagugugacucauuauuauucaguugccucagauguuuguaguuugcuuuucuauugauugauuucccccuuuuagcuauucacccaugugcacacauguggcccuugcucaguauuuauuauauggagucagaguuugcaaaaaugaaguuuaguggcuucuacaaguaaaugaauguuguauaugaaacuagagacuagaaccccaaguggaugcucagacguacugaguauuuucucacuuagucaggguuucuauuccugcacaaaacaucaugaccaagaagcaaguuugggggaaaaggguuauucagcuuauacuuccacuuugcuguuuauuaccaaagguagccaggauaggaacucacacaggauaggaacuuggaggcaggugcugauguagaggccauggagggguguuacuuacugcuugcuuccccuggcuugcucaguuugcuuccuuauagaaccuaagacuaccagccuagggauggcaccacccacaauggacugggcccucccccccuugaucaccaauugagaaaaugccuuacagcuggaucucauggaggcauuucccaaggaaguuuccuuucucugugauagcuccaguuugugucaaguugacacacagaaccaccuacuacaauuuccuauuugguagauuauaaacuacagggguagggcacaugcucauuggcuugguagcaagugggugaacuaaucuaaacacuugcccaagacaagggagacuucucuuauggaauaacuggagaaagagaagacagaggaacacuggaguugaaaugaauagccuagcagagacauccuguugauaguccacccaagaaggcaacaaacccagcagugguuacuacugacaggcuuaagggagucuugauaauuuuaaagaaccaguuguuuuuucccagagaacuguguuaagguucuucaaaaguugucccccaagcgcucacauacaguuccuuggaaaggccagucauugagcaccugucccacuuagguuacuugauggucacugccagacgaguaaccaggguuacccuccagacaacugcaaagugagccuaauggagaccaaggaaguucaucucuucuccaguaccuuucuuuuugcccugauaucgaacaauugagaauaagaaagggggagucucuuggaagaaaauuggauuguguguguguguaagggauggauauaaagcuagagguuuaaaaugaauuagaacugaauuuucaguauuuuacccaacgagaacauuauuggauaaaucuaaguucacacuaagaaguaccaaagagaaucaacugaacucgauugaaggcagcgucugggaaacguaacacuaaaaucucauggacugcuugguaaucugguuccuccuguaacgcaaaaccuaccuuaaagaggcaaggaugaaagggauuuugguggggugacagacgagcuggguagaauggaaaggagaagguucucuggaaagggguuugugugugaaugugcaggggugugugugugugugugugugugugugugugugugugugugcauguucaggggugugugugcaucuggagggcagcauccauacaaguugcuuauucuucaaguacucagcauuaauucugacagaugcuaugcaaacagcaaagaacaaaucucuuagaaucccucccucaugguaauuguaagucuaaaaaaaauauauauaugugcccagaugaccaagaaauuauggagacucuauaugccugaagggaggaagccuacauagcccaaugaaguugcgaaaugaacuugacacaucuuuaaugguaugcagagugguuacugugcugcacaaaaacuucuuccaaagaaggugucccaucuguuccuuuauuucugcuucuacuguuacuacccggcuuagcuucucauugccacuuauacaaaugaaugcaaaauccuuccgcuuucccccugccccccaccuuuggcucaguuuauucucaguaauaccuuagcaagacucagaaaucuaccccugggacagaucauacagugauucuguuauuagaaaaggcuaaagguccuaguucaccauccaaagccaaucgaaacuaacccagucucucacuacccugcuauacaaccuagugaugugacugagcacacgcacgugucaacagucauugaguuacuagcuacucccaaaacgugaauuacacgaggcacuguugauacuugugacagauacaauuuucugugccugcaaugugcuuggguuauuucuagacuuauuuuucaaggacugaaaucuucaugaauuauaaaacauuauuuaaaguaaaaauuuuaggccaucucaggucuuacagcuagcaucaacguaaguaaaacaacacauuuauaaccuucagcugagaacauggcucuuagcagcguuucucaugguucuuagcuagugaggagauuucacuccuuugcccaaguagauuucugagcuuaggaacgagucauuauaacuccuuagagcaacacgaccuauugauuguguuuccaagauggcuuuuaacucagucugucuuccaaaagugcacuuuggaaucugauagacccagaaauguuacuaauguuuuggguccaucuuuggcaaguuacagagcuguuugagacucacaucccucuuuucuaaaauaaguccaguaauauugacaccccucccaaguauugugauauuuugugaaauaguguguaaguugccuaacaugacgauuuggaucccuagccaucugaugacucuuaagcccucuuccugcuccauugcuuuaaauggaacccaccuacaguuugaaauugcauauguuuuugcccuuggcugcuuagcuuuucacuucaaauuacaauucucuugucuucuuuccucccuuuuucccuucuacuaacaucuuugcuucucucccuuugagcucacagcucuguuuuuagacauuugugugacaagguaacccaaggauacagaauuauucuuccaaguucuuuccucuccuccuguauuggaauuaugcuucugcacccuaugccaggggaaccacauugagucucgcugugguuggagguacuuuccaguuccauugaugcuggccuaugguaugggugguuagcagucucuccacuccuguuucacccauucuuuugcguucuuccuacccuguagguauacacgucuauucuuacauuaauuauuacuguaagacacaugccugcugaguacuuuuauaacugcuggugcuaggagauaaauaaagacuuacaaguuaaauucaacccaaagguuggaauuaaaauuggagcccaggaaggucuaaucagugugagggaacuagagcugaccuauagauucacgaguuagaaaaauaagacaugggcuggugagauggcucagcagguaagaacaaugacugcucuuccugaguucagaucccagcaaccacaugguggcucacaaccacccguaaugagaucugaugcccucuucuggugugucugaagacagcuacaguguacuaauuuauaauaauaaauaaaucuuugggccugcaaagguccaaaauacccaacaaccacaagaaggcucacaaccaucuguacagcuacagcauacucauauacauaaaaauaaaauaaauaacucuuaaaaaaaagaaaagcaagacauuuuuguuauauuguugucaacuacugaauuuuugauauaugggggaggagggacugcauagaguuacugcuuauuugaaagccuuugguguuuauaaauugcaccuguggaaucuaacuccuacucuuaaauucaugagucuauuggcaauugguuggggcaggacugaggaagaugaaggaagcugacuaaggcagcagcaguauccuucuuagcuuauugcgcaucaucuuaacccaggcacgaguuaagucggucucuauugcgcaugcugauugcacgagguugucuguggggggcacaguccucugcguagcuagcaccucuguacuucuguguccccugguuucuuuagcaggaacuccauuucuuccugcucucccaagacuucucuaaucccgccucccuuucaagggagcaccaauggcauauuaacuucaccggauucccugccucuggugaagaaauaaggucuuaggaacuuuugcggucucuaaggccuccaucggaacuccucacacauggcaggcacuugcuaauuggaugauuggauuauuuaagccacacauggaagacaaaugacgagaacaaaggacuaucucauuuauugucguugguacgcauuugugggggucuuacauuuuguauucugugccauaagaauuaaggguuucucuucaugaucuaacacugguaacauuuuaaacuuucauguaucaagacccaauucuagauaguaggcuguacuauaaaaugcuauuuuaauuaauucuaucuucuugauucugcugcgggacccugggcaagccacacugcccucucuagcuuuaguguuguaucuacagagucaagggguuggaccaaugacuucaaagcucuguuuuacagaagcucccaaaauuuaugauuccaugacuuguaaauuacuucuaaguuagugucugauauacuuacccaguuuaaaaacaaaacuccaaaacaaauaagcccaauuacaaaacgacacaaaggagaguaaaaccgaggagaaacgcugacuacaggucagacagcacccauguuucuuugcuggcucuuuggcaaccccuucagguaguagcguaacugcugcucaaauuagcgaugguuaagcgcuuuuuucuagcaggaacaucuggugagacccaguuaggaagcaacagccccagggucugccaggccagcaguacuguggagcaugcgcaugagucgggcacagucugaugcgagaagcagagucgugggcggacagcaggcauuccuaacucugguucacagcaaggcaggauuugacucgcugaauuccaaaauuuggggaaaaccuuagcugggaccaaaaauggaaauagcagccaaacuuuagucuucacuaaauucagauaugcuaaagcauuuaccacacaccuuccugguugcugcguucugccugcauguccuucgaaaguugcuuggaauaugucuagccucagauuguacuguacccaucagagagacagguugagcauagggacaaaagggcucuguggacuccugaccuuccgggguucagcucugaaacauucuuggcucuaagguugccugcuccacuucagccagcaacucacauuuuaaauguuuuguguagguaugaaaaggaagaaaugccuuacugacuuugaaaagaaauguuuaaaaccagugaagcagaugacuuaaggguuuaaauggccucuauagcccuuuuuuccuuuucaaucucucuuuguuugaaauucucaggucugguaccuauuaauguauuuauauauauuugcaguaacaugagcgauacaagcauauccuugaacacggucaggcauucagggaaaugauaugaguggaauuuagcacaguucuuuccucauagggccauuuaaacaauuguagucacguuaugacaaguaaaggcugaagucagguaugagugagauugcacaggaugaccuuguaucuagucucucuucuuaucugcuucucaggagcuuggucagcauagacaagggacagaggagaagauggaagguaauaaaaacugauaacaaacuacgaauaguggugggcuaucugcaaucucaggaacugggagauagaggcaggaggaucaaggcuggccucagcacauaguacauuagaggucagaauggucuacauggaacacuaucucaaaaaacaacaccaaccccagaaugcuccccuaagcaacaacaacaacaacccccagaaaaaucaacuaaccaacuaauaacagacaaagggaaaugaaggaugguauauaucauauuugugguuaaaggaauauaaaagcaguuugcagcaaguuacuaaaauggaacuaugauacuagcauggaaaauagaucaagggauaaggaacauccuaacaccaauaauggaucagguagaugcugcugucaggaagugucacacaauuagagacagauguuccucuaucuaaagggugggcuuacgauugcucaauuagaccacaagacacaucagcuuuugggggcugauauuaugagauagguuuauaccuaacaggagccuaaugaaaauuugucacguaacccucuuugcucuggagguuuuaguccuuuuuaaaaucuuuccauguucuggaaugucaaugcccacaggauagugcugaccacaugggaaaaacagugcaucggaguccucacuguguuggaaucucauggcagccugcugacuugugagucuccuugaguuggguuggagggacucucugagguacugaacuucccacaagcacuauggugaugcuaacacugccagucccugggucaccuagaguagacaugauuuagaggauggcagagggacagagcgaaggucuugauuccuucuagaauugcagaauaaagagccaauuuauaaacccagacuguucauuucagaacuguuaugugcuagagaccaauguuguguucuccaaacuguuguauuuugaagcucuuuguuuuugguagcauagcuuuuauuugcauauaaguauaaguggaaauaagguagucauaggaacauucauacggaauuaguaccugcauuuggcagcaugcugcacugccuuuugcucuguguauucauaaguguucacauuuauugacaucaaaaaaauuuucucuuucccuuaacugcaucugugggcaucuuucugucaaacccaccaucauccaguugccauaguuauauagagaugagaaugggaaucuguaggagaaugucucaaguuucuaauuuagacauuuggcuuugugguagcuuuaauagccacgggaaaaaaccaccauacagcagaaugauauggauaauucuguggcacaagaaacauacauacuguagaccagcaccugaaauuuggggaagaauuccagggagucacaugaccuuggcaucaugagcaguacagaugggagucuuggcugccacaguuacuaacaaugugaccuugaguaaacuucucauccuugccaagugcccaccaucugauuauuaaggugagagaugaaaagaauggcugagaauugucauguauagccacagagacaacgcaaggagagcuuaaugcaauacucaccgcacacaggagugccauagauuuuaucauggagagcugguggccugugugagugagacugcacggggaugccgaagggugugaagaggugugagcuaagcaugaaccacuuccacuggaugugggagagauaaggaccauacugaggaggcaaagcaaagaugguccugacaggaagagauguggggaaaguuuuaaggaaggauguugcagagcuagugagaaaaaacgaaguggaggagagggcagggagaucuggcauauaggucaugagggaucucauggaaaaaagcacagaauccuggcugcaccuggguggggagggaguuagcucugagcaggcagaauauacagagacgaaggauuuaggaaacaagagaaacaugaacggaaagcaggaagaauaagaacucaguguuaaggguagucagugucuguagggggugguucugauguuuugaucaggaaucugcaggugcacacugaagguccuguuuuucaauugguucuugaucaaucaauaaagaugcuaguggccaaugagcuaagaggaauaggcgggacuuccaguuuuccugcagguaagggaggagagagagagagauauuuugccacacuucggagggagaaagagccaucagccaugugagaucucaggcaaaguggcuauuggcuucuucccugacugggcaugggaugguagcacgagggcagauuuagagagcuaaauuuaggacuaaagguaacugagcaacuacaguugagggcaguuuuagggugcugagcugggagugaaaagaagggcaugauaguugaggaagacuuagaagagccuggccauugagcuaaagcauaucaaaacuaugcuaauguguguguguguuucaucuguggaugugagggaaccugagcagggcuuguagugcaguccaccuguagcuccaagcauccuuuaggaaugaaccugagcaugcccuggaagggaggggggggggagacuugcuuggugguuaaguuuauuuacauuuauuuauugugugugguguguggugugugugguguguguguguguaugugugguguguguguguguguguguguguguguguguguguuaugcauggaugccaaguaugcauguggaggucagaguucaauuuuguggaauguuuuuuccuuccaccauguaggacucauggaucaagcucaggcuguugucaagcuugguaguagaaccuuuaccugcugagucgucuugcuggccugcuugguaacuuugauugccuuucuugaaaauuaaggagucaaggacaguuggagcuaacucugacauggauaaucuuucugugaaagcaguauacauauauggaagcuauguggauuagacuugggguagacucuuauaugggcaaggguucucauaugugugguaugccacuguccagguaaaaacauagaaaccuaugacuuaauagaccaucugugucuagagcacuggugugccaagcucagcugcuaaacuugucugugcuguugugaugaacuggagucucucuuuugcuaucuggguaugucugaguucccucacugcuugacagggcuguguucuccucuguucugguuccuuguucuagccucuugggacucuguacuguugcuacccaagacucagaauguuaguggcccagaaaaauaaacuaggacagacagugcaggcagacagcguguugccaaguguaaaggcagaucugugagggagggugaggaucaaauuuuacccguucagugaaucccgggcuuggagaucaauguauuucuuucauccaugacucuuaaaagaaugauugaacaugaaagauaaaagcugagccacuggccaccaggcucuggagaaagguccaauacccaagagguuggacacggaggcucugcuggauagacaugucuacaagacaaacagcacuaucaccaucaacaaaucaccuggaagcuauaugguacucuaaaaagcccagagucauuucacauuugucaucucauuugucaggggcuuuaggugauguauagaaaaugcccuuuauggagucuagucugaguuauacucuuucuucugugggagcuggaggguuaauuugcucagacucuggcugggaagcaaagcaugguagguucucugcauuauacagcuacagcaagagggacgacccgagcauaaaaggcucugcuucuggaagccccuguguuuaaguucagacugugcugaagguacaaauucuaugaaagaauaaggaagcacauaagcccccucagguaagagaauugugucugaauguugccauggagugcagacagccauuggccaugccaccaacuaacucacugacuuuggccuccuggaaucuucaauuauauuucccagcuuuuggcauuggggagacacugaagaguucauaucuuuauauauuuuuguuacaauaucuaucuaucuaucuaucuaucuaucuaucuaucaccaaucaaucaaucaaucaaucaaucuauccaucuacuauccaucuaucuauugguggggagaaaauaaagaaaagugcuuugcauuagauggugucucuucacgucccaggaaauaagagaaaugaauuaagauuuagcccagagaaaaaaugauauauuccaaauucugauguaauaagucauggaguaaguaauggugaaacaaugaacaguaaagaguguauaguaagaaauguuugcaagacacaugggugaccaaaccuuaauaucagggaauacagagaaacuucagcuacauguccuugagaauaggaaagauacuuuuuagucaagcauugguuggaccacaauuuaaaagaauaggauugucaacaccaaaauuuuaaaucaugguuggagaaggauaucaccaacaauagcgauuauuacaagagaaucuauuaucugaaagugugugaaugcucuguagucagccuuuggccuuuucagcuucaucugugauacagagaaaguaacuccauggucccacuugagaacaguuaccuguucugggaggcuguguggguuauggauggaaugacccauaaagaguuuacacagaacgcaaauaaacaugguccagggauugggcgauuuuauugaaugacuguauuguacuguucccugaaguuuuggguuaaaaauauguuuaaaaaauucaauaaaaggaaauguguuuucuaccaccuuuuaauuuacaaacccuauugagaucauguugaccuagagcccugugcuaaacaucucuaccuguuuuauuuccuuggugcaaagcuauuuuaugaagcaagggcuuggauuaaagaugaacagaggaucugcugcagccagaauaaggugcugaacagcacucgcuaucauucacguuuuccagcucuccuagugaugugaauuauauuuagaaaaagacaugugaccuccucauucugcaaguacauguuuucugacauucauguagcuaucugguuguuaauauagcucacugcucuccucuuaaaacagaaacuuuaaaugcugcuaucaaucagaaagauuuuuuuugcauguuuuuagucuuagugggaaaaaaauuccucaaaccuccauuuucaggagauaaugaauacuuugaaugucaguucuauuuauuuuauauuuaaaaaccauguacuuuuucagaaccucuaggcauguacauaacuuuauucgcagaaguacuucaaacagauaacuguaccauaaagucaaaguuagcuguuuacaaaugaauaacuuauauucugccugagucaagcaguacagaggauaucauuuguaugguaguuaaaacuaaguauucacuuaacacauucaaaccccagaccuacccuccaucuauccauccauuuuuccuuccauccauugaucuauccauugauccaucgauccauccauucuuucuucuauccauccauccauccauccauccauugccauuuucauucuucaacuacuaacugugccuacuguauguacucaaggagcucuuuugguggacucaguaaacagaauuccaauauuaccaguccuuguauuuuaagaaagggauacagcuaaugguuggaggcaaaccacaucguguauuaugucagaaaaaagaaguacaacauggaacugggaacccuaaggaggagcaacagguggucaggggagguuucauucagaagauuugaagaguuugaagacagugaggggaagacucagguagagagagcaucuagcacauaggucccucaaggaagagacaagcccagugagcuuucuccaaggaauaacaagaccaauggaugaguucaauguguagcugcagaugaaugggguucaggucagugggguaauagguggcuuagugucuagaagguuccugcaaaagcucacuuugagccugagggaagcagaaagccaaugcaugcauaugaacagaggucggacaaugcucuggccuauguuucagaggaaucagucugguuccuggguggagaauagcuaguaaagaggccauuuuagaggcaguauaagucguucagaggaaagaggaugguaucuugaacaggaggccagaaaaaaagguagcagaaaaugguuagauucaggauguauuuugaagguaggucagcaugaucuccugaaacacaaaauagaauguucuuucuucucucacauggccauggagcuugccagcuugcugacuagagcugugugaugcagcuuucaccuugaacacaacugugcuugccuauccugugugggaauuuauggaugacugucaggauuagucuugaagggguccauuucaaaugagggauccaggaacacuaaaaaucucuguuccaaaauggaagcuaaggcaucgaugcacuugaucccaggaacaaaagauacacauguggagggaugacacuucugaauguguuucagguucuggcacucucauggggcccugguccuucucccauagaccagggguuaagaugaagaggccuauaucaucaaaguguucugagaaggggugagagaggacacugggaacaaaaggagcuagugcuguuggcuucagaaacauuaucaguaagcagagaugaugucauaccagacauuggugcucucaacucugggcauuggcaguuggcaaugauaccagucuuggcaggcgucaauggcauuggcagaacauccacuuggcauuggucaaagugcccuuggugagaagacacugagcacugcuccaggagaacagauacuaggaccuucaacacauuggguaccuguagcucugaagcaguuuuuguauguaauuagaaguaguuuggcaugacuucugcauaaguccugguggccugauuuuaagcuucggugacaagagccaucaccacaauaagcuagaacaagagaggccaaauagcacaggugucuguggccagccaguguucuagcuaaugguguacauacacucaaggcagcugagccuuagugggagguucugaagguccagaucauaugggaaaguguggcucuguggucaggacuuaaaacccuuugugaaguucccaaguaucuccuuuaugccaggaaugguggcagaugucugucagcccaucauaaaaucaggaguuccaggauagccugggauauguagugagacccuguccccacaaacaaacaaacaaacaaacaaacaaacaccaagagcuagagaugcaguucuaagguaaaguacuugacuaacaugucuaagguccuagucucaugucuuagcauuacaaaagcaaagagaacaagcuaccuccaaaaccaaacaaaaccaaauccgaacacaggcccugcuccaaugcaugcucucauaucuacacgugcacguacacaaccaaccaacaaaccaaccaaaggaacaucuguuuuuuuuuauuaaacuaauaaaauguauuuuuaaauguacaacucaguauugucauuuuuuaagucaucaaaauaauuuauaauaguuaaagaccucuuaaauauacaugauaucuucugaggcugaaaguaaugugcacucauucaguuuuuaaaaucuauuuggaacauuaaacaugauagaaguagaaaaaaaaucucuuauaaaguucuccaugaaaggaaauugugacagguuccugauuagacggaaaacauuccaucuccaaaggagaauacaccauguaacuauggcuuccuagaaugaauuggguaguguuccuucuguuucuauuuuguguaauaauuugaagaguauugguauuaggucuucauugaaggucugauagaauucugcacuaaacucaucugauccugggcuuuuuuugguugggagacuuuuaaugacugcuucuauuucuuuagagauuaugggacuguuuagaugguuuaucuaauccugauuuaacuuagguauuugguaucugucuagaaaauuguucauuucauccagauuuuccaguucuguugaauauaggcuuuuguaguaggaucugaugacuuuuuugaauuuccuuaguuucuguuguuauaucucccuuuucauuucugauuuuguuaauuuggauacugucugugugcccucugguuaaucuggcuaaggguuuaaucuaucuuguugauuuucucaaagaaccagcuccugguuuuguugauucuuuguauaguucuuuuuguuucuacuugguugauuucaggccugaguuugauuauuuccugccaucaacuccccuuggguguauuugcuuccuuuuguucuagagcuuucagguauacuguuaagcugguaguguauacucucuccagagggcacucagagcugaguuuuccucuuagcacugcuuucauuauauuccauaaguuuggguauguugucccuucauuuucauuaaauucuaaaaauucuuuaauuucuuucuuucuuucuucuuugaccaaguuaucacugaguagaguguuguucagcuuccauguguauguggacuuucuguuguuuguguugccauugaagaccagccuuagucuguggugaucugauagggcacauggaauuauuucaaucuucuuguaucuguuaaggccuguuuugugaccaauuauauggucaguuuuggaggagaaaccaugaggugcugagaagaagguaauucuuuuguuuuaggaugaaauguuuuauagaugucuguuaaauccauuuggucuauaacuucuguuaguuucacugggucucuguuuaguuuguauuuccaugaucuguccauuaaugagaguaggguguugaagucucccacuauuacuaugugaggugcaaugugugcuuugagcuuuaguaaaguuucuuuuaugaauguaggugcccuuguauuuggaguauagauguucagaauugagaguucuucuugguagauuuuuccuuugaugaguaugaaguguccuuccuuauucuuuuugauaacuuuugguugaaaguugauuuuauuugauauuagaaugcuauuucaguuuguuucuugggaccauuugcuuggaaaauuguuuuccagaccuuuauucugagauagugucugccuuugacacugaggugcauuuccuguaugcagcaaaaugcuggguucuguuuaaguauccaguauguuagucuauuuuuuuuuuaaacuggggaauugaguccauugaugcuaagagauauuaaggaauagagauugcugcuuccuguuauuugugauguuauuuuuuauguuuguguggcuaucuucuuuuggguuuguugaaagauuacuuucuugcuuuuucuaggguguaguuucccuccuuguguuggcauuuuccaucuauuauccuuuguagggauggauuguggaaauauauuguguaaauuuguuuuugucauggaauauuuugguuucuccaucuaugggaauugagaguuuugcuggguauaguagccuagacuggcauuuguguucucuaagggucuauauaacaucuucccaggaucuucuagcuuucauagucucuggugagaagucugguauaauucugauaggucuuccuuuauauguuacuugacauuuuuccguuccugcuuuuaauauucguuuguuuugugcauuuaguguuuaugacuauuaugugaugggaguaauuucuuuucugguccaaucuauuuggaauucuguacaccucuuguaucuuuaugggcaucucuuucuuuggguuagggaaguuuucuucuauaauuuuguuagacauuuacuggcccuuuaaguugggaaucuucacugucuucuaaaccuauuaucuuuaggucuuuucauuguguccuggauuuccuggauguuuuggguuaggagcuuuuugcaguuggcauuuucuuugacuguugugucaauguuuucuauguuaucuucugcaccugagauucucucuucuaucucuuguauucuguuggugauguuugcaucuaugacuccugaucucuuuccuagguuuucuaucuccaggguugucuguccuugugauuucucuauuguuucuauuuccauuuuuagauucuggaagguuuuauuuaauuacuucaccuguuugguuguguuuuccuguaauucuuucagggauuuuuguguuuccucuuuaagcuacuagcuguuuaccuguguucucuuauauuucuuuaaggguguuauuuauguccuucuuaaaguccucuuucaucaucaauagaugugauuuuaaaucagagucuuacuuuucuggugugucgggguauccaggguuugcuguggugggagaacugguuucugaugaugccaaguagccuugguuucuguugcuuacguucuugcccuugccucuugccaucagguuaucucugguguuagcuggucuuguugucucugacuguggcuugucccuccugcaagccuguaugucaguacuccugggagaccaguugucuccaagaggaauuuggguauggagagcuguaguacagaguuagcaccaggguguagauggaaaccaaagagauccugaccccagauguuccuugguucccauguucugauggcucugggcgggucccuccugcaccaggaauuugagcagaagugguggugcucacagguguguaggcaguccugggagaccagcucuguccaggcagucuuuggguauggagcgcuguggcacagaaucagcuccagacacagagagaaacccccaaaagaaugucuuuguaucuccacuucaagcaugagcuagaaaauguuccucugccugguguggaaacaguggucuggaggagacagcuuuguuguugggcauacacuugagccuuacagucuuugcuuguuuugucaguucagaauauuuaaugacuucagucaguggagugacugagaaucuucagcucuagugauggagucacuaccagagaguuaguuaucaaagccauuuuaaaagcuguaacuuauuuaauucagugagaaugcuaacacaaggaauagauaguuagcaaaucccuagguguugucuaaaagcaaaagauugcaaggucccuaccuucaggaauaaguaauuuuccuuaguauacauuaaaaaauauucaaaaaguaaaaucuagaauuucaauacguuuuagagaaagaaagauucgauugagcugggaaaauuugagaguuccuuuuauauccugucuugggguuaauauauggaggggauagguagggagagagauggagagacagagacagaggaacagagagagacagagagacagagacagagaaacagagagagagagauagggagagagagacagagacagagacagagagagagagagagagagagagagagagagagagaacacaaggagagaacacucagccagccagcccuuucuucuuaccaugcccaguccucucaggcagcagcaucugccucaaguggcuucuucaguguccuaaaauauccauuaauucuuugagauugaguucaagaaucauccauccuugcauccagaaguccuucccugaucccaugcauuuaguuuucucucucacagcauuuuuuucacauaauguuuuagcucuggauacagccagccaucucugucuauauguaggguaaaguuccuugaggcauagaccaagcuuuaucuguuuuucuauucuuaucucagaaccucacacagggccaacaagaaucaugauauaauugaauggcuggauggaugacagcugacugauggauguugugggcuccauacuuguagcuagcugcacuggcucuccucccuggauuugagcccgggaugcuaagguccuaguucuuuggugauuguuacuuugugacuacaucauguaacauugagaaaaaguguucuguccaaguggaugccaguaaauguugacagaugaugguguaauugagucccagaggcaagaggcaaggggaucaaucuuuucuacauuuccuguaaucaucuuuuauacacuugugggggaaaauuucacauuccaaaguuucuguaauacauuuacuucugaguauuuagaaaaaucagaaaauacaugcccuugccaccaagcaguggcuucuaaauaaaggaagauacaaggguuagaacugaacaugcauuuaaaggaaggcuuuuaaccugucagaacucccacgauucauaaauuguaacccuaaaaauuauuuaaagugcaucuguuuggcauuuauuccaucauggauucugagaauaacaaguaaggcuaaaauguguuuccucugaaagacucuggcagccucuugagcugcagacucucuaagagcagcuguuaucugcuagcauuacaaaagaaaaaguggaaguucugauuauuggaaguggguucaguagaaaacaaagauaacgaaagugggagauaauaaaaaugaccacuggccuuuucccaacggcagaugaacugggacaugauccuggagagcagagacaugccacucuggcccaaagagcacagagacuuggcaugacacuauggggcacagagcagagacaugcuacuugggcccagagggcacagagucaggauagucaggucaacagagcacagagacaugacauucugguccacaggguauagaaaugugaugcuugauuccacauagcacagaggccugcuacugugcaggcagaggcuguggaggaaagcagguaagaguauagacucuggaccaggcagaauggcuuuaaucugaacuuugcuacuugguuacuuaggcaaauuucuuaacguuucugggcuucaaguucuuuaccuaugacaugggaacuuaaauguuaauugagaauuaaucugauggcauuuaggagugccuggcauauguaaaaagucuaauuacauguuuguuaucaauagaaggauucacucugcaguaucuuucuggcauggguaggacugucuuaggacacguggauucucaaguugacuucuauuaugaguuugcaggaguucaaccaucaggacagaauccaaaggcaaaugauggaugggaggacuugcggucuugaaaucaaaagguccugcugaccaccauucucaccaacaaaaacaagcacaaauaaauaacaugcaaugagaggguguuuagcuugggguggaaagauauuaacugugccacagcugacuugcaggugcuugucugagaccgcuguguuugacuuguucucccuggaagggugaugugacgaaucaauuucaugacaggauuaaugguacuagcuacaugucagaggaugguuauuacaaaugagagaaaaaaagagcacacccaucuggguaagccaucuaaacaaaugcucuggucauuuuuuuucuuuuugccucgaacauugugagcuguuucaaaaaccccacagcaacagugcucucaagguacaacacaggaaucaucugcuuccuccucuagaaacccucuucuaguccccaggauuaggggcuucacccuaaccuuccaugcagcauccagagaccaugauuuuacuccauuccagcucacaccaugccuugccccuggcugcacuguucaguuuguccuuuuugcuuuuucucccuggcacuguaucuaggaucugugcacaugcccaaugcgugugcagucccacagaacacucauuucacuugaauucuauagauuaaaaauaagaacauggucaaacuguauccaccugucaaacagacguauacgguuaggcauccacggcuugacaauagcuuaugcaaaccgguauaguauaaccuuugaguacauucacauccuuguguguuucuauggcaucaaaaugccauuacugaugcucaggagucacagugucaagguuuaacucagcuucuuagucuacuuccauuuccuuccaugccacauacauuaaacauuugcucugaaagcuauucacucuccucccuugguccaaguagcauuaccucuacaauagagacauacagcucuuucagcauuaugcugguucauuuagucacacagggaggcucuaguuauagcuuuaaaccuggucuuuccuagcugugaugggugaugcaaucaucccaaauguauuccaacacaaucaaguuagcagaugaugacaagggaauucgcaaucuucuuccuuuccuuuacagguagugaggaaucaaaguaugcaaaaucugccaguggagaaugguaagcucucggugagacccuagcacugugaugugccagucugguacugugaugucugcaaaggcaucuccuuuggguuacuuuuguccuaaggaagaauaccacuauuaaucuacugauauuuguaauugaggguguguugaacacuagcaggagguucuaacauuaacuaggucuaagugccagccgggaccuucauuugcacuguuauguuuguaacucaaccaaaacuugguauaguaguuucugccacacucuucauuuaacaaauggaaauuagggauuagacaauguaaguaacgugcccaaggugacauaaaugggagguggcuagacuggcauuaaauuggguuugaggaaagcccaagagagcucauguuuuugagccccugaaaaacugcaaguucuguaagacacuguaaguggauuauuuagcucacucaccucaguguuccuccccaacaccauccccuuaguaucccuauuuugguuugaaguacaguguuuagacaauaaagagaaguuguuaaggaccucaguuaaauggcuuugugugaggcuaagauuaucugccuacaacaccauucacauacccccuucauucccuggcaaaaguuucaugugucacuaccccacauucuaugugauuauugccuuuuaugggcauaauauaaucugcaugaggacaguggccuuguaacccuuguuuccuacuuguuaguguuuuacugcugugaacagacaccaugaccaaggcaacucuuauaaggacaacauuuaauuggggcuggcugauagguucagagguuuaguccauuaucaucaaggugggaacaugggcagcauccaggcaggcaugguucaggaggagcugugagcucuacaccuucaucugaaggcugcuagcagaauacugacuuccagcaguuaggaugaaggucuuaaagcucacccacaguaacacaccuacuccaacaaggccauaccuacucuaccagggccacaccuucuaauagugccacucccugggcagaacauauacaaaccaucacaccuaccaaaugcucaaaagcuagauagaauagcaccuagcauguggcaggcaacucuuaagugucuauuuuaugaauaaauaaucuaggcacuuuauuuauuuuuuaugcccagaguaguaauuuuaagaaucauuaauacacugaggaaucucacaaauuucuugguucaccuucaaccuucuuuuaaaaacuacauuuaauagaucaaaauagaguacauauacuagcccaggcuccauuuucggugccucacuuacacuuaauuggcacaacaugccuacaggguaaggaaaucauuaccuccauuuaaaggugaaaacaggcagagaaaaguuuagaaacuugcccaugguugcacaauugggcacaguacagccaagaaucaaauucggaaucuggccacguucccaaccauuacagcaugcugcucucuggcuuaauccuauaaaaaugccaucuccauggaguuuaacgcugucaagaugggucccacucucuucuggagaauucccuuccagcuugcucaguucccccucuucuccacccagaucaaagaacacacgaauaagauuauuuuucuuauuucucucucuucugugaugcuuucuuuccuggaaaugaugucuguugucagugaugucaucucuggggcugccucuaaagauaagcaggacccuggaggcugcuggacaguugaccugaccuacgugagccuucauuccccugucugucucuuuccugccuuuucaggucuuuuggauccccgccagucucuccugcccagccucaagaacagaguugagagauaugugcaggccucaaaggcugccuuuuaagccugaauccuaagaugaaguccaauuuuagaaacauucuuguucuugcuuucaucuuuggguccucugcugucuuguccucuuucuguuucucucacucacacucaccccccagcccugggccuguuaaauagcacaguauucaccuaagaggucacaaguaggaggggauagaacugaguucugguuucccuuucuggaaaaggacacagguaagaaagaggccaagcaggguauuuaaagucucuucuagcucuaaacugugacuguucuuugaacacauauacaagaaggacaacgugcucaggcaacuacaucugcuucauccuugccagugucuauagccuaaguccaaggcacccagugcucuuucgcuaacagaagugaaccacucaaaguuggaggugggcagccccgggcggauagcacuggauggggcuccuuucccuacccugcuccaacaacaacaacaacaacaacaacaacaacaacaacaaaaaccaaacaggugaauauuugacuauaccacucucuuuacagcuagcaguucuuugacuauuuguugacaacugcuguagcuauuuuuguacucuguaaguagugagacuugucauuucaaagagaaagaaagaauuuuagggaaccugggccauugcuucuccgaacacauuucuaaauaaccaacuaguuuuugauccucaccuguaaacagagggugugaaggaugagaaaggaagucucuaggaaauuaaggccacuacuguuaaggguaauuuguccacaaaggagcuggccugcugcuuuguaaaacacuggaaagaaaaggcacggaaauaucuuuagaagcagcuuccuuucccaccaggauggaucuauaaucugcucuaguacguggcuuccuucaguguaguaaucacaaagugcgcauuauuaugguccaggaucagauguuccaugcuuuauaaugaagacagcauaguaaagacacuggucuugagugacagagaaaaacuaggcaguaggauacuguggcaccauagagaggucaaauggcccaucuugcucagagaaaagcuguccugacaugugucuuaaagaaaugugucccggggaaugaacugaagaaguugcagcaggugaggggcagagaagaaaugguguucggggcacagaauggccugaaucucaagaauucugucaucuuuuccagcacguggagucuacccuucuuguuccccuuugcaguuucaugagugacaugaacuuuauucuaggggaauccaaucuggucuaacgugagugauccaauucuaggccugacauuccacagagcaucccaggugaccuuccaggcuccuagcucuccugcuuuugggggcuguuagagaacagcaagaugggacacauggccaaagugacccagguuccuaaccacgaggagaaaaggcugugacggcagacccucuacaaaugagcaguaaguggcaagugcuaaaccaccugacacuuucgaucuccaugcuggcaacaguucauuucccagcuuauguggcgugccaggcuaaggaguaaugagaaggagcccaguggcuugcuguuacuucaaaauuuauagacaucgaaauacuuaaguuuuugaccuugaaggcaauuauucuuucuuccuucccuacucuccaguggcaccaacuccuuuuccugagcaaagacugaguuuuacagccuuacagcaagucggcugcuuuuucuuuaucuauucccaguguucccugccuaucauuugaguuucuuuauaauagacacuauaaaauaacauguauucugcauggguauauauguaauauacucuauaauguaauaaaguauauuauuguauuuguaaaguaguaaaaccaugccaguuauauacuacaauauauguaacauguuacauauaguauuuauuguauaaauaaaggaaugccacugaaagcauacacauauaugcauaaaauauucauauguauacauauauguauauauauucauauauauaugauuuuucuuaauaaaauacauguuuuugugaagucaagagcuauggguuauuuuuauguuguucuguauccuaaaccugugcuaaagaaaagaucuggugugcagagacccucuuagauuuuugcauaaugaauaacgauaaauuaaacaagaugcaggccacuuguguuugaacauggguucucuuggacauguuaauuugaugucuuauguggguuuccugggggcagggggaauagaucuauaaauucagaggcagagguuuguuggccacucauguguaggagauagcagaaacgcuggggugggggaagggagacaggugaaggcgcuaagggauaauaugggcaggaagaggagaagaaugugaaagcccaaauucugcagagugugugaaagagaggaggcauaagaaacuagcacacgucaaggcuggaggcuuuggaguucuuuguguccccguguauacaagguagaguuguaugagggaacugugcaagagggguagcccaggccagaccuuauggaagcacuaaaugaacauuuauuuauugacugauaagaguggggcccugaagcguucccacaaagauggccaaaaaagugacaucuuucccgacagauauauacagcuaguguucuugucaaucacuacaaaaugacuuuaucacucagaguuuuagggauaaugugugaaggaucccucccauuacagaugguugugagccaccaugugguugcugggaauugaacucaggaccucuggaagaagcagucaguacauuuagccgcugaaccaucucugcagcccuaaaagauucuuagaagcauagcaaaaccaucuagcuggagacuuauuguuaauguaaguuagguguauguaaacuauguuucacaagucaaauccugcccauugccuguucuugucaauaaaguuuuauuaaaaugcacacacacacauacacacacucauucuuucugaguucccuguggcugcuuuuacucuguaacagaguugaauagucgcaagggaagauauauggcugguagacuguagucugacuuuuucaagaaaaagcuugccaaccccugguaugagagagcauacuugcuuguucuggaacaauaaagcauuuuuaagacugcauggagccacacagacccugucaccccaaaggccagaaaguacagaaagcagaauacucuaugaacucagacuugagcccugugcaucuucuuuagguugggacccccacacuaaagugguguauaugcuuauaagagagauucuguuucacagugucuuuuuaaucgauguucaggucaaucagggugucacaaaauuuaggacagcaacaggaggguagagggaggggaaguagaaguagaaagaugagggcacacagagaaugggugaugggaagggaggaugaaaaguagcccugacaaaagguaccaugggauugucuguguccauggccugugcuuugucauccuucuucugaaaaaaaaaaucauagaagaaauagggacaaguuucugucauuuuucuaagugacaggggaauaaggccgagccucacuuuccagacuuuuaaaggaauuacauugguugaaugcuuuucccuaaagcugauaugugucugugugagcuaucgagauuacagcuaagaaacauuugagacuuaaaguccuugggaaaaaauaaagagucuucaagaguaggggcauggcgaggcuuaagugagauaaugccacuuguguaauucuccguugcacuccgcacacaaugggugauuucaucacaggcagacuccucuuuuccuccugggauacccagaguagcaaagugcuuuacuuugguuucucgccaugguucccaccagacuguguugucuuguccuuaaagugguuugagcccagacucuugaguaucuccauggcuguucaaaagggggggggucucacugucgaugauuuucucaucaacugucacuucgguuuauucccuucaaucaggcauaaaaaauuaaaggaugucuaguuucacuaucuuuccaaaaauguauuuuuguuucuaacaucccuaaguccuaacagagcuugaccaugguucugcaggagagccaaggaaagguaauguguacacaaggauguucagacucgggacagagggggugggagguuucuuagaaauccgccucuccuagacauacuuuauaaugauauaauuuuugguccaguucuccagccuaaauaacuggggucaaaauggaaaaacucagcaucaacaagaaaagucaucucuaauuuccccagaccaucacuguguucacauuaggugauuuagaagccauauuuaugaagaaugugagacauauagcucaugucaguguggauggugacgugacauagcaugguacugcaauccagaaauucaaccguagauuugcguaugcugacguugcagucugaagcucacugaucugauacauauaaaucaauaagcccaccaauacaacuuuugggaaaaaaaaauguuuguuuucuaucagugucucacgacugauacgaacauuuucuaguggcuccugaugaagaggauguggcaaaagcaugggaugccacuuuggugauuauuuaaggugacugugaguuccaucuugccagcacucccugaguaagaugcucuauagagaggccuauacaaaggaacuaaggaaggucugguccacacacauagacacccuauccccacuccaccccugcaagagcuaaacccugccuauaagcacacuugugagcuaggaagggcacccuucccaccugagucuagagaugacuguaucccugggagagaccuuaggacggaagaucccaucacgugacacuggggucccugcucaacaaaaguugcaacuugguacuuugugggaaauuuguuauguagcuauauagaaucguauguuuuuuuugaaauaggaauagauuuguuuguuuuuuuaaacuaagucuuauagugagguuagaaaagggaaugauuuaauucaaucaaauguguuugauaccugugguuguuuaaaugaaaaucccccucccccauagacaaauauggagugacauuauuggaggugugacccuguuggaggaagugugucacuggggcggacuuugauguuucagaagcucaaggcagguucguucucucucucucucucucucucucucucucucucucuccccgucuccugccugacaauccagauguagaacucugagccccuucuccagcuuccugucugcccacacacugcccugcuuccugccaugaugacaauagacugaaccucugaaauuguaagccaggcuccaugaaaugcuuuccuuauaagaguugcugugggcauggugucuccucacaguaauagaacacuaaccaagacagaguugguacugagagugggguauugcuggguuaagcugggccacguauuugcuuggaagaauaugaaacacuuuggaauuuuggacugaaaaagcaaugggacacuuuaacuggggcuuaaugggucauccucguaggaauaugggagacaguggugcugagggagauuugaacuguggaggucuggcucaagagguuucagaggagaagaauauuaguguguagccuagagauuauucuugugagacuggauugaguuugcagagauuucaaaacagcccaguguugacugauugugucacaugguuaucgguagccagcagaucuauaauguaaagaagcaagcugcacaggagaaaacuacaaaauguacaguuugaaggaaaaggggcacugcgagguuuaaacagauuaaagacaagccuaacgcuaaguggaauaaagggagugaugauuuuagaguaagacuucacccagcuaaguuuccaacuugugaaaaggaauuaaagaagagcuuaggaccaggcauggugcuguaugugcagcuuguggggggcagacgcaggugggucucugagucugaggccaggcuggucuaucgagggaguuccaggccagccagacuuuuaguaaaucacagaaaacagaaauguaauuaaacaaggagccacauuccagcccuagaaagcaguagaacuuagcagcuuuggccaugcaguucuugguuuagcaucaaggauacaagaaaaggguuauagaaucucccuccacgacuaaggaaagcugcuggggcuugaugcgucagggacguccaugcacggaggccguaggaaagccacugugugaaggcgaagccugguugccuugcagaucccaaguugguaaacacaccaaaguuguggaauaccugcuaaggaaugcugagaauaagaagugcagacagcccaaaagaaagaaguggguugcagacagcaaagaugaaagggguuggcaauauaaaggauacuuugacaucagacauggagaugcagaguuuggaguuuguccaucuguuuuuucgggguuuguuuuagucaguauuucuucacuauggucccuccccuccccuuuggaaugguaauguauauucuaugucauuguauguugacaauacaugaucugcuuuuuaaauuugacgucacagguguuacagggaagagauugucauuaagagauucaagagucucugaagagacuuugaacuuuuaaacagggccgaucgagacuguuuuaggcuaugaggacuuuugaaguuggacuaaaugcauuuugcaucaugauuuggccacaagcccaugggggccagggaguagaauauggugguuugaaugaaaaugaccacuacagauucauaggaagcagcauuuuggaggugugucccuguugaggucguguggccuuguuggagggagugugucacugggggguggguuuugcaguuucagaagcucaagccagacccaguguaacucucucuucuugguguccaccuaucuagauguagaacucucagcuacuucuccagcaccauaucugcccuugugccaucaugcuuccggccauggcgacuaaaucucugaaccugcaagccagccccacuuaaauguuuucuuuaauaagaguugcugggaucaugguauuucuuuacagcaauaaaaccugaacuaagaaaguaccguucaguaaaauaaauaauuggaauguagaaaugucacuauaacaaauggugaauaaacuggauuuggaugggaaggguaaaucaaacuuggguuuucauuauuugguaaagaugaaguaacaucauccuuaccaggcaacagccagugaguguaggaaacuguauuauggucaagaguugcauggugacacacacuagcuauuagagaguuuugaacuucaguuauaggacaagaguaggcaaaggaggggcagagcagagugcuaggaaguggaaucgcagagcagaaugucaacaggcugucaucagaucagagcuacugaaggcaguugaggauggaaaggggcucagugacucuguucugguggcugcuggugaccugaaacacggccugggugguaaagcacagggcugagucagaucccagagaacugugggauggaugguguuggcagacugcugcugaguaacuccaaaagccacagcaaagugggaagcauuugcagaugaaacagggaaacaggggaaaccaggacaugauaggcauggauuugauuggcuacauuuucaauuaagguugagagauauuaagaagauauaauaugggucuugaugcaaagcacucuaaaccuucauaaaaugaaaauccuuugaauagcugaccuucagguguucuauuaucaaaggacaaggacacuuauaccccuuuaagaggaaaacauauuaaaggcuuauucaaggauuuauuugugggguucuuaucugguaauaauaaaggguaauauguuacaaguaagugagcagauaauuucucugugucccugugucuaagagacagaaaaaguacaacaugucuaguauuuaagagugaacagaacuucuuaugaaaauauuggcaugguuuccuucccauaaagggaagaggaugaaguuugaucuucaaaagcuuagggaaacuuuagacaugaauaaagcccaauuuggaacuggugggagaagugaguggugugugagaauugauaguuauugauaguuuacugcuggaggccauacaacacaaaagacagaggcaaauuaacaggagaaggagcugacucagccagauaacuauucuaaaagugacugguuagaaaacauguaguauacuuuacuccaugaauauaccaacuguguuuaaaaacaugugagucuuugcacugguguauauuucaauauuaaaacagacaaaugagaggaauggucuugccaaaagaguuauuugucuucgaaauuugaaucaacagaacauaaauaaagcaugcuuugaaacaagcuagcagaucagggcugugcuuugaagacugucuugucucuguucgggaguaaccuccccaaaucccaaguacagugugcugugagggcaucucagauagugauuaugaaaugcuucccaugacagaugaggagcgcaaacauucugaaggccagaaauugugugaaaaaaaaaaaaaaaccaaagagacauucugucaauuauucuagcaaugcaaagccucagcgaauacagcugaaugcuccaucccuaauaccaugccauuagcccucugaagauggggcucauuaccuaaaaaggcaaagcaucaauuuggagcauugcaacggucuguugugcuguggaggaugaaucuggccauucuuaugcauucucuucucguuuguguggaugcaguaggaacguccucaccagauucuugagugcauucgcuuaauucugccuuguuucuauaacauugcuugcuacaauggggauaaugcccugucuuaaaaauaaacacuuuauauauucucgaaauaauucuagguuaagguuccuuugcaguccucaugaaauuguacguggauaacuacagaauuaucuuaaaauugaaguauuuugggucuuaaacguaucugagugauguauauauaaggcaacuuuuauuuacucauucauucauucuuuuaauggucauauuaugggaugaaguacaaggaaauuucaaggcacugagugaucucugcuacugggaugcuuaugugcagacuaacaucaguaucuucagaugagagcuagcauagagaugcaaaauucucaaauaaaucagagauuacuauauguucucauucuacaaauauuucuugcauagcugcuuggugccagcaacugucaagggguuggcuuuauagaaaggagcaaaugagucaagguucuugaaccucugggacuggcuaccucguggcaagaugaaaaauaaugaggaaacaaacaauauaacuucagguagcaagaggugcuauggggaaaauaaagcaggcacuaucaaagagagugguggauacugaagggaggcuguuaagucaggaaugccucuguggaguggguaucugaguccaagccuugcuaauguauggggaucugaaggaucaacaaagcacccgaggcagaaaugagcuugucacuuuguguaacaagagaaagucagugacuugaguguagaugagaauuauacauaugaccaugcaguagguaagggacaacagaucuuacugucuucuguaggccaagguaagggcuuucugcuaauuccaaaggcuuagaaaaucacacuggugagcuucaaccuagagcaauaggauuugauucacaguuuggaagacuugguggagaaagacagcaugaaaauccauuugcugagguggagagcgagcaggagggagaaauggagguaggugaaugguucaggguggagaggaucgaugaauuauugguucagguagccuaaccaugauaauagaaaagaauauucauuggcgggcuuacuaaaugggggaguacuugcguuagauuucuaacugcuauaauuuaguaagaagugcuuccagguuaggccaaguuucuuaggagaagugagaugauacugucuggauugaacauuaaauaauggcacauaggccauucguugauaugcaugaauucacucuuacuuguuuuaaaggguggggacggcauuggguguuguauacagcuugguacaagcccuugcugaaggcaaguggacauuuauuaaggaaauaguggacauuuauuaaggaaauaauacuuuaaguagcaaagugaauaacaugccugugggaauuacuucgagaauuaagucuaaaggcauuuuucauucuuuccuuuuuaauauagaaacuuguaugauuaaggucuucaguguguccgacucuccuugaaucugcuaauguguuaacuucccaucagcagaaacuuaguucacugucagugggcaaacuucaucagauugcuugcuaagaaacugugauuaauauuucuuuuccugugugaggggaaacuguauccucccuagacaggaagagagauaaacaggggagaagacccagcaaucucucgugauuguaggugccccauuacaguucaucugcuccagucuuuccucccuucaucuuuucucagcugcagacuccauuucaacucucucuccuucaguuccucugguaaauugccuccagaaguaagcagaauagaguauucuagagauaggcauucccuaaugcccacaaaacauucaaauuccuuagcccuauacaaauagaagaaaccuacucuuccugcuuuaucuuuggcuauaggccacacuuuucauguauuuuaagcacauugcauuuucuucuauucugaugacuuuggaaaccauggcaaaugcacagaaaacuuaacaacuuaaauauuuuaaccauauuguucacuggcaucaaggacacucccaugguugugcugaucccaccggauucuaaauuacuaauuauuucccaagugcucccagaaagugauuaccuggguaacaccugcaauuacacaguuccuucuggccuccugaagcgccuuucccuucccuucccaauuaaaauccuaccuaccuaccuuguaagccugguacuuagauccuaccucguccuuuaaaaccuggucugaaaacauaaggucagcucuguugcuagguuacacaguuuccacucaaaacaugauaccugucugacaaaucacaucuagacuggaaaaccaacuuaucaacuucaaaugugugaaggggcacuguggacuucuccaaauuaugucuuuuguuauuaggcaaguccuuuguagggacucuagaggcuaagucuuggaauugcuucguauggaacaugauguccuuucaccccaacauucguauuguauguguauauucauugcacauagugcucauucuuguacagacaaauucuuuaagaauauccugcacuuuggccacaccuuccuguuguuucugcugauagucucuuccaguccaauguuucccuuccguuuucacguugcacagaugcaugaguggguauaaguuucuucuuaguuuucaaaaaauucuagggcccucaaaugaaagaaacuaugcaauacuuuucuuucuacauuucauuuggcuuauuaugaucucgguuaccuuuauauucauuccauaucaugauaaauuuucauuucuuguuauggugaacaaaacucuauuaugcauauauacuaucuauauacaauacccaaaccagauugauucacaugcuaauggauaccuaggcugacuccauagcugcagcauguagggaucuguauaguauacugacuuaagaguucuucagacauacaccuauugcucauacaaugagguaaugauaguuggaguuuuaugaggaaccuuugggccagugaaugggcugacuuacaucucuccuaacaguauguacauauuuuuucuuuccccugaauccucuccagcguugguuguuucccuaaugcuagccauccacagugggaugagauggauucaugaucuacuuuuaaacugugccuucuuuauggcugcauguuagucaggguacauuuuaaaugaugcucccucuuaauugagguucccucuucaaaggcucuaaccugugccaagcugacauaaaacuauccaguacaaugaagaaggaugcucaacacuuuuagcauacuuguuggcuaucuacucuucaucuuuuuuuuuuuuuuugguuguuguuguuuuuguuuucccagacaggguuucucuguguagcccuggcuguccuggaacucagucuguagaccaggcuggccuugaacucagaaaucugccuguuucugccucccgagugcugggauuaaaggcgugcgccaccaugccuggcaucuuuugagaacuaccucucuacucuauuaacccaucuauugauuggguuauuugguuuguggggggaguucaggguuuuguuuguuuguuuaguuuuaaaauauauauucuugauauuaauccugucagauguauagccagcaaaaggaaaccauucacgaagcuuuucugaaugcaaucaacaugaaucccaucuuccuuaaguugucauuagaccugaguuaggacucacacagaagagauauucugaaucugucccauugcucuguagcgguggccauauggcauucuugcaggucaguuuaaaaccaagugaagcuuguggcagucuuuugugucugauuaaagugggaccugagacuauucuuaugggcugcagcagcuuguagaaacgcuguauacccaugccuauaccguuauaugcuuugaccacacaucaauuagaagcuacuuaugagagagcccaaugaagcaucccauaccuuuggaaggagcuggaucgcuuguagaauucucugucuguggccagaguuaaggauuccaauuuccaacaaauccugaucuuccauaacauugcuucccugaaauaaaaccagaaagguuaugugauagauccagccaguuaugcuauaauaagaauuuacuuuccacagaguuagacaaguucucugaguucuauaaacaaaaaacagagucauuguacuuugugugugugaagaguaagucaucugugggacucuugggagggcaugggagccgaccuucccucacauacaucucucaugacuuucuauuauguuaacuucucugcaucgaagagucauuccaugacuuagaauuccauuccuguaaaaguauaagggcuuccaggaagagucaucauucaagauuuucagcgacuucuagaaggaugugaaugaauccauuuauuuuuaaaaacuaaucugaaaauagauuuugugaggagggcugaugggaaaauugacagguacauggcagguuaaaaguaaaaauaauucauuuuagaauaucaaaugucagauucuuaaaaacacggagauggaacaaugaagaagaugcaagugucugcaaaugaugcuaguugcucccuccauuugcaaacugcaaacagguaccaugugauacuugcuuggaaauccugaggggauuaagggcacacuuuuggagaaggugauguauaaccagacaucugaacuaugcuuaagaccccaaacaagaaggacaaaagagaagccacgugcaauaaccuguagaaaaacacauguauaugggacaaaaauggagagagagagaaaaaaaaggcaaggucagaaaaguaagucuaggcuaggcuaaaugaacacuguauggcacaaugaguuuauauucauucuggccaccauggaaagcuaugggcagccuuaaaaaagaguuccaugauagaauucuaaauuuagaaagaucauuucgauuuuuaccgcugggccucaguuuccuucccuacaaaaugaaaaggcugaaugaaacucacauucugcaaggaccagucuacucccaaugucucucaagugaguacuuuaauccccugaucaguguuugaaacagaaaaguagagacugcucauuuggugccucuuaaauggcuccgggcuuucaggguucacaggauagaguuucacuuuagauugaagacuugaauauucuaaaugaaauaagguaaccacauuuucucacucguugguagaagccagaaguagaaaagagguuguaaggcuaugaaaaguggcugggagauuggaugaagggauagaugggagaaauucauuaaaauguugcaucacacaguagacuagcuauauucuauaacaguuuuauagauucuaaaauuauuauaagacuauaauauuuuauaaauuguggggaugauauuuaagaagaugaaauguuaauuaaucaaauuugaucauuauccacuguauacauauaucacauacaugcuccauacacaagcacagggauuauacuccaucaaaacaaaaauauaagauugaagacuugaggguuggguggaaauucaagaguuugcauugcuguuugucugaaugaccaacuuucauccuauaaaugcauagcaugagaaaugacagaaaaacauggaaaaaaaccagcuacuuagggaggcucagagugacagaaaaugaacuagaaagggcaguccugggguccugcagaccauuaagagggugcuaugguuguuuuagggaugggaugggccuggcuuagguaaucgguauggaaggcagaaaacuauggaaaaccaucaagcaguuuuaguuggggucagaccuacagaacgaagagaugggaaacucagagugggggcaggagauggguuagauguuuucccagauaguucuuucccccagauaggaacugaggaaggguagaagagaugauguaaacaguauaauaucagacuauguuacaaauggauaauugacuguuguuagcagauuaaagccgacugaacaguaucacgguuagggauuuaagauggccauucacagaacaaaagcgguccaccuacucauagugaugugccaaugcuuaagccagccaucucgguggagguagagugaucccgguguauagcagcaugauaauggaaaggcuaaugaaaaacaaguaaagccagucuuggcccugugccacaggaaauacugcucuuaagaaaccaccaugugcacucgauagagccuggcugagcauagaaacgacuucauuuugagaagucguuaucacuucuagaaacggacucaaggaacuugagugggauauaugaagcucggucugacuuuucaucuuugaggauuccccaaagcacuuacugacauuagaacaacaaucacaacacuggccacuuacgugcuagaccacugucaugauuuccauggacugaacuaccagucuauacauucagcucacacaaaauguggggucuaguuucuuuguauaucagcaagcauaucauuaagauuuuaugguuuguaggaccuauggucuacaguuaauccuaaaaauuuggcagcaauauuugaauaauuugaugguuucaacaauuaaguccugaagguccacugucuuuccuugacagcacucauauacaguccuuucuauuuucaauaagggaggagacuuuuggaauaauuguacagaagucugcgauuuuaagaguguuaaauacacaguaaccuucuaugcuuugggucagauuuccuagcauacaggauacuaaccaaacacuuuuaaacguaaguggaaaguagagaguuguaauacaaacuauaagaauguaccuuaugaauuggaaaauacaaagaaaaggacucaaugucccuaaugaggcauacuauuagaauuuuucauuuugccaauuauucuucuuuguucacuagacaaauguacacacaaauagaaacaucauaguguguggcaaauauguacaauuauuuugugucaugaaaaauacuaauaaaaagaaaauguuuuccuuguuucuauaauucgaagaauaaccucucucccccaauauccugauauaucuucaauuuuuauuuugcuuaaaauguaagguggcuuggaccuauuuggaguacgguuaggcaaacauaauuaaauuauaaaaauuauuuuagauuucuuggcucuuaccuguaaaaugaagccgacuaaccaauauguauuaaaauaugauuucagccauguuuaauuuuugauaaguaucacuauauauagaguguguauuuugaaacgucauuuuaguguuuuagaaucuagaaccuaccuaaaguuggcuuuaagaaaugauuaccaagaaguucaaaacaauguuugcuuguuuguuugcuuguuuuugacagagcaaucuuagcuaacaggauaccuucuguguagugcuaugaauucuuacagcuuuuuagaguaaaguaagauuuuacaacucucaugauuuccuucuacauuugggccacaguuacacuguccagaccacaggcauucccauugugcccaaggggcuacaguggacgcucacucuauugcuuguuuuuguuaacgcagagaauuucagcuuaacuuaacucuuucccccuaacaaaagcugaauauaaagcuagcucugcauuccuucauccaguuugcauaucaccgcucgaucacugguuuggugagcagagcuccuugcucuuccucugcuuaaacugccuauuccaguacaucccuucuccucaccaucgcaugacaucauucucucccgcccccauaaugagcaggagcgccauagacuucucuaccaaauaaauguuaagccugaccccuccuugccaaauccaguugguucuuuucggcccugaacccaaguacuuucuggcuaacuuggcuggugacugcaauguuggacaauacccgauuuccagcaugucugucacugaagcaaguucuguuagucaggucuucucuaacuuacugacagugaaagcauagucaaaucacauagauggggcaaacgagaccaggaguaaaacauauucaucauucucgggauguaguuagcuauauaccauuuggccauaguucguggauauuaaauauagugucuucagcaaauuaccucccaauauuuuuguggccaaaaugaauuaugaaguugucacacuuggggugguguuaguucaugacgauguuagaaagccaugccauggaacgucaagugcagacgagacagacaagcuauugagcgcagcacccaacaucgcacaggugguuuuggggaaagcaaucagagagaaaguggauuugcuagucaguaacuaaacaacuuauuagcacgaucaaaggcccggggagggggguguuuuuccagcugcugcccuuuuccugaugagaacugacagauccggggcucuuuauuaccuuccuaaaucacagaaugaagagaaaucaccuaauauccuaugcgagguagcugaagccaaagcuugucugaccauggggagacuguuauguauggagguuuucagcucagauagaccacugagaugaccaaacagaaaugaguaguugcguuuccugcuuaauggcccauuagagauacaacaacuauuuauugaaaucauaucucagggauguccgcacugauggccccggcucucagaacagcaugggaaguucgugcgugcggcuucauaacuuugauacaauauugcauucauuuagaaucuuugacuucccauuccguuuuaaaucaagagcugggaaccaccuuugaggaccucaggaaagcuggccgcuucugaaugcacgcuggaguaggaaauguuucuauucuuuuucuucaggcaggcucaagcugaagacaucgagagauaauguuggugggggaaaacggcgucugcuuuauaacugggucagucagauucuucucacaauuuguguggccuuacuucgacgggauauuuaaaacaggguacauauacggugcagcaacauugaucucucacaaacuuccacuggaaaagcaggcguauuuuauuucuuuacagcauacagaaauguuacagcaaagaaauguuauggucuugcaccuuucaugaauuaaaauccaaauguuucucuucuuaacaggaaaugaagugcuuucugauuguuuugcuuguggggugggagggucuauggugacaacaacccaacuagagaagagagcaguguacaucauauuucuucgaauaaaaugcuacaucuuagcuucuuaccuuacagcuuugagucaacuuggugucaguuuauagagagauacagugcacggcuuuucugagugauugggauaguagcuauugccauaaguaacagauuuuuccgccgugcagcauuagaauaaagcuacauauaccucgucacucagaagugugauuacugucaaugcucauaucauagaugaugagugugcuccaauuuuuauuuauuauuauuaugauggugaugaugaugauguauaguggugugagugugugugaugugugcucgugugugccaugacacacacguggaggucaggggcaacuuucaggaguuacuuuccauucacuguggguuguggagaugaaacucgguguugccaggccucuguggcaaguguuucaccugcugucccaccaugcagccuccaugcucccuccauguguaauucucuaacuuaugauaaaggaacagcauuagaaguauuugcaguccuuucaaaucuuaggccucuguaauguacucucuugauugccgcagaauuuccuauauuugcuuaacuaacuaccuauauuuuuagcuuaugaaaaauuuucugggauuuaagguuaugugaaauuuuuuuuugaagcuggaauuagaaucuuauucuccagauaucguauaugaaacaugacaccugccuggcaugccaugaagacuuuauguuuaauccaauagauaaaguagaaaauuaaguuauaggcaaaacauaaucauaacccuucccacaugucuaugaucagcucacgaucacaagagauuccauuacagauguuugugagccaucaugugauugcuggcgauugaacucaggaacucuggaagaauagacagugcucuuacugcugggccaucucuccagucccuagucuucacuuugaaagcugccaguucacagcuucuugagguaagaagaaaaguugaugugagcaaaauuuaucugaguggucuuacuuuuuuccaguuacaugcauaaacauagaaagacagugcagacagacugcccugggagaguccuccacaccccauucucaucuaggcuuagauucaccuaaaggaaagaccauuucauguauuucccaguccccugccucuucaggguugaugaaaacccagcuacacaaaacacuucaaaagacagcuucaaagauguuacccaucuaaucaauaggaacuggauuccuucaaugcuuauacaagugguaguugagguaagcuaaacuacauacuuuacugaauucuuucuauaugcuagcuaggcaccauucagauugcuuuacgcauguuuucgcauuucauucuuuuagcaaccccacuuaacuuggagcugaggcacaguucucauaaauuaccccagauagucauccucgcaguacagcgggcagugaauuggucucauuccuaaccucaucucaccuccacugugacuaaugcaggcgaggaaagauucagcuuaacaaaacaaaacaugcccuggccuaagccauuuauauauuuuacuuaggaggcauaugaaauuacauaaaaggaggugccccagugaauuugaugucuggcuucauggcauuuaagcagcugacucccucucuguggaagaucauuuagaaagcugucugacccaucccucccccgcacucugguccuuucuguucacugaaucauggaaccaggcuggcagggaccuguaggcuuuucuggcuuaaguguucccuaacuaagcauggcgcguuaacuucucuuuugcagcauggugucuagcugguuuuacaccaucccaaagggguugcugggauauuagauacuuuaaacggucuuucccagaggcugagucugacugugggguugggguuggaggggacaccccagaucuacuuguucugcucucauugcaaugcagaguguuaagggcgagcuauuagaagaacaagccaaaagcagagaaaggaaaacaguuagcagcugucccauguccuuuuccaauuacaagcugugaaguuaauuuuuuucccuugaguaggcuguacauaaucuuggcagguacugaguuuuauucuucuaucaaauaugcugaacauuuauuucuuggugccucucaagagaaaggugggcaacaucuagcuuaguguggacauucugcucuugcuuggggaggaacacaaugcuuugauauuuccagcaggcuccucuuacacacuccuuuggcuagugguguggaggaauacuaagagcugauguucauguucaugguauucgcuacauugcccauucaauuauaaaucuuguaagaaucuuguaagcuaguuggcauuauccucauuauauagaugagggaauagucuugggcaugcaaaaccauucaaaguuugcacagcaucugaugaaucugugaccuguguuuuauucuaucagacuccaagauaggaccucacuuucuacugaaagagaaccaggugucuaggaacagguguuuucuucagucaacagauguguaacauugcucaggauuaauucccaugcauacauacacacauauauauaauauauauuuauauauguauauauucuuuaacacauuuuacuucugauaaauuauauacccucugaaaggucaaguaguuaguucuuucauauuauuaucaucuaaaaccaagccacuuaauaaaugugacugaggguccuuguggcuaaaguacuacagaaauugaauggguuccgcacaggauguuggagcaucaguuuggcaacagguugauaugagggauccagcucuuguguguguaaauccuugucagaaguuuaacuggucagaugaggagaaguuuucagguccggggcauguuuccaugacuccuuuaggucgcuucccagccagaaugaaggacaguguguuggaaugcaggaagguagaguguaucugggaaaaagucaagggagguuguguucuuuguuacuagguuaagaaucuagaaaaacgggugugaguuauggacuccacaaagggugaucuaagccgagggaagugugaccaugaggauggacaauugugugcuccuaauguugauaaucuaaucauuaauaacuuauucauuaacucacagagauggcaguccccaggaaauacacaucuccagauucaaaggugaugggguuuucugacacagaaauauguucagauacauuuuaguuaaagaaauucaagaugaaaggacgaggaaggauagggaaggagggaaacaggcaggaggggaaaugauuuguucugaaguguaaaggugguauugcgggaaauaugguugcugggaaaaaaaauacaucaauugaaacuuaaguugacaccaugcuuuuacuuggauagccuuggggaugaagucacagaaagcugagaaugaaccaagaguccaaucuagagaugucagagagcaagaaugggcagucauucauuuagucaacacaaauuuauucaacucaguuuuugagcaauucuucugugucaggcauguuccugggguuuucaggacacucuucuaugagagacaagaucuuuuuccauuagaaguuaaagucuaguggauaaaacaggaaaauaauugaauaaaaacaugcaaggugugaaguaauacuccaauguuuacuaugucauuaagcacucugccuuuuuuuuuuuuuuuuuuuuuuuuuuuguccgagacaggguuucucuguguagcccuggcuguccuggaacucacucuguagaccaggcugaccuccaauucugaccucgaacucagaaauucgccugccucugccucccaagugcugggauuaaaggcgugugccaccacugcccggcacuccaccuuuuuauugcucauaacaacuuugaaaguuguuacaauuaaccuucuuacaaaaauuuuaaaauguaaugcacaaauaaucugaugaugugcucaagcucacacagaaagccgagcugcucugaaggaacuuaauagaguacugggauaaaacaagacugaacacagaggaccuguguuggaaagacugggcaggaaagcuugaggaaucauuuuaaaugauuagaaggacugaggaaugggugagaagagccauuagaaguacaucacugacagaagcaacaguaggcacaaaggcaccagggcgggaacagugccaaauacguaggaacagacagaagucuacucacugaagaagagacuuuggaguagaaagcaggaaaaggccugagugaugcagggauuugccauacucaauaacuucaauuauauuuaaacuauaauaagaagaauuggaagauaucaacaaacuuggaaucagauaaucuggccaugguguacugaacacacgaagaaacagggugacauacugaacucaacaacccgaauugaaacaugccugacaaacaucaacuaucuaaaggaaaagagacaaaagcugaccuuucagagaacaauguggauugguuucucugggggaaucaaauucccauggcaaauauaaguuuccauuugaaccaaugggaaaagccaggugguaaagacaaacgucacaguaggucauaggcccuaggggcagaaccuauuauuauuauuauguugcuaaauggauauaguaucacauggcucuguucucuaaauacucagcuuaauagccauagauuaauguggcucucaaccuuccucagagaagcuucuuuuuguuguggacagagcuuaaaauagacacccacaacuggucaaacugcagagaagagacugugaagggcuuagccuaaaugaaauauuuuuaucaugcccuaccccacaacccauggcucagggaucauccuggaagaggaggcaggaagauuguaagaacuggagauuguggaggacucuggaaaaacaguguuauccgaacacggcaggccuguugcacccaugaacucauaguggcuuuggcugccuguacaagaccugcauaagaucgagccagacaaaauaccagcauggcuuggggaggggcuccugaggcuccacccuagcugaagagcuauuggcugcugaaggaaggagagucuguuuucuucagggauucagccccagguagguugccugugcuucaguggguaguccuacaccauguucaugcuaccaucaucgacuggacucagugauagcaauaaaggaauacaugaaguugggaggaagaccugaugggaggaaucugggaagggaugggggaggaacuaggaagugaauuuggacaaaacacauugcauauauguauaguaaucagaaugguauuugauaaggauucuaaauugacaaauuaugggcaaagacuuagcaacaauuagguugaaaacauucauacuugagggggcacacaggugaaaggagguuuugcuggagcagacaugggaaagaauguuuuccugaagcagacacaggugaaaggguguuuugauauagcgaacauguguaaggaccugugaugaaggaguauagauaugauccccacagacagugggggaugagcacugagccuugguuugguuugcacugccucuccuuugccaacaacacucauguauuaguucaccuuacauagcauuguugagcuccacugugaugaggcugacauugagagaagcuugcccaagaacuacuaggugagguucccaaggccucaccucaggcugguuggugagccuugugguuucuucaggauugaacuacagcuucggguuugugccuaguguuugucugcugaaaggacuggucuauagcugucgguuccuguguggugucugccuguuuaaaggacuggucuguagcugucaguuccuguuugguaucugccuccccagaggacuggucuucagcuacugagucauauuugguguuugcuacaggacugaacuguagaucaaaagaagauugagcuugcccccaaagaacuauuguuacacagguccacuucucccacaucuuaauaacuuuucuccccaauaacucugcuggguggugggcuauaggagaaguugaacccuuauuaaaaguggguugcaaaaaguuuaugccuagacauacuugaugguccuaccaauuuuauuucuaccuuguggugaacacuauuugagucccuucucccuugcuaccuccuacuucacagcugauucugcucuaguucugagccuauuugaaacuguguuuguacaugggcagaucuacccacugggaaaaggaagaaacucacuugugaguuucugugcuuaugaggauguacuaaggacuuuccucaggguaaggcagacgagaacagagagaggcccaugaagagagagugcccauuacagcacugacugcucauugugaauaguuucauuggaugucuacaaguaggcaagccugggcuguggaagaaguaaugacucuugaguauauaagcucucuccguuuuuuaaaaaucuguguuucuuuggacaguuuuauauguugguaaaaauaaugauaggaacaugucucaugacaugcaacaguugagaaggcggcaauggguucuuacuguuugccuuauuuuauuguauucagacugggauagauuaacacaagcgcagcaaacaagggguguuagaauaaaaaaagaaaguugucagaaucaagugugucuguguagguauguguauauuuguguguauguauguguguguauaugugugcauauguauguguguaugcaaguauguguguauguguauguauguauauguguguaaguaugucuguaugaguguguguauauguguauguauguguguauguguguauguguguguaaguguguauguguacuggauuuuuucuuuucaugguuucaucuuguuuuggcuugaaauaaugaaaucuuaugcaaagacuuuugagggagcccuuuccuuucaauuccaguuucaguuaacaauuacuggauacaaugucaccacaugugcauaaguaguuuuauuuuuuauuuauuuuuauauaucugggaguagcuuugagcauugccacugcagguauccagagguuguaaaaagucagagcucagcuggaagcauauuucuacauaauccuuguguucuguaaauacaauacaugaagcauagaccaaaaaacaaaaaacaaaaaacccccacucuugagauguucacacauuauacauaucaggcagaaacaguaagagcauuugcugguagguuaggcuggccuuagguguggcugugcccugagcucuugagaugccaaagggcacguuuagauccuuugugauccaggacaccuuuggugagagauaaacggugcugauacuuuagaaaguguuggcugguggaaugaauauuccugacuuuucccuauacuuauuuuuggguuugguauuugagcuauuuuuccugagaugucuuuuggauuaaaaaaaaaagagagaaagcaauauuuuucuucaugaagacuuugucuugacucauuucaguuuuaagacgugguggugggaaaaugcucaccccgugguccucgacugaugugugaggagauggugugucccagcagaguacagaaagcagggugaucuacuagagcagugaucauaacagugagguaaggucacagacaagaaaagcccuuaggacuguuuggggccuggaugaucacaccuuugacucaagguugaagacaaaaggaaggucccuucaaggcacacacgccauaugccauauagacuguaugucuauaacauauagagugcucuuuguuuuaucuuagacccuuucuugccuagcaucucucaaccugucucgagaaagaaaaagaaggaaacccuuuccuauaauaaauaucaucaaagguucccuuguuuaauuuuucuuuuuaauuuuauuuauuuauuuauuuacauuuaacauauuuugaucauaguuuuucuucuccaccaacaccuucuagcucuuccccacuauccuucacagccaauuucauguucucuaucguucucuaaaaaccaaaaccaaaaccaaaaccaaaccaaacaaacaaaagaaugaaagaaguuauuugcaguugauaccuucugggaaagauagaaucauucuucuccaauggagagucacugugcauaucaaccacaccccagggcaugaacacacuccauguucaagaguucuuggccaacacaaaacagacuuggacgagcuggagagauggcucagcgguuaagagcacugauugcucuuccagagguccugaguucaauucccagcaaccacaugguggcucacaaccaucuguaaugggagggauccgaugcccuguuuuggugugucugaagagaucaacaguauacucacauacauaaaauaaauaaauauuuuuuucaaaagaagaaaaaacuagacuuggagcuaaagaaaaaguucuauaauauucaacugguaucuaaacuaucaugaaauucuucauauuaacuuaaaguguauauuguuuaaaaauagguacaucaugauuagguugaagaagugguaaccaguuacagaauccuugguuucuuucuccuggguauuagauuccuugucuccuuugcuggucagcaagcuuuuugggagaaaggaaugugauucauuaucguugccucucccucaguucuuguuggcuaagaaccaaauagcacacaugcuuuauugaauggaugugcaagcaugaaguauaggcucauaacagaaugcagcugaaggcucacuggcauacacgagugugcacugaaaagcuccagcagcaaacuccaauaugcaggaugcccgacgugugguuuuucuccucuaacugaaggaaagauaaugauggcauugcugguacaccauaacaccaaaauguucucaaucuuuuucuccccacaaguuuugcaaauucucaugauuugauuucuauccagggcuaucaguugagacaucugauaaucuaaaagcauucagagaauuaggaucccauauggcucaaaaaauauuuccuauccggcagaagaaagagaacauacugugagaauaauaccaguauauccuucaauguacguguaccgggagagcaaaugaacugaaaucauuuuucacggaauaaugauaaugaucaucaggauuaauuagaacaacucaaaauauacuggaucugcuguucuucauaaucauuccacauuaugaaaaaaaucaguauuucaaaguaaaggcaauaaugagguuauguuuuaucuaacaauaauauucauuagaaaugggcaccaaauuaagagugcuggcuuauuuggaaaaaaaaaacuaauuguauaaacauggaaaaaaaucauucaacuuccuuaggucuuaauuuuucucaacugaauauuaagaggguugaaccagauguuccuuccaaacacaucuggagguucuaguguaugaguacucauauacucacacuguucaaagacuaauugauucuucuuauuuggggugcagggagagccacuuuccucaaauggcuggucaguuugagagauagauacacaggagaggggggguagggaggggagagagagauaugggcuccauuauauucacaucgacugaaauuuggcugauaauauggcaacaacuguuaauccccgagagucaacugcacugccauuaucagaacaacuuuauaaaacagauauuaucaccaucaccccaacuguagagaagacagaagcacagagguaagccauaacuugagggaaaugacccaagaaguggcagagcuacuguggcugccaagguugcagggacauaaauauuggaacagagucuccccaacucugcugccuguggugucgagacaaguguuagucacaugccauugcuucaguggggucugaugguggggcuugcucucccagcuugguggccuucacuguccucuuccccaugauuucauucuagggacuauggauuaauaauaaaacgggguaaggauucagucuuggucucaugcacagcuguccuccugauccaugaauguuucccccaccuguaaaaugggguaacauucuagcaauauggugauacaaugaguugcuuuguacaccauaaaguaacauugagaaaaauaaaggaugcccauaggaacugcuuuccuucucucccucucucucucccucucccucucccucucccucucccucucccucucccucucccucucccucucucccucccccucccucucucaagagcagagcacuguaaaucuuguaguuucauguuguuuuugcuagaaauagucuauucuaaaagaagcagcauguguggugggaaaaaagauuuauuccuagcgcugccauuuaccuugcuuuguggccuugggugaggcauuuaguuggguauuucauggaaucccaggcccucagggccucacgcuuaggacuuaggcucugugauaacuaccuugaaauucuuccuauuuuuuuuuuucuuuugaacuugugcuuuguaagugaagucugaugggacaauggagugugucuggggacucaccaucucaugccacgagagguuccucugccugcacuuccccagugugauucuagcagaaaccuuuuugcugcucucuggugccuuggacucugccugcuguccugcaggcaugccaggucaugaaaaugcuacauucuucaucccagaagagagcuggggauugguccagagaggguuuguguuggguacucuuuguaccugauagacuggcagcugggugcuacccagaaucacagauauuaucuuaguacauggauucccugucugcucuagguuugggugauagauuucugggcaagagauauauuugcugagacuuccacagauccugcucccacaagguacugcaucugucagaaagauguaggguucaggggaggcugucaccugggccuggcaucaggaggcacgguccaaagugccucaggggcuauauucucccuacaaguaucugguguuugaguuuguuugccaggccaacuccaugccuggggccuuccuccuucuaacuuuccuacguuuucugcccuuccuuuuucuggcuaaaucaaggcauccugggauaagaaccagaauauaacuauaauucuggugauauuacauaagaguuagaugcuuauuuaaaugucugcauuugaaaguagcauugcacaauguaaaaacaaguggugaauuucauguuaaaauucuaauuuuuuuuuagaagauuaagcagcaaauaaaacaaaugaacuaccauggcaaucuagauacugaccacagaaaaagcuuuacagggguuccaauggcucccucccuucuguuuuugaauaagggguccuauaguuucauuuuacacuggacccagcaaauuauagagcuggcuauguucccggguguaagcuuugcagaacugccugguuucuggcccacugugccacagggagacaugcuguaauucuguuuguagucugagcuuaguuagggagcacgggcuggguggacugauucaagcaccacucauuaguagagauccgcaccuuuuuccuuacccuuuuaacuagguagaaaaggagaaaaggaaaccacgagagucauauaacucuaacagagguguccuucaccgcccauuaacuaaacggauguaacuuccaguuuugcuucuagaguuuauuaaaaaugauaaggaugagagacauugaauuuggaguuucaucacacauucauucauucauucauucauucacugcaucaguucacaaccuuuauuuaguauagaccaugguacaucaacuuggcgaagcuugagaauucagaagcaaugaagacauucucucuccuaaagaagcucaaagccaauggaaguggcuaaagcugagguaggagcagaaggcgagcacauuaauagauugcuuuuucaugcaacaagaucaaugauuaucugugcagagaagagauuccugaagcacagcagccuagauuaagaaaggcauuuugggcagggagacuauaauacuuacuaagugauguguacaaauuaaucagaauucagagaauggagagagcaucaugagaaucaauuacaguucagacaaaagggcauugagaaaagaaauaguguccugagaguuaaaauucaacaaucuuaaucaaaccagagagagagugggguggggggaagggaaggggagggaggggagggaaaagagagagggagagggagagagggagagggagagagggagggagagggggagggaaggggagaggaggagggagagagagggggagggaggggagggaaaagagagagggagagggagagagggagagggagagagggagggagagggggagggaaggggagaggaggagggagagagagggggagggagggagaggggauggggcagggaagggaagagagccagugaaguuuuguuguuuuguuuuguuuuguuuuguuuuaaaacaucagcagaacauaagagguacccuguagcucuggcagucagcuugccauuucugcagggaagagauaacuggauucacagucuagagacuauacccugguggugcuucgaaaugcaauuugaagggauaaaacuggaucuugaggcccauuuagagaacccuuguagaaaugaugcaggagucaaugaugucuagauaguugcagucagaauggugacauaaaaauaacagcaacaguuacaacaggcuagauuugcuuacugcucaagguuagcuugaguggaaggcaggagucaaggguggcugugacuguuagggugucgggugagacgcagacuacagaagguggcagagcuuuuggagcuuugaaggaagaauaucaugccuuccuugggcaguggcuauggacuggugggaaauuuuagcaggaaguuagaggaggcuaaaguuuaaggagagguucaaguuggagcugugggugaccaguaucuaggugguugguggcugucauugaaauagaaugaaugaagggccuauggagaaaaagaccuggggaauuccaugacagagggaagggaaaugagaaaaugagucaagggagagagagagagagagagagagagagagagagagagagagagagagagagagagagagagagagagagaaaacgcugucucgggagccaagacgaaauguuuuucaugaagaaggaacaugaaccaggugguaaauguggcagaagaacccucugcaagagugauuaaaagccucuggcuggagagcuagcaggcccucuuagggacucuacugugaugcucugauaaauggagauggagcuaagcagcugaugucacuccugcagcccugagacuuagaggaaccucucuuggcaucuggcaguggucagaguagaauggauguaugggggacaggggagcccugagugcugggcucuagaugagacauucuaccaauuacucacucuguggcucaggacaugucacagaagaucgggguagaaagccugugaaagaggaaggggaaaugaaguauugucuucugguuaucaccuggcccuuaugacagacacccaguagcugcacuaaacuuguacacgcacgucaaaaagagacaggaaagcaaaagcaggaccauuugagaagcagugguaagcaggggucgggggaggaaugagauaggucacgggggaggcauggccaaucacaaaauauuguauaccaauaagaaacagucacagguagaaaguuaaaauuuaaaaggcagaagagguccuuugauuuugguaauacagaucagcuggugaagcucuguguguagaacacagcucuucccaggaaaauugggaggagaaaaccagaucugaaacaaucauguauaauauuauucaaacauuaacaacaacaucaguucuaguaucuuaaauguuugaauaauauuuuacauaagaacuauucucaaauuuuauaguucaucuuguucuuguaauaucuuugugucuuaauaauuuaucucauaucuuauauacuauguauguuuuauuccuaauuuuuuauauuaaauacuauuuggaaugaaaaaaaaaaggcugugaaguagaagaaaagagguagugaaugcaaauuacugcuuaagccgucagagaggagaaugaagaaauguaaagaugucuagagauggaucgguuugguuucucucucucuucuuccuuugcugucuccuauccccucccccuuccucccccuccuccaccccuucccucucaucauuuguucuuaaggagauacuugagccagauuacagacagucgggaaccaggagagaaggacaguugcagauuccgcagaggcaaaggcaaacuguagaggggaaagauccgccuuggagcauuaggacagaugaguguggaauccuuugcugugccccacaguaccuagcuaccgcuaccucugccauccgugcauggccagcccaggaccuccaucuucaucccugagacuggagcucggagcacacucuucagauucccaucaccugacuacugaaggaauacauuuuucaugacacuucuuuuucuccagaguuccucauaaaaauuccucagcaacaauuccccaagucucuaaucuuaucuuuauagccuucacucucauaagguuccucacuugcuauuuugagucguuugagguuaccugccgugaacuccuccaagaacuucccugccuaucuccguuucuuuugcccuugccugggucuccacuuugcuucaugauguagguaaaguucuacugaccuuucauagcucaccuccagugacaucccuugucugaccuuugcuuucauauauauauaaaauaauauauaauaauuuuaaagcauauauauaugcuuuacaauuauuuggugucuuuuauguuaucuuuuaaauuauuuuaaauacuuuccagaauaaggaagggauacaaucaaccagccaguucagcagcaggguuucuuuccuuuucuuuuccuuucucucuaucucugugaccuauaucauccccauauaagguauuaaagcucuuaagggcuagugaauguuggaugcaugcauccuaguaauggaaauacacuguacauaguaccugcuacuauaaugaauggguugauccuacaguuaugcagggcaaguaguuagaagcgcagacaggaaugauuggcuauauuuauauuauccaggaaaugacuuuaacguaaugcuugauguauacauacuugcuagcaguucaaaguauaaaacacaagcaaagaaaacaugaccuuugucuccugaaggugugaaacucagcggggaguauucucauacauauguauaucccacuaggauagaaguucuaauaucugagaguggucuucuaaugugugucuguguuuaccaagcagaagguuuggcaugaucaaagguucaaacaagcaaauauauaaguauagauaccauguguggaagacaaagaagagcgagauauugagacuggaacuacuauugaaagcagacuccaagaggaaccaaauggcauggugaugaaauucuguguaggaaaucugaccauccucaaacuuucaaggcagaggauauuagcagaugcaugucuuuaaaagaugaagcuuggugguggaauggaggauaaacuuguaaagaaauaagauugaggguagauaggucuguuaagaaguuuuugcagcugggcagugguggcgcacaccuuuaaucccagcacuugggaggcagaggcaggaggauuucugaguucgaggccagucuggucuacagaaugaguucaaggacagccagggggcugcacagagaaacccugucucauccccccaccccaccccaaaauggguuugcaucugugaacuugaugcagguggggagugguaaaguuccacgugcagaaaugcuugcugcucuaauuuucugaaagacacagcaauuauaauguauugcccacucugcaaacacggaucucuguauccauucccaagcaaugcugauugaugacuuuucauccucaccucguuguguaugggggagcuugcacucugcuccauaggaucacaugcucuaguauugucucaggccguauguuuugcaugcccucucaguucauacagcuuuuagagaaagauccaugcuacgaaccguguucuaugcuuugcauagugagugguagaggguaauaagacaguagcuaucagauacuuguucacuugaauugaagacuaucaccugaggugccuugaaaaaccaugccccaucuuacuccugagguguaguagugauuccucaauaacuguacccugccccccucucuaccugcuccacuauucuuaucuaguugugacuugacuagcaucuuuucaccacuucuaggaauucuuucuugcugccccuacacugagugagguguuuuugcacccuaagcuaaagauugcuuaauuaauuuuuaagcuccaggacaguaguugguuuaugguuuugucuccaauuugaguguggugccugauguacggugaguguucuguggauacucacuaagagagaauugucugugccuauggagagucuagcacucucccuucaugcaagacucuuuaaaaugggaccugauuuuuuuaguuuaauguguuuuugugggguuuguguuugcaaaccuuaacauuuugagaucugaaucuuuagaaaucuguauuguaagcccuggauguacuuuguggauaaaagaaaccaaugaccaucuaggaaaauauugcacucucugccuuuugagcauaaaauuaguuuuauauauuugaaaacuuucaugcaauuaaaaugcuagauuaagaacaugaggacuguucaaaaaauuuucccauucugucuucucugaacaugggaaauagcuguuuguauguuuauuuucuuaugugugcuaucuccggcuuguaaguccuggugggguaugaacaguuuuggauuucagagucagaaagcaaacauuauagcaaaguucauacacaugugcauguauacauacacagacacacauauacauauagacauacacagacauacagacacacacacauacacacacacauacacauacaaauacacacacauacauacacacacacacacacacacacacacacacacacacacacacacacacagugacucuauagcccaagcccaugucuuccucaucagccuugauccugguauaaauagaagagaaauuuagaaauauccaaaaaagaccuggauuugaaguguucauagaugccauuaggcaauagaaaaacaacacuggaagugaccaagaggcuacaaauucauugguaaaaucuagggacagggaauucuuuucuuucuacauugauguggcccaaggcaauggauauuucuaaaucauauuuuauauuucuucuuaacagaaaauauuuaaaaaguucugaguccagguaauuauauaagauguacaucaaaguuggauaaugacaaaagaugccccaccauaccacaaggauauaugcucaacuaugcucauagcagcuuuauuuguaauagccacaaacuggaaauaagccagaugccccucaaccaaagaauggauaaaaaaaaaugugauacauuuacacaguggaauacuacucagcuauuaaaaacaaucaugcauguacacacacacacacacacagacacacauaucaugaaauuugcagccaaaugaauggaacuagaauagaucauucagagcgagguagcccagacucagauaagaaaaacaugguagguacccacaaguagauauuagccauaaaggacaggauaaccaggcuacaagacacagacccaaagaagcuaaauaacaaagaaggaucaagggaggaugcuugaaucucaaugagaagaggaaaugagacagacuucagggguggaugcagggagggaacuggggaggggaggggagccgauggaaaugguggugggggaaucaaacaugggaaggaugaagggagagagagagagagagagaaagagagagagagagagagagagagagagagagagagagagagagagagagagaauaugaaugagaacuggaauugguagaggguccucucugggacaagcuagaaaccuagaaaccuaggacagugaaaauuccccaggaaccuaugagggugaccuuagcuaagacuccuagcaaugggggauauguaaccuaaaacggccaccuucugugaccaggcaagacuuccaauggaggaauggagauacuaacccagccauaaaaccuuccacucacaguauguccugccuacaagaugugcagggauaaagugggaguagaaauugugugaagagucaaccaaugagugacccagcuugagacccauuccaugagagggagccugccccugacacuguucaugauacucuguuauacuugcagacaggggcuuagcauaacugucauucaaaggcuuuacccaucagcugauaguaacagaugcagagacccacagucaagcacuggauagagcucagggaauguuguggaagaagcagagaaaggauugaaggagccagagaagucaagaagaccuacagaaucaacuaaccuggacccauaggugcucacagagacugaaccaccacccagaaagcacacauaggucagaccuaugacuucuacacauauguaacagaugugcagcugggucuuccuguaggacugucucugacucuguugccugccuuuggaucccuuuucuuuagcugggcugccuugucuagcuucaguaggagaugugccuaguccugcucuaacuugauuugccaagguggguggauaaccaagggaggccuccccuucucugaggagaaagguagaggggauagagggaggagagguaagaugaagggacugggaggagagaagggaggggauguugugauugggaugaaaagugaaugaaugaaugaaugaaugaaugaaugaaaaaacuaagccagcuaagagugaaccagaucacauuaugccuuuaugguuucugcuucagggggcaaggggagaacaaacuaucuucugagaaauuguuagagcaaaaaaaaaauaucuguucacugugaugcuucuccgccugggcuacagcaucauaaggaggaaugcugcagcugaaguaagcacaauaaauauaaauucacauuaauauaaauaauauagcuaacaaagugacauaugaauuucauuaacacgcauagaccaguugcgucucacuauuccugccuccaauucccagaagccauuucuuauuuuugaauguuuggagcuacacccuggguaaaagugaccuugugaaagugaagagauugggagucuaacauaguccugcucauagaagccaguuggaauacaagaugaucacccaagaaccuccaccacauugccuuagacugguaagggaagcacaaauuguuggcuagauauacuuggcaucuuguaauuucacaagggccaucuucaggaauauuuguuccuauggaaagaaugccugacauuccuuuuuguaauacuagacaaaauuggagaauaacuauaacaaaaaugcccuuugcugagcuaaacaucgugauuugcaaagaguccaguggaaggcaguaacuaauggguuagccugauauugaaucugagccugacagaauuuggcugcagacuggaguguucuuguaacuuaguucccuugugcuguagggcagagauaaagaacugaacuccuacaaacaugguauucgccaaaagacccagagagaccugagcagacagguaacagagcuagcuagauagcagaagugcuacgcaaacagagaaaugauaacacacugugcuuucuuuucuuuuaaaagauuaucuuaaagguagagacauccaacuuaaccuuuaagaccuaggauaucuauaucuauaugcuuauaugcauguuuuacauugacuccuucccuagggcaagcaaguucuuuccuaagaugagacuuauauaucuacaugccuuuacaguggcagaagaccuagcuaaucacuucaagaacagcaucuaugcuguucccaugucuucuaccccaaugagcuuuuuccuacugaaucagcaugguagauuauuguaaaggguuaaggaugugagauuaagaagaucugaaggaaaaugcauucugggcuccacggugaucaacucauacuagccagaggguggguggggccuuugcuaccuuuccaacuuugcuguaugccuggaggauggaaauggucuuaguccaugaagugucacaguaaggaauggauaauagguggccagccaguacuugaagaauuaauccacagaggaaugaaagcaugagccaaucuaaaaaacaaacaaagaaaacaaccacaacaaaacuguccuugggcucaggguucugagaaacauaaggacguucccauggaaaaaggcagaacaauguugagaaucaugauccgcaauggguauuaauauuaggcaauauuacauggcaauagauuuguggcaguaagauaguuuauaaguagaaaaaucauccacuuucugguuugguuuaucugcucauuuuuugcucuuaaggcugagaauuuaaucuaggaagggaaucgauaagaaggcaagcgauuggaggaaugguugauuaaaggaaaacccacauucagaacaugaagaaggcaagggaaaaaaauugucaagacguuuaacagggaaagugaaaaagaaaaaagauaagcuuucugugugacauuguaggaauucaggcucuucucuagggguccuggaagcacaaaggguacaggcgagaaggaguagacacggugacaggcaaacaggagguggaagagaagucuuuuacuucuucagcaagcugggaguguuuaucaugccuagaaguugaugcuaaaucaugagugggaucugccuccagcuuccuuuccucccauuuggaucccugcccccucaggguugccaggagacuugcacuggguggugugacuuuccuaagccccucgggggcuuuauguacuguuauccaaccaucagaacuugcuugggcucuuucuaauuuucucuggacacccauuucuaugaagugacaaaggaggcuaauuggucucaucuaguaaaguaauuccuauugcaagcuuugcgggcuaagggcugccuugcuggcagccuguaucagcagugcaauuaacacagagugaaugagccuaugggcucuuauugggccaggaccugccggaugcagcugaguccaguagagcaguacacaagcucagaaaacagacagacaugaucugauguagucuccuagccucacgcucaggggagucucuccuuuagacaguggauucuucaucucgaagaaugaagaauaaguuuccuaacuacaguuuccuuuucucucagagauaauguugccuacuuccuggggcugauuuuaagauucagaaucaguauaauugaugucacuucuguuuaucauucauuuacuuaucuauucagccuuaguucaguuaaggaagagaugaaacagagagguaaguuggcuugaugaggccauccagaugggaaguuccacagcugguauuuacaucugggcaguugucuucugguucuuaacacacacacacacacacacacacacacacacacacacauaucaagggcguauguaugugaccagaugcuugccuccuuuauagcuucuuccaguggggagaugcuucaauacucucuuaugucauuaaacccucacugcacuucugcgcacggcuguccucccugcuuugagggcagagacgcaaaacucaaaggccgugauguugguccaaacucagccagcucauuggucugaguuagcacuugggaucaagugcaggauuuacgagcuaguuauaagcuugagaaaaagccagccuugggcucaggacagcuuccugcaucuuuucucugugucuggugggucuuuuugcuuuucuuuuagaguucuuugauaacgggccccaagccuggcugacuaugugucaucagauagacuggaaguaaggguguggguucagcaguagcuuugaacucuugcuguaggacuguggccagguaucucuuacugguugcugucauuggcaagaagaaagagaacuagauuguuaagaagguacacaacugucacuauaaaaucagauaagccugugaaagucaggaacaaauuccaucauagaacuguauccugccugauaucaaagaaagagccaagaaaccaugccaagaguuuguuggaugaaaacugacauuuucugcuggggagacaugcguggaagcuaugauuggagaauuauauuacgaaggguucuaaaauauuuaucaucauuuuaggucauuuauucauuuacccuuuuaaugcucauuucuuuugugccacuagguugagcugaaaccagcaagggcugguaauugacuuuguuuuuauauauugacgggaaucaggaagugucuccaucuccugguuuaaacaaaacaaaacaaaaagcauuucugagguauccuagaguacgcaauguucuuucugaaauaugaccuuugucaucaaugagaaugcuggauuuuaucugauugaguuaugaguuaugacuauaauuccuggguaacuuuccacaguuugaauauuucaagaggagaaagacugauaagaacaacugaguuggccauugcuucaggguucugaugacucuguaggcuuccucguggacuugacucagacaaccucucugcccagguagcauugucuggccugcauuccaaugaagacauccuuccucuucagcccaugagcaucccgcacaagccaacaucuaugaugucgucuucaggaaucuguggggaaguucucuggcuguguaacugugccccuuggaagaugaacaggacaaagaucaugccuuacaaucaccugaugucuucggcaccuggcaugcagccagaacaccaaaaaauauauaauguuugcugaucaucacugaaucauaaacugaccacucaacuauaggggggggggauguuguuucugucuacacaagagucacuauuucaaauuuaucaauuacauagcaaaugccauuacuuaaugguacugagaacaaacaaagaaaaagugaauuaucucccaggacagaauuuauuucccagcuugucccuauuugguuuauauaauagugaaaagguauuuaaaguauccuucugcucccaugagugaaggaugcuuuuguuacuggaccccgcuauuuuggcucugaaucuagaagacaaaaaagagguuugacuuagccacugcuuaauaccacacaagccuuggagagaagauuauacaagaaaauuuuguauuuuagguuuuuuuuuccccuauagccaauaccuagauucaaaccuuguaaaggugcugcaacccaauugugugggaaagagaggucuccugcuugcucugcaauccuuauuaaguagaaaaauaaaauaaaagcaguugauuaaggguuagcaauuuucuuuucuuucuuugcacguacuuguaauucauuuaauguaggaagugggcugaguuuuccucuucuuuccaauucaacugucagagaacuuucaugccagccugcuaugguuaccauggcaacaggaccaugguggcagucaucugaucucaugggccuugugucaauagcaucagaucaucaugcuugaggauaauuuugacaauaggcuucaguuaugcaugcaggauuuauuagcauuugauugauuacuggaaauacuguguacuuauagagugcuaaugaaagcauuuucgggaagguuagcaguuaccuuuagaucuaucuuggauugucuggugcucuagaauuuguaaaaggccuucagauacuguaacuacuucaauugccauuaguugagauggguacuguuaucucuaauuuauugaagaggaaacaaaggcuccucugaugugcuuguggaagauagcagaccaacacuuagaggcugagggacuucaauuugggccuucuggaaucucuaugccaguguaaagaauuaaagaacaugaggaaaaagcuccaagcuagguaaggugaaugcugaaaagucagaauucaaauaauuuugacguguuugugaucaacaacauuuacuacaucaaaaacagaggucuuuacacgugggugaggcuucugacucuucacggcucccacuguaaugaaccuccucccuuaagucuuuccugacaccacaugcacagacuggugcuucuuccccuuucccacaacuauagcuggagcccugcguguugcuggcugcauucauuuucccaccguaagcuccuugaaggcaggaaucauggcuuucauucuuaguaaauauaaaucucagauccuggcacaguacuugguagauaauagaaacaccaucaaccccugucacuuguuagauggauacccacguauucccgugagguagauuuaacaguuacuuucacauaaaacccagggcuacuugccuagggauggugccacccacagugggcuagucuuuccugcacaauuaacaauuaagagccccccauaugcucacaggucaagcugaucuagguaauuccucaauugcugccuucuucugagauaacuuuaggcuguguuaaguugacaauucaagccaacuaggacaucuaugacauuugacuuucuugcuuuuuaaauuaucauuauuuuaauauuuauuaucuuauaaaguagguuuuuaaaauauaaacaucuggaguuuaucuuugagagguuggaaacugaacuuagggcuccaaaugcgagguaacuuagccacauuuucagcuuucagaauaaaccccggguacaaaggauuucuuuuucucuuucguuuucaguuauuuuuuaauagauauuuucaaauguuauccccuuuccugguuucuccucugcaaauguccuaucccaucuccccucccucugcuccccaccaacccaauccugcuucccuguccugggauuucccuacacuggggcauugagccuucucaggaccaagggccucuccucccacugauguuacaaggauuucuaaauaaaaaucauuuagguagaaauauguuauuuguagagaaaauucuaaaauucuaaguugauaucuauugagacuugaaaaaaaacuauugaauuuuagaaaaagcuaaaauuucuuaucuaucauauauccauuuauuuguuuaucaucugucugucuaucuaucuaucuaucuaucuaucuaucuaucuaucuaucuaucuaucuauccauccauccauccauccauccauccauccaucuaucuaucuaucuaucuaucuaucuaucuaucuaucuaucuaucuaucuaucuuuagugugugugcucacguguguguaugugugugugugcaagcaugugcaugugcaagcacacgugcacauucguguaugugucugugcacaagcuccauagaagauuuguggaagucagaggaccaccugugggagucaguucucuucuuccaucauuuagguuccaggguuuaaacucagaucaucagaccuguuggcaggcacuuuuacuugcugagaaaucucaauagcccuggggaaaacugucuuuaaaaaauaauuauuauauaauacagagccuguaaaauaugaauguaacaggguauaaaauggguuuagauuauaacuauuaucuuugggcuagagagauacuuaauugguuaagagcacuaauugcugcuacauaggaccuugguuccauuccaagcauccauauggucacaugguggcucaugacugccugugacuccagcaccaaugcagcgcagacauacaugcaggcggaacaaccauacacacaaaacuaauaauuuaaaaguuucuaccaccuugcccucaagccaaccaagaguauagauaauuuuacggcuguaaagcauuugaaguuuuccuucugauuauuggugugugcgaggaggaaguagauuugguuacucucaugugagaacacuugaaugaagcauaccuucuauuaugaagcucuguguggcacccuuuccugagaaggcgacuguacagugcccuagugcuaaacuccauggcuaacucacagcucuucacuugcagaaagagguuucagagaggaagcuaucuuauuuaccaaauuaaaauuuaauauuauguucugcaaugcugugagcccacccacccaguagacugcagagaagcugccauucauauguuugaaugaaauacugugugugcuucucacucccuauaaaaguaacacaagggacgagguccuacucuucuuacuguuguguccauauauaaccaucuacagugauaagugaggagccuacaauguuccucacgagucagauagacacuuucaguucaccagacgcaccuccuaucuacagcuaacuuauauuuagaugguguuucaauaaaaccaaaacgagcccaacaaguccucuaaaccaagcuuccaacgggcugagggcggucagaaauuaaugcaaucacucggagggcuauggcuguuccuuaagagugcaaguucaaccugucaacacuagagguaaucauuuuauauuaauuuauacguaauuccauuuaaauucuuuauccaaguagaacauaugaaaacagucuuuccacaagcaaaaaaaauguggaaacauuuaaaaaaauaagaagucauuauuuuaaaguaacugaucagauuccauaggcuacucuuggaaacaggaccuugcuggagacagggaccacauuccuguugacuugaauauuaucucuauguauugcaugaggggggucucccuuauuccaucagaguaauacacuugcuuuaauucuuaaauguaagugauauaaacaugccgaguuaccuguaaagaaugcauuuaaagcuauucuaaauggguuuuuauuuguaagacauuauuuacuaggaagcuggcgauauuaaugcuuacuguucuaauccaguggccaagguauuaagaauuugcaagugcuuuagauuuucgaaaaugaaugagagagcuguguaaccacucugcuguuccuuccgugcaacacaauaaaacucugaaaugaaaaaaaaaaguaacacacgggaaggguagaagaaaaugaaugcgcugucaaaagugaccgcaguuggagaaauagcucaguugguaaggggcuugucugagaugaaugaagcccuggcuucaaguccauaaacuggggcaugaugccacaaaccuguaauccuagcacucuggaaacggaggcaggacaaucuuccuuagcuauauagcaaauuggaagcuagccuggacuauauaagaacuuguuuccaaaauccacauuaaaggcuggcaagauggcuaaguggauaaagguguuugccaccaagccuccagaugaccugcguuggaucccgaggacccacaugguggaaggagauacugauucucacagguugucuucuggucuugacaagccuacuguggcacaugcacacacuaauuaaauaaauaaauguucuuuaaaaagugcgaacaaaaauauccuaguaaagaaucauuagagauaacaguugaagaucagacauuuugaaaauacauuugacuuggaaaucauucgucuucuacccuuaggacucaaggguugucaagaguaaaaaguuuucuaggauucuugucuuaguuaggguuuuauuguugugaagagauaccauuaccccagcagcucuuagaaaagaacauuuaauuggggcuggcuugcaguuucagagguuuaguccauuaucaucauagcagggaaacauggcagcaugcaggcagacacauacuggagaaggagcuaagaggucuauaucuugauccacaggcagcagggagagacagucugucacacuggguguagccugagcauaugagaccuuaaaaccagccccacagugacacauuccuccaccaaggccacagcuccuaauacuaucauuauuggcuuagaauucaaacacaagagucuauggggccauaccuauuuaaacuaucacaauccucuggcguauguguagagauauuagauacgacuuuugauauuaggguaacaacaagaauggccacaaaacaguagcagcagccaauauccacuucaugacagugccugggcagaacuucagugucagcagcaggcugaacaauguuccaaagauacuggguccugauccacggaauuuacaaauauuaguuuauuuagagaagagaucuuugcagauacauuuaaauuaaaggcuuagggaggggaagaacauccuggauugucuauaugggcccuaaauacagaccuuuguaucugauaagacagaggcaaagggggaugugacagacacuggaggaggcagugugacugcagagacaaagaguagagugaaaugcucccaagacaagguucgcccaucagcuauuagaugcuaguggagggcagggcccuaguuuucuuaaaguguccucagggcgugauacgcugccaacaccauuauuauuggcccaccaauggugacuuuugacuucuggccuccagaaccuugagagaccaaugggacagugugguguguuuguaauggggaucaaauucagagccccaugcuugggaggcacacacucuaucacucaucugcuccuuccuuccuuccuuccuuccuuccuuccuuccuuccuuccuuccuuccuuccuuccuuccuuccuuccuuccucccucccucccucucccccccuuucuuucuaagucagcuagugugugcuaauuuguuacaguugucauaggaacuguaguuaaacauccaaacacuguuacucucuaucacacugcggagcuucccuuuauccuuuuuaagccucucauauucucauuccuuuguucuguugcugcugaucaagcuaaaccuaccaaaguaucuuucaagguuaggcaucaccugcugaaacuuaagcaaaaccacugccuuuguuaguccugccuccuuacaaguuggaauugagacauaaagucaaguucagacuugaaggcuugcuuuccucuccucugauuucccaaaacacagaaccacacauucucgcauuaucucauucagcucuagaguuugaauccacuacuuuuuaaaucagugacuauaaucgauagcuaaguaauauacuucucuuggucagaaaaaaaacauaaugguuuguuacaugcaaaagcauagauuuuaagucuagagauucagugacaaacgcgacacauuccccggucucacuuaaauucuugcugagaggagaagaauuuuaucaagucacagacaaucaaaagcagggugugaagaugccaucaggagaagggggaagacacagcugccauucagauuucuggcuuagcaaugaaaaaacuagcagcgcucuuaugacacgggaaagagcagaucuguggagggugcuggguuaaggugucuauggcuucuccaucuggaauaaugggcguggucuguaggugagagaccaaggguggagucacagacucagugaugaugacaugggugacuaugaauggaaagaaucuaguuaccacuggguugugaccugggggagagaaagaagguaagaaagauggaugaaggguggggcauguugaagaaacuacaauaacaaugggguuucaagagguuuuguaggagcaacacauaagcugacuaaggucucuucacugcagauggccuuaaaugcaacucgaguuuagacuuaaaaaaaauaguacauauugaauaauaguuagagguuugaguuaggggacuggugggauuauauuucugcuguauaagaugauucuaggggacuguaguggauggauauaagaacugagggacuguguuggaagagucuagauggcacauuaaugugaugauccagaauaaggggcaugaggggccuguaguguuucaacauuaugugucuauaugugucaagguacucccauggagaguucguuucuauaaaggucuuucugcuuguauggugguaaaagaggaaaauguuguguugugagaaaaacacugguguauggcaugacccaguuuccugagaaccugguggaaauagguucaggaccaugugaugccacugauucuagcaguuguggguuaagaauaaccaucuuaugggagggacggauggugacugcucacugaguggguugcuaggggucacaggagugaaugagaagaguuguucuggcguucccuagauagagaaguugaaaaaugaggugagcucaaacaaugagcaacaaagcccaagggugacaguuuuacaguauggcuugcuuccugaaagucaccgcugagcugacacggugggggaugacggcuuuaaccuuggccuucuugacauugaacagcaagauuucagcaaucaucgagccaaggcucuucagguuucauagguaaccagggugauuccucaaacaguaucuuuaaaaauuaggugaaaaaaagcgaaacuacguucuuuagagucgggcagaugaggguaggguauccuuucuaccccucugugacagagagggaaaguauguuagucuucuucaaccugagacaaacaugggggacuuauaacuagcaaguaaaaugauaucugucaacucugagcuggagaugaacagcaacguuauacauguaggcccauuucauaugugaggucucugccaaguauuuguugauuguauguuauaagagaggacugcagagaaggaagucacccagggcugaugggagaacacccccuaagaagcaugcauaugguuuccuuaagguuauucaguuugcuuaguuugcagcaacucucucuggaaugguuuuuauguuuuuacaugaaaucuucuggaauuuuuaaugagcaaguuaugcccuaacuccuguucuucuuucaguuggcugaugcagguguguguguguguguguguguguguguguguguguguauuuagaagaaccagcacaauccuuuucuagguaauggugugcaguaccucagcuuucuaugcaugcauggcugauaaccccuaacagaaagcaacaaacaaaauguaugucuaauccauuuagaaaagaauguuuaggaggcuccauaaacauguuuucauaagugcacgcugccugccaacuugccugacuugaagaguuaccauaacaaccagcaucccucucagcagcccuggcacucuccagucucagauccuucaugagaauuauuauuaucuugucugagcuuucuagcucaauuguuuaaagcaugguacuaagagggccgugguagaagauucaaaagcacauauuagcaacaaaauucucuucauggauccucuuccaagacggcuuguucacucauucaaaaauaaucacugcacacuaacagguauuguccuaucugugagggauaaaguuauaaaaccccaaaccccaaacuuaaguugaaucuagacaaaauaaaacacugagccuccaaaaccuaaaauauuaacugaacuaagaauaacaccaaaauccaaaaaauguuagcagugcauucaacuuggugugagagguaguggggguggggguguuagccacuaaaucagcaacaaacaaacucacaggcagguguauaggaaggugguaggcacgguguuaagaugugagaacuuucuugauguggagacauuugaacaaagcuucauccugugaaauaguauuucaaccagugcuguagguaugcugggagggaggguuccuacugggucuagacacaaaggacgcaaugacuggagcgauaugcucaaggcaagaaugcuaugcgaugaacucagagaggaagacagagccuguuugugcaggaucucuggugcccuugaaaagauuuuagauuuuauucuuggugggcuaggcgaguaagcacaggauucuaaggagaggaguacgaugagcccuccuauaacucagaaaacucacuuugccuuuaggaaccuuuagaguccaggaggaagaggaaccugugaggaugccguuuuaguaauuuguggauaacuacucaguacagguggcaaggagggagaugucauccaugucuggauauuuuuagagagucaguagaagucugcugacagaaugcauguggacuauuaaagagggaguccaaagaugacugagguuuuucuuuugaggacuggagaaaugaagagagcaucauacagacugagaaauaaaagcauauauaauugugauguguguguguguguguguguguguguguguguguguguguauuucuguguaugcgugcguaauggagaacuuagggggaaguucuagauauguuaauguugacauuucuaugacacauauaaacugggcauauccagaaggcaacuggaugagauaauaaaauacuuuuacaaaccccagagcucagggggagaggggucugaacuaaggauauagugaaagucauuaggguauauauggaacauagggacaugugacugaaugagaucaccuaggaaugagaauauaaagaagaccaagaauugucuuaguugggguuucuauugcugugaagagacuccaugaccaaggcaccucuuauaaaggaaaauauuucauuggggcuggcuuacaguuucagagauucaguccuuuauugucauggcaagaagcauggcaacaugcacacagacauggugcuggagcugagaguuuuacaucuugagccacagguugcagaaggagacugcauaccauacuggguaaagcuuaagcauaaacgagaucuaaaaguccaccugaauagugacacacuuccuccagugaggccacaccuacucuaacaaggccacacuuccuaauagugccacucccuaugagcuaagcauucaagcacaugagucuaugcaggccauucuuauucaaaccaucacaauaaaccuuagugcaaccaaaugaugaggaauauucaauguucuugaaggaggaaccccuaauaagggagacugugggauaaccagaaauauagaaaaucaagagaaaccacaacacuggaagagaacagauucaaggggaaggcacucaucauucaagucaaauaaaaugagggccaagagcugacaauuggauuuguccaugaggaugucacauugacuguguuuaggcuguucuuggcagagagauagggagaaaaugucuucuguuuaaggaaggaaagaggauucccgcuagagcuuugcagagguuuuguuauaaugaggaguugaggauagggugcuaacuuggaggcaauauaggguaaauaaaguuugaaaauccaaguuagaaauuauugugaucaguguaauugauggagauaaucaauggagaaggaaaauggaugguauagggagggagagagggagggggagggggagggggagagggagggagggagggagagagagaaagagagagagagagagagagagagagagagagagagagagagagagagagagagagagauauuauucuaugcaauucccaugucuuguacaagauuacaauuauccauucaacaagguuaaaugaguaccuauaauguguauaacuaaguaccagguacugaaaaugaauaaaacacguuucuauuaacaagaguuuacuuuauuaaauaauuuacauucaguguauguaaucaugauuauggcagagaaacacacccagggcucauuuuauuagggcacccugauucuuaaggcuucccaucccucuuccucuucuuuuucuuucccccuccuucuuccucauuuuaaaaguccaucuacuccccucaucuccaacccacuucuuucuuucuuucuuucuuucuuucuuucuuucuuucuuucuuuccucuuucucucuuucucucuuucucucuuucucucuuucucucuuucucucuuucucucuuucucucuuucucucuuucucucuuucucucuuucucucuuucucucuuucucucuuucucucuuucucucucucucucucucucucucucucucucucucuuucucucucuuucucucucuuucucuuucucucuuucucucuuucucucuuucucuuucucucucucucucucuuucucucucuuucucuuucucuuucucucuuucuuucucucucuuuaucucucucucucuuucuuucuuuuucuuucuuucucucuuccucucucucuuucuuucuuccucucucucucucucucucuuccuuccuuccuuucuuucuuucuuucuuucuuucuuucuuucuuucuuucuuucuuucuuucuuucuuucuuucuuucuuucuaucuguguguguuucugggaauucaggacccuuuguagguuaagaagaauguugccacugauccucacacacagccguaaggccuuuccuuuccucuuuaaaaggaaaguauugcaaauacccaguguuaucugagaauuaaaaagauaucauauguuucugcuggugaagauaaaauauguaugauguuacuaacacaagaacuaccuucugacaccacauaagaaauuugcaagggggaggaggaagaggauggggaugaaguggaagaagaagaggaagaagugaagaaggagguagaguucuugguauuaauuuccuuauuuucccauaaaguagguggagcaacucaaugaaaaccaaucuggacagacaauugcagugcacaguggcccccgacuucaugagucugaccuaagggcuaguucagaagaagagagcauagguggucuaggcaucuccucuugaguccucucuuccaagaaagaagccacacaaugucauacagcauguuucaaguuuucccagucuggagcucccaacuccagagggaggagaacauacgccccuagguggcagcuguggcauaguugugucuaagggcaugugacaugaacacucaaguuguuaacaugaagaaccucuccaguaugggugaaugggaacgcucaaugcugcugaucucaagaguuggauggcauccuuccaacauacccuuggccacugaggagaccagaaagagcagaaagaacauaaaauaaagcuacagggggccggggauccucuaucccaguacucuuuagcuuuuagaauuuauuguaccccacuuauuuccaagaggagccugggguaacuguggauguucuggaaagucuuaaaugcucuucucuugauugcuuuauuuauaaacacaaggagauaauucuacacacuguuccaauucccuucucacagacuaacaaucugccugugauguuaacaugcuaggggaugguagcugacuguguauucguauguccaauuggaaguuuugggaaaaaaaaacagaaauacuugagucaugguagaaacuuaagaguuauaugauuaacaaacaaacaaaccaaaccccuaaccuuugggguugauaagagcauagaacucauacacuuggcauuggcuauaauaaguuauuucuugagguaggauuucagcucuugguugaaggguauaucuuucucaaagcaccuucagcaagcccacaggcaaacucccaccucaauaggcugaauaauuugccugggaaauagcacacugagauuggggugcuggaugcgguggauguggaaaggagggggugcuuguaggagaugcucauugagauguaaaggcaacuagacucuccggggaaaucucacaccgucccguugucagcgacuuuucucccuugccaaauucuuuuauaacagcugucacuggugaucccgggauuuccacauccugagacggugacaaugguccagacagacugucaucauuucucaguuuuuaagaaagaagaagucaaguagcucucuguuuccaaguguggaaaaccuucgaaucagagugugugaagcuugguccgguggagacuuauaaaaccauaguguuuccuuucaguaccaagacaucacuuggaaagggcugcuuccaguaugaaaucuuuucccucugugacauagguaacacggaaucaauacauguccuagaaagcucacuguacaaagauccacagaaucuuggaaauguugaccugcuuucuuugccucuagaaaccuugugggcauggcagugggugccuugcaggggugcugggugccuugcaggggugcugggugccuuguagggguacugggugccuugcaggggugcugggugccuugcaggggugcugggugccuuucagggguggugggugccuugcaggggugcugggugccucacaggucucccagucuacucugaacuucucucacuaaggggggacugaggggacuuuaccuuuuuaccaaaucuuguauuucucuccacagaucauauuuccuuucauaagacggaaucaccuuuugcugagauagggaugaacacaccuuauuugaaaaagacacuguaaaauacaccguaaaagcuucuuuuuuuuuuuuuuuuuuuuuuuuuuuuuuuuuuuuuuuuuuuuuuuuuuuuucccauuuuuuauuagguauuuagcucauuuacauuuccaaugcuauaccaaaagucccccauacccacccacccccacuccccuacccacccacucccccuuuucggcccuggcguuccccuguacuggggcauauaaaguuugcguguccaaugggccucucuuuccauugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaugagacagcuacaucuggguccuuucaguaaaaucuugcuagugugugcaauggugucagcauuuggaugcugauuaugggguggaucccuguauauggcagucucuauaugguccauccuuucaugucggcuccaaacuuuguuucuguaacuccuuccauggguguuuuuuuucccacuucuaaggagggggcauaguguccacacuucagucuucauuuuucguggguuucauguguuuaggaaauuguaucuuauaucguggguauccuagguuuugggcuaauauccacuuaucagugaguacauauugugugaauuccuuugugaauguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuugaucuuagccauucucacuggugugagguggaaucucaggguuguuuugauuugcauuucccugaugauuaaagauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccauuccguuggaaggucaaaucuaaguggaucaaggaacuccacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaauaaaacuccaaaguuucugcaaggcaaaagacacugucaauaagacaaaaagaccaccguaaaagcuucuaugagugaaccaucuguugaaaacugaaagugagcagcauuuauauagaaacucucaguccuucaacgggcuggcggaauggccucauccucgucacuuaacuucucgguaucaguuuuuucaucaaucgaaugugcauaauucuucccucucucuugggacuaauuagaaucuacauacugcaaugauugcaaaaaugucuacuucaaagucuaauauucuauaaauagcaugcgucuggccauagaaagacacaguauccuuagugucuguuugggcuucaugguuggugaaauuaggacacaggaccacgaaugaguugcccaagacucugagucagacuuccaggcagugcagaaggaagcguucauuugaguucucauuacuuccuguugggaugcaguuaugcccauguagaauugagguggagaccuuagucacacugacagcuaaucugaaccuguuugaauggcuccaggaauuccagucauuaaacagaaacuggcuugcucaucuguacauuccucucaagucaguugaaauaaauccccagcacuugauuuucugacccgguucucagcuauucaacaccagcccauggucuggcauuaugagaaauuuuccagucuguuggguggaaguaauccaauccugccaccguggagggaaaccguguauagagacagaauccaaggagacuggaaagguucugagaccucggagaagcagaauuugguaguagcaaguuucgauagguucaaggaaaggugacugaaacaucaaaaauagaccaucccagggaacggggccacucugacuuggagcauggagagagcuaaagagcagaacacgccauguccaauucuucugggcacgaucagcugcugcagcaggaugagacagaugggaccauuuuagggccaggaaagugggccucccuccuacuggggugaaacaaguacggaggaacagauagaaacgcaauagugauggaaggcgcuaugcuuugagguaaauugccgcucaagaggcauagagcaaaagcagggcacaguuaaagcagcuacuucagcaggaagcaucccuccaagauaaagaaguacucaagugugcaugagguucaugcucccucccacacagucuagggguuccgggccaggcuguccucaauccugcagucagaagguccuaagucugacaauagauaucaggccacagucaucuagccaaagcgaaccauugguuaaaacucugguuaaaaaguaagguguucugugaacucagagacuguggcagcauacacaugcacagguuaaaaccagaaggggguccuaggacagagagaaggcuccuaccccuaaccaagaagcuaucugccauugauagcuacuggcaaaggaaaaaaaaaaucaguuuucuccaauggagucucccugguuauagcaaccacaccuugagguuggcccaaugcccaagaguaguuggucaacacaaaaccaacucaaugguauuuuugaaaacuucuugucuuaauuuacuuugcuugggcauuaaaaaaaaacuggucuugauuauuuuaguuuuguuugguuauguuuguuuuuguuugguugguuuuuuuuuuuuuuuugacuauaaaguugggugaguggaaaggaagaaucuacgaggaauugggggaaaauguggucaaaauccauuguuugaaaaagacuuuuucaauuaaaaaaugcuuuaaaaaguaauagguugugugugaugcccuguggaggguagggagagacugagguugggacaggauucaggaccugccaauuaaacagaacugggguagcacagcaggacaggggagcugcaggaauuauuugaugagcagccgcagacacacaccuuaucaguuuuggcuugaucuuuagaguaggcuaaggcucaggucugagguucagagucagcgagccagcuauggacuguuggaauuaugcucaaguucagaaccaagacagggguggagaagccaggaagauacuucugugccuauccuggacgaccuugcugucauucuuccaggacugacaaagcagaguaagauuuauaaaugacucugcauaugggauguaaauguaaauauguaaacgacucugggaaagggagauggggacaccugguuacuuagggaagacuuucauauacacugcugcccuggcuguuuaucucccagcaaagaaaagcuguccugcauuacaccgaaauuuuuaaaggauaaguacaucaaaaauaaaaaaagaugugaaacuguuaaaauuaucagugcugaagaauaacaggaugacagcucuucuagccuuuauucccacaucuauuaugugaauaagccacaaguaaugggcggauucccuacugacucugaaauucuauuuacggugaauuugagagggacauggucauccuguguccuugauuuugggauuccaauguccacuucuauggucucugccauuugcuacagugcaauggcuuuaagggaacaucaaggcacacugaugcuugucaugagcuugguaacuuuaaaaauaauacuuagugacuugcugcacuuuuaucuugacauaugauuucgcuuuauggaacaugaagacgauacauuuuauauuuaggaagcauuugcuagggaggaugguagaguaaaauuuaauugauuucuucccccucuguagcucuuaaagaaguagcaugugacuccagauuagucggcaacaugaauauuucuguaaaaaggaauuuuuccuugcuuaggcuguuaagucuuacccauccuugauacuucccuuugucuuacucucacagacaaauaucaccauguuuuaucuaucucugauuuuugauuuccuccucuugucuguccccacagcuggcaaggcucuccauuaccaaaggccucucuugcucacaguccuccacucccacccaucccccaacgccagaauauuagugugaaagaucuucucccgcuguucugcuacucccagcguuuuuuauagaauuagccaaaccuucuaagagagcacuugaggugcuaguccaaaauuaucuuucuaacuuuacuucccgagccccacccauucccgucacacauagagccugccuuaauaggcgcgucuucugaaugaucuaccauggucuucaugucuguuggaacacuuucaacgcacacuuaagugacuggccagagacuuuauugcugcaguuuguaaagccagaccuuuggaguaccccuuccugcauuugagguacaccugugcugacaaugcuuaauucuguuguuagugaugauuugucucuuccuaugcaauagcaaugaccauucaccgcucaucauccuugcuuucauagcgugcuuucaaccaucugggguagcgccaucucuaacacauaauaaguggucaacaaacuccuguuuggaaugauuggggauauugugugggacuucaugggucccuaagguugagcuuuuugucuucuugcugagguaaauuuuuuuuucccugccaguugugacuauuaccaguuguuacagucacaagugguaacaauguaacaauuugguacuagcuuuuagccauguccucccucuggcuccacacuaccugcaauagcagacacucaagucuuucucuucgcuauuaagugacagucugcagcuccuaguuuguuaagcuaaacaaacucuucugcccugccuagucccccccccccccuuuuuuuuuuuaccguagucuuuagcuuaaacuuuuuauuagaaacaggccaugucucacagucuucucaucuuuggagacuguaaauuauccuguuacuucauuuguaaugggaacauauuuauuuucugugaugauggcuccccugaguccuuccuuuuucuuagcuacauaaaguuaacuuccucaguggcgaauuaaggacagauuaugagcagccugggaaccaggcuccaucaccacaggggccgcccacucagccuccuucuguucagccaccggagaguugcagcugcucugggcugcucuccccaucucucuugaauugagaggcagagagacagagagaaagaaggaaagaugugcaugcacucauaccauauacacacacacacacacacacacacacacacacacacucacucacacacacacacacacacacacacacacagagacagacagagacagacagagagagaaacggggcgggggggagggagagaaagagagagaucccuuuuccccagcauuaucuguuggugucuguucuugaguuuucuagguucuucucuccuucuucucccccuaccccagcugccuaccaucuccuccuacacccagaccagcagugacugcacuccaagacucccccuccuuccaacacugccgcuccguuuccauagcaacagaaaauguuggugggaagcaaagaugcugaacugcaacucguguuggggcugggaggaggaggaggugaaaugugggccucucuggaggcuucagagggaggggaagcaccuuggggaaguguggugagggggaggggagaaugccaggugagaagcccucaggauaggagggaguuuggggaagguacauuggcaaguggaaauugcuuugguuagaaaacugaaauaggcagaaagaggaagacuuauaaaaaguaauggagaauucuauauauacaguaguugacugagagguuaagcuaagcagaacacugagaacagaugaugucauuuugaaggguaagugguguagggguaaaaaaguagucggggugcuuagaguauaauaauaauaauaauaauaauaauaacaacaacaauaauaaaucuacaugggaaacaaaaauaugauaccaggcuuugguuugugaugggaaugucuucuuugaguucauagaguuaagaauaucuacuucaaaaagcuaugaaugagggucaaggaaaauacaguacaugggacagacacucagaguguguaagguagaugacaauaccuaaaaaaacauuuuaguugaggaauggcauuucaaacgcuaaaauuaccacucaaaauuuacccagaaucacaaauuguuauacguuuuucuuuuucaucaucuucaguuuugcguagcucuaaguacgugauguccugcuuaagcccaugguuuauacaugaugcccuacuaccacaugccuaaggccaugguucauacaggauguccugcuacccugugccugagcccguggucucaccacauuacucagugcuugcccugucaccccacagaaccacccugggccucaagcaaauaucccaccaugcuuucauagaggccucuuguauuugcucaggccacagcagugcuggucuuguaacuuuccagugauggaggggguugcuacagaaacugcuugucuacaaccaugauuacagugguucucuggacuuuuucugaaugaaucuaugcuacuucuuccuuuaggacugcagagcaagaaaugauagaaaccuauguaggaagaugcguaaggaccucuggaccgcaccccugccucccuugugcauccugcagcagugguggucagcaagcgaugcuugagcacugcuuaagugccaucccuaggcuuugaggggauggacucauauaaaccccacuucagcccaguggcaaggggaaagugaugguuuguaucauaucuguuguuuauaugcacaagcggaggcacagagauacggaauaccugacucacggcaacaagcuugucaaggcugggcugggauuugaaucccgguggaaucuaugucuuagccaucacacuucuguacuacuucuguuugagaaaaauaauaucugggcccuugaggaacccgggcuugaacacaugaguacugcuucccaagaauagcaguuuuccccuuucagaguauaauuuaaagaaacaaaaagcccuagccucuauuucaagauggguacugaacucaauggcuuauuuacuuauuuucuucuguagauuuggagaaagguggaaaaaggaugucaugaucuuccagcagcgaagguagcuguagaaagacaauauggguaggagagaucugacugcauuuccagucaggaagaaagaggaaaugcuggcccaagcagcaggauagacgcaacccagaacugaggugugugcaagcaacuggguuugcccaccagagcaucugggguuuuagucugagaagaugaagacaggcugggggaagaaauugggaaguagggcuaagauggaaauaaauuucgaagucugugauucuaguaguugcguuucuaccuguuucuaacuucuaaucuuccuccaaacacacacacgcacacgcaugcacauacacacauagaggcuagacaacuaucuuuucuugugaaaauggaaaagcagcuuauuuucucaaacacuuuauaagguccuccugagcagggcacuccagagcagugggaccugaggugcccugguuauuguggacauguagcguucuacaccaugaaaccuggaagucaaaaccgugcuuaugaauagagauuccagauugcuuuuccauugacucuaagauaugaaucgaaaaccccucauugccagagaacggagugugauugaccaaaacaaaguuagaagcaaagcguaacagaaacaacuaacuucagaaauuagucaagaauuucacaauaagcacagagccuacagggcuucauggcucacagcaggaaaaugaaaaguguguccagagaaagaaacagaaaauagagaguuuugugaaacuggagguuaugauauuccuuuuucccucccucccuccuucccuucuuaucugucuccgucucucccuuucucccucccuccuucccuucuuaucugucucugucucucccuuucucccucccuucuuuccuuuuucccucccucccuuccucucuuccuuccuucuuucccccucccuccuucccuuucuuccuucuuucauuccuccccuuucccuuccuucuuuccuacccucccuucccuucaucucucuuucuuccuucuucccucccuccccucccuccccuccucuucucuccccucuguucuccuccuccucuuccuccucuucuucuucuccuccuccuccuccccccuccucuucccccuuccuccucccccuccuccuuucuucccugccuugccuccuuacccccaaacccuguacauguucuugcuucauugccaagguuauccucaagguugacauccucuaacccagccuuuucaguccuagcauuauagauacacaccaccacccugggcuaguuacauucuguuuuauguugccacuggucacaugccacaugaagcaaaugaaaaugcggcaaaugugaugaaggaauugaaucuucagcuaacucgaauuuaaauaguaauacacgcagcugguggcuguuacauggguugaugcgucucuaggagagucaggaugguuucuaccuacuccuuucugggaaucuuaugcucacagguuugaggcuacuguuaaauuucugguucucuuagugccuuuguccuauucaguuaagugauuauaagcaaauuccuaagagauaagaugaaaauaaaaagaaauagcaaggggcugaggagguggcucaguggugaaggaaggaaggaaggaaggaaggaaggaaggaaggaaggaaggaaggaaggaaagaaggaaggaaggaaggggauaccauaaucuccccuugcuucucuuucacagcauauaagcucaguccccugaacccacauuaugaagcucacaaugauuuuuaacucuagaucccagggauccaacaccguuucuaccauccuugccauugucauacacacacaguauugacacacaaagacacacacacacaaagacacacacacacacacacacacacacacacacacaggaauaaagaaaaacaugaaaaaaaugaugaagucaauugaagagaguaacaccagggagaacuucagaaucacauuccuuggcaggcucagagaaauccagccuccgacaagggucucuugaggggucucuauacaaaagugucaccagaaaaauagcaugguggagccuguaggaaccuaauggauaagauaauggugaaaagugaaagagauggaaaacgaacuagaaaaaucaaacaaugaaguuauuaaaguaaguaaaaggcaaguuuuaaggugcuuuccauguuccuagaucaggcaacugaaaguugggugacagauugccuucuuuggcaaugccugguuuuaacaggggcaagcagagaguguuucuucuugaugaggguucccccuacuucaugaguggcacagaggcagggaaacucuagacaaugaggauuuagccaucacggaggcuaggcauugcuugggucuugacuauuaugcugugaagacaggggaagcagaucuggaagacaggagaauuucacaguaggcucucuacuuguagccucugcauuugcgcacugagguucaucccacaacuauacuguggauagaggcagcuucgagggaagagauaguggaagcccucaucucucauaccaggaggugagucaauaccaccggaaguugguaagccaagagcuccagggacacaugccauauggagaagcuggcagaagaacaagguguagacauuuuugagguauugcuucugaagggagaagguggggaauagggagaagauaccccaagcuauguuuauguuuuaucucuacacugguuuugcuguuuaaaguuuauauaugcuuuagcuccgaauuauuuacuuuuuaaaaaagauuuauuuauuuuauguauaugaguauacuguagcugucgucagacaaaccagaagagggcgccagaucccaauccagaucacugugaugcuaccaggugggugcugggaauagaacucaggaccucuugaagagcagucagugcucuuaacugcugagccaucucuccagccuuuuuuguuuauuaauuuauuauuauuauuauuauuuuaauggcucugaaucugaaaguccuugccucuguuguucuugcaucuguguaucaauucuggaagaggcugagguuauaaaucagauaauuagccagccaugggcauucauucccuucuugccaaccccccucagccuucucuuuuccaagagucuucugggaacauggacacaagaaagaccuuacuuagggcugccauugucuugguuguggggugacaggaagcacgggagccuuaauuuuuuaccaucuaggcuucaacuccagacuguuguugaaagacuaaagugcugaauacagcuuuuaguggcaacuguuuucucuucacuacagagccagucuucugaacuaguaucaauaaaaugcuuccuaacaggaucccugacaccaaaaguccccacugacaccaguguaauuaucaucccuagacgguagcccuugucaggccacacagauaaucaccuacaacagcugaugauuagccagucagucagcugacacccagcacuccugggagguucuguagaggugacaaaagaggagaagccccugcggcauccucucuccaaacuaacgggaacugagaggauacaggagaagaaagcagaggcacagagggauggggucaaacacugcuggucuccaucuaaggacuaaccaggcuggacuaguaaacucugcuuggcuuucaagaucaggcuuguucauggugguaugcaggaggcaaugucccuucucuguuacacaggcguggggcgacucaucauggcuucuuuucacuuuugcucccguguccugacugaauccaucuccuggcuuuccucuaugugucaccacccccaccuucauuuugcaccuccaugcuaauugcagguauuuccacuugcuagaaaagccgcccuguggcuuagcuugucagccugagccucuuuccaaucugucaagggcaaagugguauagcuguuugaagaugccauauuaaaaaaaaaacaguuuuauaugccuaguuuuuuauuuuguuuuuguuuuguuuuuuaaagacuucaugugcaccuaacuccugcuguggaacuuacccugagccccagagcaggauucaaaugcuugugucuuuuucucuaguagacacuaagcucugugagaagauggacauguaugcuaucaugcuaaaauaauccaaauagcuaauacauguagaguacacagaacaguaaugcccggagaagaaguaagauacaccuuuugcuauugucacuaccauggcugaauucaaaugaccuuccacaauaucuggcacaugaaaguggcuauagagcaacuaugccuucauuugcauucuuggaacauucuggagaaaccuaguuuuauuguugaggagucaagcauugguccugggugcagggacacagugcagguauuugcuuuagugauuagggcucagugauuaucugcaaaaaacaaacaaacaacaacaacacauggucugguggacaggaagaacaguauauucuaaaggcaugagcuauugagaacagguuuucucuggcuuugagauaaaaccuuagucuguaggaugguggguguucugguugauacugugaacuugagacaugcauauggcagcauuuguagacuggguuaauugaaaaagaaagaccugcucugugauugacacaauaccuuggacuugaacucuggacuuaacaaaaggaagaaagcaaacugaguaugaacauucucuguucucuucuuccaaaucgcggaugcaaaguauguaguuacuucaugcuggccguugccauaaucucccccccccccauuauaugauugauuggacucucaaacuaugagccaaaauaaaugcuuccuuccucaagcuguuuuccucaggcauuuggccacaguaaugagaacauuuacugacaccuucuguuugggagaggcaccuaauguaacugguaacuucauuuuuuuaucagcacuagcuagaaauagccagcuaaucagccucagacagauguugucuugcucaucauucuugcuaccuugguauguggagugcaugugugugcugucaucccgguaagcuuaucuagggacagugauaggucagcaagcugucucuccacauggcgcauguggagcaccugauccaugauuuugcaaggcagggaacauuuucaugcaaagaagcaauagucaacccuggaauaauugccugacuaggauccgcuuugguuuucaaauccuacaggcaccuggacaucuuaaccucauuuguucaagauuccauguguucaccccauucuucugugucuacacaaacacuacucacacccauuuccaucagagacccuucccugaaugcuccagaugucagacagcucuuccuucccagacauaggcauucacagauuuacaacauuuauucuuccgauaguuacacuguaugccauaaaaacacacuguugacuuucauuacuacuugaauguguauugcuauugagcaguuaaguaugcuacacuuagcuuucugaguggacuguagggucuuuaagcagaaacuauauuaugcuucucuguagucccuucuacaauuagcaucgguagaugaauagaguauguaccaaguucacuccccugugaaugaauagauaagccuucccauuccccuaugaaugaauggauaaaccuucccugaauccauuaaaaaagauuuuccuaagaacauuucauaaaaauaauuuuauuuuuuuacuucagauugucaauacacccugaaggauuaaauaugcaaauaugaaacacagauuuauauuuuaaaaugcuacaacauguuuaauaugcuauauaguauaugaauaguuugagugaaaguuuagauuauuaauccuuggggaaagaacuacuauauucuuauguguucaaauauucuuauaaaauuuuuuaugggggcuggagagauggcucagugguuaagagcucuuguuguucaaaggaucuagguucgcuuccuagaacccacaugaugguuuacaacugucuguaaaucaaguuucagggaauuugauauccucuucugauauaguuagauagcaggcauacacuuggugugcauacaugcaugcaggcaaacacucagacacauaaaaugaaaugaauacauuuaaaauuuuucaaguaaaauuaucaugaucugaguuaggacauuuuauaaugaguggguggucccugagugggucagaaccagaucagauucaguucuguggguauccuauaauacucuuccagugacuuguacaaccauaauguugugaguacaguggcuuccuucacuaggugugcacacagccauuuaaucaaggucugcagugagaaugaguggaauacagugacauaucuucccagcggccuucagaguuguuuggugugaggucacugaagcaggcagguuauggauguuuggauguuccuaggacaacccagguaacccuccuccuugcuugcaguauacuccgagggugagagcaacaaaggcuugugugaauguguguguaucacugcacacuacaccaguucaucagagauucuaaagugguucgccaguucaccaagagcagacugucuucucaaagugaugcacugccugcuagaugcacacagcuggccuuaaucucauucuuaccaucuccuugcaaacuagguguacuggcuaguuuugugucaacuugacacagcuggaguuaucacagagaaaggagcuucaguugaggaaauggcuccaugagauccaacuguaaggcauuuucucaauuagugaucaaggggaaaaggccccuugugggugggaccaucucugggcugguagucuugguucuaugaaagguagaaagcuucauguugguugaaugacaagagagcaucauggaugcaggcaggaauagggaggcuuacaaaggagaccgagaaguacagcacugggaugagagaugcccaagugauguacacuuaggagauacaguggucaagagaaucacagaccaagguagauaagguuaauaaggacugggaagcugaaauuggauuugagccguuagcaauacacugcuggucaucauuuauaaauaacuucaggaucagggcaaaggcugaugucaucaggccugacuuacugaacugaaaggcaagccagggaguacagaccuuucuucugagaaccuuuuauauaaagggaaaaauaguaagagcacagaccccaggguggagggggcugaaggggaauucugaaaagaaauagguuauaucugaccuuguuuagagauuguagagaggaaggcuuacuuauuuccaaaccauuucugaugcaacuaaaugcagaaccuauuucuucugucacccagauuuagauaauauauauaaagcacaaugcaaauuuaaugucuuuauucuuucugcuaugucauaaugacuuaguaugaugucauaaugucauaaugaccgggacaucgaugaacugcauuuuaugacucuguaacagaccauucacccucuucuucucacaagaucuucauugaaacugauccagcucuucagugguugcauugcucgacaacaucucuugcuuuuguccuuuuagaagaugaaggauaucuggaacugcuguuaccaacauggacauauuuacuaauuuuguucuggggcagcagauaaccagacagacuauaucaucauucagaucuggugaaacccagguguucagcuuccucuuuaugggacugggcuuuucugauuuauaugauguggaauaugacuuuuaucaaguaaacuugauauaggacuugaauuccaagaucaccuucaaauauugagaagcauacccugcccccuuuuuuucuugccaaccauauaaacacacauuggccaauaaacacagaugcucuacaagucuuuauguggauauucugaucaacuuugcucaguaaaaaggaagauaaaagcaaaaagaaccugaaacuuaacucugugaaccaaagugacagaaaccaguauacuuauguuugggaacuugucauaaacauucauuuaacuuucucuucuuauacaccucuauaaucuguaacuagcauccuacaggcucuuauuucucuguguucuuuuaaauugcaugguuucugaugcauauggcagacacagcuagcuuacagaaucuaagaagagggcagggaggcaauugcagugaucuaugggguauugucacuuugucuuuuuugccuugguaucguucuggaugagaguggauaaccacuggcgacucauuacaccuuagaaacaagugcuacuggagggcaaauccugucuucuaugaggacugcuacugguaggugcacuguccccagcaggcauaaagugaaucauccaauacagaaggcugcagaguccaaggcaagcuugacuugcaauucucuuguauuucuguaacacacuguguauggugagaagcaguccuaagucuggaccaagucucucucucucuuucucuccuuucuuuuuuucugucuguccauucugucucuccuuucuugcuuucugucucuccuuucugucucuccuuucuuuuuuucuaucugcccauucugucugucuguccuuccuuucuuucuucccuuccuuccuucuucuuucuuuucuuuucuuuucuuuucuuuucuuuucuuucuuucuuucuuucuuucucucuuucuuccuucuuuccuuucuuucccuuccuucuccuuuuuucuuucuucuuccuuccuucccuuucuuucuuucuuucucuuucuuccuucuuucuucuuccuucccuuccuuccuuccuuccuuccuuccuuccuuccuuccuuccuuccuuucuuucuuucuuucuuucuuucuuucuuucuuucuuucuuucuuuccuuucuuccuccuuccuucccucccucucuccuucccccucccucccucccucucuccuccccccucccucccucccuccuucucaacccuccuccuucccuccauccuuucuguuaucuuuccucuucauacucuucugauucacuaucuccccaagaacaagaggugcucacagcucuuuaauuugucccaauucacaccuucggaguuugccuauuucugauguucccacaacaauuggaaacuuuccccauugaucccaaauugaccuggauuugacuuuugacuuuaauuuaguuaacagacuauuuguuuaucauagucaugcuuagugauauggggaauaauaaaggauucauaugcauacauuuauugaguguuguuacuaauuuaaucaugucauuuccaaaguugauauguggaaguccuaaccccuagcacuuuagaauguaaccuuauuuuggaaauaggaucuuuacauagauaaucaaaucaaaucaaaugaggucauuaggauggucugcaaccaagagugacuauccuccuuacaagaagagaauugugagcacagaaacauggagacacagaagccagagucaaaauacagggguaaggaagccacauucaaggcaacaagcccagaacauagccuuuccacagaguccucaguagacucaacccuauugauaccuugagcuuggacgcacugccuuacucugaggcaacuguggauagaaaugaaggugaauaccuuuguugauaaugcaugcccugccauggcuaaaguacuggucuucuuaggaaauaguggggaagagauauaagguguaaagagagagagaaaaaaguccaagaaaagagcaaacguauugaagacaggaagagcuuugagggugaagccaauaguuccuaggugccuugaaacauuuggugaaggggacagugaagacccuuacuaaagucagagaggguauuuucaucccagagagcugguuuuauaaaccuggcucugcuaacagcuuucuuaaacccuguugaguaucacucucuucauuuauaaguaugggcauacugauagaugcaugaauugugcagguuaauuuguaggaaccuguaucauacuguauaauacuuaaaacauuccauucaucaauguugaaaagcuacuaagugccaggcaucgugcuaggcuuuaggaauacaaagauaaauaacacucagucuauuccuuaggaacuucacucucuaggguagaaacagagauuugaacaaauuaaaaugauggcaaagaaacacgaggacuagcacagggcuaaaaccagggcacuguggauguacgguggguagcugggaaggaagaaaacauccccaagagacaggguaggguuagaaaguguuucuuugaggaaaugauuuuuaaauggauuugagaaaaaucaggugaagaaggaagagaacggaguuccacacagagggaagacagacuugguguacagcuguguuuuucucugucucaugccucuucaguucgcuugcugaaaauauacucucgucugcaaaacacugucaaaguccuaaaggcuggauccuguucugacuguccucagcagcacacugagguuaucuuuaaaacaaacagaccaucagaaucccuuccuguagccaucugccuguugccuggcugcccccagcccaugccuuccucucuuuucauccuuuuccuuacuuacuugcuugcuucugcuuucuuucauuagaucuggagacacaagauaaaagcuaauuucuaucuguggggcagggcagcaaacuauggcccaaugauuaaucugccuguuuuaauaaauaaaauuuuacuggaacaaaaugacacucauucauauucauacugucuauagcuauuuuacugcaacaacaaagauagacuucuuuuuuacuuuuuucuuuuuuuuuuuccacagagaccauacgucuugcaaaggcuaaaugauuuaccacaugguccuuacacagauggcccaaaucugguccaauauuuaugugugguagaagauagguauagggaauaaguggacacuauacaaguaauagaggcaaagaaggaaauuuuaaggaaggguucugcagaagagguguucauaaguucuaccugaaaggucagaagagaauugacagcuaaaagacgugacaacugaacuaagagccaagggauaaaaaagaaguuaagagagaagaaagaugacucuuggcagagaguggugugugcacagccaggcaguggaggaaaagcuugcaauucaguucccuacugacuagagaagaaauaagaagagauagauaaggcuggagaauuagcuggacccagaucagcaggguucccaacuaugagaguuacacuauggauuuuuggaaauaccuuaccauuucccacauguaagaaccucugaaggauuagagcagcauagaugaaagcaagcugaaagcaagugugugcuuaggaucccucugggcaauuagcauuuguugggcauuuauuuuaugccagauuugugcuaaaugcuucauaugcauauaugcauauggaaaugcacagugaguagugguggaaaccagguagaaagagguaaagcaaggcaaacagacauggcucucugagcaugucugcaaaguagaggaucccauaugacauacaaggacagagaggagaccagggugaugcaagggguagggugaugucccauaguuggggccaggaggaguaacugaagguaaggaguggagacagagggugucacaagcugagagaccagagagagaugaugcgagcaaggcugacuugaaggaguacagucuguaggaaaguugggagacaggcuggauuauggagagguuaaggcauugccggggaaaugaaaaacuggaggucacagcacuugagcaaguuaccugggagcucugcucuuuuaaagcacagaggaacaugguucuagcuggauuucuuaaaacaagucuauaccucagcagcuuuaggacuuucuuaggcucacaauugcaaauuccucaccccaaauaucuggucauuugaagcaauucuggagaucaaauuaugcaaaugugcuccaugacuaaauuagaggcuaauucaugugaacauuaguuaguaaugggaguuacauuacuggauuauuagaaaauggggcaacauauuuuagugcuuaaaauuuuaaucagaguaacuuccagauggaggaaaaggcuccuuuccaucaccagauuggaaccauggcugacauccucccugagagucagccuuucagcauggucaaucuagcacaugcucucauuucugacuugcugugcagcacaagcaaucaguauccuuucccgggcuaauggcauguauaagaacaauuaauagcucucgugacaccaacauuuucuccuguaccuuuagacagcucaaaauauuaacauaaucaccccaaacagcauugcugcuggacuccaugaguaaagcagaucacuagggagacaagaccaugcugacgagaagucagccuuucucuguccccuaccacccauuugcuguugcugcuuccuguauuuguaauuuagcuguuguccagauaaagaaugacuccccuuuggcacugacugauagauacugacaaauuuuaaaugucaaugguugaaaaacaaaaaaaaaaaacaaaaccaaaaacaagccacuuuuguaagaaugaguccaccacugcugucuguccuaaaugaguuuggaaauguauagauguuuuuuauaauaugaggucauccacucaauucaaagcccagucugcuucagaaacaggaagauagaggaaauggacauuuuucucuuauacuuauacaucauaaaaacuuccuagauuugccugaaaacauuguuaaguaagaaaucaucauggaaugauuagucuuagccauuacggucaaguuauuucuguugucuacaggucuaacuucuuacuuggauggugguuugcuaagacuuaaaaggucauuuuuuccagaccagcugcaaagcaaacugagcucuuugcucugcagcaaaguucuggaaaauaggacagaucuguaggucuauuagcauguaacauacaugcaccacaaacaugggagaaaauuuucauuuaaguauguaccuauuggccucucuugcuuccaucuucuguugaccucuauaaccuccaauagcuccuugggucuuuuucaguguguaacgggaacuucucauuuugaccuccaguuugagcuuuaugaaugcuauccgcucaaguucccagaaaugccaauuuguguguggcuuccaguaguaccuuuauaaucaauuccauaaagccuuuaucccgaacacuggucaaaucaccucaagucaauaggucaacaggagcugcuaaaggaaugaugcacuauacaauuucauucuuuuccccuuuagaauuuacaaauguaaguguuggguagugaggccagagaggcucugagucaguccuccuccaaguaauagacccuuuguaauaugaucuucacaccaccaaucugcuguaguacugcuuaggagugauagaugcuaucacuagcuccauuugccuugacuuugaacuccaacagauuguuugccuuuuccauuauguauuuaacuuaauauaggaaaaucugcugauugauucugauuguaagaaaagauaaggggcaagauuccugucuuauauucuauaugcaugaaggaauguuugugggauguguaggcaaauacucaggacaacaguaugccuugacugagggucauguuuuguucaucaucauaucccuaguaacuaacauuuucuaacacauggaaaauauuuauagaggacucaauuccacagugagacaacuaaugcuccauacucucauugaccaaaaagauuuuuaguuuauaaaugaagguccagucaugucaaucuguuguguaugugguguuuacgggugaguuucuaaacauauagcauuauguuaggagcugugagaaaggcaaggaaaucacacacaaaacagacuugcugaguuucucuucuaguagagaagacaagauauagacgaaugggaacuuaauuccuaacucuagaacgauggcugcaaaauccaaccacuaagcgaguuuggaaagacaaacuacuauggacuagaguccuuaagggaaguuauguaaaccaggcagggagaacuuugagaauaaaaaguauaagggaaagaaaggaaaugacaguccccgagaagcaggagaggacauaaggagcaaagacauagaaauagaggguuugugauuuggacaacuuagggagcagucaucuaacucagaaaaagaaagauggcaguagcaauaaauauaauaagggaaaaaccagcaagucugcauaacaacgaacacaucccuaaacuccuuguugggaaaauaaacagcauuaaaacuuagucauguuacauacacugcaaaggcugaagaagcacaaggcucagaggaccccacggcuuccccaggucuggugagaagcagggagauugugcuuaugcggggagcagaugugaugucuuuagaggaagcaggcagggcgggacuagggaagacuucagacgcaugacuggugagggcuugugaugucaacacacacaugacuuccccaaagucuuagcuggcuuaauuaaggcucuguuguagcccuucuugaauuguaccaauuucuauuuauuuguauauucuuaaugaugcuuuggaucuaaucucuguccuugauguccuauaaaccaggaugaaggcacagaacaaaaguuuauaauucuuguaccuaugaaucaaggguaaauauuaagagcccgaggagaagugaugaaagacaauaaagaguuaaaagcauuugggggaggaacuuccuucuucucuagccauguucaggaaucaguaucaagucaucuuuacuaaaguuaaugauugucauuagauaaaaauuaaccauauauuaugucuauguuuaagaguauauagaauauauuuagcaaaaaaaaaaaauaagccuugaguaaaugcuuucuucaaauguuauuuacacgaaacauuuacacuuaacccacaaguagaauauguuuccauaacuaagugcacgcauggauauacuauggcauuuuaaccaacauuaauuauauccucuugaugucuacugucuucuucuaaaaagaccuacaccacaucaugguuaaugggagcguggugcuuguugcuuaggcaacagaaugaauaaaugcaggucagaauaugccacaagaaaaaaaaaaaacaaaagcuagacuaugacaccgaauggaagcugagcaggucuaacagauuuuuacauuaaugaagucuguuucuuaaagugggccaaccacagagggcuuuaagcucagcauuaaguagccuacggcaaccaacagacuauuaucguaaagguagacaaucuuuucucacaauauuggccccaaacaaauggugcaugaaagccugaaaugcacuaauugaugacaccauugaauugaugacaacguuucaugaguuacuucaucuucacaauuaauuaauccuucuacauggcaaaucaaagcuguuguuuugauuuugucucauaguacaaguccuuggcauaucugaguuaacaaggugaucuuauauucuggaagauuccauacacuacuuggaaauaaacagauaaagccacaacuuaggauuagacguugaucuuccuacgaugcucuuuuuuuuuuuuuuggauguauuuggugcacaauucucacaugacuguucugcacacucuuucuucaaauucucuuuaaaaccagagagauuaccuucucauuaaauacauucaaagggggauuauauuuguucauaaguguuuaauacucagaggaaaauuaagcugaaaguuaaucauccuucaguauggacgauuaacucagugaaucuaaacuuuucacggaucagaauggauuuggaccagggcuugggaaugacaugcccuguuucagguagagacaggggggaaaaguagcuaugcagagaaauguagucaauauaacuaaugccaaaacaauacucaauuuguuugcuaggucugguaauuauuaauaccaucuguuuauugcccuaaguaagucuuaaaccucucuagggcugcaacaacuuccccuuccauccuauuucaacagagucucaacuguauaaccagugacugucugauggacacaagaaaaagaaacgcauagcucauuaauuaauuaaaaaaaaacaacaagauaccccuaaacgguuauaugcauauauuacuugaugcucauaugauagaccacauuuaugcauuuuuaaaaaccuuguaggcauacacauuuuuugguaggaguagaaguuuaaccaucuuaauaacccucaaagcuguaauaauucagucaacuuuggagaaaagcaaucuggcaaaaggaaugucaaagcucugacuagcccucagaggcuuaugaaggugcugcaggugccagccucagcauuuuaucucagaggaacgauuaaggacaccuacgagucauuugugugcuacaugcuugugacauguaggucucccuaaauuuagggaucagugauaaugugcgaugggaccuuaaaagcaagggaaggugaggagaaccgugauguagcuugaaggagcuuaacaaggggagcugaugagugucuggggaggucuaggaaugauuagaaaacuacauugucguuugcaugccucccauccuccuucucaccuauaugcacacugagaaguuugcacacgcccgguuuagacugcacacagaccaggacucgaaaguacaccgaugcauuugguacaccagccccuuucuauacauacccugacagcuaauugacccaaguguuuguuuuucaccuaaaguaacaaacaauaaauacuucauggcucuucugucagcaugugcuuucgcuaagcuaagcgaccggcugaagcagcuagcucaggaagggucauccacaggauuuaaacagccuauugaaugauuagcagggaaaaugaucuucagaccaucgacauagcagacucucuaauuaaucacaaauacugauauucacgcggaaauaacaugucuccggaauccagauuuagcuggagcgugguauaaaucuaauuguaugcuaagaucgcaaauguauaggaaagaaaaaaaaaucauacaaugaaugacagggagacuagaaauguuaaucuucguucagagcccauaaauagagcucucaccaguucauacaacacacaggucuaauggaugcauauagaugccauuuucuagucagugucuguaugcacacaacaaguucuguccuaaaggcaucccguuuuucugaugcaguuacauaucuaaagcugauccguuuccgugcaaaccaggcugccucugagccauguaaagacacauaagaagcaaagacagacaaaaggcagcuccguggacacagagagcaucuuaccauaaacuguacacugucaaauccauuagccaucaggugguucucguacugagguagcccaaugcuuuccagccauugucccacuguuuggacagggcaucuggguccuguaagagggugaagagggaagcgcuuuagcagggaguagccguccacgggguaauagcgguaguccggggcugagggguggcauugccacaucaugcuccuggggaaguuguuaucaaaggagcccgccagcuugacagauuaacguucucagcgagagagcaaagucagaaggaaaccauaguuugccaggcaggcuguggaguaggacuugauccuagcugcacauuucuuuacauauuaaucuuuacuaccgaccagugcgucauacagccccccagaaccaggcaggagaagaaggcauaucaagcugucagccuaggcugcucugcguucuaugugacugcuagaguacuccacaaugagcaacacacggccagcagccagaauucuuuuuaucaaguacuccuacacucaucaguaugcagcuccacgcuccuugcucccccucgcucgcucgcuccccuucauuacccagcccaggcuacaccucgcauuuucaauaauagccaucagauaaggcagauuuuuuuuuuuuuugucugcaagcuguaagcccgcugcugcugcugcucccuccuacacacccauccaagcgucaaucuugaaugaugagagcagucaaaacaaaugcagaaaauagcaagacucaagcaaaccaaagcgccucaaucggaaucgaagaagcuucauccagguuauacacguuaccgagcuauuuguugugggauuuuuuucuuucuuucuuucuuuuuuuuuacguuucaaaagacaccaggaaacgugaagcuugaacuacagcuccuaaggaggcucgccacagguccccuuuccccuucccuucuucgccuuuuucccuuuaaaaauguaccagagggaaccguuucugauugaaagcuucacaguguaauuauucuuuuuucuuuaccgugcagucucaaagugaaccucucuggggauuuuuuuuucuuuuucuuuuucuuuuucuuuuuaauuuuugaauuacugcaacauauagaaacugcaucauaaacugcaagccaagacaauucauuccucauuuguccuaaacaacaacauuauuaggcacaagaaaagccauucccacucugguauuuauaacucuaucuacuaagcgcccuauucuaaaauaucuauaaagguaacauuagcuggauagcuaaguuuguuuuuuuuuuuuuuuaauaaagaagaagagcccuaaccaaaaauaauucaagaauaacagauguaagugugugaguuuuuacugaauggcagacagacugaguaauuuauuuaauaauggagagaaaccacagaauaauaauagaaucugcagaacuaccucaucagaggagagacucaauacuugaagagaacuaucagaaaggcuaggcuagcccuuaguccuaggaagaacccuugcccuguguuccaggaagacuaccaucuucugcuugaaugccgccugugauggggcucucaccaccgagccaagccucuguucauuagaaagauaguuuacuuccuaccuaacucccacucgcuggcuccagcuuugccuugggagucacacagauugggaacagagucuuuuccacaucaaguacuuuaaaaauuaaacagaacgcucacacuacccacccgacucugcccugaacacgcaguaugugcccagugaauauugauuggguacacaaaaccuucacugguccucaagucucgucuugguuucuuuucucauuuuagggccauugccaaucuccucagcauauaaauauguacucucaaaacagcaugcauguuucuucuauugcugacaccaaucccuggguucuaaucccucucccucucugcuguccuauguuuauggaccugcugucuccuuuggauuuuuugcuuucuuuguuuccuggcaccugguccaauauaacaauggccauugaauuguuuuuaagucccugcuguauuuuuaaucacuaaaaacuccucuuccccuccaccccccacacccuguguguguguguguguguguguguguguguguguguguguguguguaugaaggucaggggacaaccugcaugagucugaucucugcuuucaucauguaggucccagggauuaaaccuaauuaggugugacagcaagugccuucauccccugagcccuuucuugcccuccgauccaugguauuauuauuuuuuuuaaaucuaauuuauaaacagugccagaauaaucuaagacacagcacugauaacucagccuuauuucgaaacacugccguaguuuccugauggauuaaaagaacucuggacucuucgugguguuugggguuuucaucuggcucuaccugcucuucacaguucucaaccaggggcaauuauuugcuggucuccgaaggaaggcugaaauguacuuggguagguuuucuuacuacccuacaacucugucauuuccuuuaugaaaccucuucuaucccucaauaggaugacaaaucucucucuuuucucuaguggcacauuuagaccuucuauaauaacaaauauuucuuaacccacaugauuauuacuugugucuaagacuugcuucuugaaagcaggguguaugccuuucuaauacuguauguacaucauaugcguucaguuugcauuugauaaucaacaugauguacccucacagucugaacuacagaaagcacucucauuuucagauuuaaaucauuuuguuauagucaguagguaaguuuuuuuuuuuuaacugcacuccaaguaucugauuucuuuauaaaaaggaaguauuguggcccacaggagaagaggcaggaagaauauaagagccagagguagugguuacccauagcaagacuguuucccugauaugacaggaucugggugagcucucaguggcugugacuaggugcauaagaccuguguaagaucaagcccacccaaaucccagcauggauccaggaaggucuaugaagcccugccaccugcuaagggcuuuuugguaacugaugccuacugggcaggaggagucaguuaucuuuaaggauggagcgacccaugccccagcagauagucuuauacuugugcauguuaaacagacuuuaaaaaguggguuuaaccaaagacuugcacaugaacuugggaaggcagaaugguaggggaaaugggggaggggaccagaggggaggaaaagguggguggauuuuauucaaaggcagcauaagcaugcauacaacccucaaacaaaagaagacauuuuaguuuuuaaauagaauuuucagguugggauuuuugcucagcaucuuuacccucucaauugagcaagcgugucugggugaguuacauuguacuugauuauaauuuaucucuuguugccucuugaucuuuuuagaauguugaaaaaguuauagauaugcauggaucaacuguaggagauugcaauucugucacaugaccugcaggugaagacgaaacuaagauauauaugacuugugaaugaucagaucggaggcuguuaccaggugaagucaaauguaagucucacauauagugucucuucauggacaugucaugagaagguaaacaagcucuguaaacacugagcaaacauaaggauauaguuucguuuggcaaggcuuaagaugaucggcucacucuuuaaauccaguaaccaagcaccuagcaaaagcagcauuugauucuuagguauuaagucaugcucauuaagugaaugaaugaaugaaugaaugaaugacucuggaaauagguuuugguuuuuuaauaaauaaaaagggaaaaucauaugaaggcuuagacuguuguauaaagacagcucagggagauuacugguagucgcccacuuuaaaaaucuuuauauagaaauuccugaauucuguuauuuuaauuuuuaauuccuugauuucuguuuaauacuucucauguguuagcaaaauguagguguguguguguguggggggugaauuaggagauggcaagacaggaaaaggagggagaggagggacagggauccugagucaugcuggguucugauuuuguuuaaguguuuucucaugagucaaacuucuaaaggauccugauuuaggccugaagaucacauuuuuauaguaucuaaauauauucuucauuuuacuuaaaauacuuuccuggagucuugaaauucuuucagcacauuacugaccaggcaccuuuauucagccaggaccucuguaauuucucaaagugagauucaaacagggagaagagggagugagcucagggccacgugucccaacuugucaauuaucaucauugaugauaaagaaacugagauucaagcuaugugaugggaccaggggcuuuccgauggcacagucuucugaagacagaauccuaggggcuccauucucagaaacaaguauaauugcucaauacuaggguaauaaaacaaacaaacaaacaaacaaacaaacaauuuccaauuaaccucccccccgaaaccauuagaagguucuacaaacuauucuaagacugcacaacagaugaagaaaugcuuauuuaaaacucuucuaaauagugugaucaggacucuguggugggugguugaugguggcucccaccugccuuugcaucagaauccucuccacagacagucuugguccaagcacaacuaggacacugagcaccuucuuuccugagcucccaguccacagauauaguaucucaucagaagggauagaccagucuucucuaucuccuugaaguuguggaggucaaguucccagagaaaacagcuaacaaaucaggagcuuccuccauccacccagcucucagucacgggguagaguccaccucaguuuggguagaucaagagcaguggggguacugugcacuuccaggguacaggcuccaugcuuagaaagauaaacagagaagacaaggcccgugccacaguccacugcuaacaaggaucacucgaagcuuuugucuaagugaagagucagucauuaagaaucccggagcucuugacucuagcugcauauauaucaaaagauggccuagucggccaucacuggaaagagaggcccauuggacacgcaaacuuuauaugccccagaacaggggaacgccagggccaaaaagggggagugggcagguaggggaguggggguggguggguaugggggacuuuugguauagcauuggaaauguaaaugagcuaaauaccuaauaaaaaauggaaagaaaaaaaauaaauaaaauuuucuuucuuuuuaaaaaaaaaaaaaagaaucuaaaguucuaaagcucuccuuggggugggggugggggcuaacuucauuugaaacaaaaguugagaacaaggauauuaucaaaaccaauagaaagucagacagagucauaccuuuaauccuagcacuccagagacagaggcaagaagauauugaaaucuuuagccagccuggguacauagggagagucuguguuaaaguggagguuugggugggaggggauaaagaaaacgauuugggugcuaaacagcuaaggagaagcuaguguacuucauucaggcaaaaagucaaaugguaucccacuuucagaaaaccagggaaagagaaguauuaagggcccucugccuggcuucaaaaacuucuccuguuucaauuuaauuggaccagacugcagaacaauuuauaccucagggaacugaaaacacaaauuaaaaaacaaacaaacaaacaaacccaauagcaugaccaccuggugauuagugaagcuucauaacuacauaucaaccuguggucgcagaugagggacaagaauugacacagagaugggggcaagauggcagugcccgaccccguaacaucugugaauagauguauacaauguguuacauccauaaaguggaauauuacuuggugauaaaaagaagugaggcaaggcaguaugcuacgauaaagaucaaacuuggagaugccauucuaggugaaggaagccagacagaaaaaucaggugcuauaugcuucuguugcuaugacagaggagauagagagagucaggaaguaagcuaggaguucccuagaacuggaaaggggauuugagggggcauguagagucacuauuaguggaccugggacuccuuauggaagagauggaaauguuuuauacuugcuuauagagcuggcugucaacuucuguaaauauauuaaaaaacccacugcuuugcauauuuuaaauaggugaauugaauaguauauaaauuaugacucaacagcuuauugcuacuuaauaauaaaauguaaaaagaaagauauuuuaaaguucaacaaaauugagcacacaguuguauauaaauaaacuuugauuauuucacaugugauauauaucauauagccugcuauuuuggugcuuuguuaucuucuucucaucuuuauuuuucuuggucaucucuccccuaucucuucuuuuagucugugucauccauuauccuuauaaagauauccauauuaacaagcuacaauacaaauucacauauauuuccucacuguuaaauagcauauauauauacauguauauauauguauucacacacaaaggcuaguauauucagagauacauaaaauauguagggaauuuugauacuguuuaaaaaaaaagaagucauaucacacuuguuuuugugagacuuacuuuucugauccaauaacgucuuaugcaaauucuguuaaagaacuuauuaauuauaauuuaguauucauuguuauuguguuuuuuuuucuuuaaaaauaacugcaugagccuguagagauggcuuaguagcuaaggcuacgugcucuugcagaggacccaaguuuuguucauauguguguguguguguguguguguugguauucugucuaaacuccaccuucacaguuacaguugccagguaggcuuggcccacuauaaaagggggugcugggccccuccucucucuuacacucuugcucucuugccucuuccccaccuugugaccccucucuccccacguggucauggcuggccuccacuuaucuacucucucucucucucucucucucucucucucucucucucucucucucucucucucuuucucucugccucuacuacuuucuuaacuccucucuccaugcccuaaauaaacucuauuuuauacuauaccgugugugucugucccucagggggaggggaugccuuagcaugggcccgcugaggcaccccuuucacuuacaccccaccagaacauauccuuacagcucuuucucuuuucaugaucacaacacuauguauauauguaugugcaucuacauauguaugauugcauaguaguccauaguauggauaugccacaguucauucaguuuuuuuucugauaucucuaggauaauuugcuuguuuucuuuaacuuuuucagacaacauguaguuuuauaagaaauaaccaugaggagagguuacauaauacuuuacccauccaccccuaguuucucauucaauaacauaggcagguaagugacacugguaaacucuacugacuucauucugauuucaccaguuuuacaugcacacauuucuaugcguuucuuccuauccgaucuuauugugugugaaaucaugagaccaucauugcaggagcgauaaucucauauacucuuuuaugguccagcugucccucuccuuguauuccacaucuucuggcaagcauuaaucugcucucugugucaaucauguggugacuuuaagaaugacuccugggugacacauaccauacacauaguguaucuucugggaguggcuuuucucacucagucuguccuuugaaacccacacuaaugaucugugucaacagcauagaccuuuugauuacuguacauuuuuucgcagcauggauaaaucgauuuguuuaaauuuccaucugcuuuucccagagugaggauaccauuagcaaaauaugacauccccucagucacucuauguguucccaacucuggugacauuacaacuuuguaaccuucuaccuuuuuuuuccucuccuuuuccuauagccaaaugcaaccacuggauucuuuucacuuaccucucuaccuuauugugaaccaguucucaccauuugcugguacuuguuaagauaauuguguccuagucgauuucuaacauguccugguaguguuuuucuccuguuuaacaaaucauucaauguuuaaguugcacgcuuaaguuggcacauccucuucaacuugaccucgcuauauuuacuauagucaguaugauaaugugccuuccuaccuugggcucucuauuuucauuuccuuguagcuuuguuaggcuauuuucugaaacuguuuuaauugaauaaaaauaaaaccacuguaucaaacccugugagcuagagcuaaggugucacauuggggaaauguauagcacuggaugucuguguuagaaaugaagaacuucaggucagcaaguacuuaggaaauaugagcaaaacaaaaagaaauaaacucaagaagaacaaaagccagaaaauaaagaucaccaaggaaauaaauaaaauauaaaaccagucaauagagaaaaaucgcugaaaccaaaaguuucuguugaaaugaucaguaaaauugaauaaguuuauguccauaaauucaaccacucgggaaauggacacauguauugagagaugaacuacuggaucucacuuauggagagcugcauagugaagaguucucuguuuauuaaauguauuauauucguaguuagaaaccuuucuauaaagaaagccaaggacuugauggcuugagaggugaauuuuacccacuauauaagaaauaaugccaauucugcacaaauauuucagaaaaaugauguuagaccaccaauaauccaacuccuuaaccagacagaagccguagccauaugagaaaacaacacuguguauaccaguguccacugggcauagggggagagauucauaagcaaaucguggcaaacauucaagcuaauacaguuuaaucaaaguuuaaucaagcaccucuggcgauucaugaaagggaaauaaaaugaaacauacccagaucugaaaggaaaacaaaauaacaguguuccuguugauauaggacacaauuuucuauuuguaaaauuuuaugagacuuaacguaaaguuuacuaaaguaagugaguuuaacaagauuuggggauacaggaccaauauacaaaaaccagcuguguuucuuuauaacuaaccauaaauaauuaauaaaauuuaaauaaaaaucauuguaacauacaacaaugcccagacacuaugaauuucuuaggaguaaacacaucaaaagauaugagggacuuuauacuuacagcuauaaaacauggcugggauguaucacauaggaccaagauaaacuguucuauggauuguaacacucagcauuauuaacauacuuguguuucccaaaugccucuauauacucaauugaaucuuaauaaaaaucccagcagguguauuuggcauuagaaacugaauuauaugugaaauguaaaggaucuaaagaaauagaguggaaguauaaugcuuuaagggaauuugaugaucaaaguucagucaaaaaccuuuacguucugcccuucaaaauauacuguaaaaaaaaaagaauaugugaugaugcauaaaucauaucugauagcaaacauaugcauuuguuuuauuuauguauacauguauguaguugaacugucaaaacacagugguuaaaaaauaaaauagauauuaaauggauagagguguuaaacugggguuucaccagagauguauaaucaauaagcaugugaaaacauuaaucacugggagaaugcaaacgaaaucuauaaugagaucacacugauuagaaugcccaaacuagggcuggagagguaccucagcgguuaagagcacugacugcuuuuccagagguccuaaguucaauucccagcacccaccugguggcucacaaccaucuguaaugggaucugaugcccucuucugguguaucugaagacagcugcaguguacucauauaaauaaaauaaaauaaaucuuuaaaaaagaaugcccaaacuaugucucaaaaauacagaugccuaaaauaacagagucuaaaaacaucaaguguugaugaugguauagguuaauugugacauggaucgauuggaauucugacacugcuggugacaugugaaacgguacaaccacugacaacaacaguuucuaacaguuucuuuuacauggccauuccaaagugcuggaguccacccagagaaaugaaagcaugugccagacagauacuuggaaccaagaacucacaguggucuucucuauaauaggcaacaauugaaagcaguuuggaauguccauugaaagaugaacaaacaaacugugguauaucuauacaauggguaucuuucaacaacgagcagaugaaucaguacgugacuaauagaauaauucuacagagcaaauacaauacagaugccucaccuaaauaacauauucugugcaauuccuuuuauuaagguucuaugcagugcaaacucuucuauaaugauaaaacaaaccaagccaacaaacaaacaaacaaacaaacaauccaaauagauugacaguuccuaggaguaggaagauaaggaggaggacgaggaggaagaggagaaggaggaggaggaggaggaggagaagaggaggaggaggaggaggaggaggaggaggaggaggaggaggaggaggagaaggaggaggaggaggagggucaaauggaugaagcugaggcaugaaggaacuggcccauguuccugguugugggaaugaucuuauagauauagucaucucuuuagcaucaaaguauauacugaagcgcaugcugucucuugugcauucauauguaugggggcaugcagagagcaagggucaaugcuuccucaauuaccuucaccuuuauuucuuccucaguuaccuucaccuuuauuucuucagacaagaucuuacacugaacccggagcucagcgauugacuagaauugcuagcuagcaagucccaggauccucccaucuuuaucccaugugagcaucacauauucacuguccugcuccuggguuuuuauguuagugccagcuaacucaagucggcucaauuguguggcaaacacuuuaccaacugacgccucuucucaugugaugcucagucuuuuauagaucgaguauacauaaauaaguuggcuuuaauuuuuuucauagacauaaaauagaaaaaggaaaucaagugugaaguccagguaauguaagguuucuuagcgcagucaggggauguuucugugaaaacuuuagugcaggagaugccagacugguuuucuaggaaaagaguuguaggcaguagaaacagcguccuguccugaaugccagggugguaccuaguaggagaagccaagaaacucuuaacaggacucccacuuucugccucauccccauccaaaugauggauggacuguguucucacuccagaccuugguccagaaacuuaacaacuguacuaaaaucgaggcaugauuucaguguagcucuuuuagaauuaguuuucacuuuuuaaacaaggcaacuagaauucugauuauuuucugccaucuuuuaauuagcuucucauuaauuaggugagggggggguucuuuucuguauacuucauauacuuccucagcaugcacugauuuuguuuuuucaacaaauacuuacaaaguacuucuuguaccaagcauuuggcuaagacaugggaagagacauuugaacaccccugcucuugggcaauuucgagccucaggagaacaucaguuuaucccugaggaaagaggcucuugagagcagagggauuaaaaccagaaacgcgacuuauuauugugaccaaaaagagaagagaaacaucuuaagacaaaacaugggucugcaccaauagguguuguuuaguaagaugaaauagucaagguagagagaugcuuugucagaggcaagagcuguauuuguuaauuuggaaaacagcacuuggagacugggagagaauggagagcuucugacaagggcugaaaagaaaggagcugauuggcuccuuaaaaauguaauaaauauugguuaaaugcugaagugacagacagaagacuuuucugucccacagaacguguccuuccaguaauuuaagccauacaaaacagaagggagcaccuacuguguguccagacucaucuaugggcuauagucugaaugugcuccccaaauguauuugcggcaacacaguuuccaguguaacacuguugggaggucaggucauggcucugccaggcugacuggguugacuuugcuauuaaaaaugcuugcagggguggguucacucucuucugccaugggggaaaaaaacauguaagcuuucugccacgugaagacaucggccgagggucuccucagauacuggaggucagcacuucaauugggcuucccuguuuccagaacugcgagagaauaaauugcuguucuuuauaaauuacucagaguucaggugccuugcuguggcagcauaaaccauccugggauaaagcugugucucaccaugugagacaagucacagacguaugcugaacacuuacuauggucaggcuccguucuaguucugccacaccuauaggcuccuuuuguuuacacagcuaccuuacguguuagaccuacuucuaucauggucuuucuggggaaggaaauaagacacagaaucauuauaaauagucugauuucaucuauuuagccuugaaccuuagggaccugguugaaggguuuagcgaucacucaucuccucggcacuggaaggugggcagggacaccuaucuuuuugcagaaguggacccucgccugcaugcaugccagcuuguuuauuuuucuuguucccaucacguuuaaucgauuccuggccucuguaucaagcaaugaaaacaaaagcagguuggagaaggguccuaucccuuggguauuucuguuugaugcuaacaaagggcuucgcuguuucucuaagauugaagcugcucuaugggcuuaaccuggguacucggaagguuugccaugcauggcugcuuacacugcggggucgagagagauggcugccuccgugggaccugggagaacguggagguugggagcucaggccucugagccagagguacuuggauuucaaucuuggcucuucuccacuauuucaguauuugcuguugcuauuuuugacagcgccauagaaaaaguaccauuccacuuggacaaaucccuguggguaggcuguuuuuugauaccaugaaauggggcacgucgccgaucuaucuuguaauaucugaaguugagaugaaauaacgugugugagaaagcaccgugauacagaaagacgauuucaaugcaggggauaaauuauccuuacggccaagagaauauacacuuggguuucauuuagucccccaaacaaauagauuggucuggagccaucagguccuuucuucgccuaguucuucucuuuguuuccagcagacaaaaaugcauggggugagcuggcaggccaaauaacagaggaaagcuaauuguauggugaauugaucgcaagggcugaaugugugauacuaugccuuugucuuauugaacggagagccaagucuccggcaccaaucagacuagccuuugguauccgacugaaggcguggcuacgagaaacgggaugggacugggagugucuagaaaaagaugauguauuuuuaaucuccuaguuuugucauuuagcaaaaaagggaucaauaguuuuaucaccuuucaaauaaagccuggcaauuuuuuuuuagagucugguaaaagagcacacugaacuuuuaugaaggccgugacugcaugugggagagagccagcacauuggguuagcaggcaaugaccucugugcaugccagauuuccuguuucguauuacacaaugcgggcaugggagcuaggaaugagcagugcucaccccuguacgauggcguaggaacgagcccgacacuuuuauuuuuaucuggaaaacagcacucucugguuuuucagauccuaaauguccuccaggcugagauguauaaacuacauacuuaauacugcuucuggagaaauauuagcagugaaugaacaugggggaaagagauggacuuaaggauagcgcuccuucuaaugaugaaaggacaggcugggacagaaacaagaagcgggggucagagaccagaggaggagagggauuaguuacuccaggaacucugaaaugcugugggucaacagaacucaggaucccgaagccaagauguuaaucggagaaagcuccgagcucagacauugacguuuaaaugcuaacgggagucaggagcuaugauuuaauuuucccuuaggccucacauuuuauuugaacuaaaaacuucauaggaugcuuaagaaauaccagccuuuacuaaacagaucugacaacuuaugcacugggguauggucuaaaauaggaaauggaauuuaagccuaaaaugcuaaaaucuucuggcagacaacaaaauuauucauauaggcuguaccugacugggagagagagaaaaaaaaaagcccaguaauucaguugauuucauuuuguuuucucaucuuuuaagggaucuucuaaagucuacucaugaagagaagaaggugcuuagaacauuagugugcccaggccuccugugugggaacccuugaauuaaaaagccaagggguaaaggaauggguucuggccuuaaggcucuucuaggaugguaggaauauaacuaucauacagaguggagaaugcaguaauggaaagguguagggguuauuuaugaaguguaggaaugaagaaacggucuuaguuugguuugaauggagacuuuccagaggcuuccauuugaucuguaacuggagggcucaguaggcauuugugaggccaauagagggaugcuaggugcucacacagagggaccugcaugaguugguauguuucaauaacuaagagacccauguugcuggaauucaaaggcuuugcaugcaagcaugaggaggcauauuuagguacccaacuggcagggcaggcagacaggacacaaucccgagaccuguguguugagacaaaugcagcuauuuuacuuccugguaacaaauauaugaucaaacuucugccacacaaauaucacuuagagcagugguucucaaucuuccugaugcuaccuuuaagacaguuccucauguuguggugaccauaaaacuauuucacugguacuucauaauuguaaguuuucuacugauaugagcuacaauguagauaucugauaugcaagauauucaagauaugaucccuuugagggucgugacgcacagguugagaaccgcugacucagaggaugggagugaccaaauaauacagagaagaaaccaggaauagguaggcagaggaaaccuacugaguucuccuccaugaagaacuuauagaugaccuaacucaacacuggaaagucucuaaagcagagaggauuccauacauccucagucacuuaaaagcuuccacagugucugcaucugcugugaaagguacccagucugucgugcccccacucccugcagaagugaagcugaaggucgauuuuuucccauagagaauauuuugucuaauaucaguucaaaccuagacaauagucacagcaaauggacauucgcugaauguuggaaggauaauacuaaaaucugagauguccagguauccuaugcaugaauugcaaagugaagaaaaagaguuaaguauacaaguuuauagaauacgauugugaaggaaauucaagaaguugauaaauauggaaagcacuuagcauauaguagacacuagauauuaauaaaaaucauaauaaauauagucuaucauaacaauagucacaugcaguuauaguacuuaacuauaaucaauauaaucuauaaugcauauuuucauauuaauaaucacuuucugaauuauaaacaaauucaaauauguaucuuucugagauaacuggaaaucugaauuuuggagggaccugucacugaauguguagguucauauuagaaccuguuuugaaguaaauguacguaagggugucuuguuuaguugcuugauaaaggcaguugauaggucugugucuucuauugagaaaagacucaaaauucucugucaucucaauguuaaugcugauuuggauuuccuacugaauccuugaaaaccaguuguaaaugguugguuguauuucuuccuaucgaucuucagauaucuuuggguacagaagaagaguugagaccauuguagccucaaaucuaugugguguucuaccauuucaacaaccucauacauagaaauuuuaacuuuuucauguugagcaaugguugaaaauuauaauauagaaccccaaauaacaaaagucuagagcuggcuuagaaguguugaaugaacacaccaaagcguucuuauuccauaacauaaacauauaauuaaguaauuuaaaauaaacauugggucucauagugacucaaagucaugguaguuuuuuuucuucuuuuuuuuuuuuuaaagagcuuucuuucuguuuuucuuaaaacucggugccauaucuggggcccugucaucaacaguuguaggcacuacccguccuuuuccugacugugguaucaaauuucuugggggacuuauucccuucacuugcucucaucucuggcccuugggaagagguuuuugaacaucauuuucagagguggaccuagagcucaaaaguggugaagacguggcuuauaaagguggccccauggaugcuugcucucuguacaucucccucucccuugcuugugagccucagaacaccucggucuuaugaagauguuauuuucaucauuagaccacaaaacguugacuucuggcacucuagaagaucuccccucuugcuggcuugauuuuaaaaagguggggugaugagccacauacuaagggacuccggaaacuuccacccaacagccccugggaaaugugguccucaguugaacugcuuaaaaggaauucgguucugccaacaagcauucaagcgagcuugcaaauggcucuuuccccuguggagccuucagaugagcucccagugacugccaacacauuugauuaaaacauuuuguuuggaggagauagucugaagaaggaaccuaguuaagcaaugccuagauuucuggacccuggaaauuaaaauauguguuauauuacaauguuaauuuugugauacaccauuuuaaaaagcaauguaugacauauaucuggccauuuuucuagguguuugacacaugaccuaaauaagaacaauaaguuaaacaucagacaggagaauuguauuauugucccuccucuuguagaacugagagaugaaaggaaugggguuccuaaagauuaucacagggaguucagcaacaggauuuccuggaaaccugaaucccucuggacauauguagauguaugccuucuuuauaguauaugaauacagauagauacuugaaauguaccuuuucccccauaaacucauuugaguuguaagaccaugaagcaucauuaaauggcauuucauuucauuucauauccugacuuuacaaccagcauuuuaaccucuguauaaaaugguaauuaauuguugguagcucuaaguggacagguggucaacaaaggaagucuccacuucagaaccacuuugacuuuaaaauuaaucaaaagcaaaacuaaaaaucaacucaguagcacauaggaaguuaauugagagugaacagcauagcucugauguuguuuuagauucuguagacccuaaggucauuguauguuuuuguuuuaaaaguaauauacagagagcuggagagauggcuuggugguuaagagcaccaacugcucuuccagaaguccugaguucaaaucccagcaaccacaugguggcucacaaccaucuguaaugggauccaaugcccucuucuucugaagacagcuacaguguacuuauauaaauaaaaaauaaaucuaucuuaaaaaaaagaauauacagaggguuggagagauggcucagugguugagagcuuguucugaucauccaaagggccuauguucaguuccuagcauccacacaucaggauguucacaauugccuguuauuuuagcuccaaggagagccaaugccucugguuucuacaagcauuuguaauaacaugcacauagccacaugccgaagugcagcuuacaugcaauuaaaaauuaaaaaagaagaucuuuaacaaaagagucaguguuccaaaaaauaauacacagauacauuuucugacauuuugcugucuguggucauuuauuuaaccagucaaauaacauuuuuaaguucucaugaccauuuagagagggcuugauagauuguaauaugguggcacuaugggaaaauuauuauuagaguuuaaaacacuauauaaauguguauguuuccaauuucaaaauguauaucccauuuaauagaauuuugcauggguuauuuugucuugaguuucuauuauauucuuucuaugugcaugugugcccaugugagagucagcauggaggccaaaggucagccuuugagggcauucuuucagaacuguccacuuuguuuucagaugccucucacuauucuggaguuccccuagugggcuaggcuguugggccagggacccaucugccucaucucuuccaugcuggaauuacaaguccaugcugccaugccuagcucuuuuauguacauccuggggacugaacucauguccuguuuuguguggcaaacacuuuacuaucucucuccaaccacucuguguuacucuuuauuucuuuugauaaggcuggucuuucaauguagaacuguuuuucuuaucaaaauaguaauuggcaugaaaaaugcaggugucacauuuuguuuacuagccaaaauaugaagagccauucuuauugccuuguguaauuuaagguaauaugaaguuagucguuggcaaauauuauacagggaguauuucucuaacacuguaaauggugacuccaguuauugccauaucgaccugcuuugcuuacuguuuacuuuuuucaacugaccaugcuaacuugaaaaugacuuuggacagaucaucuaccuaaugggcuguagacagggaaauuaggaauucagaccacagcuaugcaaaauaacaacaaggcugauauuuuguaguuuuagauaugcuuggaauaaaauaguaggcacaaagauuuaugaaauccugucacauucaagugcuaguucaacuauugaccccaaaccaggcaucucuucaacucauuccucuuagccaucaaggacucaaccucauaucaggauaauaaauacagugcauuagcaugacaaaagaauucuaagggggccguguagaaaaggaggcuagcaauaaagcaaaccuuaaguuguaucauucaucuacaggacagcagugauccugagucaacuacacauuaugaaugccuugagguagacauuagcuuagaccucagggcagccaucuauuuuaaggaauuaauggugagaaggcaagcgguauaucauuugcccuaacaacaaagcuagaacaguaccaugcauuuguuuuccuccuguccuugacuaaaggugcauuguguaguaagcaguagcuuagggccauauaaucauuaaguuaggacugagaacuuuacaaagugcaagguuuuagcuguguuacagugugaaaaagagugagguguuaguugugugacagugucucagcacaacugcuuucuagucuauuguggggucaaucugaguaucuacauuauauguuauugagugacuugguuggauaauaacuagaacagugcuugggauauaauaauuccccaauaaaaacauuugguucagggcucauaccacauuacccuugaugacuguuauuucuaaaucaacaccaucauuuggcaugaaaaguucuucaguauuuggacacacucauucauaguccacuccuucuugauuaagagaaggccuucuauaggacaugguaaagccuaucacuuuuuaugauaaccuaaaaauuuaccuaagaaagaaaaaaggcuacacacacacacacacacacacacuacacauacacaucguaccacacauauacacaccaugccacauacacacgcacacacaucauaccacagacauauacaucauauuacacacacaccacauaccacccacacacauaaauuaccugucucacaaccucuccucucccuguuucuacuccuguucuccuaaccucucuuaccacuugugucuaaucucaccaauuuucucauuguagugauaauuuuggaguuuugauuucuuuggaaaacacagaaauauuguaaguauaugguucuguauuaaucucaggugugggauaugaggcuguuucagauuguccacagacacuaacuaugauuugucucacgcucuaguugaggcaugauuuugccagcuguagauaguuucugcaauugugugaccuuaggaauucugggggcuuuucggaaggcauauaaauaccaaggcccugauggaugggggagguugguuguuguuaguugcuguuaguugugguuuguuaaguagucgugugcaaagaagaaacaacaagaagaaauuagauauucugauagcaaagauccaucuucucccaaggaacuuggugccccuaaucaucaggaaguagucugaugagaauguuaggugauuuuugaccccugacuuuauucauccuuuccucucuauccauuuuccucuucuaucuaguguuaugggguugaaaggguggaagaaagaggguggagaaggguggaggaaagaagaacccauaaauagcaaacaaacagcuauaucucaugguucuaucuuauuuaaucccuaaggguucuuccaucucuucugcaaugcuuucuagaauauuuucacaaauaagucacugcuucccauaaaaauauauuuuuauuuucgugccuguuacaugagacuuuucacuuuguguuuuauauuacacugcauuaaauucauguuaaugccacauauuuuccaugagacuacacauucagacaauggagaucaugccuuuaccauaucugucuuaugcaguuccuagcagaaagugcaauuccuugaacauuuuaaauacagauuuuuuaaacacaugaauaauuauggggaucugucauauuuuuguuucaguuaaaaaaaauaaaaacaaaaacaaaaucccucccaggcaacuggcccaugcaaugcuuguuuuucugaacacaugaacagugaggcucacuccugcgguuuacugccuagagguccaugcugaccacuggauuccuugauuuucccaagacaggggcugaugccugaaauuaugagggauucuaacagguaaggaaaaucgucacuuuucaucucucuauuacuuucaaagagugaaggcaugguuugaaaggaauuagaaauauaaaaugagacuugagaguaucaggacccagaacaugauaccccaaaaugcagucuuuagggauguggagggcucuacacugaaggaggcuggggggccaggcaaggguuccuuaaccuccucgcuuccuuuuucuaucucaaauugagccaucucauuccuuccuucaugugccaggcacccugucucagggaggaaugagagucuaaaaagaccuuccuaaggcucacaguuauugguauuaguucagaaccuuuuucucuaaccauauucucacagaaccuucuucacugaaucuaagcauccaaacaaacuuucuuuggucuuugggucuauauuuuugaagguuaauuugugacauaaaacuucaugagauauguuuuacuuuucuccuuauuaagugguccuuuguuauaaauguaucaucuauagccccugugauaggaaaagaaaauucuuacuuuuucuucccuacaaagggaaucauguuugugugugugugugugugugugugugguuagucucagugucuuguucuuagaagacuaucauuuuucagauuagugaaacccaaccacucacuaacaugaacucuguguucuuauuguucuaagggauuucagcuuucaugaccuaggagaaguaauucuuaaagccucaaaggaaaacauuuucuaaauaguaaguuaauuaguaaaagcauuuuccuuuggcucuuccuuuaaaugugcaugauaaaucacacccacugcuauaccaccaucacuaccaccauuaccaccaccaagagagucuucacaagagaaaauauucuuucucagaauaauauugacuaauuugaauuuggaagauuaacacauuaaaaugcugcuagggugaaaaacaauucuuuuaaagagaaaguuuucauugaguauaugaaauauucagaaaggaauaaaauaucuacauuggaaucugaagaauguggaggcaaagacaauacaaugaccuucauuuacuauugcuguuuuagaugauuucgaugucauugggcauauaaaagaaaauguagauaauaaaaaguuggcuuuaggcugaugaaauuuucccagagcuuuagcauuucuaugaaauaaugaaaggaauaauacaaaaucaaguucaguguucaaggaacuuuggaaaauaaagacaugagggauuaaguacuuuucuuuuccuuccuuccuuccuuccuuuuuuauuuucuuuuaaacuuaaacccuaacuguuauuaugaaucuccaaggagauaaacaagaauuacuguguguuuaaauuuuuuuaaaguuaagaucuuauaaccugggcuuuaaggcugaccuugaacuuauccucuugucucaggaucccucucuccagagugcuggaccacaaugagcccuuugcuaccaaccccauuaucagaucaccuugaaggacugaaaacauauggagcauauuuuuugaaaugccauaccuaacuacucauaucuugauacaauggaaaauuaaaauaucaaagcaugguaucauauauaauaaguaauuuaccuauaaaaccaaaaaaagcacagguuuaagaugaaagggguuuaagcaucucagauagaugucuucuaaagaauggguaugguccuagauuauuagacaccaaugugucauuuaaaucugaucauucauaacacaaaauacucaguuuuaacuuucuuuauggcaaagcacuaugucuaauaacaagauaacaaaagccuuuaagaugacaaugcaucuuuucauuuggguugcaauuucaugggacuguaaaaguauauucauaagauaguuaaggcaugucaauaucauauauuaauaaaucauuccaccaugaaagcuuaaaauauuggaaaacuaauaugagaaaggaaauaauuuccuaagagaugugagaugugaaccugaccuagagggcuggaaugauacucauuugaaagaaaauggccuccauaggcccauagggaguggcacuauuaggaguuguggccuuguagaaaugauuguggccuuauaggaguggguguggccuuaugggaguggguguggccuuguuggaagaagugugucacugaggguuggcuuugaaguuuaaaauguucaugccaggcccaguguugcuuucucuuccugcugucugcugaucuggauauagaacucuuaguuaagucuccagcaccaugucugccugugugccaucaugugucccaccaugaugacaacggauuaggacacucaguuuaguucuauuuaaguugggauuguagauuccaaucccaguucugaaaaaucaccucucuuuuccuugaagcuucagcuuucucauuugaagaccauggcaaauaaugccuaagguacuuuuaagaggagcuccuaugguuggcaugacaaugguguuacuaugaagugucccuagccauauacaucaaacucaucaagauuuagugcagagcgccauuuaccauugcuucaguaaacauuucucccauaaaggacugaacaaauaaugaauguaguuagagaccugaaucucauuauucacuaccaaacacugugaucugaguagaaucuccucaacaccugccagcccaggcuucuuaucucuauaaaaaggguuaaaacauuacccuuaugacuaagaaccgugugucacuggugguuaaaugaagacaauuucaguaaugugcuuugcccaacagccaacacauacuuuucauuauacagagaucuuauaaauuacacaccuggagaguggaucuaaaguaugacaauuguguuaauaaaaagcuaccgguauaggacagaagaagcaguguucaguguguaguuauaaaaugaugcuuuuugucuuauugacggugucuuuugccuugcagaaacuuuggaguuucauuaggucccauuugucaauucucaaucuuacagcacaagccauugcuguucuguucaggaauuuuuccccugugcccauaucuucaaggcuuuuccccacuuucuccucuauaaguuucagugucucugguuuuaugugacaaaacgaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucauuagggaaaugcaaaucaaaacaacccugagauuccaccucacaccagucagaauggcuaagaucaaaaauucaggugacagcagaugcuggcguggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaguuccuagccaaauggauggaccuggagggcaucauccugagugagguaacacauucacaaagaaacucacacaauauguauucacugauaaguggauauuagccccaaaccuaggauacccaagauauaagauauaauuuguuaaacacaugaaacucaagaagaaugaagacugaaguguggacacuaugccccuccuuagauuugggaacaaaacacccauggaaggaguuacagagacaaaguuuggagcugagaugaaaggauggaccauguagagacugccauauccagggauccaccccauaaucagcauccaaaugcugacaccauugcauacacuagcaagauuuuauugaaaggacccagauguagcugucucuugugagacuaugccggggccuagcaaacacagaaguggaugcucacagucagcuaaugguuggaucauagggcucccaauggaggagcuagagaaaguagccaaggagcuaaagggaucugcaacccuauagguggaacaacauuaugaacuaaccaguaccccggagcucuugacucuagcugcauauauaucaaaagauggccuagucggccaucacuggaaagagaggcccauuggacuugcaaacuuuauaugccccaguacaggggaacaccagggccaaaaagggggagugggugggcaggggaguggggguggguggauaugggggacuuuugguauagcauuggaaauguaaaugaguuaaauaccaaauaaaaaauggaaaaaaaaauaaaaaaaauaaaaugaugcuuuugguuugacaauggcauaagaguauaaagcuagagagaaacagucucuaagugauuacucauaaggaccuuagaucaucauaccauuaaaccacaaauaagagaagcacagaggcucgcaaugccuauuaagccucaaagagcugaauauauugaacagaaguuuggacuuuucauuccagugguagguauagcuuggcagugaccugaagaaggaauuuugauaauacugccuuaguccauuuuccauaucuauaacaaaaugucacagcccaaguaaacuuauaagcaaaaaaguucauuuguuuguugguucuggaggcugagaagucagggaugcuggccccacaucuagugagggucuuuugcuacaucaucacgcaugagaaagcaccacagcacugacaguuacagugcugucagugggaaaacaggaacucaggcuuccuacggaucccugccuggaacauaagcuugcuccuguaauacucaugaacguuucugaacaugagugccagggacacauucaagccagaguaucauuuauaaauucuuaagcgguuucauguucuguugggacucugugggaagguuguacacaggaagaucuuugagguagcacuaggauucugagguauauguucuuugauaugaaaauuagguuaaaauguuaaaauaugagcuuaaucucuagcaccacaauggaaauaaaauaaguauuuaacuaaauaaaaaagaaaacaguucaagggucuguuauguuuuucuauucucuuugaagcauuuuuuauuuaggaaagagaagguucaguaaaucaauaaaauauacagauuauauugugaaaaucuguuuguguuucagaccacuaagcuuuuggcagcauaucaguuauuuaugaucuauuuugaugaaauaaccuucacuaucuagaaaaugugcucaguacuauuaaauacauuaguaaaauauuuuuaaguggcauuuuaauuacuuuauucuaguguaugcaugggggcugcaugugugcaugcagauagagcuuagagaauguguauaaguuggcucuguuucuaccaugugguccuugguauagaaguaaguuugccagccucggugguaggcaucuuuauccaguuguugacccuucaauaccuuuauaaaguuguauuaucgauauuaaaaccagugcuaugugcauaauuaauuuuuuuagcauuugcagauagaagugggcucacuuccagucacaaaagauaaccacugcacaagacaucguauaagaagugcucuuaauaucacauuuuaaauaauuggaaaauguauugaaacauauuuugaugaaacuaaagcgugacacaaaccaucugugaauaauauaacuugaaucuuuuaaaauucuuuggcuacauauuauagcuacucuaaagcaaaagaaaaauuaccaaauuauucuaauaguucuagucuccaaaccauuaaaaaguuuugccugucguuagcguuuagcauaguguacauaauuuaaguacaguacuuugaaaucuuuaaugugacauuucauauaauaguuucauaugaugcucuauucucacacuguuacaagguagaaaucuuugauuuaaccuuuuaaaucuuucugccuggcuaaucugucaucaaauucggcuauuuccuaguuuuucagaucugacuuucucuuugaauuucauugcuuacuuuaucccuggaauaaguuacagguagcuucaccauccucacuccugauauauaauaguuauaaggauuguaacuauuguuagauugcuacauaugcuacagcucauaacauaauacuccagcaacugagaaaaaaauaacaaacaaacccaaagcagaaugucauccuaacuuuuaccagucucucuugucugaagcauaaccaucaaugggguucucuaugcaccaugccuaaaaauaggucacaagacccuccuucuauaaggguccuaaccuauaaaccaaggacaaaaaagacucugagcaaacagucugccuaagcuaccuguaguuaucacacuggguuauacaccuguagaagaauuuuaguccagcaacaugacuacucuggcaagggaucauauccaaagaccuucuaggucugugugauccgguuugaguacagauaugcccuuaguacacaccuuuaaucacucugacuggacuauagcagguuguagccagagaaugagaaugagccagaagauuagaacaaauugucaagaguuaguuugaauccaagcagagcaaaucagugagaagccaagagaagccaguuugaaucagucagguuagagaggagucugagccagaacaucugaacugaaccaaccagccagaguucagaaaaaacuagaaagggugaccuuauuuagcaguaagccucugagaugacaauuacaacuggagaauaaaaguuacuuuuacacauaccuuuuuguuaugcaaucauaccugagggugagaacuggccuauuaaauaucuugaugauacuuaaucacaaaaauguuccguuuuccccugggucuuugaguuccuauuucugaaaucuauucugccacauaaaauucuugcuaaauauauuuguuaaagcuuucuuguuuagccucuuuuguuacaguaacaucagccuugaaccccacaauggguggugaaagugacaauuucuuaucccuuacaaugcuaaugcacaaaagagaaugaauugcucauugaucaucuuucugguuucccuauucagccaccaacucucuggguaauucauguaagauggauuuuccauucuuuuucagguuguaaauaugauggaaucauuuuuuaaaacauauguucaacuagaguucaucuacucaugggaauauuuauauguauuugaaaacugagcuacauuuaaauugggguuuuauauugaacaaaaacauaacugcauguauuuaucuacuauauaaccucaaguuagucaacaaauauuuuuuaaauaauggagugggugguauccuuuugcauauaggccacauacugauugcuucaagggccaugauagauguuauuguuuuaucagugaagguagacccugcucuuuucuucauauuguuccaaaacauggauuugauuauucgauuauuuuuaagaaagauuuuccuauuugauaaauggcacuuuuuucagagccuuacacucauaaaaggaugcucauaaggagcaaagcagaaaaauggaaaauuauuauagauuagacaucagaagagauguuucaacaucuugcaauguauugguauuguuagcauucugucucaaacacaaaguugaaaacauugagacaaagggaacagguaucagguuuaugacauauaguacuauuauuuuauauuccuuuguauauucuaauaggaauuuuauuauuucaaggaagcuguuaucuuuuagauuauauacaagguguuaguagacagggugucauggcuggcauucucuuuacaguuuagguacauacaugcagggaaggaaugguuagcauagaacaaaaccauccuggcuaagcuugaggguuggggcugaguauguauagccauguauguucagggcacaguucucucuucuuuuguuauauuuacaacuuugaauauggaaaccuuucauugagaugaagugaucuucugagggaaagagaugaagcagaacacauucuccuaguuuguuccacaaaugcuuucacaccaugguuuaauaucauacuggcuaagucaaucuauuagagguagaaucaugaucuuuaguuugccaaacacuuuaccuuuuacuuacuuaaugacuggauucucaccaguguagcauuuagcuggacacaggacuccaauaacaaucaccucuaguuucuacaucuaccuuccuugugguuuugaacauagucuuguaaaagaaaaccuaugcauagcaucaaacguugauuuugccaaacauuauaucuucuggcuagaucaagcaaaaccacuucccgacgugcagcagcugcacaaucugcuauauuugcagagagcugagauuggcaaggacuauagaaguuacuuaagagagaacuucacagggagauggagcacagaaaggaaaugccagggagaguggaauguagggcaaauuccucuggagaucacagagcaacagcaaaggcugggaggaguuaggucagcaggagacaggauaccacaucuaagaaagaggggggaaauaaaagauuucuuuuacuauuucaggaauaagagaaagcuaaaugauauacuuugcuccuucgguaggaggagaggaaaagcugauggcuccugagagugagaaaugaugaugcauucagucauuuuaaauagucauugacaugaagauggaauagaaguagggucacuauaacuuugacugggaaaugaaagggauguaaaaagaauauauauauauacauauauacauauacauauauauauauauauauauauauauauauauauauauauauauguguguguguguguguguguguguguguguguguauacauauauauauguguguauauauauacacauacacauauauaauauauauacacacacauauauauaucauaacuauuuugaucuugagauugauauguaaagcucacacaugauagaguauuauguagccaauaaaaacauuuuuaagacuuuuaaaugacaagggaaauuguuaccaauguggcauaaagcaaugcagaaugacguuauugucuggaauggaauaagccaaauuauuaauagcaauucuuguuguugguuuguauucguggagauuuuuaucuucuucaucuguauauuugauaagaacaggagacagaaaccugucauguagauaaaacaggaacuccagaaagcagugucucuggccaggaagacagaaauguucccaucagagacauugacucauguccugguuucagccuaagccagacaugccagaaguguuccagacagagacacuggagauugucagaaccucaguccagccaccaggauggaaaggcaccuggacaccucacggauagaccagcuggacugaccaguuggcccccuuacuuuaucccuguuucagccauaaguucuauguuucaaguucauucucuacugucgugagaaccaccacauacccaaaacgaauuuuggggaggaaaggguuuauuucagcuuauggucuaucacugagggaagccagggcaaaaacucaaucaagaaagaauguaaaauagaaauaggaaaugcuucuugcuggcuccaagguaggcucauauuuaguuaguaucauauagcacagaacacuggccuagacaguggugcugccccuagugggcugaaacuucccaaaucaaucaacaaucaggacagccucccacccuguacucucccccccccccccggccccucuccccaauacaucuacaguccagucugaucuggaaaaucccucaucugagcucccuucuaaggugauuuuaaggcuguaucuagucuauaguuaaaguuuacugggacauucuguaaaaaacuccagauuggacacuugguggcaacucauuucuuuggaccaguucuugcuauacaggaggucuuucugcguguguagcuucuacuuacaaaccuacaguaaacuuuuucccccuaaaacaccacucucccugugaucaugaaaaucacuuuuccaauuuuccagacaaaaucguggagccacugucuuauaugaccaucaacuucuggcacugaaaugccugagcuaaguccuccugaggcuagaaagccuccacugcaugcaagcccaccauuuuccuuuguuucauaauaauuuauuaaaauuauuauuauuuuugugugagcaugucucuguguauacauguauguuuggauauguuuaugugugugugugugugugugugugugugugugugugugcacgcgcucgcacaugccaagugcauagaucaaucuuggguauuuucucuuuuucauccauuuccacauuauuuuuccugagacagggucucccacugaacccagagaucacugacugucuauacuaggggcccagcaagcccuagggauccuccugucucuugaaugcaugucaccacaccaacuuuuuaugugagcauuggugauccaaauucaggacaucauuaucaugauuuaccaacugaaccaucuccccaaaacccacuugugagauacuguacagaguaaauaacuuucauagucagacauagcaauagaaauauguaaaguguaacucccaaaccuccaacaguuuaacgcuaaauagcucauuuaaauaagccauacuaaugcuaccaauaacuaucacuuugcuaaauuaaaugaauucuuuugcuuuuaauuucuggcuuauggcauauuucagcuacuccaaguuaaaauucucugccuaucuggcuugacucuucuaauuuaauaaugucucaccuaauaccuuggugauuauuguuaugguauggauguaaacugucccucacaggcucauguguuuacacacuugagccccaaauaguugugcuauuaggggaggcuaugggccuagcuggagaaagugcugaguaauccacuuucagggaugaugcuguuguucuuaguaggcaccuagaugcaaacaggccaggcuguaagcuccaacaaccaaaacuguagguacuuuguggcagucgagcugucaucucuaccaugaugauuguauuugaaucaagcugacuucuugucagcuauucagucacagcagaaaaaaaaaagagcaauaaauauaacuauggcuggugaccacagcuuuggcaauggccauggugggucuucaccauuaggcaugcuacagacugcuaccaaggucuaagugaucccuugaaaagcaagcaguagauguaagggggugggacacgugguggggagagcuuacuuuacaggacugacuuucuagcucgucucugggccauucacucccaagaacgguauggcucacuuuuugaucuuuccucaguaaguggugauaggcagaagagcggucuccagagauaucuacgccuugguacagggaacaggacucugaugcuuuauaaggcaaauaguccauaggagauguggguaagagugggcccuuugagauggggagauuaucuuggaucaccugggguagggggcauucuauccaugggaauucugaagagccaagcccucuucccccuccugcccuccgcucccagauucuccuagcugggcagauggaagugugggaaggccuguacccaucccugcuggcuuugaauaugguggaagagaaucauguaucaaaggcuacaaaaagggguuagaaacuagaaaaugcaaguaaauggauuucccuuauaucuacaaaaacauaaugcaaaauggcagagauuuuuauuuuaccucggugagacuugaaccuuuagacaaguuacagaacuagaggaugagaaauauauauuauuuaagccucuaugucuaugguugcaacaauuauuagacagcaauggacaagugccaugcucugauaggauuucauggcuuuuacacucuggcuguuuuguauaaaacucucccuuacuaaccuaccccacuugauuucagucaauaugaugcacuauaaccaucuaucuuaguuaggguuuuacuucuuuuuuuuuaauauauuuuuauuacguauuuuccucaauuacauuuccaaugcuaucccaaaagucccccauacccuccccccacuccccuacccacccauucccacuuuuuggcccuggcguuccccuguacuggggcauauaaaguuuguuuuacuucuaugaagagacaacauuuaauuggggauggauuacagguccagagguucaguccauuaucaucaagacaggagcauggcagcauccaggcagguaugguacaggaagagaugagaguucuacaucuuuaucuaaagacuucuagaagucuuaauucuaggaggcuaggauaagggucuuaaagcccauggccacagugacucucguacuccaacaaggccacaccuccuaauaaugccauucccugggguaaaauauacaaaccaucacaccaucauucaaaauacaacucaaacucaagugucagccccucucugaagcuccucuauuuccacagucccccaguacugcagccaucagagggugccacauuuaagauacaacaugaauuauccuggaauagguaucuucuuuucccccaugggacuuuaaauacauuugauaacaggaguuauuauauucugauacucagggaauauugaaggugaagcaacacuggucauaucaccuaguuuuaauaacugcuugagaaugcaugggaacccauugcauugguugcucacuuugagacuuaagaguagaaaggauuguguugggacucagaaaaaccuggcuucaaauacgcccuguuuagcuuccacaucccaaacaucaggaaaggccuuucucugaaggucccuaccuacauaaggacagggucugucaaagggggguauaauagguuucaaaucuucuuacugaaauuucauuaacccaaaccacagaggaccauggaacuaagaaaucaaaugcccuucccagaguccagaggagcucugucccaagucauuucucuguucucugggcuuauucauuucuccuucauaaaaauggcuuccugccccucuaugacagccuauggcucucuuucccauuuucuucuuccuuaugaagggaguauuuugcuccaacuaucugggccucaaauuucaaaauuuguauggcggucuucauacuaaugugcacaauaaauggaggccucuuuguuccguguaccuuucuguuguauguuuuagcaggcucaauuaucaaaucuucaaagggaaaaugugaacuucuucacugucugaaacuggaacaugcccaacauuuaaaauaacacuguagauuuagcuucugucagcaugugaauggagggccaugauuauuaggucagucgucaaauaccuugaagacagaggcacauuucaugguguguaaaucuuauuuaaacuacugaacauauucucuugugucagugacugaauugguaaguuuacacguaugaaguucauuggaaccaaacuuucuugauacggcaaaguuuggcauugaacccuacucacaugcggacuuggaaaauguggucuuugcuauaaugguauuaagucaacuaucauugccugacuccaccauucacaaguaugaagaucugcgcugcaugacagcuucugaaugguucccuuguaugacgcccccucccauaccuaugggcaaggggggaugaauagggcuugguaaugguaacaauaucugauuuuucagguuaggccuaugaauuccauugcuacacuuccacauuggucguuugaagagcauacauugaacagcaugcaagacaucagcucuacggcaaggaugcugagagggccugguggagggacucauuccagcaaaggggguuauuugccacuaucauucagauagcucuauccauggccauuuauuuguuuauucauccacauaagcuauuaucuaucauuguguaucaggguuuccccccacuaaauggaaucaagugagguuagguuagagcucaguugauauaggauaucuuagucgguacaggagauauaguauuaaggggauauagcuccguugguacaggagauauagcuuaguugguacaggggaauacagcucaguugguguaugagucccuagguuugauccccagaaacacauaaacuggguauggcgcuaacaaaccuauaaucccagcaugcagggggcugagauagcagaaauacuuuaaauuuaaggccaguuggggcuaauuaguaugaccauaucucaaaaagcaugcccaccauaaagggggaaauaaaaaaaaucuuaaauauuuugcccacugacaaacgaucagauuuauaguuugcauuuuuucuuuuagggcaucuuuggagggaguuuguugggccagggucucacauaguucuaguggccuccaauccuuuaugguagagggugaucugaacuccugauucuuucugccucuucucaaaugcggagaugacaagccugcagcaccaccccaggccucugcagacacucuccccccuuucuguaacugucuucaguuuguucuuugcuagacagaagcuuuuuauuuuguuguaaucccauugguugauuugucuccuuuuacuuuuauugcuugugaucugugucuaugcagauggaauggcuagacaguccuccuuaguauccugagauuuagaaauagaguccuggagcagaggccaguguuucuaagcaaggaugguaggaugguauauguugcuguuggucuuuugucuccuaugauuaucagcaugacauuagcccugagacuuuauaaauacuugugaggcugugaaaacauuauguguguguaugaguguaugugaguguaugugugcauggaagugugugugugaguguauaugagugaaugugugugaguguauaugagugagugugugaauguaaguaugcauguaagugugugaguguauaugagugugcgugagugugugugagugugugugugcaugagugugugugaauguaugugugcauguaagugugugaguguauaugagugugugagagugugcaugcgugugaguguguaugaguauguguauguuauauguguguguauguaugugugcauauguguguauguguuagugugagugcauguaugcucuauagauuaagugggaaaguuagugaucucugcaguaguuguauuaagaauuauuguagaauuuaagaauuaaauacccaagauuuaagaauuaaguacccaaggagcuaaagggaucugcaacccuauagguggaacaacaauaugaacuaaccaguaccccuggagcucaugucucuagcugcauauguaucagaagauggccuaguuggccaucauugggaagagaggcucauuggacuugcaaacuuuauaugccucaguacaggggaaccccagggccaagaagugggaguggguggguagggaagugggggggagggucuggggggcuuuugagauagcauuggaaauguaaaugaagaaaauaccuaauuaaaaaauaaauuaaaaaaaauuauugggauauaauguagaccccaguuucuaagauugcaaaaauuuuggcaaugguaaaaaaaaguaugugaagguccagugaucagaguaauuaaaagucaauuaugagggaagcagguuucugacagugcucucccauguugcauuguguaagcucacugcagcucugguuucuaucacacuaugugcacacuuuguauuagauguauccccgcaccguggcacaccaaugaacacugcuuaaaacaccucggcuccaagcugaggccacugcauauaaugaauggcagcacuuuuacugcauagacagguuucugcucuuaaagaaacaugauggcuuaaucagagaaaacaaacacuuaaugcuuuuuuacuauuauuuuucaccguguaagaaucaaagaauauauauuuaaauugcauuauguaagaauguuugauuuuugaaaauuguuguuugaguugccgacacaagucucauuaaaaaaaaaauccuuaaaugaauuuuggcuugagauuaagacagaauuuccaaaaauuucugacaaggcucuaaauauacuucugccauuuuauacuauguacuuaugcaaaguagaguucucagcacuuaugauuauaaaaucaaaacauugaucaacucuaaaaaacacugaagaugcucuauguccugcaguaucaaauauucagucaaggcuuaguacccuguaaaacauaaacaagcacacccauuuuauuaguaugcaaauuugcuuuuaucauuaacaaaugguaagaugacagcaagaauugcuuaaggaacaccucuuuguguuuuauuauugguaaguguuuuauuuauauaccuguauacuugaagccacaucaaaguuucucaaacaaaaggagucaugagggaagaaaaguuuagacauucugggcuagaacuagugucaccucuucaccuugucuaaauucaggaaaguugacuggagaacacaggagacauaaucuaaaaagacuagguaggcaacaaccugaggaguuucacaaacguaggcaucguucccuuuucuuuucuugaucaucucuaaggguuuguugcccaucugaagagaugcucaauggaaggcagagucaagugaagaagugguagcuacagagguggggacuuuuaacagcccagaaugcugcuccaucgcucuugauuugccaugauuccugaucugcucuggauuuggaacucagucacaagaaaacauuuagcuacacucaggaggcugaggcaagagaauccugaguuugaggucaaucugaacuauguagaaagacccaguaucaaaaaucaaacaaauaagacauaagaaaccauaugaccuucaggcaacccguggaggcucaaaucuauaugcaacauuugauauguauucauaaucauugcgaugguuaauuuuaacuguaaacuugacuggauuuacaaucaccauagaaacccaccucuggguauguuuccagaaagauuuaacagaagagagaagacuuaucccaaaggugggcagcagcauccuacaggcuggggacccagaagccauaaauggaaacguaagcagagagagaacacuuggcucacucugcuuccuacagauguggcugggcagccauuuuaccuucccuggaugcucucccucaagcuggaaaccaaaacaaaugcuuccucucuuuauguugcuucuugcaucgcuuucauggcaacgaggaaauuaacacaauccugugugugucuuucugagauggcugaguuuccaccagauucucagaagaaucugugaccuaccuaaaguuaagugucgcucaaugggaaauuaagagggugacagacucugcaugaacugccauuuaggaguucauaccuuaacuggaaguugaaccacagugcuaccuggagggaaaaugcuauaagccacgagaagagaagguuaauuguugcaugcugugagcuuggccugcuaucaaagcaauaaggaggcuuuuguuguguagcagagaaaagaagagucacaggaaauggguaggagagauagcugggaaagagaucacucaguguucugucagucacucuaauaacugugagauuuauucugauuaugacaggaaaauguuauugacuaaaccagaugguuugauugccagaguaaguauucaaagcucacaaggacaccaggcugucucugacaaauguuauuucccaguagaaaaagaagaucguagaaacucaagauacagucaaguaucccaggacugcugaauaaauacuccuagcucacuagucaguagauauauuugaaaaugacuaauaaggaauguacugugcuauuauucaagcuaucaggaaggauauugauuuaauucuuucuggagaaguugaauaaauuuauuauacuuuccagagacuuucccuuagggaguuauuuuagugcaaugccaauauaugccucucuucacugagccgaccuuugagguaugcaggaguuugcauguuaauucucucucucucacccucucuuucuuucucuccccucucccucuuacacacacacacacauacacacacacucacacacaccugucuuuguuacuacaaaggcaaccaaguaauaaacauuuuuuuaguaguguuaacaacaauaaaauacaagaaaucaaaauuaaauuacaugagaucuuugaugagaagaugacgggaaagcuuagccuucagcucauaccauuugugugugcaugugugugugugugugcgugcguguguguguguuuucagagaaauugaauucuuacaaaugcuaguaagcuuccacuacuggguugaguuacaaccucagcccuaugcucaaguuauuauuauuuuugucugaaagaaauaaaagggcuuaauuuuucaauuauugaauaagcauguacuuauuaagggcuauuauaugcaauacacacuuccaagagguauguauaggaaggcugugaacuuugggcuucauuuacuuuucuuaauccauucauuucaacuaucauuaauuaaauauaaaccauauaugaguuacuauauuuagacaaaaaguaaagcaaagagaaaauaauuuauaguccaauaaaaguuaaauaaagcaauagcagauuuucuaauucuaaacaaaaagaucugaauauuucuuuuuucauuuuuaagagacaaguugucauguaucccaggcuuuuaaaaaaguuaugauguagcucaagaugaccuugaacuucugaucuaccagucucuacccucuggaugcugggguugcauguaagaaccaccaugcccaguucugcggggugcuggggacugaacacaggaccuccugugugcuagguaaacaccuuacaaacugagcuacauguccagcuuaagaucagcauauuuuuuuuucacaugaucacuguugacuuuuaaucucuagccuauguugagguuuauucuccucuacugccuuugguuuugcuuguagucaguaagccuacuggaauagacggauguacuaguuaauaauuaaauggacagaugucuaauucucaaugacaauuuagaugacuguuuuuggugucuccuugggaagugcuggagcuugcuccaauggccuaccuucuauaacccuuguggcuauuuguauguccacauacaaugcuggcuaugucaugggaaugccuauucucgguuaagagagggaguguaugugacuaaagcaaugguuggcucuuacagggacagucaacuuucccucugaagauccuacauuucuaucugcugaaauaaacugucacuagauuggcaggagaaaagucaugacaaauauauuuuguuaaugaaaauaauuuuaugguuggggaacaccaccacauuaaagggucacagcauuaggaagguugagagccacuguuuuaaaugcgucuguuguaaacggauggcacucuccauguuuuucuuacaaggucccuccagcuuggcagcuaugguuggaugaccuguucagccaaggauuccaaggcuauuucuagucuucccaugacacaggagccuucagacugaagaccccaugacccagggugagcagccaugcagaaauaugauuggacagaaaggauaagggaauggaaacaggaggaaauccagaggggccugacuguuucaucuucuuugccuuucaaagauacagcacuucuuccugcacauuuuuuccuagaauggaggucugaugaaccacuauugaucaaggguaguuuuuauggccaacucuuccacagaaggaagaaaguaauagcuuuagguuuuauauauauggcuuggggggaaaacagguuuugguuucuauguuccacuuuggagcauaauucuuccaggcucucuggcuuucacaggagagcuuaagaggugagggacaggagggcuagaggaguccagggagaaucuucacuucuaggcugcuucgucaggcuuggguaucauuuucuguauccugccgcucuccuuuuagcauuucgauacuggacaguuacuuuaaucuugcuucuacaauuuaaaagcauccauucuauaagaaagucuaauuuagccaaacuucccauccugcgaacaccuuguuauauuaagacgacgguggaaacguaauaaucacucuagccccagacuuuuuuuuuuuuuuuaaacuacagaaugccugcacuacugaugucaucuguuccugaauuuugucaucagguaccugucuuccuuuguuaaaucaccgccaaggcuugggaggacuaaaacaaugaacauuuuugcuccucuugguauugguauugcaaaauaggcaaggcucugccaaagacuucaaguggucuggcuggggucacugguguggauauauuuagcugguguuaucucuggagguuacagaggcagcugucugugucuucuuguagguucagaauccucucucuccaugugucccauauucuucguuccucuaagguagaggggcuucuuccugggaucuuucccggcucucagaagucccagagauugagcuccggaauggaaacgauugcuuccaucacauucuuuacaugacaggggaucaucuagucagucugaugaagguagaggaauccuccaaggaugcacagauguaaggcugcaucuggccuccgacauaaucauuaaugauaacauaaacacugccuugcuuaaguuguaaacaaucagauugacagaaaaccuaagaagcuaggacaagcucuucaacaguuagaaggguccuccuccucagggccaggacccacaggcuuugcucuccauggcccuaauaguacauucuuccuggaaaucaccuuaccuugauuaucagucuucuucagaacagucuauuccuacuuucaauauucagcgagguugcuccucucuauuguggcccuggguacuccuccugcaggagaccuugccagauaaccucagaaucaaugaagcccuuguucccgggcuuuuagaauguacccuauauuugucuguuucucagaaguuaucguauucuaauauaaugucugggaguuuaucucguggguuugcauuucuagauagauuuuuuacauccugcaggcaagagauaaaucuauuuuuugugguccuguuguucuuauauacuaaguaaaaauauguuaagauggagguaaaauaguagaaaugugucuucaauacucugguaucaccauauuaucaagaauaaugcaaggaacuuaguauuucaacaaaugguuguugaaugcagaaaucuauuucuuuuagucacugcauacaaguauaaacccugauuuuagugacccaguaaaaucuucagcaagcuucauaacaauuucaauuccuagcugggaaagaagcaauaugccuuaggcauaacuuuucaaguaauaucaauguuuaauagcauaaaccuuucaggcaggggcauauagcuaaaaauaaaucuguauccauuugaaagugcuagcuaaaauucuguaggcauguauucaugcuaccaacacaaaacuguucucuugccucuacaaaacaaaaugagaccuacaagaaaccaaauuguuuuucuaagcuugacaaaaaugacugcaacugaaacaagagauggucuccaaggcaaagaucaagaguaacuuggagguggguaaauucuaguauccgcucuaaaaacacacuuccuucuuauagaucaaguuuccuguuuuaugcuugauggaaaaugauucaugcaucauagagucugucacucagaaaucccaaacaagcaauggacuaccauuccaacacauguguguacuuuguacggucuuuuccuuuuacaugcuuuaugaggagcugugggucugccuuuaacaauguucucccuaaaauuugaaaucaagaugcugaaaggugauccuccaaguaguucaguaggauucacuaagacaacagagcaucauaaaugucuccuccagguaccauuuuguuccagauuuaggaagcucuucuaagaaguuuauagacaucuuguagaagguagaagaguaggcucacauauauggguuugcaaugcuguguguguguguguguguguguguguguguauguaugagagagagagagagagagagagagagagagagagagagagauugauuuggugaggaauagucuaauaagcaaagaagcuccaaauucuagguucugaaccuuccucagggucaucugugucccccaagacuuucaaggaccuguauguaguuaauaugccuauaauucuaauuuccaaaauaaaauuguucugucuuuggaaauguauacaacaauagcaaaacaaaacuacaauuauugauauuauuuaucauuuacuaccugcaguauacugcaggcaaacauuuucuuggaacacuaugaaauagguauuugcugucuucauuuuuaagguuaaggucagagaaaguaccuuuccugguuuauaucucuaguaagagugugagaggcaaagccauguccuagccauucugaauaaaaagucuauggcuauggcuauaauacccugcauguacucgaucucaucacgauauaaagucuguaucgauuccuauaacuaaucaguuuaaaagucgauguccuccauuuugagcauccucaggaagugaagucuuguuccccgagcuucucaauggucacgggguauaccuauagaaauugguugcaaugacuuugguacucauccuguccucaacuuaaucuuuuaucuuuagggacaauaaaauuuuagauuccuucugacauuacagguuuuugacacccagugaguacucagaaacauuggacugaaaucagaccccuuguaaaucaagaugcccuggagguagggauauuaacuuaauauagccuagaaagaaccccaucuucugucugcuguugauccaaugacucuuccuaugcucgaauuuagcugugugaagcacaaguacaaaguggaacagauagcauccauugguggacaagccaugcuaauuucuguugacuggaccauugaagugguaaugaggcagaauuucugccuuuggccagaacaaacccugagcucuuuugucuugucauucaucuucucccugggggauuagcaacccaggcagauaguuccuuucuuaccaggcaaaccacaaacuucuuggugaagugacaagaaauacucaccccagugcacaucuucccaagaaggcccaaggugcaaugcuagcucucuuugugauucccaggcaacccagucugccauaaaguacaguucagagcauugugcuacagggaaagacaagcaaacagaagaaaaacaaauccacucugcauagugauuuugucuaauguggcauuugcacacaugagcgaccacaguucuuauggaccgcugccagccuaauuuauccccaauaccuccugaucaugauguuccccugccccuaaacccaugcuagcuuuaucuccugagacagcuaggcuuuaaguuaaaaguucacaacucucuggcaaguuuacauuuccauauuucccauuuucucagaacaggaaguucucaagcaacaauugcauuacuuguucagugcauucccaugccuuagaaagcauuggauuuucuucacuuguaaaucaaaauucuccaugauucaaguuccagcagcugacuugcuccccacaauaaacuuauucugaccuugccugcuggcagacuccccucuucagagcuuuaacacugguuuucucgcaguauaaauacauuuucuuucugaugguuuuauguccaucuaaccuguaggaccuggcauucaauaaauguuuauggaaugaauaauguucauuaacaauucugaauuaauguugauuuaaugaagacuuuccauuaauggugucuuuggaaacaaaaaauaaaauagaacguaugccaauucauuguuuuugaggaucagagacaauuugaagucucugcaaugccuacaggguccgcagauucauguguauucccuaaggguuuccugcuguaggcaccugacauugaauacuguuaacuucucugcuugcuuaaagugugauauugcuccaucaccucuccuucagaagcccgguucuuggcaagaaaaucagugauacuuccugcccuagcauguauauuauugcugugaaaacacaccgagcaaauccaacuuggggaggucagaguucauuuaauuuuuuagccuauggucuguuguggaaggaacuugggacaugaacugaaggcaggaacuggaggaugacugcuuagugguuuguucccuaugguuuauccagucuccuuucuuacacagaucaggaccaccugcccuaggguagcacugcccacaucaauccuuaaucaagaaaagaccaucuacaggauacauggaaaauacaugaaacauuuucucaauuguaguuccuucucagaugaaucuagcuugugacauguugauaaaacaaaccacaaacaauaaccaaaacaagguaccuuucauauuuagagaaaacaauacaugcucaaagauccaggcccuugcccauagucauauuuagcggaaagaguaggcaggauucacacccaggguuauauggcuugaaaucuagucuuuagauuuugguguuuguuuguuuguuuguuuuucucuaauacuucacauuucuuuuugaacuaaaguguuuuuuuuuucccuccuucaagugucaggaaaagccaguuauaccugccagugaccugcuuaguucuaauaggaucguggaggcuguagcuucauuucggugcccuugaggccaacuucucuuuacagaacccggagcucucugagcuggaagcaugguggucggccaaucuuuugugguucguuuguacucuuucugucuaaccuucugugauacacuucuucccuaacacugucucagaggccugcaagcuacaaaucuggcaacccuuacaaaagugcagcacccaggaaggguugagacuagcuaauugggaacaugaggacacugugcagaguuucaucaaauguagauuaucucuaaguaccccaaagagaaacuuuucuggguuaugaggagauucgugacagacgaggcagacaugacaggggcuccuugaaauaagaaagcaguaucaaaguuugauacuacugcaaguaucaaucaccuucccugaggacagaugauaccaaauauccuuucaugaauucuaagaugcaauccacucccauucucagagcucuguaacuggaagguggcuuacgacugagagugguaaaaagcgauuagagcaaaacagcagucaucauaguuauuacagccuauggugaugaaucucaguugucacccugaugggauuuagagagagaucccugcauugggcuccuauacuauagaaaaggagagaaugggcugaguacaguaaguucuccuucucugcuuccugcuaguaaaugcaaugugguuagaugcuucaaguuccuacuauugaauuccucacugugguggauuguaucuugaacugugaaccagaauaaaucuuuucucucuuaaguugcuuuucucaguauauuuuaucacaauaccuggaaaauaaacuaagacagagcucuuacuuguguaucaaauuuacgaggagcagaaauuauaaacugggcugaaaugguugugugucacugcaaagccacccugugagcuccaggacuuuauucuuuuauaaaucguucaggaaaugucccagcaacagccugagcacuaugacagagucaguguaggccauucagaaaucucagacaaaacaacacuucaugaaguuuggcagaguucaaagucuuagacaagacuaggacuuuagaguccuugagaaacauggacucuaaagccacugucaaucucuauucgggaagcaugguuugacacagcauucugugucauagaauuuuauaacugggcuauuguaauagaauaucaggguacaaauggcuguuuaggauauaucuccuagcuuccuuugcaacucagugugaccauaugacuaauuuuagucaauaguuuguuaguggagcgaaauacgaaucagagcaucaugguuugggucuuuaaauacuccccuaaagcauauaugguaaaggccuggucugcuggcacugcuggaaggugacggaagcuuaguuugcggaaguccaucuuucggagugugccuuggaaggacccugguuuuucuccuucuuuccccuuccugacuaccaugaggugagaagcuuccagcuuucauaggguccugaccuaaguucccaaacaguggaacggccugaugaaggacagaaaccucucacccugcuagcugaaauaaaccugaucucuuuacauugauaucaccggcaaauucugucacagcagugaaaugauagcucaaacacuggcccuauccucaagaugucuacuaugaggaacacugaugggguagagaaacuucaggcauuuucuugcaucaaagauagaagccagguuuuaaaggcagcagaaugacagaaauaagaaguuaacucauugagcuaucucuguaggccuuucugcagcucaaaugaucucuacuuccuugguuuugucuaacucauucucuccugcccucaucaaccugacuuaacuucagauacacacgggucacucuuguaagaaaguuuucucgaucaacaauccuggguuucuucucugagcagcugcuguguuuucuugcauucuacuuuccuugggauugccaaucuuuuuuuuaucuuuggugaaaggagucuuguuuucaaauuauacuucuauacuuaaaggacauugucuuuuuuauucucaagucccaguccaguucaucucaaacuuccuauuacaacuuguagcuuccuuagguuagacccagcgugaaccauaucaccuacuggcuucuuuuuucucucccugugugacucuucugguucgucaugugccaauaggaaagucaaccagcagcuuuucccacagccccagaaaauagggcccucaccuuuucuugcuuuucucugagcucuuuagcugggcaugucugauacaaacuaauucucauaaauuauuauauaaguuuuccuuuuauuacacauuaucuccaauccuuaaaacaguucuaaaaaggaggggucuuauugcucuuauacugacgcucaggauggaccagaugucugcuucaggaagacuuauagaguuaaguacagagaucuucaaauagaaaccagucugcauuaggcaugguggcagaugccucuaaucccaacaaucagaaaacugauacacgaggaucuagaaugcaagggcacccugggcuacacacaagguccccauauguaaagcaaaacugaggauauaacguagugguagaagacuugguuaggagcauaaggcacaagguccuggguucaacccacaguaccacaaaacaaaaggaaccccaaaacccaggcugcaucuuuccuacuacauagagugcuuuucaagccaaaauuaagacaaaggucaaagcuccuggggaaagaagaacaaggacuuagucguuacaucucaguacaggaaugguuguaguagggaaguaaagacccuuucugguuuccuggccuagaggauagacuaucacaaggaugaugagaaucuuuaagaccugcucuggaaaauaaaaaggaaaucucucaccuuuugucuaagucccacggaagauucuuccauuuuucugaccuugacagauauuucucccuaagcccucugaauuauuacgggauaaaauggcuuauuuuaauuucccuggaugucuuuauugaauucuuucacaguguuuuauggaaaauaucuuauuacugauucauagaauagaacauuaugaaauuuuaugcuaaguggccugccacagugguauucaggucuagaagcuucaguacuccccaguucugaccuggucccugcaggcucaaaggggggaugcuaagcuccugcauuuuacaguuuaccccaaucacugcacauuguaaguaacuaauaaagagaaagugguggagucagagcugcagaaaaagcuugaaaaaugauaaagcgaagcaugcgaacccugaagucaaaagcuugaguuguggaaucagacuggaucugaaucucauugcuucaauuuaaaugaaguuggcaaauuuuccuaauacucuuuacccuucuguaucauggucuuguaaaguagagaugauucauagauuguuccagaauauuugugaggauuacaugagaugacauaaaugcuuugaagcacaccuagcuuauaguaaggaugaccuuaaagguuacuauauuucuugucacuaagaggugcuaagagaaaaauauuguaggaugugaaagacccuguguguguucaucccucccaaugugaaucaguaagguuguggugcuuggcauaauuugccucauuuaccuugguuggugagcacaaugcacaaggugacaauguccuaggugacaagauagcuuucucuaaauaaggacaugaaucccucauugcagaccugguaauaacaggugaaacacauuuccagugagggugaaccuuauacugaucaucauuaaacuuguuucuuacugauugcaggcuccugaccucccuuuacauagagugcuugcuuuauaaaacuuguaauuauggaauucauguucuguucucuucuuuauauaugagcuuuuuuucucuagccucuucaaauuuuaucagucagaaauguguuuucuaaggaccugggacucaugccuuugaaauacaaccaucaguaagucuggcuuggccaugguagggacagugugacaugguuccuggccuuggaggacagccuccaggguguggaccucuaugaguguugaugguugcugugcacauauuuucaaguuccgcuuucgaggaauauccucucugucgugguuaaugacucucugauaaucagagacagcaugaguccgggaggugagaguguauguagugucucagccaaaugcuaaacauuuggaccuucaggacuguccccaaggcuguggaaaagaacucugaaaacaugaguucaaaaguauauaauuucucaacuaugcaaaauagaaggaugcaauaugaauaauauaagaagcuucacagaucuaaaagaaucgaggcagcuguacuaugagccagcuugugagaaagauacuaaggagggaagauaaagagauuuagggaguggugauugaaaggcaagaucccaacuagcuaaguguauuguuuuugcucacagaggcaggcagauuccagaguuccaggucagucugggucagagggaauuuagguccaggcccaguaugguaggaaugguaauuucaaggcagggucccacucagcuaacuuauugucugugcuuaacaaaggcaggcauaucucugaauucuuuuauaauguuaaaaaaaugugcuugcugucuaucuuuaagaaucuuggggcuggggucaugagaugcugauuuaagggauaaucgaaggggacccugggguaauaacugaauugauauguaaauaaaagacugggauuuugaucugaaagagaugagcuaucaagagaguuuuuagaagagaaagcugucucgagcagaacauagagagaacagucuaucuggaaaguugucucaagcagaacauaggcugucagcuuuuaacccaugauuugacuucaaguuguuuguuuugcuccucucagauaccccuuccucagaacccuucuccaagcagagacuggcccuugggaaauaagccaauagcuaggcucuguagaagaguaggaaccuaauuuugauaagugguaacuagcagaugacuuaauuacacagagcagccuguccugcaguguccuucaguacucuccacuagcauaccuuagugcuuagaaacccucuugcuucagcauuaaaggucaucucucacccauuaugacauuaguguagaauucagucuuccaggccuguuuaccucuccuuaccauaacuuuuauuuucauauucgggugggccauaucauguuacaaauguuucuaugaaaaccaaaaaugaacaauaaaagaaaugccuuguuucuccucaccaucaaaugagauuuuuuuaaauauauauuuuauuuuuauuccucccagaauaagggaggagugaaagagaaaugauuuacagcaagugacagggguagcucagauuucuguagaucaauuacagaccucacugaagauuuagaaauuuuuagugcucuaguaaaaccagcagucucagucugugaagccuggccaaugcccuggcauugggcuaucaucuacuuccuuagacagucuuucguuaagaaggcugugauuugagcagaguuuucaauagaagauucuaugaagaaagucauggccacuuuaauccccagcaaggauaaacuagguaucuccaaaccuugaagaagcaaguaguauguguaugcacacuuaaaguguaccagacaagcagauuccuggaugucagagccuuugcuuccacaguguuuggauuucaguggcauaguaucucuuuucucucucuuccagccuccagcuacacuaucgaaguaggugggacagagaugaccuuuaccugaagcaagauaguuacuaagcacugaagcaagcuaguggacaguacuuaaggauacuucagggaagguugccgguacaauucagccaccuguguuaguuaccacuuaucaaaauuaggcuccuacucucaacagagcucaggagauuagcuuacugauaguuguauuacaaaggcaugacacucaggucauuagaaaauagccuccagcuuccaccuuccaauuuggucucaccucugggccuuguucuuaugcauaucccacugcaggaccucucuucuccucuccucuccucuccucuccucuccucuccucuccucuccucuccucuccucuccucuccucuccucuccucuccucuccucuccucuccucuccuccccucuccucccaucuccccucccuuccccuauucauauuuuuauuuauuuauuggguagugggaaauguguaccaugguagguguagggagaucagaagacaacuugaggaagucaguucucuccuuugccaagcuugguggugaguacguuuaucuauagggcaccuuaucaguccugcccuacccuguuuucucuggcuaguuucuuugucugcagacaaugagcuccagaaucauuccaccaagauggaggcuauagucagcuacaugaucaguuggccaucuaaagccuuccuaccuguccauggacuuuucugaucucaaugccauggcuuugauagaaccaggcuacuucuuccucaaguuggaagagcagaaguacaaggaagucggguuccuccugaaaaaaaugcagaccucaaguggacaugucaucucccaguacauagucgcugugucagaaugagugagguaacacaccagaggccacugaggcagucaugcccuggagaaggacuuguaccgggucuucucagauuuauauggucuuguucuucucauauagacugacaccucuguggcugucuguagaaccauuuccuauauaaggaaaugaaacccauuagaaacacugauaaguaacuccucaaucacugugggcuggccuuccuccaggauuuuauaauacucaucuuuacauaucaaucgaacaguucucucucucucucucucucucauuagauccuuuccuggcguguccagugacugcccagugucaguuugguguacaugccucuacucaguuuugcguauaaaauuacuauuaagauguacacagugaaagugugcauaaauaagaacuagaaggcucgggacaugcacacacacuaagacucaggucaaagaaagccuugcugugaucaccauggggacauggauaaagcuuaucuuaaaaauuguugcagugacauaaaaaugaaacauaaucaagccuuuauucaaacuacuaacucacacagacuugaauucaaaucuaauaaaaaaagcacuugauuauguagucauuaacaggauucaaauaucaaauaauuaucaaauuacuggcacugacagcuguagaauuuuguuaaaacaugaauguuuaacucucaugcaugugggucucugucaucacauuuguuuaguaaauuggcagacauuucuucuuuauugaauaauuuagacgauaaaguaaugcauauucucuguaaaaauuuuaaaaaguuuagaugauggcaaaauauaaaaaucacaggcaaucuuaugaagagacagcaaccacugaugcuuuuacauauguccauguugaccucugacuguuggaagaauacuguaugucuucaagucauuucuacuuuuacuucuuauuuugcuaauacaaagucaacaauugcagcuuuuauaaaauaggcaauauacuaaaauucucugaaaccucuugagccagaguuuaauucaccuggacagagucuaagcucccagagcuuaaaccucccucaguacugauuucuuccauauuccuacuaagauggcccauuaagccccaguuagauaaggcauucuacuguuuuccaaauccaaaauccugaaauccacauuccuccaaagaaaagcauggucaugccuaugacagcaauacccuagucccugguagcaacuucugucuuaguuuggguuauacugcugugagagagagaccaugaccaaaguaacucuuacaaaagaacagcauugaauuggggauggcuuacaguuuuagagguucaaugcauuaucaucauggcagaaagcaugaagcauccaggcagacuugguaucagaagagcuacgugaucuacaucuugauacaaaggcaggagacucuuuccacacugggcagagcuugagcauaggaccucaaagccuaaccccacagugaugcacuuccuccaacaaggccacaccuaaacuaacaaggccacaccuccuaauagugccauuucucaugggccaagcauauuuaaaccaccacaacauugacuguaacucaucaaauugauuuuuuucccucagcuuuuuaaaguaaggguucauuagaaaggucagagcugcccugaaauaugcaguugaagcugccccaaacucaagauccuccugccuccacuccugaauauaaauguaugccaccaugccaggcuaguauuuuuaacuugucuauauagacuacuugcaacuguucauuguggaugagcaaaugauguuucuauuagguaaacaccaaagcuacacacacacacacacacacacacacacacacacacacacacacgcacgcacacgcacgcacaugcgcacacacacacuuuugcaaucuuuauuuucauagaucauuuugucaaauuauaauuuucuucuuaucugcauuucucuucuuuucuuauaacugacuauccacuguuugucuggaguauauauuuccauccucucaugccauauaaucauauacagacauuaugguuugaaaacaaauccaugcaauauacauuaauaucuuuucaacauauuauaauaucuaauaauacauguuggaaagaaugaacucuucuuuguguuuaacuucuuucuuuuaauagaguaauagauaaaaaggaaaagagaauauaaggaagggagaugucaucucuuaaggcugacugugcaccaggaaugagaucgcuuuauuucuuauuagagccuccuaacuuuuggaacaaguauuguuucuuauccuuugacuaagaucaaauguaaacacugaagauauuauuuuacagauguguuccauaugaagaagugaggucuggacuacagaaauaauuuccucaaggacacaguacugguaacuguuggacuuagacaugcaaaacauggugacacaacaaaauuauuuuuaagggaguuggaacaguaacuccaaaauaugcucgccaugcaagaacaaggaccugaauuucacaucuaaaacccaugucauuacccuaccuucucccagaaaaggcugaauuugaugguguaugcaucuaaucucagcucuuaggaguuggggacaggcagaucuaugagcuuguggcccagcuuugccuccuagaugagucuuaggucaaucagaggcccugucucaaaaucuuaaaucaaacaagcauggaugguaccugagguauaguaucugagguuauccuuugucccucacacgaaucuaaacauacauauacaccugcagaaacaugaacauucaacaaacacacacauacaugcacaacaauaauagauaauaauagugagcuuccuacugaaagacuuuaucuucucaaaguaguggguuuucauccuaggaaauauuuaugcugauguugguugauauugauuauguaucaggaaggcuaucagaagcauuccagguggauaauggccccuguucaaacccuccagacuucuucuauaggauuugauauuuuguugaacuuaagcaauguaugcucacuguauuauuuguuaauaacugauacauuauaggcaaauaguaggccacagacuauuacucgacaaguucacccuuaagauauggcuaauauuacauaugaccauugcaugcaauuucauaaguagagacuagaaaccauauuugacagucaaaauacauauuauacaaguuauuuuaguugcaaaggacuauuugguauacauaguaucaaauucuggugucuauugugcugagcacaguuguuuggcuuguugaacaagacuucuugacagagacugguugauucaggcuggccuagcaacugcuguaauucagauucuuacauaaauauucuauuauuaagugauuccucugcuuuaacccauccaaacuacauggcuaaaucauucagucaaguguuacauaaaauaacaauaaaaauaagucucugaauuuagauaaaauagugugcuugucugcuaauguauucuacuacccaccuuccccaguugguucuauuaaaaauaguacuguaaagagaaauaaaaaucaaaaauaaagcaugcucguugcaaagcguuucacggagaggcuuuuauguacaguuuaaagguucauggggaagugaauguuccuagaggcgaggaaaacucuuccucugaacauaagccacacccagaucacuauuugaguucuggagcauugccaggugugugcucucaugugugagggcugugccucacucagacccaucaccacucagccuggccuuuaggagggcuucuaagcuagccaucaccuucagcgaaggggaccauuagacuuuaccgagaguaagugagaucauggggcuaucuuugcugccagagcuuuguauuuuccagugaaugaccuaaaauucaucuauccaauauacaacauacucugugaucaaauucuuucuguccuucuuuggguaguuuucauuuauaacuaaaacuuauaugaaauuuuuaggaaauaaaaugcugguucauuucugugcagauacaauuuaacuugcaggauacaaaaaugcauccuuaaaauauguuuaaaaucuauuuuuauuuuguguauauauuuaucucugccuuucauguguguaucaugugcaugccuggugcccagaggcuagaagaggaugccagaucccugggacuggaguugcagaugguugggaacugucaugugggacugagaacugacuccagguuccaugcaaaaucagucagugcucucaaccacugaaccaucauggcccuaaaaauacauuuaugggccagccugauggcuuagugaguaaagaugcuacucacaaagcuagauggcuugaauuuggcuccuaggaaucaaugguaggagagaaggaauugaauaugauuccuguagguuguccucugaccugcacacacacacacacacacacacacacacacacacacacacacaagaacacacaaaccacacagacacucacacaccaaacacacacacacauacacagaugugacugacacacacauucacacauacacaccuacacgcacacaugccuauacacauauacacacaugcacacacacauagaaacacacacacacacacacauagaagcacacauacaugcuuaccugcauguacacacauacagacacacacacacaugcacucacacaaacacacacuaaauaaauauauguaaaaugcauuuuaauaaaaugcugcuuuuuuuagacauguaauuccaaucuaacacuguccguccagugguacucucuuuagucuuaauggacauucuuuagagguagggagacacuucuaagcuccaccacuguauuguaacgucuggugcuugguuagugcagccugaggagacgguuguucuugcuacuuaaauggaucucagucucaucaagaagauuaucaauugauuuuuggaaaguacaagaacuugaagaaauaaagagcuuccuugugacauaaugacaauggcuaaguaauaaagucagaggaagauuucacauaaaaacugcugccuacugauacuccagcuacaaucuucacugaucagaaagauaaagcagauuuuccaaaugucuuugugugucaugcacucuaaugagaaaggcaagucaugcauucauagauaagaagacaagagaauuuacacuucauugauugcuugcuacauucuaggcuacagcgauaaauaauacaauaaaaauaggugaggaaguugauaucaaagaggcugcggucagucgaaaaauuagaaauugaaaccaggaccauuuaauuucaaaauugaaacucugcaaaacuucuuugcgugcaagccuagcacauguagacacaacaguacagaacauccuaucacaccacguaugcaauagugccuaagaacuggacauggaaguccaggguggucaguaucacugcauucuacuauuuaccgucauuuauuccacaugugaaucugguuucaagugaaaagucaggaaugcuuguguguggaggaauuuuaauccagcaauaugacuacucugguaaggaaaucacauucaaagaccuucuaguucugugcacccagcuggaauacacacuuuuaacccuucuggcuauuuuacaugugacuggagaaucagaaagcucaccaacaaugcagaaaacagaggacauuggagagaaagccucagagaagggauuugccugggaccaucuccagaggaaacagcagucuuuuaaauucagcuggaugcccaacaagacucaugagacucuggagccaugggagccucgaacccagagcaaggaacaacacuggagccucugagacagggaaucacaguaagcccucccaaaagguaauuugaaugauauagacagacuuuuccugcauuaaacaaugggaacuccaugccaaaucccuuaaguccaaggguaggacuugaggggauaggaacauuacuugaaaaaaaaaaucauugcaguacuguugcaacuguggccacuggagugaacuccucccuacuuuaaauugcaaucuuuauauuuuuuccucccaaaaaaagguugaaaaaauagauauacaaaaagaaaaauuaucuaugauaauacaaaggcuugagagacaagagacaaaggaaaagaacaggaaauacuuaauggugaaccuaugguaccuacugaaccugaggacagcccauugacaauggguaagaagacuggcucaauggcauggugccagguaugaaaugcaaguaucuaaauaucuaguuuauguguggguucauagugaucuaauugcaccuuugauaaacaggaaggggaaauaugauuaauugaaggacacugaauuauaaaaaaaaaccugcugaaauuuucuauaugcuguauguuuuaaaauguuuuaacaucagcauggaugucacagaauguguuauauuggggaugauccuccauccucccccauaugggacagcucaauaacccaacugaagaaggacagaucguucuucagauuggcaaacugaaaaccaugacacugaaauggacauuugcugaaggacagaugaucaggacugcaguuaggaaggauccuugcaucagugaaucuucauaaggacauucagacuguuagguuugugguuuugauaauugcuucuguuguaaaguuaaacuguggaugauuuuuuagcuuaaauagauagggggaagauguagaggaauuuuaauucagcagcauggcugcucuggcaagggaucaugcccaaagaccuucuaggucugucugauccaucuggaauacacaccuuuaaccccucuggauggaauauagacucacccuuaguacagaccuuuaauuccaaacaaugauucuuauugaggagcagacaaaguaaugaaucagagaaagauuugacagaaugagucagcgauaggaucuguccaacucucaggagcacagcaagaauauaguagcuacugaagagaagagaacagaagagaagagaagagaagagaagagaagagaagagaagagaacagaagagaagagaagcgaagagaagagaagagaagagaagagaaugauaggaggggaagggaggggaacaggggggagagagagagagagagagagagagagagagagagagagagagagagagagagagaagauggcaguuuuacugggacgguuuuacagagacaggcagaaagaauaagcuagacacaggugaagacagagugagccagagaacgagaaugagucagaagauuagaacagauugccaaaguuaguaugaggucaagcagagcaauucugucagaaaccaagagaagaaaguuugaaucagucagcuuggagaggaguuuugauucagaacaucugaguugaaccaggcagccagucagaguucagaaggagcuagaaagagugagcuuauucagaaguaaacuucugagaugacaaugacaucuggcauauaaaggauacuuuugucuuugugaaaauuauaugcuugcauaugcaaaguuagaaccugagaacuggccgagaaugaagucaguaaauuucauuuguuuuuauuuuuacuuggucucagacagcugagcuugcuggauaaguuucaaaugacuauauaauuagugaggauuccacccccccccccaaggaaacuagcuccacugaguagaaccauuguuuuaugauauugucauaugauuuacacugaguccucucucugaguucuuucagauuuuuaggauggauaaugagaaaguuccaacuuuauuccuaguuggucugaaacuguuuauaaguaaaccucuaauaugagggggauggggguggggacauauaaaugcugaagcugagcagguaggaacauugccugucuacacugauccuuuauguaccucuauuauuuagguauuucucccccugaaauugccuuuuuaagcaagaaauucuacaaaugcuuauaaauuuuguuaauaccagucauugauaccucaguggcuuucccaagcuaaaugcuauugccugauaacuccuacucuuuauuacaguauuuauuuucacucauucugaauuuauuuuccacuaauuuuacuguguauaucaucucugcugugugugugugugagagagagagagacagagagaaaggggagagagacagacagacagacagacagacagacagacagagacuaaugagauuucagagaaguuaauuuagaacaauugaauaaaaaauauauauacuuucucuuuccuuuguuaggguucucuagacauuugaauuccccugagggaacugggauuuucugguaugaauuuucuaguagauuucuauuccaguugacaaaucaugacaguuccaggaaauuuaguacauuuaaugcuaaggucauaagaauagcuaauaucguaagauacuuucuuaugauaaagcugagagauauuuuguuuguuuguauauucaucuuuccccugguaugucaaggugagagcuaaaauguaacacacaucuacuuguacuauacaccuuugaacacgucucuaccacaauccuacauuagugucuucauuguaagugugcuaagaucaagcagccaguagauaggcuguacauuguucucuuuucuaucugacucucuuuucauuauguuauuuucaaccacauucaguacccaaaauguuauuugugaaguaacaucuucaugugguuguuauguguguauguuauguguguauguuauguacauguguguguuauguacacagacauaugugugugugugcguguguguguguguaggggguguguugcaggcuguuaaagcugugauuuacgaccagccuaaggaccaauugaaauguuacaugcuauggccgaucacuuaguuuauaauuaguguguaauuaagagguaaaacuaaugcaccuacagagccagccuuugucaauaauaaugauucuuuguggauagugccucugauuucauuucaaugccaaugcagaaaccaguaaauaaaggggggcaggcagaugguaagagcugacacacaaaaacacugcagggaacagccugcggauuuguuuaauacugaaauguuaauauuucuucauuauuuuaaugauggucagaucugggguucuuccauaacuuucaaauacaggauugagaauguugaaacaacacaucagacuuuuauacuugguauguguuugugugugccgguuugcuauggaauucacauauuuuuguuuucaccauuccuguuuaacauggagauggucauuaugcuguaaaccucgcuguaggagcuugagacacaucuaguaucaagguuuaaaguaauaugcaugccuugguaccugcuaccaaucucuagggagauugcucuagauauggacugaucugauauagaacggaguaucagauauaggauggggaagaauuaugggagagaaaguuuguggcugggcaguuaacugucccacucucaucuuuccacacauguaaccaggcugcaaaaucaugcugucuuaccgguucuucuguaccaccgcugagggacaaccuggcuugccuuggaagagcaauagcaccaccagaguucucaauguuuacucaacacugcagccuggacagcugaagagcaucuggcuggccacugccuaaggaucugacaguucccugaugaggcacaugcuguuguuagccauucuaggaauuacaguaugggacuuuaagcuacccuacugaggugguaagcuugucuucauuuaaauuuugauaguguguuuagcauugauuuggcauaguaauuuugaaaauuuaaacaauuccauuaaaauacuuuguguuuagaugacuacaguacccgcuaagaucuugcuuguuaggcaaguaccuuauucaccuuauccuaggcugugcucugaugagggagucuaauuaauuucuuuaguaugaauauagugauuucuaaaggcauagcuaauuugguauuugacaucaucuaucagaguuaagcaaaaagucaguaaaaugguuccaaguggcuuucuacucugagcugaaauuauagaagaaacucuuauaggcauauauuaaaucaugaugguaaaagaaauucuucaagagauacucuacucggcacuacaggaucaaagaagaggaguaacauauaguuuugccaaaugguauuuaaaacucacaagcuguuaauuacuuucgccaggauaaauggaacacauugcugaaugaaaaauagcauaucaaaugaucagacuuugcgccacuuugaagcgcuuuguagcgcuuugugauccauuaaccuaaaguugaaacuucauucaucaagauuaccugacaucauaaaagagcaacguggggaaaaauucucaauuugcccaaucaagacacucaguugacguuuuaggugaagguuguugcaucugagaguugaaggaaaucauuugcagcuacucauuauaaaauaggacauuagcuaaggacuuugcucauuuuucuggcuauugcuuaagcagaguuacugaucacaccguggaagacaguuuauguauuuguggucucaccauucaucccuucaaguucacuguugauuccaacgucaaucgaauucauuauuuugucgaucugugaaaagugaaaaccaugugagaggaucguuuugugcacuuuuaucauugcauucagaaauugccauuaaauacugcaaucauauauucuuggugcuacuaccacagccaacuaaaacucagagaccaacaguacaagauuuaaaggcaagcaaacaucuuuuguuuuuuuaaaaauacauaacuuaugaacucaccuuuuuuuaugcauaugugacccauuaacuuaggaacuaugaagucuuuaaacccagaaaaagaaggggaaaggacagguucagugucaaggucuauguucuuugugaccauucuccuacccucagaagucaugcacucuucacugggagagguagguuucaguuugugggugcagcuauuagagucauguucuaacugaaccggucaaacaacuacaagcucgcugguggcauuaaugaaagaauauagccaccaaaacaacuucagucuauaaguuacauguuucaauguuaucuuacaaaaagguauuccaagcaagauugcaggaguuaaaaauuuaaaacuggauaugcuaauaagaauauugggauguggguuuggaauuuagauuccaaauucuagauucuagccaucuacaaucugcccauccuguauuagucaccugcagaaaauggaaggugucaagaggacaaugaacaucacccaaguguucccauuuguucagugugaaagaaaaaaauauagagauaucaacuguuuucccaaacagcucaauuuagaaggucaauaucagaaucacaucuauuuuuggcucccaggauaccaaagugaccucauguacuucaaagauaaauccacuuggcauagcuuuuucacaaacaagaaugugacauguuaggauaaaauaucaauugaaaccuguuuccauucuuuaaagaaagucaagaaaaagcaagaaacaugauuauuauguuaugaugugauucucguaggaagaaaugagacuguacaguuuuacaaggggccuuuauuuucagaauaauucuuucagacuuugucucuaagugggguuuagagcagugagaccugacacuaaagugcuuuuucuuguuuaaugugccugugauagcaacaaauggaaaauauucaaugauguguauuugcucucaaagaagagccaggacugcuggcuuuucuguuaagacuaaaaucauaaggaucuguuucgaaaaucaaagauacuuuaaagaaggaaggcaugcuaacaaaacguuuagcaagucgcuaaaugacacagcaaaguaagauuuuucucaaacugucagccggcauugccuggugggacaugaugggaggggucuccugcaccucacaguuacuuauuacuucugcuugauagcaauuucuauggaaacaaagugucccccacacauguagcaaugcgcucauuuucccacuugcugugaaauuacuguauauuauccauagaaccuuucccuuccaguuggaacuguaugcauuuauuaacaacgccuaccccuccccccccccacuucagcaucugaaagauuuuaaaaacugaaaaucuuucuucugaacuucauucaacuccaaagccuacauaaagagcaacaagaaaagcuggacuuacuucuucccauucagaugugaaagaagguguucucucagaauuaucuuuggaacugcgcuccgcaguugacgauuugcuccaguuaacucucgcuuuguccuuggaaggguaggcaauaagaucagaaucggacuuggagacauuuuuggauaaaugcaugucgaucaaggcuuuaggcaaugaccuuauucuccccagaguacaugcucucuccacaaagcccccuggauucacaccccauuggucaccauugcgggauccacuccuggacauucuugugccaacgaugguaugguucucaaguuggugguuucuuuuguggaaaauuguucuacugaccacuuuggguuuaacuuucuucaccgaagguuccggguuguuuucuauuggagucugcuugaaaggcaaaggacuguuugccaaacuggcuucaucugguccaucuucacauguauuucuuuucccauacagaugaaacggauuuucaggagacucacaggcuggagaggauccauggagaaggccugcgaauugcccagcaucauacucuuuuggggguucgucaucuuccugcugagagagaucaucugcaaaaaggaagagggccgucaggaugcuugcuuacaaaugacugguagccaccaaaaaguggcaaugccuuugugaacuuuuauauacccaggcauuugauguauuuauacaucgcaacacauuagcuuuaggaaaugcacaugauccuauacagccacauaucaaaugugcaugugugugugggaaugggcuuaugcgugugaauuaaaucacuccgauaccuuguaggguucauuugaaagacauaaacugagaaauuccaguggcuauauaucuuuccuucuugauaugagcauauauguuugauauuaaaggaacaaaauuguguuucuucaaguggggcaaccauauccugagucucauagauagugguuauugugugguagaccaucaagcugccauuaugcacacugacaucccucuacgcuucucucaucaaauacauucaaaaccaaaauccugggagggaggggagcaguauauuuaguaaaaacuuaaagauucauaguccugaaauuauuaguuucaguauuaagguaacacuauucagauuauaugaguuaaaccaaaggaauuuuuccaggcucagcagaggcaagugguacguuuaucacuucacucaaaagccugacccuucaacacaacugacgcugagccguacgcagagcuugcucuuucuccuccgaaacagcauaccuuccgauuccuuuagaucuuugcaagggcaacgcagaaaagaaaucaaaggaguauggugauuuuuuuucauugccuuagaaauguuucuaagauaaaacauaagaugucucugugguuuaaaauacauuaucuuuccuuuuuaacgacuugagugaucauauaaagagacacugagugaaaacuucuccaaagggcuuggcaaaggaagacaguuuacuuuguuuuacagaaguaauaucaauucacaggcauagcuaaauauuugccaagaaugaaguuaugcuaugugauaggccgugagccucguccugaaguuagacacagucagcguggggcauacugacaaaacacugaagccgauuggcugauucacacccggaaaagguucauuguuauuacaagacucaaucccccaaaagcuuaugaauuaacaaguaacauuuaaugaguauagucuacuuucuaggcacugaauggagaauuacauuuguaccacaucauuugauccuuauagcaacugugugaucugguuauuaacaauaaacguucuuuucugauagggaaaagauauauaaacaaaauaacaaacuucccuaguuuugaaacauuggaaaccagagcaaaucucagcuggaccagucaaaucuuggugcucugcauggacccugagccucugugcuucucucccccuacagcugguaaaagaauguuucuucuuggcucugaguaucuuccaaucuucugcugguucauggcaggauuuuccaagaagaucauauuuucccacccagacuuaucccaucagcaccccagaauagaagaaagaaaagcaacaggaauuaagaugcaacagucugagccaaaagcagucugcaucugucuacuucuguguaaucuacauguugguuuuaccgccaaaacuccaucucuaugcaaauagucuucaugucuaggucaaccacauuuugcauuccccuuucaacagagaucacucuugauugaggcagaggucagaguugggacaagacacuaugaauucuuuaaugacuaguguuuauugcuucuuaugucuauuuguuaagaagucaaagucgacacagaaccuaacuugcugaaaguuucugugccuaguagaaguuaagcugugacucaaccuaaggucuaacagguuccagaaucuacuggcuggaauacauauuacuacugaaauaaaagaauaauuuaguguuggcuuacuaagagaauaauaaggaggcucauauuaaagagggucauugcucucuuccucaucacuauuuuggaacaugaggaaggcauagcaaaggcaguacuguuguguuugaugugcgugccucuucucagagacaagccaauacuaggaggacaaaagacccucaaccucuuccaguucauuuucucauccuucuuccugggugccuuggacucuccacuguacucugcagcaucagcaggugggguagaugaaagucaugguaggaaauggucagaaaaacgaggaauaaggaaguuuaaaauuuuauucugaaugucgccguaaagaccaaagugauuuaguuuggaaggaaaauugaagagugugagaaaccuauuaucagaaaaaggucuguaacucuuagucaaaggguuuucugaucauguuaguuaucuagaauaaugagauuuuuagggacacuauauuuaaaguuuaaaggauucugugagugauaguuuaagguuaccaucaccucuguguuuugacuaaaaugacuguaauuacaaucucgagugauucguauggaccaaucucucaagucacaagcagccacuuccuuaaaugaaagggaauuuaguucuuagcuuguaagcuuagccuuugaauaacaguccuuagcaucaugacgguugaaaauauguuugccugaagugguagaauaguucuugcuuauuucaggggucaaaauuuaaagguuauucaaaucaaagaaaaggagacauugauuugaaacuuaaaguguuugugugguaaacugguggcaauucauccaucuacugcucagguuuccugaggccccaccccucccuguagccacauucucccuguagccacacccucucccuauagucacaccccuaccuagagccacacccucucccuauagacacaccccucccugcucccaguccuugacacugacugccacugggaacaaguguuuuacauuggugaaagagacagaagcaaacacaaugugugauguggcuggucugaaaggcgcuucuacauuucaccagcugcucuuggaaucuugccagcugaacuacuggaugaugaggugacagccagcuguuugaaaauguaauuuuuuaaaaaaaaauauuuuuagggaugcuggagucaugaaaugaucguaauugguaaaaagguagacuguuauacuuaaagauccaagaaaagaauacaccucacucaauggagccacaggaaugcacaugaggccagauaaaagucagaggggauaggaagagauugugaguaagugucuuuuucuggcauuucuggaaaggaauaaggcgaagcagagguaaauggguuuagacuagcuagugggaaugaguucagcaggacagucuuuggcugcuuagugccugacccuggguaauuagagcaaccucagacauguaugccaagugaucacggaauaaccucaagugcugccaggaugagcuaaagcugucccaaguggagcaaacgaccuggacucaugagcucaaagaaugccuauuauacuuaaagcccccagucucugacacaugacuggcucacaucaaaucccaaguuuucacaaaucaauaccuucuuuaaaaaauaaguuuugcagugcucuuaauuccauauccuggaaaucacaguugucagcagcauacaccuaaaagcaugaccacugggcgaagcgacagaccugucuuaguccauugggcagcucuaguaaaacacuauaagcacaacagcuuauaaagagcaaagaacuguucauuucuauuccagaggcuaacaagccugauggagacacuggaagauugucugaugaggaucuccacauccuaguucagugauagcaccaucuaacuguguccuuaccuuauaaagggcacgagggggguucuuaggagcuuuuuauaugggcacuaaucccauucauaagggcucuaaucucaucagccucccaaauccuucaccuucuacuaucuaccaccuuggggugaggaugaugacuuauguauguagcaggacacaaacacuccgaucccagcaauaagcagaaccguuaggaugauuucuguuguaugcaacaagagaaaaccacguuuaugguauuagaauggacaauuuaaaggguuccauguuuuauaaggaaauauaauauuaauuggugguacuauacauuaaaucaagauuuuuuuugacaugguaaccauaaagaauuugcuauuuuauuuuuauuuaaauaccuuuguaaguacacuauagaaagaauugcauuggguuacuauuuccuuacauaaaauuucagcaaaguauauaaauuaaauuguuuugauaacuugucuuauuuaauuucauacuguucuuuugagaaagcggguaucccgggcuaagguacagaaguaaauaugugugaauuccaaucugauaaucauuagcacuucaaagaaaugccaaagccuguaucuagcaguaaguaguucaaucuucuucccaccuuugcuccugauuuucaucaccuacauaaauaucugaauaacaacaaauuaaaaaauucaucuuagaauaaaaaucaauuauagaaaaaagugaccaccauuauacaucaaacuuuugucuauuggguuauuccauuuuuccuucaaggaaaaaaaaguucuaauuuuagagaaucuagugcuagaauugauauucauagaaaugauugauucauuucacaaauacauauggaacacuuuucaguauauucaggggcaaauuuucugcaggaacaaaggcagaacaaagcaucccuccuccuggcuauuacauuucagaaaaaaaaaaggcaugaccacagggaaguaaggaacagccucaauuuggaugaagugauggaguuagcauaaggagggaaugagauaugaaugaauggaugugcugugaggugaaaggaacugucuuucugaggaccuaacauccuauagacacaggacccaagcaggagacauugguucuuuggcauuuggaggaugguuauuucagggagagggaagaagagaggagaagcuuggaaaaguuaccaaggaagagcaaauggcugcuauggcugcaguggagugggugggaaugaguagaauggugaaggcaauaagaacggugagggcugcuguaauuaacguacuuccugacagccuaggcuuuccauuugcuguuuuauuugaguuuggguuuucuuugucuacucucaugucuuggaagguucucaucaauucauucagcuuuuuguguuuccacagucuuugccagagcauugacucauguucuuuaaggucuuugaacauuucaugaaugcuacuaugaaguccuggccuugugcuucaagaaaauugcauuuuucuguugcaguaggguugugggcuucuggaggaggcauucuuggauguuuaugcuuuuguuuuuguguuuccaucuagcuaucuggaugguauuaagaugcuggagguguuauuuagugucgauaucuaguaucgucuuggcugagaugagguucaguuucuugguugcuguugcccacuaggaaucuugggcagauguaguggcuguagggucccugguagaguguuucuguggcucuguggguaacacaagguggagauggacuaggaggagaggcuaagagacacaccgaaagaucuaggaagacaagguauguaugaagacagggagauccagggagaaaggugggaggagcggcaccugcgaacaagcagcugcaggacuaagagcaauccuggagagacaggaaggauggcuuauaaucaccuaccugcauuccagcucaguguggcuacugggagucccugguagaaagugauucucuaggucggugggugauuggaaagaaugaagcuggguuaaaagugagggcugagaagggcaguuggagauaucuagggugggggcuuggucugcaguaagagucgugaucuagggaauggagguggauggagaggagcuccuacaguaacuguaagucuggaaaaacuggaaugacagucuagggggacccugggucuaauauauacuuuuuaaaguuucccuugcacggcaagaacaggacaauaacauagcuucuuuuuuuuuuuuuuaaacaaaaucaauuaucucaaggucccuuauaacacucauuucuaauuaggauuuccagucaacuugacacagccuaaucaccuguuaaaugaguugcucaauugagggauuucucaaauuagacuggccuaugcacaugccugugggagacugucuugauugcuacuuacuguuggauggcccaguccacgguggacuguaccauucccuaggcaggugguccuauagaagaaaguuaguuaagcaugaucuuaagggugagucagcaagcaggauuccuuccuacccacuucaguuuucugucugauuuccuuacuuaauuuucuccaaugauggucuguaaucuguaaccugaaagaaaccugucacucccuuaaauugcuuuuagcugugauauuuauaacaacagagugaaaccagaacacauggaaugacugucaaucuugauuggcaaugucacugugcuuagacucaggaaggaaacaaaccucuaggcaugucugugaccacucaccuugggggcagcacuguucuauaggcuggagucugagacugaauaagauggagagagaaagcugagcaccagcauccauugcucucugcuuccugacuguggaugggaugugaccguccaucuaacauucuuaccagcuaccaugacuuauacaacuggauucuuagacugugagccugaauaaacuuccuucaauaacuugucaugcauuuggucacagcaacaagaaaagaaaguaacacagcaaacauacugagaagugggacuguugcugcaauaaaccuuaggacuuuggaacuaguuugugggaggaguggaggaauucaaagcuacaggaaggagcccuagaaugguauguacagagcuuaaugaagcacucuaggugcaguguggaugcucagaauuuggauugaacugcaaacccuagaggugcagcucauaaggagaacaagauucucucaggaacugccuggagaccacccauaccauauuuuggcaaagaauuugacagaauucugccugugucuugaaaaaugauuuaaagauaaauuaaaaaguaauggacuaauuuguuuugucuuuucuuuuuucuuuuuauuguuugugacuaugucuguauguguacacaguauauguauaugugguguauguacacaugugcacauacacaugccucguguuaacggaugucaggcauccugcuuuaguguguuucauauauuccuuuaagacagagucucucacugaaccuagaguuaugcuguuagccagcaaucuccagcacgucucucgacucagcuaucuacagcauugaugucacaagugugcacauagccuugcuuaacuuuuaaugugggugcugggaucugaacucauguccucaggcuugcacagcaagcacacuuacccauugagccaucuccccagucucugaacucauuaauuuagcagaggaaauuucaagacagcauaaccuuuaggcuacuguaugaauacugcuaauugugcuuauccagauuacaguaggacagaacauacaagaugugaaaauacacaauuuggcaaggaaaaagaauguucaugaguuuaaugagaaaaguaauaaagauaguaaaagacaacaugacagaaguaauaaaagaaagaaagaaagaaaaaccuuaucagugaugucuaaaagaacuagguaucaagaaauccuacgucacuaaaauggagagggauacauaggaugauaucacagcagagcccagaacuggucagcagcugggcaccuguaggggugaagaaaagggaauaucugauagagcuuccaaacuguggcauucagaaacugccaucagguaacucaaaggaagaaagcuccauaccaagaaggaugcuaaacaacagaaucucagaacagucaggaguccuugaaaagcacaacagcagccaggcaaugguggcccacgccuuuaauccuagcacuugggaggcagaggcaggcagauuucugaguuccaggccagccuggucuacagagugaguuccaggacagccagggcuauacagagaaaccccgucuaaaaaaaaaaaaaaaaaaaaaaaagaaagaaaagaaaagaaaagaaaaccagcaacagcaaaaauagauggagccuuugagaaccucagggaugugcaauagauacuaacucuaagaaaaguuuuggugaggaagugacuugguggguaugaacacuuacugcuuuugcagagaacugggauucaguuucuagcaucuuuaucagguaacuuacaaugccagggguuccaaugccucuuucugguuucauuagauacucauacagauagagacauacaaguauacacacauacacgugaaaugaaaauaaagaacaauuauucuaaaauguggaauccaaaguaaagguaaaaaaaaaaaaauccaaacugaaggagaucuccaagagaagagcauuucacaggacagggccgcaaagguggcaugaaaggcagaugcccagcaggaggagaggcugaacauaaugcaauagaaaaguaccauguucaccggugaaaggauuguucuggaaagcgaggugcaaggaacugugguggcagcagcaggaggagucauggauuaaucagagaaguaacuauguaucuuaauucuucacagugaugacaggggacuaggaugugcacaagcuacuguaauuauucauaaucuauucauaaauccuucaugggcaucucuccccauuaaucuaggauaacccuucccauuaaucaugggaaacagaagugaauuaaagaaaccccacuuaaagaaacugcaagaaaaauagagggaaaaugaauauuaagagcuaaacaaaucaagagacuucauagccccaaagaauuugaaacuguaaccuaaaauuucagaaugaagagcaacaauuaaggcaauaaucaaagcacugggagagcuacaugaauuguuaaguacaggaucucagaugugagacauuaaaaucccaacaggaaauggaaguuuuucacggguggaaacuuguugcacuggagugacagucucaauggaaguaagcagugcuuacacagagggacaaucugucaugaagugccagauuuuaucagaacuaacaaaguucuaggcagggaugaggagguggacauugaagacuggcuacuuccagaaggacggaguaaaucaauaacuacaugaagagcaauggacaccagaucucucuuugcucaagggaagaaucuccaaauauagggaacaauaaagaaguguuauguacuggaaugagaaauaacccaguuuuuaagagaaagagaaagacaggcagacagauguaaauauguauuuguauauuaugagcuuagagaaucaccuagagguaccuaaugggaggaccgaagaaaugcgucuaugauggccagauuuugauuucuaaauacauuuccuacuaauacagggaugggcugaaaagugacugacagcccaaguagggcgggaacaagaugagaugagucuagaacauccugugccauagaggaaggaaccgcucaaaagaugauaaggcauaguaacaggacagagacuccacuugaauggcucuucgcugguuaaauugaagauaauuucugaaacccauuaaauaauuagaguaauggcuuauagcccauugaauacaauggaaaaacacaagcucaugaagauguauaaauaaaauggucuugaaaguuuggguaggaauggggauuaauuucaaauugucuccuuacagaauaugucuuuauuguaaagacagaguaauuugauaguaagaaaucuaggaggugguauuacuucauuccaaugaccaauguuguuaucaucaauaauagaacacagcaaaacaacguucucgaaucugcuaggacccaacacaagaaaugcagaaucauuuccauauuuucccgacgaagaugaauaaccugucuagucaaacagaacuaucagauacucccaauuuguaggcuauucuaugaugugacccaccuguaaccuuuaauaguacaaagaucauaaaauucaaggaaugacaaaaggacaguuucccauuaaagaacacuaagaagauguuacagucaaacagaacauuugaccccaaacuggccuuucaucacaaagccaguauuacuggggaugcuagcaauaacuucaacggagccuaagggauuaaugauagcaauggauuaaugugaauuuccuggcuuguuggggcugugcuuaagaaugcaauuggcucuagaaauugcuccccauauuucccaaaggguaggccaaccagggauauguuaaaucuuccagauuguuuccaugaagcaaaaauacuuuuaggagccugugagauggcucagugggugaagguacuuacuggaaagccugcaacaugaauucugucccugggacccacauaguggaaagagaaaacugacucuugguucuacaggcuuggccucaccuaccuugccccacacccacaugaauacauaaaaguaaauuuaaaucuuuaaaaaaacccugcccaucccccccucccccuuaaacucaucucucaugaguguguggacaguuguuugagagggugcaugaucugccuucccagaauggaaguacuccauguuucuucacaucucagcugaaggaacugguauagucccauuccuacuuaaaugaagucacagguuuacauguaaaauggagugggaacagccuucccagcaccgcuccacaguguacagugggaaagacagacggaagacccagggaaagacauccugucucaacuccagaacagcucuacauuuucuauuuaaaaauaauguuugcucaaggauuugauggguagcacugaugaaguccaauauuuugauguuuaauguucuucuuccaagguugcuaugaacuuuguuuaugauuagaugguaagguuauaucaaauaucuauacuuauugauuauguaauuuuuauccuuuaaguugcuagugaaugaaauuuacacacuuuuuaaauguuaaaugccaaacaauaacaggacacggaugggaaaacccagucggcaggugaugguuuucuugcuagucuuccauguuuaauagguuuucugggauuuuugcauccauaucuaugacuaaaauagggauuuuuguaaccuuucuuacacuaacuguucaauuuugcuaaaaugacuucaguuuuaaucaacucaacugagggaacucuccaauucucuguagauuaucuuacaacgugauuauuucuguuauacucacucuaccuuuaaaaucaucugaacucuguauauuuuuuugccggaagauuuuaaauuaccuauuaaauuuuacaaucauagaacuauuugaugcuuguauacauuuugaugccuuuuuuuauaacuaucuagaauuugaccauugccuucaguauugaaucacucgugugguuuuucaauucauuucuugcccuguacauccuuuuaaaauaauacgcaguuauauauuuucucauuccuaacacuucuuauuuauaucuuucauuuugaacuuugucucuuggaaauagggucucagcuacccuugaagucacuauguaccuaccugaggauugccuuaagcuccugauuuuccugccucugccacccucucggcucuagcaccccagcacugggauuauagaugugaggguccuggcuaauuuuaugucaacuugacacaagccauagucaucugaaaggaggaaaucucaauugagaaaaucccucuauaaguuauggucauaauacaccuucuuaaugacugauugaugggggagaacacagccuaauguaggugguaccgucaucccugggcaggugguccuauguguagacuuuucaacugaucugugcagaucuuguuuaggaucugaggaccugaaagaauggggcagacuccagucuaaugcuguagcugucuuacuucaguuuaguguacuuuuauacaugaauguaaugaagaaaucaaugauuuuaggaagguuguuugaguucuuaaaaaaaauaugaucagaagaacuauguaauaaacuccaguaagcauauacuaaauaucauuagagcagcccuuucccagaauguucucaggacagagcaauuuaaacacaauugccugccauguacuauagauuaugucugggaaagcaggaaagcaaggcagaaggccauaugcagauucaggguacacugaucagauuggguuuuacagcuaugaucugacauccaacgagaauaaacauuucuuaugaauuaaaaguaaauguuuaacccaggaagaaugaaaucaugcccaagagcaauauagagaacaaaaggccccugagguaaaaggccucucugccuuuucgccuggagccucucucacaguucccuaggcaucguccaccaugcaccauucuuuugaccaagucucgacacuggguuccuccuuuucuggcucucuuuucuggcauuuagcucauuuaguuuuccugguauaaucauuugaaacuucuaauuuccacuugugcuacaucaucauauuugauauuuaucaucccgacucuugaucaguuuaaaauauaguguuuuauauacuuaaaucaaaaaauauuuggagccgggcgugguggcguaugccuuuaaucccagcacuugggaggcagagacgggugaauuucugaguucgaggccagccuggucuauagaguuccaggacagccaggggaacacagagaaacccugucuugaaaaaaauuaaaaaaaaaaaauuggagaauacuuaagaaugauuuacuuaacuaaucgaauuguucuuagaagauauagugucagucucucugacauauccuaaaaucugcuuauagcauaaauaaaaucaaugcuugugauuuuauguuucaugagauagguuucauucucagggcaagcgaggugcagcauggcucuaauuccagcagguaagagguggaggcaagagaaucaggaguucaggguuauccuuggcuacaaagcaagucaacuuaggccaaccuagguuauguaagacauucucaggcaaaccaaaccauacuauaaguucucaguuguuaaauacaaagcuauaugcauuguaucaaauggaguuucuuggccgaccuguuaaaaucuuuucgugacuaaaggauguugaaaucuccuacuuauagaacacuuaggauauuuuuuuccugacaguucuaccaaauacauguaaacacauauauacgauacgauuauacuguauauucuuauaauuuuaaaugcauacaugcuuagaguuuucaaauuuuucuggugagacauaccucauauaauuuugugacucugaaaagagagcaagcaaugucuuaguguccugagcaaauuguauuugcauguguguaccgcagaaagacccuuugaguuccuaggcugagcuaguacuuugaaacaaaauacgugcauuauaaaaugaauagcuauaaaaaauuuauucaaaaguaucuucacuggaacccagaaguauuuacuauaaccccgaauaaccuguauucuacuaaaauguagauuuauuaauagauggauuuguuauguacauuuguaccuuguaauauaugagauauuuuauauuaacaaaguauucuaaggauuuuacaaaugaagaaggguacuacuucaacuacagauguaaaucaaguaaauucuuugaaaauaugauucuccugagcuggguauguugccuuuaauccuaguacuccugaaguagcaccaggcagagcuccaugaguucgaggccaaccuaaucuagguaggacagccagggauguuacacgaaaacaacccugucuuggaaaaaaaacaaaaacaaaaacaaaaaaacuaaaccaaacaaaaaacaauauaacaaaaaaaccccaaaacaaaauaauaacaaauaacuacuacaugauauuuaguuaaaaaauuaucaugcaaaauggucauaugaguauccuuuuaacauaaaucuaacaugaacuuguuuuuauugaaaaaaauuaaccuccaucauaauaacacaucuggucuauaccuuccaacaagcuuuuaaaaacauauuggguuuuaucacaaauauuaggaaaagugucaccuaugguuuucaauuaucacaucauucauuguaugaacccuacuguagcuuauccuucuguucccccuagucacagagcucacuuguucaagcuaguuguauccagaugugacgaguaccuuuacaucucaggacagaguggcauuaggugaaccuuugcggcaacuacuuaggauuuacauucucuuccuuccucucccucauaacugaacuaacauuuccagaagcaagugacaauauuuaaauaaacuccaacuccaugcaaaggaauuuauggcaaaggucacagaggguaagauuccguaggugguaagguaaggggacacagaaggaguaacauccaucaugugccuuuuauguucaaggucaucccaucucuuugaagcccucuacuaagcuucugaaguaggagauaugggcacugacagggaaucacauagcucaucaacagagggccagcugugggauguaagucugauuucccacuacauuuacaagacuuugugucucuagcuuacucaaaacuuccuguggccucacuaucacaugcugucuaugagcuccugaguaucacuggaguuugaaaaacaucccaggaccuuccaggugucagcaaugaccuuggggguauuuggucggacugaauaaucaucccaagauagguagcagaucauacuaagggcaucagguagguuggugauaacauucuccccuguaaacaauuuaaggucaauacccgcuuuucugaaaucacaugccagccagcucuauugucuuuugguucaucaguccuacacccugccaaaaaccagcaucuaaugcagaagccagaggaugcuggguuccugguagcuccuggaccagagcagaccauguaguuuggcucugauuucaaacauuuauaaucuuuucucuugcucccuucgcucaauauaggagagaggcuaucagccaauuuccccaccguuuauagcaaaucccaaagcuccuucauuuccagcugcucagcugccugggcagacuguauuacuaaauuauuguaucuucuugguacagugccugaucuaucuuggcaugcauuuugcauugaaagaagcuccuguugcagcagaggaagcuagcugcucuugcucucccacgcgcccuuccucugguacccucaaccacuaaccucuuuguuccuccuguauaagccaagcuccuaggggcaguuucucaucuaaggcugucccccuagggguuagacauuucaaaggaugcucugugcuaggaguguuucccacagcuagagagagccagauggguaaguggccuacaguggagaacugcauuuggaacgaagagauuuuguuucucccucaccaaaauguauuucuuuguaaugcugcagucaguccagccuuguaugguccucaacagaagacacugcacugugggaagacaggaaaagagcccuuuuacuuaaaucuguuguuuucaaaaguauuggcucuuugguuuaacauauuuuaaaaacuuucuauuuuuauccuaugccaacugguuaugaaugcugagagagagagagagagagagagagagagagagagagagagagagagagagaagcagaagcacuauuauucuggaaaaaugaaacaaacaaaguuuugucuuuaaaauaaaaagaaaguaauuucucaacaucaaaggaugaaaauuauuuuuaauuacucugaaaugaauaaccauucuaauucagguuucaaaggacauaccuuggacuugaaugcaagucacuuaaauauccucaauugaagcucugggaauguaaugcaugcaaauguguccugugagcuugcuauuccuguaagcaaugagcagccuagauuuuucucacauacaucccgagagaugucucaucuccaaagagcaggagagucaucuaaagucuaguccuauuaacaagacacaccauggaaaauacacagaaauguuaaagauaaauucuaucuagcaaguuacauuuuaaaucaacauugcuguugcuauggcaagaaaacugaauguaaaauaaaagucuucuauaaggguuuggcccuguagucauggcaacaaugaaugauacuuaacucugcuaauguuuccauuugauccggagagaacuagaugugcuuuaaagcuauguaacauggcuuagaaaauugauuuuuuuuauugcuaucuuucaaaugccccucgaccaauuaaagaagggaucacaaaaauaacagccaggguaagaaaaaugcagaauguaugggcuuguuuagguuuuccaugaugguggaagcuaugagugucauuuucucugagaugcuagaaaauggaauauucauuuagcaaaauacugcacagcaauuuucagguuggggggcaucauguaauuuuccauagauagaaaaaaaaacauaugaaaagcaaucaaauggcaauuuccaccucuuucauccagaaaaggaaauauuaacuuaaaguaagaaaauauggaaaucaauguucccgcucugcaagcgagcagcuaauucugauuucuccccuacuucccaagcagucuuuugauucaugucccuccacggacacaucccuccuccucgcacuggcaaaaugcccauagugccgaaauggaccguucuaaaucuuccuccuacucaaccuaccagcugugcaucuaauacagccucucgugcuccuggaugggacacucucauuaagccccuaacucaucugcuuucuucacaccccauggcuguucuuucccaugcucuuuggcuuaguccuccuccuaucuccaaaagucugucucaaagaguccuugggcucagcaugcuaagccuuguuuccuguuuuguugauugcucccucugcuagcuagucauuugcagucuugggcuugccuauuaccuaauucauaacaauugcaaaauuuccauuuuuuuagccagauuucuacccugaacucuagauuucuaccucuggguucccugucauuuuuaugcuaauuuuucuuucucaccccacaaccaauuguguccuaguucccuguggugguuuugccucugaaauacaccuacauucugccuaauucucgcacauuaguuucccacuggaugguugugaaagucuccuuacugguuucucaguuucuacugugucucuucaggcacuccaugucccagagaucuguuaaaguagacagaggguaagcaauaguuguugccuguugagguuuggucuugaugucuauugcaaugcuaagugcuggucccuaagaccuggaguccucacacacgcucaagagaugcuaugugacccugcccccaaguuauuucugauugguaaauaaagauguuacagccaauaacuggacagaagaaacagguggaauuuaggagaaggagaagagaaggugaggaggaagggaagccauuaugaguuagguaaaaguucaugaaaauauuguccugaggauuagccaauuggaaaugccauguuucccccaaaugaccaguuaagaccagcccagaugaaacauaguaaauaauaacauggggguuacugauauaaaaguagauucuaauagcauagaggguagguaucugcucagcucuugugcuguuuaaggcuuauuguaaauaugaaagcugugugugucuauaugugucuuuuauacaggaacuaaauggccaaaggcuggguagaaacccuaggucuggaugaaaauucucuucaacagcugccauguuaacuaggguaauccaugaaggcugaaacaagaaaaucaugaaaugaaaccucacugaaugaagacguugguucugggaguagaaauuccaagcaaauauucaagcaaauuguguacaugaggucucuuaaaaggauuuggagaauauguuuguguguuuauuuaauuacuuucaaaucaucuuuaagcccacuucucuguuuccaagaguaucauuuaauuuuccccuuugagguuaauagcuaagguuuauugagucauuggaaguacuuuuauaucuaucagcuguuuggguuccaccccuggacaagagaugaagaugcauauuuuacaugucaaagcagaccugguuuccagguucucccaacacuccuuggucccuaccuggcauucccuaccccuuucaguccaggggcugggcugcccuuuccgcaaaagcgcugcuuuacauaauccagacauuuugguauccccacuccucucuucucuuucucugagaugcacccuuucucucuucuucuuccccuuccccaccccuuuccccacgaugacuccucugguccuuggggccagugaacuugccugagagcagcuuccaaauaaaccugauuugguucaaaucugguuugaauuggcucauuucacugguagagaaauagcucaucuucaucugauuuaucuccuccacacauuuggggaaaacauggcaauuccaauuuacagaugaggaacuuaauucuucuucuccucucuuccucuccccucuccccucucuccccucuccccucucuccccucuccccucuccccucucuccccucucuccucucuccccucuccccucucuccucuccccucuccccucucuccccucucuccucucuccccucuccccccucuccccugucuccccucuccccucuccccucuccccucuccuccccccccucucucucuuuucugagaccagguuucucuguguagcccuggcuguccuggaacucacucuguagaccaggcuggcuucgaacucagaaaucccccugccuuugccucccaagugcugggauuaaaggcgugcaccaccacugcccggcuggaacuuaauucuuagaugaaaagcacccacuaagguuacauggcaguaagaggcaggugucaccugaauggaacacuuaaaagcuucugacugcuauaccucuugcauuccuaaaauaagaaauaugcaugucuaguccuaaauucccuacucauguccacacuucauuuaccaauuugggguucuagaugaacccuucaaaauauacuuuauaucuuauaauuuugguauuauauuccaacacuuuuauaucuaacaugucccuugcuuguucuugagaacuucauuuaucaugaaaaugaaaauaaacugcuuucuaucuccuccuccuccucguccucuuucuccuccuccuccuuuuauaaggaggcaggacuucaguggcacaaggaccgcaaucacacaggggagccugaaacucacaaagcuggucacaaggaccgcaaucacacaggggagcuugaaacccacaaagcuggucccaaacucacaugcaucaguccugucuuggccucucaaauuauauauauaaaauauauacacacauauauaauauauacauacauacuaauuacuuuuuguuuaauaauuuuuauaauauacuuugaucaugaucuuuccccuuuccaaccccuccagauccucccccaggauuuuuaaaaauguuauuuucuauauaaauauuugccugcaucuauguauguacacaauaugcaugucugguaaccaccaaggccagagauuccccuggcguuggaguuacaggcaguuguaagcugcugcauggguaugugaauccagccagaguuuucugcaagaauauucagugcucuuaacuacugagucauuucucuggcccaaauuccuuucacacuauggcuagccauauaauucuucuauuucaaguccuuauccauuucauuaaauacucuggagacauuucuccaucuucuggguucuuaaaguugaaacguauuugauacuaagcaaauuguauuacuuagcuaaguacccuaucuugucauagugauuucuauccacuuagauguaggauguuuucucuuauccuugaaauuauaauuuaaauuucuuaguaaaagcuuauuuuagccugaaauuuugccuauauucagcaagucuguguuuuauuauucaagcuauuuuuuuaaucauaauggagaaaaagguuuccaguuucuauuuugcuuuuuuuucucuguuagauucuucuuuaugaaauaccuaucagaggcauucugagcucaaguguuuauccugaaaaaaaaauguuaucuuuccuuauuuccucccuuuguccacugaaaguuuugagucaacuucuacuuaauuauguuguauuucuaaaaaaacaacauauuuuuuuugccucugguguaguuuugaauuugauaggaacacuguuuaaauauauaaguccuuugcuaucuuauguuuuaacacuuucuuuuuaaagauuuauuuauuuuauguaugagaguacauggcugcugucuucagacacaucagaagagggcagcagaucccauuacagaugguugugagucaccaugggguugcuaggaauugaacucaugaccucugaaggagaacagucagugcucuugacugccgagccaucucuccagcccauauuuuaacucuuuguaacugcuuauucuaguuuaauacagcccaagucuucugaagacugcugagguccauuuggcauucauaguuuuggaaaucugguuuuuguuuggaguaguuacauuugcuagaaugguagucguacuguuccucagcgggugcuuucuuuaugugaagcaucauuuaaagcauccagguguuucuccauuuguucacacuuguagacagagggcuacuuugguggcuugucugcuuuggggauugacaugaguucuaccggacucugagggagugcuuccuuccaucuucaagauuuauaagaaagaggaggagaaauuuuugccauuuguacaauucuugggacaucucuucaagaaguagaaauacaccucccaugauuauaugcucuguagcugugcuguccaaugggguagguacccauaggcaauguagaugcugugcauuuaaaaugugacagagagaacacaguuuguacacauuuaucuuauuauuuauguccuauuuuaaauagcagcaugcagaagugguuaccauauagugcagggcgagagaaauugcccucaccggauggucccuagcucagcaucacuagaaucuccuuagaugcucaccaagaauucuuggguccugcucuagcaucugugacagugggccuggcaaucuaugucuacacagauccccacuugauucugacacaugcugacagcucaggauuccuggucuacuggcggugaguuaggagaggauggggucauaagaguucucgcuugauucucuucuuugaaugagcaaccaggaguuaacuggggcaguguccuccuucuuugccugucacaguuguccucauuaaggacugacugugacaauaccucccuuaaguguaagccaggaaugcgcaugcuacaugauccucucuuacugaucccagugggaccuaggugccucuuugccuucccccucagccuuuugggucuccagguagugcuccggccagucgcuuuccacauauaggggacauacaucuuaccuaucuucaauccugaucauuugucuuuucuccugcagaaaccuuugaaugugacccacucuuaaucucucacgcuguucuuuuuuuguuuucuuccuuguuuuaugucuguuggucaaguguaaugggauacaaaggaaguugaaauugacugaagcauucaaacucccucucuccuaagaaacuaugucccucuuagugccucacuuucaucggauuccagaauguuccuuuugauuuuuuuauuucauuugauccacaaaacaccccugugaugccaauccucccaugcuaaagacacagauaucacggcuuuuaauguuuaaugggcuacauaagagaacuaggaagugcaucugcuuugugaaggccccaagaaacaggaaacgguagcuccauuuauugaaucuguaucacugaacgcuguauuaaauauuuguauucuuuaucucauugaaggaucauaagguuuuuauuucccauuucacagaugcgaaacaaaacuagacagguucaauaucuucuccaaauuauaggccuaguuagugagggccuauugugcccucacuggacagcuguguuaguuucuaaucuuggagaguaagcccuguggaucucaaaucuguccacucuggauuguuugauuuaguuucuacacuacugcaaaauucagaagccaauuuuuaacaaaauaaacuauaauaagauaaaacaaaaaccaucaccuugaaguuggacaaggcaaaacaagagagggagaagagccccaauauaggaggcaugagaaucagagaucuaacuaacauguucacuccugaguaggagucuccuagaaauccaaacugaagguuuuuuuuuuuccauuuuuuauuagguauuuagcucauuuacauuuccaaugcuauaccaaaagucccccauagccacccacccccacuccccuacccacccacuccccuuuuuuggcccuggcguuccccuguacuggggcauauaaaguuugcguguccaaugggccucucuuuccagugauggccgccuaggccaucuuuugauacauaugcagcuagagucaagagcuccgggguacugguuaguucauaauguuguuccaccuauaggguugcagaucccuuuagcuucuuggguacuuucucuagcuccuucauugggggccaugugauccauccaauagccgacugugagcauccacuucuauguuugcuaggcccaggcauacucugacaagagaccaaacugaagguuuuaauggauacgcagaggaucuggugcagaucuguggaagcccugugcuugcugcuucaaucagagcccauucucaaguagcuaauacagaggcaaacauuuugucauaaucuuacucuuuugcuugucuucuauugcgaguuggaauaucacaauccaugugagucauuacuuccaucuccaaucaugcuaaguaucuuuggcauaucugagacaugccauacaaugugcuaggcacugugugggcacucgugggcaguacuagcuaccaacagacccugucaaaagguuuggugaagugcaugguuacugcugaacucagccugccuuagugaugaugcccauucauaaaucuacccagugcuuuguuagcacuuuaaguuccaguuuggagaacaagaaggcagcuugaaggcagugcuaauuucaguugcuccaugacuacagauuuauagguauccaaucucccagccaguaccagucaaauguugucucaccaguaaaggggacaguaucauucuccgaauucugacucaucugaugagacugauucagagauggaaacucugcuguucaagcaugaguuuucuauauaauucaucauauauauauauauauauauauauauauauauauauauauauauauguaaaguucucugacaccaugacaccacugacuguuuuccaccauaaaccagcuaccuuccaaagcuacuaaccuaguacagcaggcuugaaaaauggacauuggaaucgaaaaagaacuugccuuugaaaguagucuaugcaaaucuuuccauuaacacuuguuccacaggaaggaauauacaccugagacuguaaacauggucagaagcccauggcuggggagaucauggggugaaaucuacuacugcuauuuugcuaaauggccauguuaucaaacuaccuucuaaauguuuaugcuucugcccauagaccugggcugcugucagccuuggucagagaagcggugagcagcagucagugaaaacacucauaauuggucaaagugcagaaaagaagugauugagugcucagcucuaaaugagacauggugaucaaaggcucuaccaaagccucagggagagcuggaagagggaacagauacaaugaaagggcuggaggauaaggaugagugagugguuugagaugcuaucuucuaaacaaggaaggcauggcuacaguacucacgaacucacagugcccacggccaccugcaaaaugccuguuccagaucaaagcagcucacccuuaacuaaaaagcuagagagagauggaugacugauaacuguucuucuuuaaggaugugaacccugauagguugccauguuccugugguuguccucagaccuauguauauaacggcagcacuuauuugacuugugaguuacuacaaaauauaaaaggagaaaaaugaaguuagaaugggggggugcuauauauagggaagaccagggggaggugaagagaggaaaugaaggauauauauauauauauguauguguguguguauguauauguauauauguacacacacauauauacauaucuauacauauauauacacacauauauauguauauguacacauauauguguguguguguuuaauagauauaauaaaaauucaaagaacaaauuaaaaacaaaauuuuuacuugcaaaaaugagcugagagauauguauuuuaagguuacuacuucaucuuuacagagaucagccucacuauuugucauauuaaaugcagcguagucuuucgcuacacgucuagaauccagggaagcaauaguaggguuaaguguuuugcauuuugacaggaggaucugaaauccccaaacugcuaagcaguuacuuaucucuggacaggucuugucuacuuuauuuuaaauggaagugcaaaucuugguggauugaaaaucaaaccagacauguucucgguuauaacaaaaauuuaaagcaauugauuuugucucugugacuaugucaccuuguccucaucugccuuguucauuacacacaauuuuccccuguagcucaugggccuuguggguauucgcugucugacucagaaucuagaagaguuagagacagagccaguagacaugaaaugauccauauuuugguaacgauauaaagagaaauguaauaaugaaugcaaucuaguuuuaauuguaaauuuaaagaaaauucuaccuugcaauuucaugcuagaauuacugucagcaguagaaaauacuuuaagcacaaucuucaauauugaaaagaagguugaaauuacagagucuccauuuuuugucauuuccauucaagggccccauuugagaccaugagacuugucacuggccuaaaaugcagcuuagggaagagaaggaaauuuaggcuucuaacuaauucauugaacauaaaaccaagcucuacuggcuguguuguguuauauaauggcuuucuggaaagugcuaaacauacacaaaugaauaguuuuaacgugacuuuaaaaaucagcuuuccacugaaaacaagacccccgaguuacugaguuacuuauaaaagccauccccucuaacucuuacccaggaaguaucccuaugggagcagaugacacucuggcaaucugaauuucagaaauaauuauuugccacuagggaaguuaguuuugacuacucggaauuugguuuauaucaaguaaacacacuuuuuguuuuuucuguuuuaaauaguauuuucauaauuucauuuauuuagggauaauuaucuaugguguauagaugaaagagaaccaucaaccgagcaaauuauggcauucauaauuaaaugcuuccuguacgcagacuccaacacugcuaaaagaagccaucacuccaguauaaaauuaaauauaguuagcauaaaacugcauuaaacaaacccuuaggguuuuuauuaauucauuuggaaugaaaucagcagaguucuggccacaaguuuuucuauaaauucaacaauuccaaagcuuuauucaugguuuuuaaaagccuaguuuaaaugggcaauacuaggguacacuugaugacugaaugggccauuguuccauuagagagaaaaauaugagaugaggauuuuggcauugaaccaaagaccugugagcaguacauuuuccaaaaaggauagcuauaauauucaaaugucuaacggagacaugcggcugauuaauggauaugagaauggcauugaagccaggcuauauggaaccugaaagagacaccgguuaugccggucaaugagguuugaaguccuaauagagaguccuaaugaggcagccuugguucuuccuucuguguucccuagucaauaucucggagcaucagaguuuacuuuuaagacgucucuaaaaucgaacugcuucauucucuccuauccacaacugguuccugcucauuacugaagacucaggaccuuuccaucccagaggcuuauucuaauucuaaccaucauuucuaaccuuaccugugcaucucucacagccucccaucucuuuaggucacucuguaauuuucauuuucuuauuuacuuaaguuuacaaacauuuuuuuucucauugcacaccauuccucucacuacaguguguguauaugauguauaugcauaugucugucuaucuaucuaccuaucuaucuaucuaucuaucuaucuaucuaucuaucuauaucaucucucuauauauuuuuuuuucuuucuuuucuuuuuuuuaaagacaaugauuuuauugguuaaccauugaguccuaguacccagacucaucucuggaaugugacaagugugugaacuuguuguccacccaugcuguccucauucagguccuuguccugccaagccugguaacaaugaaaguucccuaacuauucuccuugaugcaagccugagcuuccuccuguucauguucuccaauggggcuccauuguucucuauaauggaaguacacuccuguugcaccgcuauucaaagcucuucgauguuucuuugugauugaaaugaauaucaccaaagcacagaguggugagagguaucauuuuaagcaauucauggaagaacaguuaauaguuaucuuuuauuuauuuuaaugcucauccuuacagaccaucaaguagauggcacauuaagcucaugaauucagagauauuacuuaagaaauuuuaaaaaaacuguaagucuauuuagagacauagacaaaaaccaaaaaccauaaauuuauucucaagugaguuuggaccaugcuguuguaaagaauaaagcccagugccacuguuucaauuucccuaagucuuggcuucccucccgggcacaacagccaccacuucuuguuuugcacuucacaucuuagugaauuuaaacuauuggcagcucuuucucucaucacacaaugcucuucuguuuuaguccagcugcuuccuuggccuagaaugucauugguuuguccuuuuacccuauuaucuaucaucugaccagcuucauucucauccuuaugacucggcucagguaaccaaccccauaagaccuucucuuuauuuccucugccugcaucuuggcuagguacuuccuucacuuuuguucccuuacauacuuuguugucacauagacuucuuccaagugggacauuccuaauauuagggucaaagugaucuuucaauuaauagccucacccucugucauaaggcaugaaugaauacucaguuaaaacaauauuuauuaagguacugagaguaauuaguugugaguuguacccaugcagucccccccauacuuccuuguaugacauauauugcauucauucauucaaugguagaaagcuuagucucauagaacuagaucgauaaaaagacaaaugaaaagguccuagcaauaccagaugcuaggguuaguugguaggcaagauuuuaauguucauuguuaccuugaugggguuuagaaucaaaucaccauggguaugaaucucaaggcaugcuugugagggauuauguagauuagguuaauugaggugggaagaccacccucaagguagguagugccauuucacuaucuggagucaugaacugaaugaaaaggagaaagucaucuacgucccagcauucauugcucuuugcucccaacugugguugcaaggugaucaaccgccucuugcuuuugcuucuauaccgucacugcuaugacagaagguaucuuccagaacugugagccaauauaaacccuucucucuuauguugcuauuaucaggcauauugccacagcaacaauguaaguaacuaacacaauggggaagaagaagaaaaaugaaucaagagugggaugaaguaagaccuagauaaugcugaaaguaacaguugaauuuauagauaagaaaugcuauuaucucccuagacauugcacagaaauccauaauucacaaauuaauggcuuguauaguaaagggaguggaauguuaauaguacucuguguguacgugugcauguguguguguguguaucuuggaaacuuacagaucuugaggauucuguuuuuugguuuuuuuucuuggaaaguugaaucaaugacaauucaugcaaacucaacuaacguugccuaaagaauagauacuaagagccagacaucuugauggaagacuauccacuacaacugucuuauguagaccacacaccguggaguuagagagaugaacagaucaccuuucauagauuccaguguauuauuauucaggccauacccaguuaaagaaggaggaugcugcccaauuucauagagcuauacugugaaauguaggguuacaucuuugucagacauacuagacaagggucuaugaaaggacacucucuucagaauauuuagugcuugagaaaucacaugaaaagccagcaagaaagaauuccgggaagauagcagagaaacaaacaucuggaaaguaugucuuuucccacuuagaaaacaaucuccuuggccaauucugucuggcauaacuauuuuuggaacucagaaguuuauugauggcuugaaaucuucagaggaaggcaugacugcaaauuggcuaacacucuauuaauuugaauuuuuagcucaauaucaagcccuuauucuuuauucugaguauagggugguaagcuauguacuuguuccuggggcagcuacucauagcuugaaggagccaacaugcaugcaaagaggauucaguccucuaaagauggucaguuugugcucuggucucugauggcuaucuaggaugaggcagaggcagcagucaauauuguuucaacacuugcaccucauuguggugaugccagcucuucuaaagcagguacauauaacagaugaaauuagaaggucucuucauaugcucaggagauguuccuaaaauaucagcauagaccagaaagcauuagaagaaagaucucacaguauauucauuacuuuccuugucuuucagacaaauauaccuagcagaagcaauguaagagaagaggacuuaucuuggcucaugacuuuaggagauuuugguugcuaaugguggguaagagaugucaacaagcauggcucauuguuggugggcacaugaaccagauagaaaggggugaaagaccaagaaguagcgaauggguaagaaucagggcugagcuauaaccuucaaagguccacccaguggcucaucuccguaaguuagaaccuauaugcuacaguuucuauaauccuucccaaacagugccacucucuggggucagauauucaaacacaugagccuaugaggaacauucacauguaaaccuuaacacauaguuaccacaauguuggaugcaaauaucuagguuucaagaauaaaaauaauaauaaaagccauaagccauaugaaaacaaacaaacaaaaaacagaaagaagaugccugauuuaaaguaaaaaauaauagucacuagaaacuguucuuguaagacaucugaugauagcucuaguagaaaagauuucaauuuuauuaaagaucaaagaguuaaaggaacaaguauaaaauguauagaaaaugucaugaaaaaaauagaaauauuuuaaaagacauaaaaccauaaaaggaugaaaaagaacauuuugcaacagaaaccccauuuuuaucaaagguuugcuagaggaauucauaggcaggagaggaaaucggugaccucacagacugggcagcaggugaggaucaggaaaaaagagugaaggaacuguacguccggcuaacccaugcauuguaggagcuucaucggaaaagaaaaggccaagggagagaaacugugacuuccagugcagagggaauucuagcagacuaagaucaaggacauuaggcagugacuuugagcuguguggagagauuaaaaaggucaacacacaagcaguuauaaauggcagaauuaccguaccuuuggacuacaguucuuauuuuccuacauauuuucaaagucuaggggaaggccacacauuuaggagguauagggagcaacaagaguacacauugggcuuuagaaacaaccaaaaaggacucaaaguuauauggugagagaagagaggcugggucugggagaaggaguugggggagggggugaacaggaccaaaauguauuguugaaaauucucaaaaaaaaaaggugggggaggggaggggaauguauaaagacuuaauucuacaacaacagcaacagaaagggguggguguaaaguuauuaaagaaauaauuuuuuuuacauguuauauaaagugagacugaugaaauuucaacuuuguccugacuucauuguguuauaugcaauacuccaugaucauggauuaacugaaaacuuccagucaguccugugaucaggucaauucucaauauguuaccucuuaaacccccaaacucagcagguuaggcauauacaguuuguuguucacuuacauaauuuucaacuuccuaugaauggguuuguaggaauguauccacauuguaaauuaagguauagucauaauuauuucaaaugaaaauggaauaaacucuccaaaauagaguuugucaaaacagguaaauaaguaugauccaacaauaugauccugacaagaaacuuuauaucuaaagacagaacagguuggaaggaaagaauggaaacuccaugccaacaggacccaagucagagcacagggaccuauguuaauaucagacuauacaucuuaaaggguuacacggggagaaaauguuuuacauuaguaagagguucaguacaauaagaugguagaagacuagugaacacacagcaccuaauuucagauucucaaaacaugaaacaaaugagagaaacaaagggagaaaugacucugcaacaaagacuucccugccccauucucaacaaggaagagaagaaacagaggaugcagacuaagaaaguuagggacauaacuaacuccacauaacaaucagaacuaauguaacugcucugugaaagucaaccgcauguccacaaaauacaugucuuucucauguauauuauuaggacagaccauauguuaggcuacaaacuaucucaguaauauaaaaaauaugucauguaaaauacauuuauugaccacaacuagaugaaaucggaagucaggagcaaaaggaaaacguggaaaugugcaguuugucuaaacacacacacacacacacacacacacacacacacacacacucacacaaucagugggccacaggaaauuuggaacuaccuagaaaagaacaaauaauacccaccaaaauuuauggacaagggaaagcaauguuaaaggagaauuuuauagcuacaaaugcuuauauaagaagacaagaaucaucuuaguucaauaacauaccuuugauaggcauuguggugaauccuaguacuugggaggcagaggcagauggauuucugugaguuugaggagagucuuaucuacagugaguucccggauagcuaggacuacacagagaaaaccugucucaacaacaacaaauaacaacaacaacaacaacaacaaaacaaacaaacaaacccuuuacaaauuaaggaaacagaaaaagaagaaucaucuaaaucuaaauccacauuaaugaagaaaauagcaaagauuacagggggccagccagauggcucaguggguaaaacacucacuacccagccugaugcccagaguuugauccuugagcccacauagugaaucuugccugacuucuuaguaagggagagcugacuacuaaugguugucuuccaacccccauaugcauauuacugcauaugcaagugguugcuucaugaucauucacaugcaugaguaaauaaauaaauaaauaaauaaauaaauaaauaaauagacagacagacagacagauagauagauaauauauuuuuuaaaaguuuauuuuacauguaugguuauuuuguuugcauauaugucuguguaccauguucaugucuagugccugaggaggccaaaagaggacaguggauuacuugggccuggaguuacagauaguugugaacugcaaggugggugcugggaauagaacauggguccucuuaaagaauagcuuaugcuuuuaccugcugagauaucucucuauccccaaauagauauauuuuugaaaagauagacuagagcaggaaaaaagccaaaaugggaacagaaaaaacaauggaggaaaaaaaaucaaugaaaucaaaagcuaguucauuaaaaaugaucaagaaaauggagacuaugaauagaggagggaagauucaaauagcuaaaaucagaaaaaaauggagauauauuguggauuccauagaaguaaaaacguguauuuaagaaaauacaaugaacacaggcuuucauguuuuuccaaacugaugaaccguauagcauugagugauugugaccuagacaggaucuaaagagacuuaugggugugucuguaagagcuuucagccugggaugaaugggaugaccagacucacccuaaauguggacagcaacaucucaugggcagucuagaaagggaacaugcgcugaguauccacccucuucacucccuguuuccugaauguggaugcaaccuagccuguugccucaagugcuugcugccaugcccucuccuccaugaugcacaacacucucaaaccaugagccaaagaaacccugcuuuccuuaaguuccuucugucagguauuaugcagcagcaaugagaaaaauggcaacaugggaggcaggaaaacuuucauuaccuaaguggacaugaacuguaucuguaccuuauucacuucccuuggagggcuauacaugauccaguucaaaaguugucaaaauuauauuauaucuaugugcuauauguauuauauauuauauacaauaugguauauauaauacauauacauauguguauuuuauauacauauauaucaguauuuuauauguauauacuauuuuauauauaaauauauauuaauauauuuauaugagucuauguguacauauguaugcauauguauaugugcauguauauuuuauggguguauuuuuauauauguauacauauauguguauauaugaguauauguguacacauguauauauguguguagauguaugcauauauguauguguguguauguauauguguauaucugcauauauaucugcauauauauauauauauauacauauauauauauauauauauauauauacacauacaaaguuuagcaagauaaacuuaguuguguaaauggguuuuggugauaucuguacagcucuaugaauaauacuacugagcuaugucauauucauauuagaagugacuuacacuacugucauauuaacugaaaucuucaucucucuuacagacacacaggaaagggacucacugauuaaggacacuauacaguauuguguuuaaaauauacuccagauuuaaaaaaaucauaaagauaacauuucccuaaguuuauaguuacagagcaagaaacaaaaggcauagaccuguguguggaaggaccaaggauggcuaggagguagaagagguagagaaggcagagugugcucgagggccuuuaacuugggucucuaugagaaaaaauggccagagaauuauagauacacuggagaagcucuguaguggauaguuugaaguguuaacaggcucuggccuacaaggacaguccccacuucuucaauacaugagaugauuuauggucguggcaauguugaggugcugugugagaguuugagauuuaauaugaucagggguguggacucugggcugguugguuuguaugcucagaggugauuguuuacauaacuguaggaauuaacucugggaagggcuuugucucccaaaucaaagccucaaaugccagacuacccagauaacagaaagcaagaaaauauaaucaaaaaagguccaggguagguggcaaauacuuaaaaauauaguguuguguagcuauggaggcgaaacagaucucuccuauugccuauguccucugccgccucugaaaaucacaaggagaguagagcguuacaaugguugagcaaagauggcuguuggaucuuacaaugccaaaaguggguuccuaaauucucccuguaaggucaaaggccacagcagcaaagauaauaauuuguuuugacuuuggcaccauucuuugcuucguuuaaguggaagaaaauuugaacgcgauauauauuuuggaagugggauuauaaugaugaacaaguagaacacauuguaaaucucguugugcucaacaucguuccucugagagacuaugcaaagcacugauugaagguacccuucaaaguauuguccuguggagcuuuaauggcuuuuauagcugcucauacccaucugcaaucucagcagcgauccacugagcauccuacagggcugucacugaccccuggcaguaucucugcauugccuuucuuauaaaggauaauagcccuguacaguuuuccagauacuaauaguuucccuuuccuuuuuuuuuuuuuuuuuguuuguuugguaguuuuuaaucuagaggugauaccagcaaaugugaugccuugcuccagcuauuuauuuuauguaacucccucuacaggagccccaagucuuagucucuuggcaaugugaacuagaaauacaggauccacuccuucaagcagaugcagguguggaauagcauccucaggugcacuuucugggagauagcgccucgagagccauuccucugguccgcauagcugugaacuucagaguccauuuauuucuagccuucaauaugcccagaugcuauagacagcagcauuuuaaaaagaggggagaugggaagcaagcagaaguuggcagacuacagaaacucugcaacccagcuuggcacaagguuguugaguguuugucuauuguuguugguauguucauuuauugcuuuuuuuuuuucaauugaagcucaguccuguuguccuggaguugcucacugcugcuuuugauuccuggaggaauagaauggagcccccaggacuguauauauauauaaaagcuacauuuaaaccauucagccauggucuuuuguauauuuaaacccuagaaaacaaauauaccaucauuaaaaugaguucuagucucuggguucuugguuuuuaacucuuagugauuauccauuuugcauaaggaaaaaaaaucuuauacuuuauuucuguccagaaaagcuuagauagugcaaaugacauuuuauauacuguauucucgcugguccuuucaguacaaccuaggcacaccucccccagaaucauccucucaggaagacuaugggguuuauguucucuaauucagagccugucaugagguaaaugcccuauccacagaccucuucuacccagaauucccuuugagaccgcugggugccucugugguacucuuaagcauuuaaucaguuccaucccucaguaaggagucuuucugaagccgucccucacuccuuucugaagucuuucugaagaugacccccggcaacagccuguucaugaacuccaggcuucuacuaaugcuugccauuguaagccucuacccaacauucucuuugaggccacaagaaugucaccaacaccuuuuccccaauacccuugaagcuacuugauccaaaaguuauuaugguaucuuucaagagacugaaaugacuguaagaauuuuuccagguacuaaaauuuguugcagucaugguugcuacuucaaguaaucuuggaaaagcacaaucaacccuguugcgcgcgcucaacaggccaggaagaacgacgcugcuacaggauccuucugcacacauuuauucaguccuguuucuucuuucuccauauaucucccuuguuuauaucucccuuguuuuuauaucucccccgaacccugggccucucacucuuuuauacucucaguucccauccacgcacagcaggccacgccaccucaccaggcaugcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccaccacacccgcuccccacaauucccccuuuuuucuuuuuuggcagagagaaugucuguagauagccccccgcagccaugccccuuacccguccuugggugacaaacagcauugguuugaucccugucuuagguuggugacaugcccagggagucuuaucacugacuaccucucuauuaugccaagccacaccuggggagauuguguuuugcuuguggcaggugcaucaaaaggccaggauguuaauuaaccuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccuaggggaagggaacuaggacacugaaccuucaugcaaucagacgugccuuccacaggaugccaacagcaagcuauccucugugcagugcuuagccucgcaccccacggcauaacgcagcauaauuucuuuuagagcggcaaaccgaaucugaggagauugucccgccuccacugcagcaaaagccuacacuaccauggcgaaagugcgggccgcacacucugcaccuaacacaugugucaaacacaaaacacacacacacuauaacaagcauacaucccagggcucucauccccacucaucuucccugaagcaagggauagauggccagcggggcuaucucuuuaaggggaauucagggaucaaaaagcguggaaaaauuugaaugucauguugagcugguaucggcuucuggaauaccgaaaggaucucucaucucggcuccauccuuugugcuugugggaucauccaccauauccacaggggcaacuggaucaggagccucauucuugcagcgucucaccaaucucuccggcacccaaagagguuccgucugguccuguggaaacacacaaacagacccucucgcccacgucaacaccggaucuggucgauccccaggggagauggacacaauaccucgugguaaugagaccauaaccucaaucaccuguguguccaucugggaagucaauaugaaagucaaguuuucacuagcuuccccucuguugggcaauaauuuccgugcccuuauggcaaucugauucaccugcuuaaacaccugcacuggauauccugucuguuguugugcaaaucgaccuugaucaagcagcauaucucuaucccaugcaaauucagcuugaucagugaaaauaggacaucccagcaaggagaaucuauccucuuuccagaccuccggacagaaggucugcccauagauggcugcugaggaggcauagggagggggagcagaagcuaauucaccuccuccuccgccucgacucuguuguccuguccuuucuguccaccugauaacacugugucuccuuucuuuuuccuuuuucuuuuuaagcccuuuuccucuucugacauacuuucuuguugcucuguaaggauuuucugaccugucuugacugccucuacacacaguuucaaacaguaacagaguccauauaucagaacaaacaagaccaaaacuaucagaccuacccacaaagggucaaugggagaaaaaagcauaacuacacagcgaggaucuauugaucacuacacugagguuaucauaguuccuuaacuuguccccaaaccaggaaccuuaacuugucccaaaaccaggaaccuuaucguuacuuugugccuccuuccuggcaacuuuauacuugccucaauuuuauccgagguccuucccaaacuccuggguuacuuugugccuacuuccuggcaacuuuaugcucaccucuauuuuaucugagguccuucccaaacuccuggggucccaaguuucacucaccaugaacuuacccugccggcaaccacugacugcugaaaguucugaacucggugggggagucgguuccccguacgggccaccaauugucgcguccgcucucgaccagcaagaacgacaugaccaccaguccuucuaacagcaguuuauucagucuucaucuuucuucuuucucuucaucaguaccguuccccagcugaagaguucugaauccacgccagauccuucucaacagucuguuuuacgggaaccuuuauuaaccccuucuuccccguuaugcaguucugaauccucccuguagcagggggucuucgcuugugccugaagauguuucuuuucccggguuuucagcaccacuucuuacgcgcgcucaacaggccaggaagaacgacgcugcuacaggauccuucugcacacauuuauucaguccuguuucuucuuucuccauauaucucccuuguuuauaucucccuuguuuuuauaucucccccgaacccugggccucucacucuuuuauacucucaguucccauccacgcacagcaggccacgccaccucaccaggcaugcagcuucagcuaaucagggcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacacaacccagagguuugcucuugugccuuauggucaauaccucuagugcuuugacaaaauaaacucaaaggcuuuaaaccgcuuacuccuuguacugcuaugcgugcccuuggaaacuugcauauaaucuuuaaaaugacaaaggaaaagaaaccuacuucugacacaugaaucagauccuuauucaacauaacagcugguaaguagucuauagauacuagugaaacagaucaucuccuuaagacugugugcgucagcaauuccagauguaaagcagucacccgcuaaugcgagcuuuguaauaggcuugcaaugcucaugccaucucuuuauaguuaguucccuaauaguuuaucaggugaacgcugcgacuccuuuuggguuuauucuaaccaaagucuacauuccucuuccugucguuccuuugucaggagaaccuucuuuacucaguaaucaauuucaagacaguucuaagaugagauauuaggaagucuuuaagcuuaagagagaacugcaauuuugagaugaguauaggguugggggacagcuuaguuaccauguauagacuucauauguaggggaccccagguucaggucacagagcuauaaaggaaaaggagcuuguuguuccccaggcugugugccacaauaccucucugcccuucccacuucugucaugucuguugguguaguucuuaguaaaugacagugucauuuuaagauuccaguuuauuuacuucucaugaaaaccuauuaaagacuuuuuauuuaagauacccuaaucauguccagaauuuaaugaaaaauuaaauauuucauuucagaagauuaaagaaaaaccuauuguucauguuucagaggauuuaaguguuuacaaggggcagggaagacacggcagaggagcaggaagcuaagauauugcacuucaacuguacacgggaagcagagugaacaguaagacuauaaacccucaaaucucucccucauuggcaggcuucccucaggaagacccauauccuaaacguuuccuaguuucccccaagcugccaccagcugaggaccaaguuaucaaauaugugaaccucuagggaacagcucucagucaagccacaaugcaaaauggcagcuaacaaucuucaugauuccuuuugauuuuuaggcuuugaagggguguuuggacaacaguaucauucauggagaaaagaaaaaacauaaauuagagguaucuauauugacauauaaggagcuagaagaaaaaaaugcuuacgaauuagugaagagcucuuccuuuauuuucaaaauugucugaccacggaaggucuuuaaacuucugguuuuguucaaagccuggguauguggguguaaacaggaucuguuugugggcaaacaggauuuaguucaagauacugaagugucuuuaaacugcuaugauucauucacugggccaugugggaauucagacagauagaaaaguagauuacgggucucugcaugauggagugcacauuuuauuaggugcaacagacuacaguaaaauuuuacccccgagacuacuccuguacaggucucaucucagggccugaacaacggauauuugucuuuucuacuuaagcuauaauucuaacagucucuuuguucauucucagcacauauacuugauucacaaacaaagugaucaaugugggagucaccaagagguguaauucuacccuuugugacauaaaagaaaaaacuauuuagugcggcugucagaaauuaaguuguccauaaaagauuuguuuuuuuuccccccaagggaaaaaacacuacuguggugugggggaaagauggucuauccgggaagagcaguuccccauuguuacugcauucagugggacagagaucugguguggaagagauuugcauagcugaugaaugcucuguccaugucuacccaagcaaguuucucagacucuccuauauuuuccccaccaguggcuaaacaguuacaccuuggcugccacugcaagucccaauguccaaaugaacuccugcaacucugcugagcugagcuacuagagugauaagaacguguuugcuucuguagcgaauauuuacaguaacaaauaaccagaggcuggggaauaguuuggucagcaaggugcuugcugugaaagcauuaagacauaaauuugguccacagcacccguguaaaauuaugaggugugguggugcaaccucaccauccuagggcuggagagguaaagacaggaagaacucuggggcucuuugucuagucagugagccucagauucuagugagagguucuggcucaacaaauacaguggauugauccugaggcaugauaucagaggaugaugucugucuuauacauacauacauacauacauacauacacacacacacacacacacacacacacacaccugcacucacauuugcaucccuacacuuauacaugcacuauaucuuguugugauaaaauacucuaaccaaagcaacuuaagggaaaaagaucuaguaugguuuauaguuccagguuucaguccauuaugguagagaagucggggaaggagaagcuugaagcagcuggcuauauggcauccauaguccggaagcacaaugaaugcuugugcucagcuuacuuucuacugcuuauacagccuagaauuccagcccagggaauggugacacccauagugggcauuaaccuaaugaagaccccccuuacccccaacacauccauaggcaugcucaucugguuuuuuuuuuuuuuuuuuugguuuuucaagacaggguuucucuguguaucccuggcuguccuggaacucacucuguagaccaggcuggccucgaacucagaaaucugccugccucugccucccaagugcugggauuaaaggugugcuucaccacuguccagcuggcaugcucaucucuuaggugauucuagaggucauccucuggaauuaacaauuaaaauuaaccacuacacacacacacacacacacacacacacacacacacagagugagagagauaggcagacagacacagaacuggaaaaaaguugcuaauaucuaacaaucuagcugacuuauuaauuaaagaaacauacauuaaacugauaaauggagaaagagaaguacuuuaagcaugaauaaaguauaagcccucuggaaagaaagagucuuucuuugucauggcuaauacaauucucuaaauauuaaacauaucuaucuauuacuagucuuucuuuugcuuuauauugccucacauuaaucuaaucuagagccccuagcauuauauauagagagcacauuguacuucuggucuuauuccuuguaauacuggucuuacuccuucaaaggacaaugcaccuccugaagagagaggucauggucuuuguucuuguuuucaguaggcagcauggugccuagugaaggccaugaacagcugcaugcuaacugaccugguugcuaggugccugacaaacacagcugagagacgaucucaaagcuuuuaugaaaaagaaaagcuaaauaaaccagcucugugguguggauaaaagacaauugagaagucaucuaugaaaguacacaauucagugauuuccaauggagaauuguaaaaccauucccguaaucuaaucuuagaacuuuucuaccaucuaauaaagaaacaucucaccaaucaugccuuguuuaccuuauauuucccuaguccuaggagauuguuaacucaguuucugucuguauauagauuugccucauuuggauacuucauguaaauggaaucauauaaucauauaauccauggaguuuuuaaaacuagaauuuuaucuucuggcaaaugcugauuauguuuuaaaaauacagucaaacauuaucaaaugugaucuuaaaugugugcaaaugcauaacauauuuggagcacgcaucuucuuucuauaugcaugccgguguguguaugugugcauguguguguguguaccucugugugucuguguguauguauuauugucaauugucaacuugaagaaaucuagugaaaggucaauaacacaaguacaaggugggccuuugcaugacugaacagcuuagaauuagcaguuaaaggagcuuucacccccaccccuuccuaccgauuugaguucucugcagaucuccaauaguucaaaccauaacucucaaucaaaggagccuuacuuucuuugacuaucugaauagaaggauccuacaaacacagcacaagguggggccacaaaggcagaugucugggucugugaauaaagggcaagaacacuacagaauuuacuugcacuguacagagaaaagaacaagaaaccaaaucacacaucuagcacugcuucagggagguuugugcgguagcuguucauggcaacuagugcuaaguuaguauaguauaugcugcaugauccauuccaagaaaagcuaacggaacguuauccacuucagaggaaugaauacaucuauacuucugaauuuacaaauuuguaagagaaaauucugagucaugagagaagggggacgcuuugcuaauuggcuuacauggagacaagucuagcccaacggacuaagucagucaggggacacugcuaagaguucagacccgaauucuucuaucuaucuaucuaucuaucuaucuaucuaucuaucuaucuaucuaucuaucuaucuaucuuaccuaccuaucuacauaccuaccuaucuacguaucuaccuaucaguugguguguaauuccaaauaaauuagaaagcacaaacauacuuuuaucaccuuuuguggcaaugcaaagaccuguaacuaguguauugacucuuauggugcugagaaaagaaccccccaccaccacccaguuugggggaguaggauacauauuaccagaaagcaacugcacugauggagaagcagaauuauuuaugaggcauaggcuuuugacaugggcugucacagguuuaauucuuguaccaguuaaacaaguguuuauugagaaacugcuaauuaaauugaggcauggaaauguugacacucaacucugagagaauaaaaauaauguuuuaauuuaguucauuauaauuaauccacguuaaacacugucgugcgugcugggcauucagcgagaacuaaacuccuaacucucaugaagcuuaugacuuagggacagaggauaaaaaccagucagaggacaaaauguucaucaaggauagaugcaauuuacaagaaugaagaacuuuaggggauaaguacaguuauaaagggaggaacuuguuacuuuauugcgagugagaaacccuuugcuuuggguaaagcagugucugggaacagagcuguagaacaaauaggguaagucacuagguugcuuggggauggccagagaggcagaagaggaagcacaaaggcucugaggugcaacugaacuuggcccuuucacacgcagacucacgcuuugcaagcucauuguagcugaagaacuuggcuaacaccgugaauggugaaaggcaggcuagcgaggcuguagcaacugcccauguugacuuuggacugcuuggcaaugccugcuuuucuaugaacuaugagcuauaaacuguggaagguuguggggagaagucacuccuguuuucaaaggauagcucaucacuagaucaaaaauagaucuccaggagaacgaggcagaaugccacauggacgccaugcuucuuguacuuccuugcauuuuguuuucugccucugaguaauauguuucaauaggaacccugguuuucaauaguguuggcaauggcagaggcuuaccgcuuaucaauuaugaguuaaaugucucaguuguggaccucacuguugucagguauccaccuuuguucuaagcuuuauguccucugcuggauuagugaacacagggcugugggagggaguuaccucuaacacaggaacagggcugugggagggaguuaccucuaacacaggacuggggaaauggaaggcugauggguuccuucccauguggcacuacuggaguaucaccauaaccguuagcuaacugauaauuuaacuucaaggguuccuccccacccccaauuccuauggaaaaaaagaacuugaauaaaaauagcugcuuccauuguggcugcuaaagccuauuguuguagcuagauaccuuuacuuauucaagaucaccggucuuugaagaaagucuaugcucucuuugauguaaauguggauucuuuuagcucugggagaaaaggagucuacuucagaagaggagaaaaagcauuucccugaguacauuagagacagcugaaauaauacuuggcuggaauuuuuugauuuuuauuucucuacuuauaaaaaaaugcugccagaugcuuauuggaaugaugaauggagaaauuaaaugaaugaacaucuccauugagaugugggucagaauccuucuaaauacuucuaagaaagcucuggcuugccuaggaguauuaacaaaaaaagcaucaugaagaggggaauacguuuccauaaagaagagcaaaaccucagagugcaaccuuuaagggaugcuaggagaucuugguuucuccacgugaagguaaagcagggacuucuggcaugaaguuuaauugugcuggacuuucuagaagaguuggauaucaguaaagaaagaagcaagacuuaguggcuaacuuagugcuucuucguugaguugagugucccaagucacaaaacuagaacaauagguggccaggaagacagacaggggaccuguucucgcagauugguuccaacagugauuugcaauggacacucgaauccaccagccacucaaaauuaaaauaaacacagaaagcuguugauuucaguaagauuauauucucuuaagccuuuucucuccaccuuuaauccagcucuuuuuguccaaaccguguuauuuucuugacaacuucguuguugaagcuuguagccagucuccugugaccucuguggcucuuccacgugcuggcugaagugaugcuucuauaguguaaauuaaaucagaaaaucucugaaaaucauuuacuagcugcucucguuguacuccccaaacaaagaccaaagccuuuucuguacucuuugaaagccuguauguuacaggccuugucuaugacucugacugucccaguuaggauuuuauugcuauaaaaagacaccaugaccaaaaagcaaguuggggagcaagggucuuguuuggcacuuccagaucacaguccaucaggagaagucagaacaagaacucaagcagggcuagaaccuggaggcaggggcugaugcagaggccauugaggagugcugcuuacuggcuugcuuccuauggcuugcucaaccuuauuucuuauagaaccaaggaccaccagcccagggaugguuacacccacaaugggcugugcccccgcucaucacugaucacuaauugagacaaugucuuauguaggcauuuucucaacugagguucauuccucucugaugacucuaguuugugucacguugacauacaaaaccaguaaguacacugacuugggguuggauuguucagugaaguuauuuugagguuuauucauuuuguucuuuagguucauaacuuauuccuuuuuuauaccuaguagaacugcguaugaauacaggacaaucuguuuagccauuuacccuuuggagagucugaaguacuucuaguuuggggcuguuggaaagagcucugcaggacaauugcacacaaggcuuuacaaaccauagacauuuauuugugucuaauagauacccaggaauagaaggugguacacuuaaaacauaggugcaaguuaaacuuaaaacaacaacuacagcaacaaaccccugccaaauaguauuuuuuuuuccugaagugagaaaacauguugcauucucauggauaacauauaaagggagcagcugccucuuguucccaugaccuccucauaaccuuugauuuugcaguaaguguguacugaacuaacagcucauguacauuguuuucccacauguuuguuuaccaacuguauaucuuuguaucucuuguggagaguugucuuguucaaaaaucuuuguucaauuuuuaaugggaaugauucuuuccggacuguuggauucauucuuacauacucugaaucuagucacuuaucaaauaugauauuuaauaauacacacucccagucucauguuuuucuucuuauuuuuaauaacuuaaaaaaauccagauguugugggaaaagggaacauucgcccacugcugauggaacuacacaucuauacagccacuauaaaaagcagugucaaguccuuggaacgcugggaauagauuuaccugaagauccagcuugaccacuauuggucauauacccaaaggacucuacauccuacuagagagacaaugccucaaccauguucauuacugcuguauucauaauagccagagauuggaaacagcuuagauguucuacaacagauggaugaauaaagaaaaugugcugcauuuacauacuggaauauuacucagcugcuaaaaccaucaugaaauucauagauaaauagauagaucuagaaaaaaaauaauccugacccaaagagacaacacauaugguaucuauucacuuaccuguggauguuagcugcuaagucuucaauaagcaggcuacaacuuguaugaccacagagguuagguauaacguaagggacuagggauggggaaaggaccucucuaggaaagggaaauagcuugacauagauggaauuggggucagggggaaguggaacaggaagaucuaaagaggaaaggaaggaaacagauggguaagagagaaaauauggaaaggaacagcuaaacuuaagggccauuugcagugucuuaagaaaaauuaauacaguagaaguuucuuaaaagacacacaaacaugaaagaaaucuaaauuggaaucacgaaauaacaggggauacaaagccccaauuaaauaucucuugucaccaaaugaaaccuccagggcuggggaauggguuauaucuaaucaaauucuugccaaaaauggucccaugggaaaccccaaauaacccaggcuguuaacaauguuauugguuguucucaacaaacugaugauaaggcccuauaaagugaagacaacaacuacauuaacucacagaacuuuuucuauggaaaaguagaauugguaacuacauagagccuucaccaccuacugucuaguagggucuuucucuuagaaauguuauaguuaagaaucuuuuucauuuauuuucauaaaccauuuaaguuuucacaugcucuccuaguuagcuucagccaucaaccugacacagcuuaaaguucucaagggaguuucaauuggggaaauugccuugcucagauuggccucugagcauguuugugggacauuuucuuaauuguuaaaugauauagcagggccuugcccacuguggguggugccaucccuaggcaaggaggccagggcuguguaagacuggcagcugaaaguggcucccagaaaagcuguggaacaauguuccuucauuauuucuaugucaggcuccugccuugaguugcugccuuuggugauggaguguacccugagagaugaaacaaacccucucuuccucuauguuguuauuggucagagcguuuuaucacagcaagaggaaacaaacucauggugugagguauagauaaauauucuucuuuuaaaaaaagacacccaauuuuccaauaauaauucuugaaaauacuuuguuuucucacugaaaugcaucucuguuugaaaucaauuaaccacaugugugggggcuuauuucuguauccuguauuuuauucuacugguauguuuaucuuuacacugauacaaaagccuuauaauacugugacuuuagaauaagucauugcuauaagcagagcaacugcaacuuuucaaaguguuuuuuuuuuccuuuuuaauugugcauccuauggguuugagaaucaguuugcuaauuucuacaaaggccugcuagaauuugacucaauauccaaaauuauuaucacucugauucuugguucuuugaugacauggguuuacccaaggcugagucacaucauuuuuuuuuucagcucaaaaauaaccuccucagaggguaugcuauucaauuuaaauuauuauuccucacuucuccauuucaaacauuuuacuugauugacuucaagcauuaacugucaucugagauuagcagugucugccuguuuacaaaguugcucaucugucuuuccaaacugagaaaucuaaguuauaguagacuucacuuuucuuucucuauuuguauccacgaagccaaaaaaguaccuuggagaaacaaacaguaaauauuuaucaaaugaaucauugacuauuuggcaaacacaucucucaguaagacugaacugguauggggacacauaaugcuaaucugaacaaaguuaacuuauucccagugagguauuccucugugaagguuugggggacuugaaugucacuaagagaugcaguucucuggaagguugccagugguguuugcugagguauaucugacacuccauaaacaggcaacuuuaaaagccacucaacucauuaucuaugcaucauuauuuaaaagggauccuauaagccaccugugauggcaacacaucuuuaaucccagcacuugggaggcugaggcagaaggaucucuggucuauggagugaguucugggacagccaaaacuacaaagagaaacccuaucuugaaaaaccaaaacaaaccaagcaaccaacuaaccaaccaaccaaccaaccaaccaaccaagcaaccaaccaaccaaccagguaaaaggcaauggcuggggauugggggugcaugaacaucaaauuagcauuacuucuguuaucuuuugggaagggaauaaaucagaacaaauauaaauuuucuacaaacauuugcuggcaaugauguggagaaagaggaacacuccuccauuguuggugggauugcaagcuuguacaaccacucuggaagucagucuggcaguuccucagaaaauuggacauaguuuuaccggaggauaccgcaauaccucuucugggcauauauccagaagagguuccaacugguaagaaggacacaugcuccacuauguuccuagcagccuuauuuauaauagccagaagcuggaaagaacccagaugccccucaaaagaggaauggauacagaaaaugugguacauuuacacaauggaguacuacucagcuauuaaaaagaauaaauuuaugaaauuccuaggcaaauggauggaccuggagggcaucauccugagugagguaacccaaaguaacacaaaggaacucacacaauauguacucacugauaaguggauauuagcccagaaacuuaggauacccaagauauaagauacaauuugcuaaaugcaugaaacucaagaagaaugaagaccaaaguguggacacuuugccccuucuuagaauugggaacaaaacacccauggaaggaguuacauagacaaaguuuggagcugugacgaaaggauggaccaucuagagacugccauauccagggauccaucccauaaucagcuuccaaacgcugacaccauugcauacacuagcaagauuuugcugaaaggacccagauauagcugucucuugugagacuaugccagggccuagcaaacauagaaguggaugcucacagucagcuauuggauggaucacagggcccccaauggaggagcuagagaaaguaaccaaggagcuaaagggaucugcaacccuauagguggaacaacauuaugaacuaaccaguaccccagagcucuugacucuagcugcauauguaucaaaagauggccuaguuggcgaucacuggaaagagaggcccauuggacuugcaaacuuuauaugccucaguacaggggaaagccagggccaaaaagugggaguggguggguaggggguugggggggaggguacaggggacuuuugggauagcauuggaaauguaaaugaggaaaauaccuaauaaaaauauuaaaaaauaaauaaagauaaacggaagaaaguuucaggaggaauaaaagcauagguauuucaaaaacaauacuuaauuuaaugaugaauuagcuauaguucugccagagacaacaauuagucuguauuguuuuauugugcauguuuaaaguaagaacuaagaaaaucuguuuauuggacucaaaugcaugagccuggaaagcucgugcaguacaacuguaaagcccagggguuaucuggagaucucuaguuccacacaagcagaacuguauccacugagcuguuucucucgcucagaagcuuuguucaacccauccaacccaccaaauuuggaugggcaugggcuacaaguuaggaauugggcuaagugauggagauaagaaauauagaaagaucuccaaacuuucaaagaagucacaggguuuaucaucuuuauaucaguaagggaagcccacaacagaagagucauaaaucaugaaaauaaugauucccccuucccuuguuucugcuucuguuuucugugguuuuagaguggcccucauucaauauuuaagccuugaagucacaguaggcuuagcuuuccccucgcucagcccagugacucacagguagcagcuacggaucucguauucuauuauuagccucuuuaaaccuaauuauucuaagaaacacuuucuacuggcaacaugguaaucauguuuaaauauaacucucccuuaucaaucuccaacucccgauuuucauaaccaaguuucuguuuguuuagaugugaugauuucuuucuuuaaguuaagccacauuuuaaugguccuaguugauuuuaacuuguaaaguagguauguguguguguguguuccugucuuucuguccauccaucuaucuaucuguccaucugucugucugucuaaagcauguagcucuuugagugaagaucacuggcuagccuaguuggauuucuuucccccaauucugucugcaguguucagggguucuagagguacagugucaggauuagaacaacucccaauucaugguuaugcaauuacagcaggcauggugacugaaugcuuccuauguacaaagaacauggcagcaugcauacuuuccuugauaucugcaucacaccuauaagguaaucucuaccuucuauuuccucauuuuaacaaaaagucucaggcaggcuaaguaaauuguuccaauuuuaucauuaaguaaaggaacaaggaccaugccucgacuucaucuuucugcucacagcuggugcauuuagcuacuguauuaauguaaaauauguuuuaagcuagaaaaaaaaauacuaagauuaaaaaagaaucuuuuucuauauccuaugugacccuauuaucccagucuuucaguaaauuggggcaauaaggcugcaauuguucauuaucuacuuucauacgcaugucugauucuuuuaaaauaagccauuuguagaaaaugucuaccucuguggaguuggauuuguugauauaaaccuauagcugaccuuccaguuauuuuuguaauuuugaccauaggucauucauucaauuucauuuuuguagguucugaagaauaagaaguuugugaguuaauauauaauauaaaaugucaauauaauaugaaauauaggcuuaauuuucacagcaaaccuuuguuuaaauuacuuuucucuuucucuuuuguucuuucaaacuguaauaaaaaugaacaguaguauaaauaugauucucuaaaacauuucuuacuuguagguuucuaucccauuccucuguaagacuauauuuuucuguucagucauucauuauauaaccguuauaaucaaguacccaacuuucauguuaaaugguuauccaguuuuccaaauaacuuguucuaaugauagaauuuaggacagaucugcaugcaugugaagacucaagaaaaaaauaauuaaccaauccaauuucucaaaauaaguaauuaaaaaaaaucucuacauuccccccacauuuugguugagcaauugaacuuuauuuuugauauuagcuguugacaucucccgccuacauagcuucgggggugaguauuugcuuuauugauuucuugucuuccuagaagggacaaugaauguuuuggaccuauugcuuuucccgucuuuggugggcaaaucacaguuccuccagucuguuuauugaauuugccuucauggucaauacagauggcuguaaucaaaucaauucuggaacaagcugcacugaauucugaaagcccauaugaacggaucagccuaaagaugacggaaucuaugcagcugccagauaauuauuuugaugcacaaaaaugaaaaaaaaaugcuuuaauuaauuuaccaggagggaagagacuacaucaaaaagacuaaaauuaaaaauauaacuaagggcauuaaaaucccuaaaggguuaggccugagggagagauuucuaaaggaugcccaaaugacuucaugcagaccuaaagaucuagcuaaugagugguugcuaaauaggacaaaugcagcucauuauccuuuuagaaggacaugaauuauagauaauuauagguaaacuaucacugcgaucugaaaugagauggagaugacacguugggccuuuguuuucucccacaauaacacugaacauccccuaaguucagauuugcaagugaauguaaaaaguagaccaaaauccaguguaacaaaaccaaauggggcaccuacaaucugcuugcaggauaaucuugcuugguuugcauauuuacaaaucucuuuccuaauaaaggaaagcuagagaaaaguaaagagggucauguccaccuguuuugcagaauuuaagcaggcaauacauuguuuugagaauagaguugugguaagguggagagaguacauagaagggaggauugcuuguuuuuccuauggauuauccuuggucugguuugguggagagauggagcuugccuguccaaauuuuagacaccagucugauguggacgcaaaggcugggaaaacaauauaagugcuauuugaugaugagaugacuccacuagauuucaacagagccauagaacagaaacacacagguacacaagaaggcuuguuggguguugugcuaccugauuugggagguuaaaaaggucggugauaggccaauggcaagauaaggagccaacaaagcuggcaguguaauuuaguuugaacauagaugcccaggaaggagaacagaugguuuaaugcccuaaaguccaaauguggaagaacuaucaggucugauguccaaaggcaaguguagauggacuucucagcucaagagagaaugaauuagcccuuucuccuucuccuucacuuuuuccuggaucugcaauagaauguaugacaccuauuucacugauaagagcuuuacuuauuaaucugcugaucaaaugcuaaucucuucuuuuacucauucacuagaucauuaaaaacaauuugguauauacuguaagccaggaaucaagggaauugaaggcauguuuuuccuuuauggcauuuaaaacuagugagaaaaaaauaaagacaaauuuuucugugcacacucaggugggaauuaacacaaaggcgcaugcauacauacauacauacacacauacauacauacauacacacacauacacuccauaugaaaaucaacaacaacacuaaaauucauauaaacacaauuacagauguuucauaacagauauggaagcugcacaguauaguauaaugaaggggauauacccaucauagggcauuagagagagccggcagggugcaagagauucaucaaguuguauuugaaaacgaggacauguuauaacuaguccaaguaaagcaggaagagcccaccaggcacccgaacucugggugggagugcagugaaagcuuuuccugggagccagggagaaggauccuggggcacacucuagcuccucuugcugucucaaacuuuaaggagacagucacacauuuaaagauggagauuuucucuuucugaugagagucugguauagauuuauccugcugcagagagaucccaaaugugaaaauguuuuuuuuuuuccucccagaauacaugaugugcugguugguuguauggcaaaagacuugcuugaaguacaagggaauuuuaccaauuaaaaaaaaaaaaagaugccuaggguuucuucuugaguuucugugcacacucaggugggaauuaacacaaaggugcguguauacauauacacauacauacauacauacauacauacauacauacauacauacauaauacauacacacacaacuucuugaguucuuuauauauuuuggauauuaguccucugucagauguaggguuguuagugaagaucuuuucccuagucugccguuuuacccuuuugaugguguccuuugccuuacagaaacuuuucaguuucaugacgucccauuuaucaauugcugaucuuagggccugagccacuugguauucuauucaggaaauugucuccugcaucaauucguucaagauucuuucucgcuuucuuuucuaccaggcuuaguguaucugguuuuauguggagguccuugauccacuugaguuuugugcaggaugauaaauauggaucuauuuguauucuucuacauguagacauccaguuagaccagcaccauuuguugaagaaacuuucuuuuuucccauuguaugguuuuggcuucuuuguugaaaaucaaguauccauaggugugcgaguuaauuucuggaucucugauucuauugcauuguccaaccugucuguuucuuuuccaguaccaugcacuuucuguuacuacugcuccacaguacagcuugagaucugggauagugaauccuccagaguucagcauuguuuuggcugccuugaguuuuguuuuguuuuguuuuguuuuuguuuuuguuuuuguuuuucauaggaaguugagaauuguucuuucaaggucuguuaaagaaucggguuggaauuuggauggggauugcacuaagucugcagauugcuuuugguaagauggccauuuucacuauguuaauccuauggauucaugagcaugggagaucuuuucaucuucuaauaucuuuaucaguuucuucagagucuugaagaucuuaucauacagaucuuuuacauacuuggcuggcuagaguuacaccuagguaguuuauguuauuuguggcuauuauaaagaguguuguuucuuucucugccuguuuaucauuuguauagagaagggcuauugauuucuuugaguuaauuuuauuuccagccacuuugcugaaguuguuuaucagcuguaggaguucucugguagaauuugggggaucacuuauguauacugucauaucauccauuaauaacgguaucuugacuucuuuccaauuuguauucccucaaaauccuguuguuaucuuaaugcucuagcuagaacuucaagaauuauauugaauagauagggagagaguaggcagccuugucuugucccugauuuuaauggaauugcuuuguuucucuccauuuaauuuuccauuggcuguugacuugcuauauauuuuuuuauuauguuuuuguauaugcuuugaaucauggaucucucuaagacuuuuaacaugaaaaacauggguguuggguuuuuucaaaggcuuuuauaacaucuaaugagaugaucaugugauuuuugucuuucaguuuguuuauauaguggauuauguugauguauuuucauauauuguaccaucccuguaucccugggaugaagccuacuugauuguggugauugauguguucuugcauucaguuugcaagaauuuuauugcauauuuuugugccaauguucauaagugaaaauggucugaaguucucuuuuucuuguugagucuuugugugguuuagguaucaggguaacuguggcaucauaaaauuagguaguguuccuucugaaucuauuuuguggaauaguuugaagaauauugguauuagcucuuuguugaaagccugguagaauuccuugcuaaaaccaucuggcccugggcuuugggggggggcuuuuaaugauugcuucuauuugcuuagggguuaggggacucuuuaguuuaucugcucuugacuuaacuuugauauaugguaucugucuagaaauucauccauuucauuuagauuuuccaguuuuguggaguacaggcuuuugaaguaauaacuaaugauauuuuuggauuuccucaguuucuguuguuauaucucccuuuucauuucugguuuuguuaauuuggguauugucccuaugccuuuuuauuaguuuagcuaagaguuggucuaucuugauuuucuaaaaaacaaaacaaaacaaaacaaaaacagcucauguugauucuuuguauuguucucuucguuucuauuugauugauuucaucccugagucgaagcuaaacucuaacaaaccaaauaacccaauuaaaaauggggcacacaacuaaacagaauucucaacagaggaaucucaaauggcugagaagcacuuaaagaaauguucaacauccuuagucaucagggaaaugcaaaccaaaaugacucugagagucuaccuuacaccaguuagaauggcuaaaauuaaaaaaaaaaaaacucaagugacauuagaugcuggugagcauguggagaaagaggaacauuucuccauugcuggugggagugaaaauuuguacaaccacucuggaaaucaaucugccauuuucucagaaaauuggaaauaguucuacaugaagacccagcuauaucacuccugggcauauacccaaaauaugccucaccauaccccaaggacauguguuccacuacauucacaggagcuauucauaauagccccaaacuggaaacaacccagaugucccacaacagaagaauggauacagaaaaugugguucauuuauaccauggaguacuauacagccauuaaaaacaaggacacugugaacuuugcaggcaaauggauggaauuagaaaauacccugagugauguaaaccagacccaaaagaacaggcaugguauguuuggauauuagccauaaagaacaauacccaugauauacuccacagacccaaagaaguuaaacaaaaaguaaggcgcaagcaaggaugcuucaauuacacuuacacgaggagacaaaauaaucauaggaggaagaaggagggaggaaacugggguggaaaagaggagaccaauagaagagcaggagaggaaggggagucaggaucaggugcugggagaaagagggcagaggcccagugggaggcucccaggagucaaugugggugacuuuugcugagauaccuaacaacagggacauggaaccuguagaugucaccuccuguaggcaggacccccaggggaacgauagggacaccaacccauccacuaaacuuuugaccccaaauuuucccaucuaaaagaaaugcagggcuggagcagagacugaaggaaagggcaaccaaaagacagcccaaacucaaaaccuaucccaugggcaaacaccaaccccugauacuauuaaugauauuuuguuaugcuuguaggugggagccuagcauaacuguccucugaguggcuauaccuagcaguggauggaaacagaagcagauacuuauagccaaacauuucacagaagucagagauacuuaugugagaguuucaugaaggauugaaggcacagaaguugauaagaacuucacagaaagaccaacagagucaacaaaccugguccuugggaguucucagaaucugagcagccauccaaagaacauacacgggcuuaaacaaguccccuggcacauauguagcagacaggcagcucugucuucauggcugcccugucuagccucagugagagaggaugcaccuaaucuggcagagacuugaugugccagggucuggggucccaaccucucagaagagaaggggaaggagaauggguggaagggacucagugagggggaccaggaaagggagcaguguuugggaugugaauuaauuaauuaauuaauuuuaaaaauauagggaaugcuucauggauuugcacgucagccuugugcaggugucaugcuaccaugccaauauuaguacaugcacugccaaaaugagcacauaauguuauaggcuaccuuauaagcacuccguggucauacacaucaccacuguuuuauuuauuauuuauuuaugauacuggaucucacuguguagaccaggcuggucuggaacccacagaguucugccuuucucugccuccuaagugcuaggaugaagugugccaccauauccagcagauuuuuaccaaugcuuuuuuuuuguuuuuaaaucaaaauaguaaaugucuugguccauugaagcaugaagcuauuuacucuaguguaucuuacauacucuccucccaagaaccauacacuacacaaaaguacacaugguuugccuuucaaugaaacuagcacccuuaccauuuaauuuucauuagcugcuaaugccaagagaguucaauuaaagcaaauuacuuuguauaguugaaagacugauucucuuuuaaaguagucuucagaagucaauaguggucacaggcuuaaagauuuggggggcaaagaacuuauggggguucauaaaacagugauaugcuagguauaugaaugguugcauucacuucaaagaaaacgguauccuggaagaaucuuugcgaugguuuguguaugcuugcacuauuagaagguacggccuuucuggaguagguguggccuuauuggaguagaugugucacuguggacacgagcuuuaagacccucauucuagcagccaguauucugcuagcagccuucagaugaagauguagagcucucaccuccuccugcaccaugucugacuggaugcugcuacgcucucaccuugacaauaauggacugacgcccugaaacugugagccaacaauuaaauguuguccuuauaagaguugcuuuggucuucgugucaguucacagcagugaacuaagacaaucuuuauacuuccuuuuauuuaacagucauuauagaaucaucuauuaaguaaacaagagccucauugcuaaguagcuugaaggacuagucuuagcaauacccuugugccuuuucuugucuuccucaaaguaugaaauugugaacacaaacagaccuacuuuuucauuuacuuuuuguuuauaaacuuaucaauaaaacauuccgcauaaucaaagacacacuggaaguagagauuacacuagaagauagcuacacucuucuauuuagggcuggagaaauggcucagugguuaagaacauuggcuguucuugcagaggaccugaguucaguuaccacucccaacauccaauagcucacaaccaccuuugacuccagcuccaggggauccagugccuucucugugucaucauggacaccagccauccaugugguacacauacauauaugcauauacucacacauacaaauaaaauaaaaguaaacuuaucuuuaaaaaugucacauuucauaaagacuuaaaauauaauaccauggguauuuuagacagucacuuguaauuucuuggcuaacuggguucaaauacuggcuuuuguguaauguucaaaaaggucaccucauuaaguaaucuuagcaagcacacagacuuagaaugaucucauaugacuaaaaguuacauaaaaguuguaaguggacuuuguuuguucuuuauaaauaggaaguggcaauaaacucuuacagagacauaccauaggacacuuuaccccucaguuacugcugacauugcaguuaaaaauuacauugacaugggggaagguguguacacuauuggguaucaugggaacgcaugaaaaucuaaaguuauaaaacccauuacagaugacaugugggcuucuugucaggggucaucuuguugauuacaucuuucuuuuucaaggaugaaaauaacuuauucuggauauuuucuuagucaacuucucauuuuaggcuuuagugagccccccaaucaaucuaggaaucacuaucuacuuccaucuauuuggaaaaacaaggugcuaaaccauuggauucugacagugaaacagacaacgccauagcuguacacacauagauggacuguaacacauuuucauauaguaauacaaugauguuacauaaauaauaaaagaaagcgggaggagggagcaggagguuguggaagaacuucugaagcaugcuggggguuuuuccuuaaguuacuguccacauuuuuggcauguaaaauauaaggacuucccaugcagugcugacucauggcuccucuaucuucuccuuccugcuuauuucuccuagguuuugccucuuagagagugaguuaugagggggcugauaaugcuauuucuguugacagcuuuacaaagagacuugguugaaaugaagucuaacaauaauggcuaaaaaaagguauucuuagauucuaaggauagacuuuuucuguggcaccuuagguucacaucuucagauaacagaggaugacuuggcuuucugagugauuucaguuuuucauaggcucuggggguagacuugaugcucauuauuuauuuuauuuuuuauuuuuuuaaauauuuuuauuagguauuuuccucaauuacauuuccagugcuaucccaaaagucccccauacccucccccccccacuccccuacccacccacucccacuuuuuggcccuggcguuccccucuacuggggcauauaaaguuugcauguccaaugggccucucuuuccagugagagacucaucauuuauaauagaugauauauuuacauagacauuucaguuugcucauuucugaaucugcuaggaagacaucuugaaucuuuaguaaugaacucacauugugauauuccauuaaacugauaggaagauuaauguguucguguuauauguuguauuauuuccugaugaugauauuagucuccaaguauuugauguguuuaccaaagacuauuacuaaaucguugguaaaaaaaaaauguggacaauuuaauaguuucaaaguccuguuuacccuauggucaugucgagucuuauaggacaaagacuuaauucugaaaguaguaguuauaggaacaaauaaaaaacauucaguguuuuuaaaaagagaaagaauacagaaacucagaaucguuggaaauaggggaacaagguauaaugugucauccaaagucauggggagguaaacagaauucuauacuuaauaucaggagucgaauuucuuugagggaauacccuuuggauguuauagucaugcaauccuaaguagucaagagaaguuucuagaaaucaaagcagccaaauuuucgaucagacuauuaagaaucucccugucuaaguucugagaguauaauuuacugggcagcucccaugcacacuguauguacuguagaguuauuuagacuccaguaagagagaauucgcucuuagugcagugagcuucuuucauagaaagccaugcgacgaaugcaauguccuuuuguugaguugaaauguccccuuccauuucuauaauagaaaaagaaucacacuuucgggggaguccuuucauacagcauuuugacacuacacauauauuucaauucuauguguguggugaucaugcaauuuauuuauuuuuuccuuuuuuggagagcaugcugggagaaagccaggaagagaagaaggccuuagugcuucgauccagaauuuccuugacuucuucucuauuacagcuauuaaggaagcuguugauaaaauggcucuuuaacauauauccugcuauuggucugugugccgaucacucggcagccucacgaggaggggugaaacgagugugaagacaacauucacuuacucggagcucucuaggcauaacuggaucaaacuguacuuccacuucacuuuuacccaaaagaaccuccucccuacuggcaagaugaguacucagcaauaauuucuuguauguuuugacaagcccuugaagcauuuaccccugaaacgucuaugaacugaacaauucauagaaguauuugaagcccuccaugaagucuuauaggcugaaaguuuauucugauggcuuugugugacccaguguuucuggauuauccaggccuucaccuacuggaugcuaucuaugcaaagccauuuuaaaauguuuacauaauuaucaccuacuccaguaaaaggauaccacuccuggugaucuggucacaguauucuccguacaguauaauuuuauaaacauuuuacaucugauugccaacgaggucaaucaaaccucuuugcucauuuucacauuacuaacauucaaggcaaguauccuaugauuuguucucauacagccgauuacuuuuuaaccucaaggcaggauuuuauauuuuuuuuuucuacaguaaauuuuguccuaaugauuucuguuucgccucugagcccauucugcaccaggacuucauccaucacagcaguggucccuccucccagaugugcagcacacaccagguucaaagaccacaguguaauggucaucugggaaacaugcucugcuuucuaaccuuuguaacacuuuuccuguggaacgcucuuuccucugggggaaccacaggacuaauaccucauauagcucagcaacaagucaaacccacugucugucucucggaccugccuccugacaauugguuaucagacaaacagacgaacaaaaugaugaguucguuuacccacaucuauacauagagacauguguuucuacauuaauuuuaaaaacagcuuuaaggaugcauuaaauagaaccacggaaaauagaaucaaugcagccauugcaugcugcauuuauuuauuuauuuauuuauuuauuuauuuauuuauuuauuuauuuauuuauuuaauauguauaucacagguacauuuaaauuauccuauuugucacucuguaaucuacuucuccuuguguauauguggacguaugugugcauauacagccaggggucuaugucaagcaucuucuucaaucauucuucacauuauuuuuuucagacaaagccucucacuaagccuggaaaggaacuucuuauuucugucaucuuguuucugagcuggagguauggcucauauagcuaucuggauuuuuucaagugggugcuauagauggagcucaaaucugcaugcuuguggggcaaauacuucugauugagcccucuccccagacuuaauuuucuuucucuaucccuaaaauuguuauaauuuuccaugaaguagacuugugaagaagcuuguaagaaaugauuuuuuuuaaaaacaugaaaauacuuaagccauuuuauugaguaggguccaguguagaagcauuuaccauccugaaguuuccaucucagugggggcucccuuaaagguucauuuuucaugucauauucauuuugucuaucaguuccacaucagccuagccucuaguacuuucaugguaagauuuuauauccaccaaagcuagacauuccauaucagcaaaaucaaaaucguuuugguucccugauccucgucauuaauuuuacagcaugcuuauaaaauuccaugaaaacucuuucgaaauauuauaguggcuuuagaguucaaacuagaagcuaaaagacaucuuuaugacauccaacaagcccauuuugguuaugguauaugauuucauuuacccacaucuuuguucauauuuuuuuuaagcugaagccuaaauagcuuuacaagaguacuuuuauuuaugaagaaaggaucacauggauauguagagugcacauguaacauuuauacauacaguauguauauaauaauacauauauacugcauguacacuauguauucuacacagauauaaagugaaucaggagaaugcuaacuggugucucuauuaucacccucauaacuuuucugaauguccucauagcuuacuuuuccauuuucuauggauauaaacuugcaggugauauguaacuauacaccuucuucuucaaccacaauaccucaugguucuuccuauuaucuuucugcauuggccaggauccuauuacauuuugaauauaagcaaugcuauagauuugucauguucugaauagauaaggauccauuuaaagagaucuccacuuguaacuuugcuaaugugauuuauuuuguggucuuaagagcacugaauucuaccaacuguauuuuaaguaccucaugaaaugauggacuuuccuguuaacauguuaacagaguuuccacauauugaaacauucaugcaugguguggugguuugaauaugcuuggcccagggagugauucuauuuggagguguggccuuguuggagaaagugugucacugugggggugagcuuugauacucggcucaguguggaagagucagucuucucuuaguggccuucagaugaagauguagaacucucagcuccuccuacaccauuccucccuagacgcugccaugcuccuggcuugaugauaauggacugaaccucugaaccuguaagccagccguggucaugguaucuggucacagcaguaaaacccuaacuaagacacaugccuauaauuacaacuaauuuuuauggcccugugaguucugauauaauuaguugaaaguccuguuugugacaagauuuuuaaauuggaaauaacaaggcaugagucuuuccacuuaagaucaaguguuuguguguguagacauaguauucauacaaauuuauauaaacacauauaugcagucaucuacaaaaacauauauaaauaaugugcauauuuaggcaugcauaaauaauuuacacauauauacaaaggaaaacuguaaauaaagggaguguacuuugucuacuugauuuuaggccaaucauugaaguucucguuucuguuaacauugacuuuuaaaaaccaguucuaacugucauagauuauaaucaguguuaaaagugagaacaaaauaaaaaaaggauucuacagacuuugaagugagucuaaauaacauuaugaacaacauccuccucagccaaccacuaugaugcccucuuaagagccuuacuuaaaaucuccaaagcucauuuucucuuuaguaaucacgagcuuagagugagguggcugagggggguggggggaagaaccugcuauaaaugggauuugaaaguuucucaugugaagucaguguugcuagggaacauggcuucucagcauuuggaaagcuaaaaacucaagccucuugccucuuuuggucguagaaauguauaugaugaaccuuauuucagagagcuggaaauaagucggcuuaaaaaaaauuuggauagacauuuucauuguguaaccaacuuuuuuuuugucuuaaauaauuauguguuaagaaaugggggaggggagguauaugaucuacuguuugauuauuaggagaccaugucacugaguuaugggauaacggcuacaaguucaaugacugucaauuuuguguugucuuguuaaaaauagggugcccagauaugugguugguuaaaacaucacuguggguacuuucuacaugagauuaaugcuugaauugggagacugaguaaaguggguuacucucucuagaaugggugugaccaaucaguugauggccuugacagaacaaaauggcuuuguucuauuagugacagagauggggcuuaacuaccuuuacaugaggacauuagcuauugcuuuuggauucacacugaaauacuggaauuucauggcucuuaacgacacauaucuuagaagaguagacugucuagaucucaggguuucagagucagacugaaacuaacccauuugcuauccuaugacagagugccuauauuuaaaguauagcuuugccacuuacuccugugugaugcuucaugagcuaauucaugcacuggggcuucaauuuccucaucuuugaaacagaaaaacccugcccaauccaguuuuaggcaaacuaaauuaguuaccguguagaaaauagucacuagaauguccagccaucaaaauguuuacuacauuuuacuuaauauuggagugguuuuggauuuugccauucuuuuauuagagacugcauuuucagaaagcauuauuaaaaauuccucaaauucuagagauggauaggcuacuaggaaacucacaaacucuugcuaaaugcaccucuuccuagcacuguccaggaacccuaacaaguugaaaaauauguauacagaaaaaaaauaacaaaacaaauguaguaucuaagggugagugggcacacugauacggguaucauuuaaauggaccccugaauauacauccaagcauguuuuuaucaaaagaacaacauauguaugaagaaacacaacauaauuuccucugcuucauaaaagaugccgacugcuaagagagugagauugaugcuauagguaucaauaugaaaguaaacaccacaaaaccucagaaacuggaagagaagaacaauucaguaugcaaauugaaaccaccagggggaccuagguagguggaagauaauuacucagccuggaaaguaccuaggaugcuggauuaauaauaugcccauguuuuuauaaaaggcgccuggcacuuugaagcagucaaacguauucagaaacuucucauuagauuuuuaugaucauaaaagauuuugaaaguacacaugauauaauagucaaaaucuguacagagagaggcgcagaaugaggagggaagaagacagcauucucuauuguuauccauauuucaucuuuuuauagugcggaagaggcuuacauugaaauagaaugacagaaaugaaugauuuccuccugauggguacaaaauuuucagggcauuauuuccccccccucaaaguacacuauucaacuuuccauuacauggaaagaauaaaaagggcuaugguaaugaguuucauuagagaaauguacuugaagcauuuacugcaauguagaaauagauuuuugacaguggcacugaaauaaaucuuaguaauuguuucuacaguguucuaggcugaggcuaucuggguuaaaugagucacuucuugagccaugaacucugcucuuuuguaaaggaugcuuuuuuuuuuuuuuuuuuuuuggauaaaggcucauuuauuagggccagcagccagaagccuggaucugaaaagggaugaugucagaaaucaaggcuagucugcucgaggcauuggcaccacugggaauuuaguacacuggauaauaugcucacuuucaguuuauaauggacauguuccuuguugcuacucugcuaucuaauauggugaguuugggauaagaaguccugccuagugccuacacagagaguggagagguagauauuugcuugcccuaaacuaucucuuuuuagaucauucuauuccaagcuauggcaagaacaguaaaucugauauauauaauuugugguauauauaucccaaaugacuacagagacccaauuuauaucucucaaccuuuucucucaggggccuuccuaucuuuuaucagcacugagugaacuaauucaucuaagacagaagauuauagaccaacuuaaugaacgaagaccacuuaagacgucuugggcauccaugaaguacagaauaggccuauggcauuugcucuuugucuggaccugcuggaaaggaauagucccgaaguuccugcgaaaugucugcacugaucuauucauacuuucccucuucccugccgugaacucucuugguuggaugacucauaucagaugauuuaugaugcacugaaggcacccaacuuccagcacuucccuugucuuccucucagcuugaauuguucuuccuauuucacauuacccagcaaaacaauaguauuguuuucaagauucagcucaagugucugcucaccuacaugacccucauuaacuucuggauagagauguacauuuccuacaucaugcuccauuugagacuuucauauuucuguuauagcagauauacuguaccacaccagacagagcuccuggcauguagaacacauagccuauguuugcaccuuaaccuuguaugcuauucaucuguaccuguuuccuaucauauuagucccaagaguucaaauuaguagccgcugauauucauguauugaauucucuucucucauuggcagagaccccugacauuguuucuucucauccauaacagaaagucaaguccaugucuaauaugaaugcuugaagcaugucgaauaagagcuauuuauuauuuucacaguguuuaaauguguuuguuuuuuuaaccuuuauugacugcaaucugccuuguuugucacacuuagacuaacuagauuuuuuuuuuccugucagaguaagucugagguucguuauugaaauuguggaaaucaauucucuuuaaagcagaagugucauaggaugaggaaaagggaacacugaagagcugauggguugaagcuauugacuauggcuucacagaagacggugaagccaggaauuacagcuugcaaauauaacacuaagagaggagguacugcggcauguaguuacccauauugcuuagcuuuuaacuccauggguaacuuuuuuccuuccuuuuugggucucuuucacuuuguuuguuaaggaagaaggcugaacguaagucuuuugugugccaccaauaucuggaauaacaguaacauauuuagcugaagcuuuggguugccaguggcuaguccgaaguucuucauuuguauuagugcauaugagcugcagcauguccauuuuauuccucauuuuauaggugggauuaguggcagaaguugguuaagaacucuuacagauuugugcagcuucuaaguggcaaagcauggauucaaacccaaucaggcuguagcugcauuugggaaacaauggacugaaagacacgccuguccuuucuggcccuguguccuguguacuuuccucugggcacucuucuaagucccuaagaguguacuccugugucuacuuagcuuaauuauguuccuaugugguagagucugcuuagaucguauuuuuuuuuuuagucuuuuuacuauccuuucacuacaauuauguaaaauugcucauuucccccugaauucgaaagucaaauuucacugcauucucagaaacuguuuuaucuaauaguccaguaggcaucaugcauucuugacuauuaaaagaaauaugaaguugccacauucaauggaaucaguguguccuuagaaguuuacaacucacgagugaacuacucuaagauaucuuuucaugucucccugaugcuaaccauccuuucaccaaaagcaauacacagaucaauccaauucccaucaaaaaugcaacauaauucuuuacagacuuugaaagaacaauuccaaauuuuauuuaaaaaaaaaaaucaaacuccaggauagcuaaagaaaccgucuacaauaaaagaacuucugaaggaaucaauaccccugaccucaagcuguacugcagagcaauaguaacaaaaucugcaugguauugguauagaaacagacagguugaucaauagaauugaaucgaagacccagaaaaaaaguauaccuauggacacuuuauuuuugucaaaaaagucaaaaccauacaaugggaaaaagaauguaucuugaacaaauggugcuggucuaauuggaucucugcauguaaaaaaugcaaauagacccauauuuaucacccugcacaaaacucaagugcaaguggaucaaaaaaaccccaaauaaaacuggauccacuaaaucuaauagaagaggaugugggaaauagccuugaacucauugguacaggagacaauucccugaacagaacaccccuagcucagguacuaagaucaacaauagaugggaccucaugaaacugcaaagcuuuugcaaggcaaagaacacugugaguaggacaaaauaacagucuacagauugggaaaagaucuuuaucaagccuacuucugauaaaaggcuaauauccaaaauauacaaaaaaaucaagaaauuagacaccaacaaaccaaauaaccuaauaaaaaugggguacagagcuaagcagagaauucucaacagaggaauuguuaacagcugaaaaaaaucuuaaacguucaacaucuuuuuucauaagggaaauacagaucaaaacgacuuugagauucuaccuuauaugcaucagaauggccacgauaaaaaacucaagagacagcauaugcuggcaaggaugugggggcaaggggaacacccuuccaucacugguggcaaugcaaacuuguacaacagcucuggaaaccaaucuggaagaaaauuaggaauaguucuagcucaagagcuagcuauacgacuccugggcauauacccaaaagaugcucuaccauaccacaaggacauguguuccacuauguucauagcagcuuuauuuguuguaauagccagaaacuggaaacaccccaagugccccucaacuaaagaauugauuuuaaaaaugugguucauuuacacaauagaaugcucagcuguuaaaaacaaugacaucaugaaauuugcagccaaauggaugaaacuagaaaaucucauccugagugagguaucccagacccaaagaacaugcaugguauguagucacuuagaaauagauauuggccauaaaguacagaacauucacauuacaagccauaaaugcaaagaagcuaaauaacaaagagaacugaaaugaggaugcuuggaucucuuagaagagacccuuaguccugcagugacuugaugugccaggguaggguaauacccaugggaggccaccucaccuucucagaggagaaggagagggggagaugaggagauggaaugugugagaagggaacugaggacuacaaucuggauguaaaguaaauaaauaaguuaacuaauuaaugaaaaaaaaucaaucaaaccaaacuuaccaaccaaauaacaaaaagacuuucuaauaggguaaagagauuaccuccacuauucauuggcaaauauaccuaauuuucucuuuaaaaaaucaaauauauuauauaugaaaauuuuauuuuuaagauauacauacaaauaaaauaucagauaacaugaaauuuuggugaaagccauguauuuuuaugguagaaugagaauauggcaauuuuggcaggaucaauauagucaaaauggcuaucuugccaaaagcaaucuacagauucaaugcaauccccaucaaaauuccaacucaauucuucaaagaauuagaaagggcaaucggcugauucaucuggaauaacaaaacaccuaggauagcaaaaacucuucucaaggauaaaagaaccucugguggaaucaccaugccugaccuaaagcuguacuacagagcaauugugauaaaaacugcaugguacugguauacugacagacaaguagaccaauggaauagaauugaagacucagaaaugaacccacacaccuauggucacuugaucuuugacaagggagcaaacaccauccauugagaaaaggacagcauuuucaacaaaugguguuggcacaaauggcgguuaucauguagaagaaugugaauugauccauuccuaucuccuuguacuaaggucaaaucuaaguagauuaaggaacuccacauaaaaccagagacacugaaacuuauagaggagaaaguagggaaaaaccucgaagauauggguacaggggaaaaauuccugaguagaacagcaauggcuugugcuguaagaucgagaauugacaaaugggacuucauaaaauugcaaagcuucugcaaggcaaaagacaccaucaauaagacaaauaggccaccaacagauugggaaaggaucuuuaccuaucuuaaaucagauaggggacuaauauccuauauauauaaagaacucaagaagguggacuccagaaaaucaaauaaccccauuuaaaaauggggcucagagcuaaacaaagcauucucaccugaggaauaccgaauggcugagaagcaccugaaaaaauguucaacauccuuaaucaucagggaaaugcaaaucaaaacaacccugagauuccaccucacaccagucagaauggcuaagaugaaaaauucaggugacagcagaugcuggcgaggauguggagaaagaggaacacuccuccauuguuggugggauugcaaccaagugaauauuagcccagaaacuuagaauacccaagauauaagauacaauuugcuaaacacauggaacucaagaagaaggaagaucaaaguguggacacuuugccccuucuuagaaaugggaacaaaacacccauggaaguaguuacagagacauaguuuggagcugagaugaaaggauggaccaucuagagacuuccauauccagggauccaucccauaauuagccuccaaacgcuaacaccauugcauacacuagcaagauuuugcugaaaggacccagauauagcugugucuugugagacuaugccggggccuagcaaacacagaaguggaugcucacagucagcuauuggauggaucacagggcccucaauggaggagcuagagaaauaaccaaggagcuaaaaggauguguaacccuauagguggaacaacaauaugaacuacccaguaccccccccccccagagcucgugucucuagcugcauaugaaucagaagcuggccuaguuggcgaucaguggaaagaggggcccauuggucgugcaaacuuuaucugccucaguacaggggaacgccagggccaagaagugggagugggugugugggggagugggugggggaacaugugggggacuuuugggauagcauuggaaauguaaaugaaauaaauaccuaacuaaaaaaaaaaacaaaauaauaaaaaaaaacugaaaauaaauacuaacuggcuacaaucccagggaucuaucacuaguaauaauauuuugcuaucauuuuuuaucugugugaauguauauguaucugcuaguguuuuacauauauauguuccaaauuagcuuugcacugaucguaaguucauaguuucuguguaggguauggauuccucugauaucacauguagaugaaugaaauuucaacugccucaguuuguugacuagagagagucuguaaggcuguacaaagggauucagguagaguagaggacuggcugauuugaggaaauagaccugagaaucugggacaaucaugguauguaacauauggucaaguaaguaaaugcagcagauacagauaaaacuucaaaaauacauaaaagccagcuuagcgucuugucacuuguaucuaaagaaucacaguaacuuacuccuaggccuuaugaccucuucauccaugggucauaggguugacaguguuagucaugaaugcccuccugagaaguaggccucgaauccaaucagagaaugguugguuauugcuacaacacucaugccacuaugacacaguggucacaucuugccagguagguuaguacuguagguuuuaggguucauagcugaguaagaucuuguuucuuccagcugccugcauaauacuauaaaagcuagcuagaagggggaaguuuccaguucaguuucaucuccauuucucuacauguuguaaugaaaguuguaguguguucagcaauaggguauuaucaauuagaucucuugaacuuuuagaggauggcaagagcuuguguuuuuggaagcuucucuuugcaaugaacuuuggaaaauacagacucaugacugcagaagguacugagaauaaauuauggcugauuucucaccuuuaaacaggacauuuauaucauuucuuuaagguucaugggauacugcagaagagggggaaaggaagaguguaagagucagaaaacauagggaagggucugugaaaugcuaucuucugggcauggcauaacuauuacaaucaucaucucaaagcagcuacaucugugugcacugggccugcacaggacugggcccaucaucagucaaucauggaucagagagagacucacagaaccauaccauaccuugguaaacuauaggcuauugcuguauucugagagaaaggcagucauggucuucauuuguguuccuacaggggagccagccagauuccaaaggauaaguugaaacucacuggucacacauacaucacugauuaaacucagugguuaaacugaagagaaaccaauaaaauaggaccaggaaggaaaggacauguauggacaaggaacuaacagaaguggggaguuccagaaugccuuauauacaugaauaaaauuuucaaggaauucaauaaaaguucacuauaugugcccccacccccacauucacagaagguucucugaggauucauuugaacaaugaucauucguauucuccauucuaaggaauaaaucaccugaaacagugaguagggauuaauaggcugcccagugcuuacaugggguaaagaauacugcuguuccuaaucagggagcgcacacagaaggaccucaccucauuagcaggggguaaaaauucugcucugauguuaccauugcuguccucuggccuaacaugauuuaaaaacuaccauguucccaaguaacucaacugcgcucaagaaaaaccucucaagacuauuuuauagguuacacagguucaaauaaggugaaaacauacaaugucugacaucugauccgaaacuaccaggcaugaaaacaagcuggguacgugagacaggacacaggauaagaaaauaagacaaacugcucagaacuuacagauaauaggggggacgucagaaaacaagccaagcaugcauuagaccucuguccuugaugguacagccagagggacauaaacaaaaaggcucaaucaaagaaacauaggucagaauucagugugagaugaaaaauauauggagcaaugacaagggcaaauucugucacauaaagaggucacuaggcaaccaaacaacaguccuacccuauuaauuuaucugaaauaaaacccagaggaacaaacgaaagaugagcaggagaucagcuacuuguggggcaacuugaaacagcugaacaugugaacagagggagucccuagaaaaggccaaaggaaagagaaagaauguguguauuugugugugugugugugugcgcgugcgcacgcacguacgcgcaugugguguuugagaauaauuauuauauuucacucuagugguguguugaauuacaguuuauuccaacucuaaaauccuacaacucaugauuguuuucuacauugaggguuguaauuccuuccaagacuuuuuucuucugugauugccuaucccugcuugagaaagauuggguugaaagggggagcauuuaauggaugcagguguucugcagauguuaaagauacauugcuuguacugauauaucugggcuugaaaaugugagcaaauuauguuuagaaguuuccagcauucauauacaaaguugcuugaucuucccugcuucaaggagcugauucaaaccaaaaccucuuccaaaaugauuauaagcuccaaacucaacuacuaaagaauaugccaaccuauaaccaauaggaaaauggagcuaauuuuaauuccaucagugucaaacuaaucaaacagguuuguauuuuaaacagcaugucagauauuugauauuuagggacucaacuuacauacaguuugagagaacaugcaaguaucaauuaagagacuucaauaaguucauuauuugguguuuaaaauauauauguagguucauugaacacugguggaccaaacaaacaaacaaacaaacaaacuauggccacuuaaccuucuaaacuauauuuuacaccuuaauuuuauaaaauuuuaaauacaauuaaaugaguacuaacaaucuauaugcuuuauagaauauauaucuguauguguucauaaauaugcguuuuagacaugauaugcucuuaugacuuucuugauugauuaugacaccucuagauuuacucaacuuuuccagaagagagacagaacuguaauacggagcuagauaucacugaaaaaguaaacuaguagcaguaaaugucaaaauucccccuucauauggcaucucuaauuauaaacugacacuagcaaagcauuggcagcaucauauugccagcauccgcaggcucuuacagcugcggucaaaucuccagcaucucuccuacauuugccuuucguucaugacauuugaucagucaacaguacggagcccuuguguucuccugggccacccugcaguucaaaacuccagccuguuucagguugcucugaaagcggguagggagcacagugcagcuuuccgaaugagagcugcacauaucaaucacagcagcggcugcuuggguaccagccuuggcagaggugaagcuggggugcucgccgggaagagaaaagcugucugggaugaaaauggaggcgaaacaauuuaggcagcugggggaggauucugaagacgggaaagauuggauuuccagggcuucgauaaugaagacagagaugguuuaaauuuaugggaagcagacaggagaacucagcuucaggucaguuuaaaaaaaaaaaaaaaaaaaaacggcaucuggggagcucuucuacagagaaaaucacacaggcugaaucacgcugggggagugagcaggggaaaagcuuggcacuaggggccucauuuaaagaguaauaaaaagcaguaaagacaacucgcucuagcacagccucaauuaaagccugcauggguaugugccuggcaaccucagcagaaaccaguaagcagcccuacccuuccagugaguucugucccccgugucauccaucucugaaccucccacaugaaauccuccuccacaguggccucugccaaaugaauaccgugacaucucugaggagcuugucagagaugcagaaucacuguuucgacucagacguacugaaguggcacugguuucccaagacacguguacgacucuagggcacauuaaaguuugagaaguaucgcuuuacaauauacacagugcuccuuuugagagagagagacagagacagacagacagacagagagagaggaagagagagagacagagagagaggaauuaccuuagcauuucacagcaauggcauauagauuaggaguaccugucauguuuuauccucucugcaaauauccauuuagcauaguaagcaauuaauucacaggccuugggaccgaaggagguuuuggacuguacucuguacugugugaacugcuaaccucauagaguuauauaaacauugucccagucccgaaggacaucacgggcaucuuaggaaaugguuaauuuuuaaaaagauagcuucgaugucaaaaacauguacuuggcacugagguagcaugaggaaugagugguggauguauguaagaagguugagcaggguuuccugagcuggggagguuucugugcagccgauuuccuugcacuuaaaaaggaaacuuuuucuauuguguugaacauggggccuugugaguagacuaaaauauaacauagcaggaaagcuuuaacuaaaccccaagggcaagaaauggguugaccuguccagauaauuuaaaguagauccagauggcuggguuuagguuuugagggcaguggacuggggucugguggucggagauaaggaggaagaacuuugcaggagcgaggcgcagaggguuuguagaccaaggacuucaggaugauuccuauggagcaauaaaaggaaguugggacgaguuuuaaguagggcaauaaccagauccugucugcauuuuagaaacaccacacuggaggauguuuggggaacggugauuagccaauuuggcugaagucucaagcacauggaaggaagcaauggugucuagaaaugcagcuuuggauacagaucacagaggaugcuggcugucauguugcaugcuuaguaggcaguggggagcaagaggaagcguuugacugagaagagaccgaaggcagguggccaguuagaagguuacugcaaucauuuaggcaaggggguaauagaaccugaugacuccaagaauagaaauuaagggcuauauucgaggagcaggugcauaauuauaagcacaguuucauuacucauuucaggguggcgcaauuuuauacacaaaucagaucuuuauaaaugcuucuauuuucacauccuaauauagccccacuuuggcacaaaucacaccggggaagacacuccuaagguccgugggucaccaaggaaaaaaaucuuccugcugcccuaacuguaggucccucucucaaugguagauggacacucaaaacucaaauaggaaccucaugauagagcuggccuuuaguccccucuuuugguugcuuucccaccuuaauuauuugucuagggaagcaugcuaucauuauuguuugucuucauuaaccuccaagauagcaaccuccccuuucucacccuuacccacuucuacccucaugcauugccuuuauuagaaauaccgacuucuugguggcauagggacauugaagcccugcuucuauuucucauuaugauggguaucacuaccacugagucacaccuaccucaacugaugccaggcuagcuguuaugugauuugaagcuaugaaacuccauuucaggugacauuuccagaauuucuuuagaaagcuuuuccaaguguuucaguuauacauugcagaauauuuauaauucugggucaagcaucaugcuuggcuugacuuccaaaauacagaacucaaaaaaaggugguuauuuucuccucuaaaggaaaaaaaauguaucuugauaaaauaggaaguagcucuguauuauguguuuccuguacaucaauuugcaccaugugaucauuugccuucugguauugucugacuguauucuuucuaauucaagauucaaaaggccuagggaguaaagggaagcaaccaugcugcaaucuucacauuuagggaaaccuauuguuauccaagcuuuuuauuuuuguuaagguacucacucauaauagaagcugcccacacaauaccuacauggaagucauaucugaucaauaguguuuaucucuccagcacuuuugaauggaacagaacaaggacugaggaauguauguguacaucuauguaaaauacauaagaaacaaauucagauuuucauauccagaaaauauguacuaccaaaauauuauaccuuaggaaaaaaagcaugaacucucaauauccauauauuugccucagauggacuuuacuguuggaauaaagauaauaguauuguugauuuaugaaauaacuaccuauuuuuuaccucuauaagaaauugaagucggcuuauuuuuuuuuaacuuuuuauugguucuuugugaauuucacauuauguaccccaaucccacucaucacccccugcccucauaccugcccucuacccuugcccccacacagaggaaaaaaaaaucucauuguagaaacuuuagugugucacaguguauccuacaguauaccccuuuuauucacacuuugcuuacaaauaauuauugcaaugacucaucagucugguacaaggccucuagcuucugcuacacuaucaauacuggauccucauuggggcuccucucagcuauccuguugcugcccugugucuuggagauccuucagcuuugguuguguaggaccaugcccuuuauguacuccagcaguccauccaaggguuagauguugggaugggccaauucaaagcccuggaucugggccuaagagguaucugaacuggucagccugacagcucuccugcucucaugcccuugaggucagcucaccagcaccuuccacaaucagggccagcuuuacucugcugcccagugaggcacagggcccacaguucugagugcugcagccaaugagacacaagaccagaacacucucuugauauccgggcuagcucuccuaucugucauagguggcaagggacaagagaagcaaagagagcaucucucccuuguccauaccaccacucagcagacaaggucuauaaggaaggucagcucucuugugcucauacccucagggccagcucaccuacaaccucaguguccagagccagcucuacuauacugcuugggugagauauaggaccuccucuacugagugcugcagcaggugacaggcaguacaagcucuccugccugcuguacauggcaagaggugagggugggagagcauuucucccuugcaaaugcuuccacauggcagacaagucaugggcucagcucuuccaugcucaugcccuuggggcagguucaccuccauccccugccaucagggucagcacuacugugcuggccaggugcgauguagggccugcucacccaagugcugcagcaggugagaggcagggccagcucuccagcuaucaugacccuguuggggccagcuccccugccugcugcagguggugagggcaaaagagagggguggagaucucucccucccugaugccaucacacagaauggcuggccacacccucagggccagcuuaccugcaaugagcauauuuugugggcaucauaagguacaauccuuuuucacuucauguguagaaugauuaugaaauuaucccauaagggugguuauucuugcaaauuuggagaugaaaugaaguuuaucaauauacuaucuuuuuaugagagaucauccuuuccuuacuguuaacuccuucauagucucauaaccgagagaacacuacuauaagaauaucucaaagacuccuauucucccacuucauauuaugagauguuuccauacaguuuuauugagucaucaaaauaguuuuauaauuuuauugcuuguaagucaauacuguuagaccuacuuaaugcauauauauguauacauauacauauauaaauauauauaugaauuucaauuauuuuuucuuuuugcuucuguaguuuuucuucuuccugguuuugauaaauagcuucuuaaaguuauuacuugugguagcucuucaagauuagagaaacaaacaaaacaaaacacaauccuggcagacugcuccauaaaacuaaugucacguagaaggaaucagcuugugugguuacaccaguucugcuccucauggugaggcuccuaugcaaaggucuggacuuucaccuucagaaccuugcuuugacccugacccuugcuccuggcaguuaaccuggaucugguucucauuuugauggauauuuucauuuccacugcuacccagaaaaugauucuucacaucaaucuccaagucuuuaggcccagucccgcaugacuugauuucuguuuuagguacuuugaaauguuaaccuguuuguaaagcuuagccaucucuauagugucuggucuugcucuuuaucucagacuguaguauguaaaauggagucaccuuguaucuucaucuuagucucuaaaacuaacugaaaaaaaauuuauuaccuugccccaaauugcaaaccuaaucaauaguguaagcugggcuccaguucaagacgucauauuugguuuugaaaaucaaacuuuauuucauuuuuaagagagcuauuuucaauggaacauugcccaauggagguaaaacaagaacacacagcucuugacucaaagaaauuuuaucaagucccagaucuccuaguuacuggcucaucuugccuucagucagccagcugugugaugcuauguggaguugccaugauaaggaucugagaaauaaaaauaagugcacuaugcaagugcagaggacuuaguagcuaaacaaccugucuuuuuaaguuuuuaaauaauggcguuaauuucccagaaauaauagaauacagagaaacauaaagaggaaaacauuccuuguaauaugauuuaguaguauauuuuacauuuaauguauauucaacacauuuuuaaaauuugugaauaaacaucuauagucuuuucugauauuuugucagucuuuacaccuaucuguauuuaucugucugucuaucuaucuaucuaucuaucuaucuaucuaucuaucuaucuaucuaucuauagaucuaugugugugaguguguaucuacagauauugauuguuccugucucauggagauuaguuuauaguugaaaagagacauuagguaaaagauuaugcauuaauuaaacacaacuuggaggcuacauggaaauaaaacagcaucuacauacacacacauacacuauacacaugcacacauauacacuacacacacacacacauacaaucaaccuaucaguuaagaaauauauuucuugauauaugcccagaagagguauugcuggaucuuccgguaguacuauguccaauuuucugaggaaccgccagacugauuuccagagugguuguacaagcuugcaaucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccucgggugagaaaucuuuguucaguucugagccccauuuuuuaaugggguuauuugauuuuauggagucuacuuucuugaguucuuuauauauguuggauauuaguccccuguccaauuugggauagguaaagauccuuucccaaucuguugguggucuuuuugucuuauugauggugucuuuugccuugcagaagcuuugcaauuuuaugaggucccauuuaucgauucucgaucuuacagcacaagccauugcuguucuauucaggaauuuuuccccuguacccauaucuucgaggcuuuucccuacuuucuccacuauaaguuucagugucucugguuuuauguggaguuccuuaauccacuuagauuugaccuuaguacaaggagauagguauggaucaauucacaaucuucuacaugauaaccgccaguugugccagcaccauuuguugaaaaugcugucuuuuuuccacuggaugguuuuagcucccuugucaaagaucaagugagcauagguaugugguucaucucugggucuucaauucuguuccauuggucuacuugucugucgcuauaccgguaccaugcaguuuuucucacaauugcucuguaguacagcuuuaggucaggcauggugauuccaccagagguucuuuuauccuugagaagaguuuuugcuauccuagguuuuuuguuauuccagaugaaucugccaauugcccuuucuaauucauugaagaauugaguuggaauguugauggggauuucagugaaucuguagauugcuuuuggcaggauagccauuuuuacaauguugauccugccaauccaugagcaugggagaucuuuccaucuucugagaucuucuuuaauuucuuucuucagagacuugaaguucuuaucauacagaucuuucccuuccuuagauagagucacgccaagguauuuuauauuauuugugacuauugagaaggguguuguuucccuaauuucuuucucagccuguuuauccuuuguguacagaaaggccauugacuuguuugaguuaauuuuauauccagcuacuucacugaagcuguuuaucaggcuuaggaguucucugguggaauuuuuagggucacguauauauacuaucauaucaucugcaaaaagugauauuuugacuucuuccuuuccaauuuguauccccuugaucuccuucuguugucuaauugcucuggcuaggacuucacguacaauguugaauagguagggagagaguggauagcuuugucuagucccugauuuuagugggauugcuucaagcuucucaccauuuacuuugaugcuggcuacugguuugcuguagauugcuuuuaucauguuuagguaugggccuugaauuccugaucuuuccaagacuuuuaucacccaaucgguaagaaggacacaguaccucuccugagcauauauccagaagagguuccaacugguaagaagaacacaugcuccacuauguucauagcagccuuauuuauaauagccagaagcuggaaagaacccagaugccccucaacagaggaauggauacagaaaaugugauacauuuacacaauggaguacuacucagcuauuaaaaagaaugaauuuaugaaauuccuagggaauuaagucacagagacaaucacauaagacaaguaucggucucucuaagggacagucuaggagaaacuauugaagauaugugaaauaaauggaauauuagaucaucucaagguugaaaggauuccagggaaugggaaggaagccaguguggcugggucguggacaguaaagaagagacuggcauaggauggugguaaggcagcaaaucaaugcucagggagugaguuaaugugagccugcuuccaggagaggaagcugaggcauuuaaggcaccuccauuuacacaggaucuaugacuccaaaauaggguaagugccguuuuaaaacagagaaagugggaucgguguaguaagccuuucuaaacucaucaugguacgagagucuucaucaguggaccacaaccuguugacaccuucgugggguugccuauaucagauauuuccauuacgauucauaacaguagcaaaauuauaguuauaaaguagcaaugaaaauaguuuuuaugguugggggccaauauaacaugaggaacuguauuaaagaguuguagcaucaggaagaguaagaaccacuggucuacaugcacacaugagaaaaaaaagucaguuuugugacugcggaauuucuacaaggagaaaagcaacaaggguuaaaguaaggaaauaauuugguagaaugaaaauaaagcccaugaaucauaccuuuuuuuuucuuuauauugccuuugaguuaauauuuugucauagugaauagacaagcaucuucagaauuuuaccuggagcuacuuuaagagaaaugggcuauguccacaauacuugaaccaaguagacucugaugagugggaaggggcucaugagccccuacugcuaacugaggaaauguggacaguugauggcuucugggggagggauggucagguuuacuuucaaaaguguggcuccuaguugguugaccauguuucaaugcuauagucaggagcacaggggcaaaacaauuugguguagccagaucauuaaauuuuuaaaaaguagacacaacacugggguuguggggggcgggguaggaaguggaguggaguuaggaggaugacauucucaaagaauaaaauauuuaaaaaaaauuaaacgaaugcuccuauuuguuuuuaacauguuuuaaaucaaacacacacaaaaaaucaaaaugcccuacuuuuaucagaagaaaaauuauaauuaauuuucaucuacuugcagaagaaauaacaccccaaguuacucaaccaacaucuaauauaccuuuuuaaaccuucaaaagauuuggauuauuauacauuccaacguaacgauuacaaacauauuaacuuacauucauaucuuuuaaggcuguuaacaaaacacuugacuacucaaacacauuaaagauaaucaagaacuggggggugggaggaguuagcuuccuugagagcagacucaguauuucaugcuucauagcaaguuuuagaauagguggcuuauuucuguagaauuuggagucuguuuucauggacaugaacuucaaccuuagacgcugugccugacauaauuuccucugaguguuucacaggucagaggacugaaccgaaguccccaguguacagauauccccuuugucugcuauccuugggggcuuugcuuaaucuccacucucuucucaauauucacaacauuucccuuuuaucuaauccuuuuccucaucaaauaauuaugcucaguucacuuauggucaaaaucaacagugaauaauaaaacaauccuucaaaugugccuccucccaccuacauuuuuuucuuuuuuauuaaaguauuguuuaccauuggcaaguugguucaguggguaaagguguuaacuaccaaacaugaugaacuaaguuuaaucccugagagucauauaguggagagagagagccagagaaucaacucgcaagugccucuuggcauuuaaaggugugagcgccccucccccaucccaaccccgaaaagaaacacuuuaaaaauaauuaagcaguuaagaacacuaucugcuauaucacgguccuugcaacaaacgcuugcuaguguaugcaauggugucaucguuuggaggcuaauuaugggauggaucccuggauauggcagucucuagaugguccauccuuuugucucagcuccaaacuuugucacuguaacuccuuccaugggugauuguuuccaauucuaagaagaggcaaaguguccacacuuuggucuucguucuucuucaguuucauguguuuugcaaauuguaccuuauaucucgcuauacuaaguuucugggcuaauauccacuuaucagugaguacauaucauuugaguucuuuugugauuguguuaccucacucaggaugaugcccuccagguccaaccauuugccuaggaauuucacaaauucauucuuuauaauagcugaguaguacuccauuguguaaauguaccacauuuuuuguauccauacuaggccggggccuagcaaacacagaaguggaugcucacagucaacuauuggauggaucacagggcccccaauggaggagcuagagaaaguauccaaggagcuaaagagaucagcaacccuguaggugcaacauuaugaacuaaccaguaccccagagcucuugacucuagcugcauaugcaucaaaagauggccuagucggccaucacuggaaagagaugcccauuggacaggcaaacuuuauaugccccaguacaggggaaagucagggacaaaaaaugggaauggguggguaggggaguggggaggggaggggaggggaacuuuugggauagcauuggaaacguaauugaggaaaauacguaaaaaaaaaaaaaaaaaaaaaaaaaaaaaaaaaaaaaaaaaaaaaccacuaucugcuuuuccagagguccugacuucaauuccuggcaaugacauggaggcucacaaccaucuauugugugaucugaugcccucuucuggcauguagguauauaugcagauagagcacucauagucaaaacaaguaaauaaauaaguaaucuuaccccuaaagacaaacaaaaacaaaaacaaaaaaagcaaguacacauggagggacccaugguuccagccguguauguagcagaggauggccuuguaggcaucaaugggagaagaggcccuuggucuugugaaggcucaauguaccaguguaggggaauacgaagguggggcggcaagagucgguggguagguggaggaauacccucauagaagcaggggucggggugggauuggagguuucugaggaggaaaccuggaaaguuaacauuugaaauguaaauaaagaaaauauacaauaaaaaaaaucaccaaacuguuguuucauauugcauauuauuuaaauacuaucuuuacacgggagauuuuuagaguuguuagcauuugcuggcaucuguuccuuaccuucuauugauuucaaucucucuucuguucuuacccuccagugaacuccugaaaucaccaucugugaccucuugguugcuauaugaaguagcagacuggguugaccccucugcaguguuuauagcauuaauuagaaaccagaaguaggugguaucacagggaggagcaaggcaagaucugaggaucaaacgugaagggcaccaaccuaacauuuacucuguuauauuaacaaauacacuugcauugcacucagccauagagguuuauaaguuguuauaguaccugccauauauuauauuauguuauguuauauuauauuauauuaugccaacaaguacauaaacauuauuaaguuucccuuaguagucucaaaagggcauuuucuccucuguguacucuaggcuuuggccaucuacagaaauuacuguaugcacacaugucugcauacaugugaggcacuguccaggccaguguuaguuccuuucuuccuuuucuuuguuggcaugcuuguauagucuuauuuauggucucucagaaaguuuccuugccccugacaauuguagguuccuaugccauaguguccagcacccacgccacugggucaucauaggauuuuggcccauaaugaacagucugagacucgagguguuugugcuaggguucucucuuguguuaugggugacacaugguaagagguucuugggggauauaugaauucuaagaauuauaggcaugcuuuauuaaaaugaggcugaaaugauacagacuauauccuuaccaaaaaaaucuuauaacauuugauucugacaaagaagaacccauuuacagccauauguuuuuguuaccuuuuguuauacccuagcuauuaaaagacuuguagcgugauuaaaaauaaucucuugcuaccacuagcuuuaaagauucugucugaaaaacaaccaccccaaacuacauguacccucuaucuaauuucuuuagaggugauuuuuccauccacgauaaauuuuucuuaccaaauaauauuugcauaugaucauguucuuuauauuugggauguauuaauguuuuaaucgacuauaagcaaugagaaggagauuuaucuagucugcuguggaagugcuaacaugauuuuuaaaaccaacuaagaacacuaauuuuguugucaauuuuauaaccuuauaauuaccucguaaauaggcagcauuuucucaugguaaucacuggaguuuucaaauggcuuaaaaagaagaaaggcauuuaagcuaaucguuucggaacggauggaguuauuuauuuugacauuuguugacugugguuacggaaccuguccuuuccaacucugaaaaugacaaccuggaaaauucuguguccagaacacggaauucuaacacauuuaaaagcaacucaagcagaaccaauuuguggacucagaugagauuauccuaacacaccuuuuugcaaaggugcuuggcagugccacuagcuagggugcuggcacauuuauauugcaccaaucacucgcugggcaagagacaaagaccugagacauaacucuuuucucuagccccugccaagaggaacagucaauagcaggauaaugcuaucagguggugguccuauaaggaggacagagaguuuaagaaauagguugaaacccacaugccaguuuaaaaggacaugaaaaauaauguucauagaguuuaugagauagagguuccagauacuaacuauagaugaagagaaugggaaucuauaaaaauuccaagcuaggucagaaagaacaauauaaccugaagaauaaaaagaguuuuagagauggguuauuucaguucaaaccccucaucuuaaagagaaagaaugaaccuuuacaaagggcaaaccagcagaggauguggguuacacugaggcagcgagaauagugacugugguuccuaagguggagauggggaagaacacccgagaacagcaaggaagugggucgcuuuucauuuucauucagaaacgcaaaucuuuuaagaguauauguggacuauuaaaaaaaaaaaauagcuucaucaccugcagagcugaacucaauucugggguuggaccaaggcuaggccagacaaaaugcuccucuuaaaaugucuuugugcauggauaaccuuccuaaaauuaaguuccuauuugcuguuaagcuucuuuuguaccaguuuuaauuguuucuggguaugaaugccuuaagaguuacaaaagguuuguagaguugggcucuuaacauuuuaaaauuuauuuauuuuuauugaaaauaaauuuauguuuuucauaaaauauaguuucccuuugacuguguuccugauauuuuuggauuacucuuagacauccauaugcuauagaaaucaauuuuaauuuccuuucuaagguauucaaucuauucacuugcacugcuacacuugcuucaauauaaucucuacaauguuguuuaggauagcaugaaacauaaauacuuugagaccuuaacuuuacauuuccacacacaagugcaugcauacguacauacacacacagacacacagacacacacacacacacagacacacacacacacacacagagagagagagagagagagagagagagagagaggaagagagaggaagagagagaacucacauauauacauaguuauucacaguuauaacuacaggaaauguauuucuuaaguagcuaggcaagagacaucugaagaccaggagucaugaaugugcaaaagccaaccuaagaugugcacaaagagaucagaggugcugaaagaaaucaggagcuauuacaugucccucuacauggaaacuagaaggccuaacauucuaaaaacaguagaacaaaaagcuaucauuuuuaaacucuggaaaagaaccaaagauuuauaauaaacaaguucaaucaugaaagaugagggcugaaacacagugggcgagauuuagaggucauuuuccacuauccaccuccucuauuccuggccaaaaaaaaaaaaaaagguaaagaaaaauaacagcacaaauaauugagaaaaauaagaaacaauaauacuggagagaaaugguuagggagucagauacucaggaaggaagagcugugaaaacuuuaugguuucuagcuguccagauggccacaccuaugcacaaggcauaugaacagaaaugaccagcaaagacccuaacacuccccuucaauuggccucagacugugugaacaaaaacuaaagccaaaagcugagcugugcucuguccagagcagccagugcagugccaacccuaauguccagaaagcccaacuacaaaugccaggagaauuugucuuacuucccacacuugugcaacaacuuccaugagaccacaaccugaucagccaaugaaugaguagaagagauuccagcaagcauacuugacaaauaacaacaguucagagaauaguucugaaaagucgcuaagucagcgacagccccacauaaacaccaacaguagaagcaugugugugugccacguauacauaaucaaugaaguuaaaccuuaaagaugucaauuuuuaaaacgaguuauuagguauucaaaaaucgaagaaaauauauuuauucacaaggggguaauggaacaugacaagcuguuaaggaauucuuaacacugggauuacuagaugauuaacuaaaauaauaacaccauugaaauaagaaauguagguaaauauggaccaguauuguugaucuuagcucuuaauuucucuuccuucccucccaaaauugaagaaaaauuaacaaagcaauaauuauaaaccuacauuggcggauacauaauauacagagguaaaauuugggacaauaccacaaacagaguaaugcauuuauacagaaucuuuauacuauuaaaacugguugguacaaauucaaacaagauuccuuaucaauccaaaguuuaauaguaauuuccaugauaccugcuuuuaaaaaaaaacagguaaaaauggaacaaaaauuaacaagaagaaaauuuaaauaaauugaaagagucaaauuaaauuagauuaugaagaaacaaauauaaaaauauaauagaggaggguauuuagaaagaaaaaguugcaagacacagaaagcaaauaagcucgcucuuaucagcagauguauuaccuauaaauaaguuauacccuccaauuaaaagagagauaauuguaaaguaguuuuuaaaaagauccaauuauaugcugucuaucuaaacccaacuucaaaucuaaacccaagccuuaguuuuaaggauagaaaaagauaugcuaugcaaacaucauccaagagcugguauggcucugcucacaucagaugaaauacaguaagucaaaauuuguugaaaaagucaaaaacaguguauauugcucaaagggcccaucuaucaagguguaacaauuauaaacauagcugcaaacaauaacgaguuuccaaaauguaugaaacacauuuaaaagccacaaucuagaaucaccagggaagagagucucaaggaagcauugucuagaucagguugaacuguggguauaucuaugugggauugucuugauuauguccacugagucuggaagguuugcccacuguggcaccauuccccaggcagggauucugaacuguaugaguagagaaggcaagcugagacaaacaugaauguauuccaucucccucuguucuuggcugcggauaugacuggcugcuucauuuuucuguagccuugacuuccuagagugaugaaugauaaccuggaacugugggcuaaaauaaacccauucucuaaguuacuuuugucuauauacuuuaucacaucaaaagcaaauaaaacugagaaaaaggauagaauaaaacagcgcaaggcuacacaaaacaaaggacucaaguggcacuauaagccaacagacucauauaucaaaugaauauaaaagauuaucuagagauauagaguaaugaugguauacaauguuuugaaagauacuaagagucuggguggugcacuuuaaaauaauaacguugagaguuuuaggcuaugugauuauuuuaaacaaugaaaauguuuauuaugaacauucaagaaaaaauauugcuucaaaagaauaaauacuaugacuuaaaaaucaacaccaaauuaauaaaacuaguaaaaucugaccucugugacacaaaucaaaugaacagauccacaucucaggugggauauaacaccauagaaaccacccucaugaaaauuacaacaaaagcuuaaauaauggaaauuuauaaacaccuuucuucuauaggagaaagauauaagguccauuuuuagauguauuuguguguggguuggugcauaugcauacacauaaugguggauagaggacaaccuuaugucauuacuaagguuccauauaucuuuuugaauugggccuuuaauuuuauuuuuuaaaagauaaagauucucauugaucaaguagauuacgcugucuguccagugaggaccagggacucaacuaucucuuccuccccagugcugggauuacaagaaagugucaccauacucaggguuuugggguuuguuauuguuucuggaagugaugguguuacaugguuuccugacccuagaacagagccaacagggugugacucuucacaaguguugaugguugccaggugaaaggcuuguuuguauauuuuacuuuuguucuuccuuuacaugaaugucuucucugccaauguuaaugacucuaugauaaucagaaauagcaugaaucugggaauugaugguguguauauguucuuagcaaaaaggguaaacacugugaccuucaggauagcccuuaaggcugugggaaagaacacugaaaauaugaguucaaaauauauaauuucucaauuacgcaaaauauaagggugcaauauggauuuuaugaaaggcuucaugaaccuaaaagaacagaugcagcugcacuaugaggcagcuugucagaaagauacaaaggcaggcagauuccugaguuuaaggucagccugggacagagugacuuuagguucaagcauggucauaaugguaaucucaggacaggauuccacccagcuaaguuuauuguuuguccuuacaaaagcagacagaucucugaauucauuugccauguuaaaaacaaaauguacuugcugucuuuuucuaagaaucaccgggcugaggucaugaaauggcaaucaugggauaaucaaaacagaacuugggguacaugacugaauugauauacaaauaaaagacugggcuuuuggucugcaugagaugagauaguagagagugacagaaauuauuuuuuagaauuuuuuucuaguaaaugcugagcugucuagagaucucuggagaaugaauauauuguucuuuuaaaaauuuguuuucuaacaggauuucugaccuuggucagaaauacuaaaaauuacuuagagagcuaacauagcucuuuuagaauauuuucuagcagcuaccuagagggaacuucuuggaaaaugagcauagcuuuaauagaauuuuucuagaaaaucuaagaauauuuuauagcagcuuuucugacuuuggucagaaaacccaugagcuauccggagaguuuuuagaaauuuuucuagcaugaaacagcagaaaguuaucucaaauagacugcagagccaagagcuaucuacagagagcuguuuagggagucauuucaagcagacuacacggcugucagcuugcacccaaucauuugacuuugagucauuucuuucacuacuugcaauaccccuuccucaggacccccaacuaagcagaggcugguccuuggcagcuguuguuuugguuuuuuuuuuuuuguuuguuguuuuguuuuaacuuggaguucugcaaauuagagccagguucuuugcuugcaauguaaacacuguacuaagugaacuucuggccugauaaaauaggauuuugccauaauauguguguguguguguguguguguguguguguguguguguguguguguaaacaaagaauucuaaaauuuugguacuuuaaaugauauaaauacaugauuugauuuaaaggaaaacgucgcuaacuagcuuuaagaaaccgugacauucggagaaauucaaauucacacacagucaguagauuuggagaaauucauauucacacagagucaguagacacagaaagguagauugaacauacccaggucuuccaaacugcauuaggcuguggucacugaguucugccuuuguuucuggucucucauuauagcuaucguuccaaacccaacagcaugaaccauaucuuucaggucuuucuuucuccaaagcaaucucauuuuuauuucagaauuaaugucuccccuuaugguguuucuuaugaaugaaucaucaaaaccucaaggaaauguaucauucccauuucaaaaucuauaaaaacaagcauuuggagaaauucugaugaucucugacuuguaaaccuguagagagaccauaagugaagucaacacugguaaauuaagaccauuuccacaagggaggaagacagguccugcaaguauccccuuccuaaggagcaggauuguaaaaugagucuuucagguauuaagacaacuuuccuggggccuagagagauggcucaguguuucagacuacugguugcucuuccagaggacccuuguucaauucccaacacccauguggcagcucacaacagucuguaacuccaguuccagaggaucuggcacccucauacagacauacauccaggcaaaacaccaaugcacgugcacgcacacacacacacaauuuaccaauaauuuuacaguuuucugaagcagggucuguuuucauuacauaguaaauaauugaccauuuugcgaauguuuuuuaauaauuaaaagcuagacuuucaaaagcaguguucucaaugccuccugaacuuaccaguaaacauuuuuaauguuuaauuuuauuuugagagcuauggagagaauuagcauuucaacuuguaauaucacaaaacaagcucuaauaucaaauuggacguggacuugaauuccaaacugacacuuucauaaucugcguaaacuaaaauccugggcauucugcauugcauagaauagaaaaggacacagccugaagaaaucagggauauuucugggaugcuguauuuaacagacaaaaccauaccauuuuuaggaaccuuagggagaucucacaaauccauuaauuauucacuugaaagaguauguugagccugugugguggcgcacaagcuugggugaccugaauucuuacccuggaucccaugguaggagagaaaggacuccugaaagcguucuuugaccuacaacauguacugugacacauguauuuucauaucugucuaucucauucagauauauacuaaucuuuuuaaaauaucaaguaugcagaaauugauuuuuguacauuagcucccugugcuuuuuaaagcacauuaaaaagcuggauccugcaauaccucuccugggcauauauccagaagauguuccaacugguaagaaggacacaugcuccacuauguucauagcagccuuauuuauaauagccagaaguugaaaagaacccagaugccccucaacagaggaauggauacagaaaauaugguacauuuacacaauggaguaguacucagcuauuaaaaagagugaauuuaugaaauuccuaggcaaauggauggaccuggagggcaucauccugagugagguaacccaaucacaaaggaacucacacaauauguacucacugauaaguggauauuagcccagaaacuuaggauacccaagauauaacauacacuuugcuaaacacaugaaacgcaagaagaacgaagaccaaaguguggacacuuugccccuucuuagaauugggaacaaaacacccauggaaggaguuacagagacaaagcuuggaguugugucaaaaggauggaccaucuagagccugccauauccaggguuccaucccauaaucagcuuccaaacgcugacaccauugcauauacuagcaagauuuugcugaaaggacccagauauagcugucucuugugagacuaugccagggccuagcaaacacagaaguggaugcucacagucagcuauuggaugggucacagggcccccaauggaggagcuagagaaaguacccaaggagcuaaagggaucugcaacucuguagguggaacaacauuaugaacuaaccaguacccuggagcucuugacucuagcugcauauguaucaaaagauggcuuagucggccaucacuggaaagagaggcccauuggacuugcaaacuuuauaugccccaguacagggccauaaagugggaguggguggguaggggggugggggggaggauaugggggacuuuugggauagcauuggaaauguaaaugaaaaaaauaccuaauaaaaaguauuaaaaaaagaaauaaaagaaagaacagauuugaauuucucugaugagaaagccaacauugaucacaacuucuuguacugugugagggucauagucauauaagugugcaacuacauagggucaugcaacuaaauauaugagucaugaaaaauuccaccucaaaaaaaaagcuauuucuccuaaauaucuagcuuuccccaccuuccuaauuuucuagugacaaucaaugauucaaauaaaagucucaguaauucuuuagaauguucuucacaaugcagucauuugaaugauagguuuuuacaucacagcucgguuuauagaguugauuuaaauuuaagccgacucauugccaaacaggaaccuuacucuuuucuguaaauuuccuuaucuguaaaccaaaaugaugcccaucugaucaguuuuggaguaagguaaguauaucugugucugugaagauccuggcauuuagaugccccauaauaaauggcugucacgcuuguugcucugucacuucaugcucagaaaacaagucacucgggucauaucaaaucacauuaagucucuuguuguauuuuuaaagcuuucuauuuucuugccccauuuccccuuuauuccaggaucucagagcacagcuuaggucucugaucaguauauuuuuccuucuaucucuugcacucagcauuacaaauuuuugaauauugauaguacuuuuccuucacuuucuucuucuaauugcuuauggcuuuagcuuaugcccuuccuauuuccucgacacagcaaacauucccuugaggacacacuacuagcucauuguucucuucuuuggcuccuaguggcagcucucauuagaucugggaugugcuuuugcucuucucacuagaaccuacucuuccuucuaaauaaaucucaccgcuucuacgaggccuaguggcacacaacuguaacccuaacacucaaauacuaagucuucuacagaugcucuguugagggaaaaaaaaaaaaagguuucuuugugugacuuuagauguaugagaaaccauaaauacaguacaaaugcacuucaaagaaaagccuggguucagagaaagaguguguguguguguguguguguguguguguguguguguuuuaaugugacauugaacuucacagugacuuaguguuccccagggugagccugaagugagaugacauauguacaguguauggcauacaauaaguauuccuucaaugaaacauuuagcuauaauuaggaugaauauccaaaagaaacacuuaucauuauuaucacaccauagagauaaaaagcuaacucacaaaauacugaaaagaucuuggguccuggaauacuaaccuaugaguccaccauauuucugugagugaggcuaggcaguggauuuagguugcauaaucaacuacagaaaaauaguggaccuaggcugcauaaccaacugcagaaagaugggaacccugagggauaagacaauugucagaaaaauauccaggaguuuguuguuguuguuguuguuguuguuguuaacauuucacaucaaguagaaguaugcaguucaaucaaucucuggguugagaauuaggaagguauaauugugccuucaacaacuaaaccagaggcuccuucauagcaaaaaguucaaggacauuugaacaaauaaauaagguguaauggaauuaaaggucaagcugaccuuuguuauauuacuaccaauagcuaacuguaugggagugagaauuucuugaaugcuuacucuacugcaaaguaauaugcuaaauauuguuaauauguaauuugcucuaguuuuaucuuaagaucuuuaaaaacagcuauuucuuugauuuuccccauuuuuaaaccaaggcagugugagaaaugagccaauaaaacacgaaaaugucccacugacuucuguuaaauaagguaaaugugcuucaggcuuugggacugguaaauguagguugggaaauugcuagaauuaguuccuuaguuuuggugcaaauuucuccagguaagacucuuuaaacaauuacuucagaucuccauuaauuuugugcuuuuggcaagacuauuccuuaggauaggucuagauuuaguguaacaauuuugaguuguccuuuaaugaaaaggugaguuacauuaacuugaagaaauuauauucagaauuagcuaagcaguuaugcccgguaaaacaaggagcugauuucuucuggcuucauuuuuuauuugguagccucuguguggaaacucagauuucguuucucauuuacauucaugguuuugucuucuggcccccaccccauaucuuguuugcuaauagcucugcuuuugugcuauuugccauugcggagggaauauuuuuccuuaauacuuuaccuuugauccauuccugcguaagagauauuuacucagcuuagaguguguacccacacauuuauuuggaauuuuauacacuuuaagagcuugcaucuccuuuccauauuugaauaauuaugauucuuggucuaugggacaaacauacuccuugcaucacuuuaacuuuggcccuuacuuuuucuugccaaaagacuggaaugcauaauaagaucauagagguucauaaaguccagaugcauugaggcauaagcuucacacagaaacaguauaguaauuugaauaggaacuauuuguuauauaaagaugacacacaccuguaauguuaauauuuuggaggcagaggagaaaggauuuccugugaguucaaggcuaguuuggucuuccuagugaguucuagcccaacaaaagcuacagaguuagaccuuauccacaauccccccaacccacuccaacccucagccccagcaccaauaggauuguuaacuguaaccugauuagaacacagagggauuagucaguaagaagaaaagggaacucuuuaaauugugguaaugacagcuaggagaagcagccacuacccuaagaaugagauagauugccaagagaauggagcugaaauaggcuaucacagacugaagaugcagccaugacacauggaauggaaggugcuggaguugaugaaggcaugccuucucaaacuugcugaagaucuacucgcuacagugccagagaaagcuauuuauaaggaggugucuuuccggagucucuccaugugaaacuuccuaaggugguugcugggaaaauugggaggcugcuggcuacaggaugguccaguaacucuucucacugagggagcauagcaaagccagggaggaaaaucccucuuccuugccuccaaucaacaaagccuaacuuuuauucagccuggcaaagggaaaucuuaaagggcucaucuccauauuugcagaacaugcaacgggguauaaauuugcagcugagagacuauaaauugauaacugguaugccagguaacacauauauagcaggaaccuuggaguaucaucugguccaauuuccucucuuccagcagauugaugcuucugcuauuuaaagcagagagaucuaauucuguugaaacauacguuccuuuuagaacccguuucauucuuuaaaaguaugaguuaauuaaaucuauauauguuuauugcaaagaauuuuucaaauacugaaaaauuaucacagagaaaguaagucacaaugucagggcuuagagaaaauuaaugccaauauuuugauguauaguagccccuauuaucugaacaagguauauuaauaucucugguagauaccuguaaccacagguugucucagauccuauaucaauauuuuuccuauauauaccuaugaugauaaaguuccguguauugauuaaacacaguaaaauacuaacaacaauaacucuuacuaaaacagaaugcuguuaaagccaggcuagaguaaugcacugugccuagaacauaaaauauacaguaaugaaugagaaagugguauuucuuucagaagugucuuauuccauugcacuuucucguuucuugcaauaauggggcaugcuauaaugaugaugugauauaaucagaugaaguaaagugagggagguaggcacugugagcuagcaccaggcuguucuaugagguuagcggaacagacacuuagcuaaucuaugagaguuaauagcugggagguuagugacugacucacggguagacagcacacacagucuggauacaguagaagagaaugauucacauccugggcaccaugggaauugcgugacaugaaauuucauuguauugcucagcaucauacacaauuuaaagcuuugaauucauugauuucuagaaacuugcauucaauauuuuuggaccauuaaaguugaaaccacagaaugggagugacuagugucauguuauacuuuucuuuuaacucauucacuuaauuaaaacuuaauuuaagacagccuaaucuaauaucuccuaggucuaagggcugugagaauaaaugcuccaugguaaaccaacuaagaaccaccucauccacuugggaucuaguaaggggugcaaauguuaagcgaauauaaacauauuuauguguauaaguuauguauacuguacauuuuuauucauaauauuuuaauaauaauggacuuguuuauauaugcugagauuuguagucaguguauguauuuauguaacaccauauuuuccaugaccuuaaaauuuuguagaagcucauuuuuaugauaauaacauucauuuaaauacaguuuaacucucucaaauuuuuauuaucagacaacucuuuaacacuuuaaauuauguacugugcacuauauuccugcucuaugguuaauauuauuaugcaaugggcuaaaugaccuugagaaagaacaccuaccuucucuguuuucaaugaaauaaugauaauaacuuccuccucuacaugcugagaagaaaaaauuuuacuguaggaaagccgcauggaaaguaacacuaaaacucaaguugcuaaauauuagcugucaccugauucugaguauuccuaugagagguaaaugauccaauccuaugcucucacaugcccaauucccaacuuggucuuucacccaccauuggaguuaaauguuuauuuaaaguuauauggagaguuggguuuggcacaaugggagccugcuugccuagaauguguguggggggggggggggcugugguauugagcaguagauaaaggagucuguaguggcuauuccugguugucaauuugacuauaucuggaaugaacuacaauccagaacuggaaggcucaccaguuauccuaaucuggaggcugggagauacaaguuucugaccuggaucuuggcauggagaucaugagacauaguggcuaugaauucuagaagauaaagacagggagaucucugaguucaagguuaucugaaauuaaagacgugguggcacacaccuuuaaucuaggcuauaucuucugcuggagaccuacauaaggacauuggaagaaggaagauuuauucucgucucuucuucaccaacuugcuuugugggacugagcaacugcuagauccuugaacuuccauucacagcugcuguugccaauuguugggaauuggacuacagacuguaagucaucaacaaauucccuuauuauuaagagacuacccauaaguucugugacucuagagaacccugacuaauacagagauauaaccuaaaauccuuccauaucuaagguaacuuguaaauuaauuguaaguaaauugacaggaugaacccuuauguguagaauuucuuuuuuuuuuaaagauuuauuaauuauauguaaguacacuguagcugucuucagacacuccagaagagggcaucauauuucguuacggauggcugugagccaccaugugguugcugggauuugaaguagaaccuuuggaagagcagucggugcucuuaacagcucaagacucuugaugcuuuaaagaucuuaacauacuucggaacacaggaauucauuuucuaaccacagugcuugacaaaaugcucuucuuagccuaacaacacuaggcacuugaugcuauaaguuaauuuuccccacauuuuaauaauacaugaaacugcauugcucuuccagcucauauuucauucacuaguaaaugaagcgugcuuuuccaguuguauauauucuucagauuguccaucuuccuugaccaauuuucuacugacauaugugguaucugcucuugggagccaaaugaauaauuacuugcuaaauggcugaaugucacugccuuucauuuucagaugcuacuccauauucucacaauuauaguacgaugcaguuuguuccuuccuugugaauaacugcaucuuauuagaaaucuuguaccauaugaaagccaaaauggagcuuggcuccuugaucuuauagaauguauuuuacuuuuugaaccuauugaguauuuucaauauuauuuguucaaucauuuauucuuccccugauaugcuuaaacuuuauaaacuauuaauucuuuuauauugaguuaaaguucuugaagucuauuaaaauccauacauuucuauacucgucuagcaccauaauuuaaaugauauguuuaauucauuacagguucauauuugguaaggucuuugaauucucuuaaguucagugaguuucuaaauuuuacuuggauagcaguuuuauuuuuaauuuugagacaggcucuugcucuauaguccaggcuggauucaaacucauaauucucccacuccagcuucccaagaacugacaucauauccacagacuacaucaguucuuaauauaguaaauuuaauaauaccucacaggagaauuccuaauucccacaaugcauauguucucucuuccccccccccccacauacagaguggggagggaaggaaagggugagaaggagggaggaaggugggggaggggggaaggagggagggaggugggaaggagggagggagggagggagggagggagggagggagggaauauauaucacauccauucauccuuuugaaguugcuuuggugaucucaauuccugguuugucuuagaggcuaacaauuaaacaccaauuaucuugagagagagguuuaagcagggggaagaauggagaguaagucagaggaggaugggggagggagagagagaauucuacuccauuacauuuuauucaaucaacacauaugugggauaccuacauauaaccaggaacuuggugaacacaauagcugauaaaacaaggguugaagcugcaggucagaguugaaguacugucuuaacaugcaugagaauugauguuguuccuaaauguacaugagacauacuagaugagcaaucucauuauggaaaugcuaucauaaaucaaguucaaaguucccuguacagccauuagucuuagcucagacuuggaggaagagcccauuccaggaaaaagauaccuaaaacuaagaucuaaaggguaugagguacaaagggacaugagccaggcaaaugcaaaaggacauucaugaaauaaaguugcuuuaauuuuacuuuaagaaauuacuauuuguguaugcaugugugugcauucauguuuuuguguguaucaugcaagugugcauguguguucauguguguaugugugugcauacaugugcuugugugugucugucuaaauauguaugcauauguccaucuaggugccuguggaagccagaugaggauguucauugauuccugaagcuggaguuaaagauguuuauuaaccgcuugaccuggguucugggaaccaaacucugguccuugggaagugcgcuuaaccacugcaccauugcuccaacccccagccccgagaagcuguuauuuucaaacuuuucuaaauauaucguuuccauucauccuuuugaaguugcuuuggugaucucaguuccugguuugucuuagaggcuaacaauuaaacaccaauuauccugagagagagguuuaaguagggagaagaauagagaguaagucagaggaagaugggggagggauaaugaacacuaagaacauuugaaaagcuguauggaaacccauucugcaaguuucuacaguguauagauguauauuuauauucacaugaaguaguuuaauuggaguuacccuccacaggaggccaagcuucuucuagcagcuauagguugccaaauuaaaagcccagagccagcugugggguaccuucccuugaauugcuagcaaugauauccugaaaagaaugccaaacaguacuggcuaucguuacugcucaagguacccacuaaaaguugaugguaagccccuacugcugaaaguacuauacacuucagucacaggacauggaaaaaucaaguuagcacugaccaagaagagucuucucugcuaacuagauuacauaguaccagaugggguaagucacugagagucuggcucaacugugagaacuguauaccacaauaaugaugggcgcagaggugaugugaagguuaggagguaauaaucugcuuucugauuggauuuaaggccaucuccagaggaagaaacauaugcauuguacuugcauguguuuguucuucaaaaagcuguccaagaacccaugguuggggauuucaugggcccuagggaugaaccuacuauaauuauuuuuuuaaauaagcacaauauucaaguguucccucaacguguaucccucuauucauacaucagugaagcucucagaccucauuagaaaaguuuguucaauggauggagguuaauguagaaacucacaccugguaagugugcagagaauaaguguucauggagugcuuagcuacauauggaacaucuacaccauuugucaacccacuaaagcucaagcaccauccaagaagauaggauggagagagcuagagauagaagucaagaaggauugcagugaaauaguaucuccuggacauggcagucccaaugcaugcaugaacacaugacagcugugguugccugacaaagucuauacaagaucaagccagccaacauucuagcauggaucaggaaggugcccaggagcccccauccuuaacuaugaaguucuugaccauugauggcuucugucuaaagaacagguuaacuagaaggguaugguccugaguauguagaccaugcuccaauggaugguuccacacccauaaauguauggacagcauauaguuuguuuauagaaguggaugugaguugaguugaguggagagauaggaggguggaucugagaggagcuaugcaaaagagcugaaaugacuaaaauaaaaauauaucauacaaagaauuaauaaaauauuauguaaaaauaaagaaaauucuaucuuucuauguauguauguaugaauguaugaauguaugaauguauguauguauguauguauguauguauguauguauguauguaucugaauuucuuuuauaauccagccauuagucacaaacuaaucugauauuucugauacugcuacaucuuauacuuagccuucaugcuuaugcuaaguccaguaucuuccaaagguuccucgccuggagugcuauccaaguaggcaagcuauuacacgucauuuucugggguauauugguugcuugccagaugucuuagauaauuacuuuuugaaagauugaaaagguguuuguaauuaaguaugccaagaacaugaaaaauuaaacuuaaaaugguguagcuauucuuguauaggagacuugaaguucuuagaaaauaauuuuuaggguuaaaagagagauaaaauuagagagaaauauuucuucauauguaaucaauuuuauggagucugcaaauauuguuuguguucacacagacacuucuuauuuucugaaaugaauaugagcaauauugagcauuuuggcuaaauccacucucaaaaaacccaacucuuccaaugucaguaaauaaucaacagaccuggguuuuauguauuuacuucauaaucauucaggcgcuaugguucuugauguuaaugugaacuauguuugauaauuuuuauuuuauauaaccugauauucauggaaaauacaaacuguacuuuuccgaucuuguucuguuuuuucagaggcuuggcuuaaguguuaagguucuacuuguacaacuuuaaguuaacugacuuuaaauggucauuuaguuuugguggaaguaaauuugaaccauuaaauauuuccagguugagaaaagaacuccagggaacuccuuuuuagcuuugcuacaguguacuggaauuuuuuuuuaacuucucagagaacauccagucuagaauauucuauuaaccagugggaaacaguaauguauuaguuguagggaaugguaagccgggcuucacaucuaucuuuuccacuaacaggaucuaaucacgggugacauucauucaauauuuucaggacacacuuaauuuguaaaaugaaguaauugguaauagugaagcaauugauuauagucucuuuaagaccauuuuaucucuaagagugcuaaaauuuguaugacucugaucuuucaccugaaaugaucuaaugaucugauggugacuugggauuuuuggaggucuuaacgccgucuacuaaguaauauguuauaaagggugccauuguguacucuuauugcuugucucaacccucagcacaguguuccuguggaugaaucauaccuuuucaucacugauuuggggauuagccuuguaauguucuuugggcuguacaauagucuagaaaggacaagugugguaggcaauucaaagcgaggcugagaaagacauuggaugcuuccuucucuugagauucuguccucugucacaagcacagcauagcccauggagcgguuuccuaaaaccuggaucucugagugaaaaagagaucuauguaaagcaggcuugaccggaacaccagcauaaauggacugugacccaguagagucaaccuaacuugcaaggcgguaagaaauauccuuccugucaccaucccugagagugcaugguuugucacaguaaaagccgaugaaucaaguacgagaugugcuuuuugauggagcuaacaaaagcacauuauuuuugaaagucuuauuccaaaacacuuuaaugagugacuccuuauuaucaaggcuuuucuuccucugauaugcuuacugcaucagcuaaaugaagagacugcauagaagggaagugcacuuagggaagcugaaaaugcuucucugagucuauuucucaaaauuagugaaggcgaaaggucaacagacagaugggcaguuuugguucaaccaccuggcacuguucuuacuacagcgauacaucaucauuaugucuugguugaaaacucgcuuuaguaaaauuuggcaaacuguuuuugugucugaauggcugcauuugaaugucugcauagagcuuucuaccuagaugaaauguaucguuaagaucuguaaaaucacaaaaucuuugagauaauuagaaauuugcuuuugcuuuguuauagaccacaaggguggggcaaauaguaaccaucugaauacauuaaauuucagagggcagucgaaaacuauucugugucuuauauuccuuuacacucauguaaauaagcaaaauaaugacuaaguacuuauaucaacacauaacauacauaaaguacuaauaauacaaagccuuuagguaucaaaauguugaugcuguauauacauauauauuacagauacacucuguagagaauauaauaauuaaacauuuuauaaaauuaauauaaaucuguaauggcuaagagaaaugcucaucacuguagauaacacccuaagccccauaaagaaggcugacuacauaguuuacugaaacaaagcggcauuuacugaaacaaugcuaauauauauucugcauuauauauauguuccaauuuugagggcauuuuauagcaauuauaacuuuggcaauuuuaucuauguuuagaaauuaaaaugauaaaacguuauaaucauuuccagcauuggaugauccguuaauuaccugaaaaucuuuuugagugacuuuacuaucuaucaccacaucauacauuaucuaauccaaggaucauuuaaaaaaucuaccagguuauccuuucaucacaggaaaugucagguaucgacccugccuaagguaugacaugauaggccaggaaguaugguuaagaaaaccagagacacugaaacuuauagaggagaaaguagggaaaagccaugaagauauggguacaggggaaaaguucuugaauagaacagcaauggcuugugcuguaagaucgagaaucgauaaaugggaccucauaaaauugcaaagcuucugcaaggcaaaagacaccaucaauaagacaaaaagaccaccaacagauugggaaaggaucuuuaccuaucccaaaucggauaggggacuaauauccaauauauauaaagaacucaagaagguggacuccagaaaaucaaauaaccccauuaaaaaauggggcucagagcugaacaaagaauucucaccugaggaauaccgaauggcugagaagcaccugaaaaaauguucaacauccuuaaucaucagggaaaugcaaaucaaaacaacccugagauuccacuucacuccagucagaauggcuaagaucaaaaauucaggugacagcagaugcuggugaggauguggagaaagagggacacuccuccauuguuggugggauugcaagcuuguacaaccacucuggaaaucagucuggcgguuccucagaaaauuggacauaguacuaccggaggauaccgcaauaccucuccugggcauauauccagaagauguuccaaucgguaagaaggacacaugcuccacuauguucauagcagccuuauuuauaauagccagaagcuggaaagaacccagaugccccucaacagaggaauggauacagaaaaugugguacauuuacacaauggaauacuacucagcuauuaaaaaaaugauuuuaugaaauuccuaggcaaauggauggaccuggagggcaucauccugagugagguaacccaaucacaaagguacucgcacaauauguacucacugauaaguggauauuagcccagaaacuuaggauacccaagauauaagauacaauuugcuaaacgcaugaaauuaaagaagaacgaagaccaaaguguggacacuuugccccuucuuagaauugggaacaaaacacccauggaaggaguuacagagacaaaguuuggagcugugacaaaaggaucuagagacugccauauccagggauccaucccauaaucagcuuccaaacgcugacaccauugcauacacuagcaagauuuugcugaaaggacccagauauagcugugucuugugagacuaugccggggccuagcaaacacagaaguggaugaucacagucagcuauuggaugggucacagggcccccaauggaggagcuagagaaauuacccaaggagcuaaagggaacugcaacccuauagguggaacaacaauaugaacuaaccaguacuccggagcucuugucucuagcugcauauguaucaaaagauggccuagucggccaucacugcaaagagaggcccauuugacuugcaaacuuuauaugccccaguacaggggaaccccagggccaaaaagugggaguggguguguaggggauuggggggggguggguauggcggacuuuugggauagcauugaaaauguaaaggaggaaaauaccuaauuaaaaaaaaaagaaauaagagaagagcuaagagguacagcucaguggcuugagccuugacuagcagguacaaagcuauaacacacacacacacacacauacacacacacacacacacacacacacacacacacacacacacaaaagaaucugaauucuugggccaggcacaguggugcacaccuuuaguccuagcacuuuggugguggaagcagacagaucucugugaguucaagaccagccugaugugcaggacaaguuccaggacagccagaccuucaaagagaacuuuuggcucauaagacuaacaacaaacaaauauuuggaauucuucauguuaaagcaggcuguagugaacagaagaaaguuaagagucccuuaaacucauaaggcugauggugaggaaugaaauccaaacuuacauaguuucuaggaggagagauuaauucggaauuugaggcuuuaauuguggucuuauauacuacaccaaauauuaaugaaaauacaagacauuguuuaagauagcuaggaucccacuuuuuagacuaggcuggccuuggacuuguaguaauccuccugccuccaccaccugagugcuggaauuauagcuauguaaauucauguccaaucucuugaaauuuuaucuuuaaauaugcauucuugauuaaccuaacuucaguauaacuuuuauagucauaucuuacuaguuucaauuacuucguuuuauaauucugaaauauuuucuacugugaaaaguaaccuuuagaagaccauuuuaucccaguagggaacuaggaguguaagaauaauuaacucccaagauguccuugcuauuuuacucauauuugauuacuuaauuaagggaaauugugagacacauagccaaagcaaguugaucucagauuaaauaauuaugauuuccauuaggaucaaguuacacaucucagugauaucugaauauuauuagagaaaaguguaauaaauauaguuuuaaaucaucaaguaauuugcaaagauugagugaauuuacccccaucuuaugauaggcaaugcagacaaaagaacccuuccuuuauguagccuacaaaagugcuuaggaaauagaugucuaguagauuuccaagaaaauacugggacaggaagggguguguguguguguguguguguguguguguguguguguguguguguuuuaaggggaagcagaaauuagccaggaaaagaaagaaagaaagaaagaaagaaagaaagaaagaaagaaaggaaggaaggaaggaaggaaggaaggaaggaaggaaggaaggaaggaagaaaggaagaaagaaagugucccuucccuugguaacaaauaccucaguaaaauugauucaguaaagguuuccauucccuugcuuaucaucuugccagugacuuaagcgguuauagaugaaacuguaugacuugcaaauaacuugaagccaagagggaaaaguauggugcacaaugcaaucuuuaacaagguaaaauuuggaggcaauagagacaacaugcugcagagaguuaaauacaaauguuccauucuggaagaggcaauauuaccauaaaaguucaccaagagcaagccuuagaccgcugaccugcaccaaugcugacuagcaccucuuucguaaaguggguccacccaguuccccauucaggccacacaacacccgaauuugcucuuuagcuuccguuuccauagaauaauggaggaagcccaacuuuuauccuuuaguuauucaugaggcuuucacaucaaucugggacugcaaacaaaccacuugagcccuuucuugcacauaacugugcacauaauugguuuuauuaauagugugagaguuuggugccugcacaugugaugaguuucaaaaugggacagucacugaucagccauuccuucagucucugcugcauuuuugacccugcauuucuuuuagacaggaccaauuugggaucaaaaguuuugugaguggguugguauccccaucccuccacucaagguccugucugacuacuggagguggucucuucugguuccauaucucaacuguuggacauuucugcuaaggucaccugcauugacucuugggauccucccacauccugggucucugggacauuuuagagaacucuuuagauagcuuuuauagugcuagaagggaccaggcaggcugcuggguuagaaaaaucaucaauggucugagcugugcauccuauaaauugugauaacaaccggccaaggcaagacauaccuucuaguccaaugaugcaugacuguuaaugggguagucaacagcuauuugagaugcucaccauagaaguaaauuaauguaugguucuguagacuuggugaaaagccuuuggguaggggggucauaggccguagagugggaaacuaauacuguuguuccacuuacuggucauguucaaauggcauuaauuuucuaaaucaugaaaagcauuaugacuaagcuaagauaagccucuuucuauaauaucguauuucaaguuauccaguaagcaaacaagauggacauaggacagaagaugguacaacuguuaagagucaggcuugcucauguugaggaacagaguucaguuucccagcauucauccaugucauauaucucacaagucuguguaacuccaacucugggaauuuugacacccucuucuguugauucacaugcauacacacacagagacacacacacacagaaacacacacaauuaaacacaaaauaaaucauauuuuuuaaaaagauaaguaaauauuacagaaaaagaagcaaaaaaaaaaaaaagauuuuaagagccaaaggaaugggaaguuugcugugagguuguaucuucuggcaaugucagaaaccaaauccaacaugacugucuaaacaugaacaaggaaaccaaagccccauuaauguggaugagcucaugagggcccaaccuuacacaaagaacagaggcaaccaaggagugcugagcaaacacagucuucccaugagaagagugcacuccuugauuagcuaacaccaaguggucaccucugauaacauacucauacaagaaacagaaggcauauuaagcagguuguauuuauguacuuagaauaauacacauauguuacauauacauauguaacaacaauuagugaaaagggggccaugaauucccaagaggaugggaggaguuggagggaggaaaaggaagggcgaaaugacauaagcauaguaucgaaaacuaaaaaauaauaauuuaaguagacagaugaauaaauggaugaauguguaagcacaaauacacggguauacagauaaaguauaauuaaguaagauagaugauggaaaaauacagcaaaauuucaauugucaaauacagacuacagauaauucuaaggcucaaguagagacuuacaaauacuuagaugaacuagaaaaguuugcccuuucaggugaaaaggcagauucuuuaaaugacaacagaacuucuuguacugccuuugcuuguaugguauagccaugauuuuggaugccaagguaaagguggauaaaauuccugucuaauugucucuuuuguggguuagugcccucacucuucaugauacauagauguugugcaucauaaucuaugucuuagccauaucaauaaagcuuuagauugcuuuuuuggggacuuaaaccugguuauccuuuuuuaggcagcacugguauuuguucaacacuguacuguguugucuccauucaauuacucauaagauuguucucacagggagacccagucaugggugauacauugauggagagaagaguagguugaaaagcaucuuccuuccuaggauccuuguguauuuacaguuucagaugucagaaucaagagaagaguuguguuuagaaagggaaagaucaagaauaagauaaacugccuggcagugguggugcacaccuuuaaucucaguacucuggaagcagaggcagaggaggcagaggcagaggaggcagaggcagaggcagaggaggcagaggaggcagaggaggcagaggaggcagaggaggcagaggaggcagaggaggcagaggaggcagaggaggcaggaggcaggaggcaggaggcaggaggcaggagguaggaggcaggaggcaggaggcagggggaucucugaguuuaaggcaagucuagucuacagaagaauuccaagacagugagggccacacagagaaacccugucuuaaaaacaaaaacaaaaacaaagcacaaaacaacaaaaaaaaagaauaauauaaacuuguuaaucuacuaggcaaguacauuuauauuucuugguguauaugugauuguguaucaaguuguuaaggaaaugggacauaguuuuggucaaccaccaaccuagguauuuguuugaugguacuuuugaaaugauaaacauucugucacuagaccggauuguaacagacuacacauacugauggugaagagccuauaucaucagcuaaagaaugacuuaagagaaaaagcuguaagaaaaggcuauagucccgugaggaaaauggaauucugcuaugaacacagaguguucccugaaucuucugccuucuagccugacccauacagcacaaacuuacuagcucccacaguuucauuaaucauccaaugaaacaauucauugaaauuaucuaccuaucuacccauaccucccuccuucuaccuacccacucauucauccaucuauccaucccuaccauccaccuacccacccauuuaucuaucuaucuguccuagauuacucuccaucuuucauaucucuaaaguaaccuagcacaauauauuccuccacugguaagaacuuguucaaaacuucagucuuacaauuuuauauguaaagaagagucauucuuuuugucaacuuguuuucugaaaauuugucugaaaaaauuuuuucucuuucuguugauaaaugcaaacacaaauuccaucaguauauaacaauauaccauucacaaguggcacuugaaccaauaaccuguaccauuuacuaaaauacggcacaguacugaagacauguaguuacuguagugacucaaaucaauccuaguaguaauucuaugaaaaugaugacauaggugucuugguuucuuuuccuguuauugucauaaaaugucuugcuaaaacauccugacaauagccuaaagaagaaagggcuucuuuggguucauaguuggagauacaaagccuccacagugaggaagucaagcaguaggagcaugaaguaucuaucuggucacauugcacuacagccaucagagaacaacaacugcucccuagggcucacucagcuucuccaucuucuauagccaaggaucucuugauaagagaguaggcuacccauagucaagaucagucuuccuacacgacuuauggcaucaagacaaaccccaacaagcaaaccaaaaggcccaucucccagaagacucuagauugugucgaagugacaauuaaugcuacccaugguaaugaguaaugcacaauuugcuuugggggcauugaaaaggagcauuaaaaguguucuauaggcuacgauaaugaugaacugggcccuuaaauauuuucacaaauuaacagaguguaaaacaggaaucccaggauauauuaugaacuuuaagugauaauggagcuugugaaaguucaucacuuguagcaaccaaccaugccucacugggaaaggauacugacaagggguggagggaggagacuauuaugugcaugggauagaguacaugaugugaagacaaucuuauauucaauguugcuaugagacuaaaacuucucuaaaaaauaaagucuuuuagaaauuaaugacccaagugugaauaagacgugaauuacauagaacaccaggguuuaaaaucaacacgcaccauacugauagcacuuagggcugcugucaugcuguguucguuaugauucacuuguaauuagucagaauauacugcagcugguagugauuuggggaaaaauaagacuuuuuggaagagaaaauguuucauuauuguugcuuuucaaaauuccuuucuucauaaauaguguuuuagauggcuuucaauccccauuuccaaucauaaauaauauugauaggcaggguucuaucacauaugauaaacuacacaucaauuuuauucccaccuccugccugaguccuacagauaugcauuuacuacacaaucauuacuuuauaugcauuaauuucugacucuuucuaagcugauauugcuaaaaugcaggauguugaguguuuuaacuuucuacauucauacucugacaccacugucagguuucagaugugcuaugaugccuuuuguguuucccaucuuagaaauuauuugaauuuaaauaggacagucuguugaacauuugaauggaugcauuucuauauaauguucaccuucuacauuauguuuaguugaacuuuuuuucauaaccgugcaguuucugggaugcuauaauacuaaggagauauauauauauauauaucauauauauauguauauguguguauguauauauauacauguauauauguauauauguguguauauguauguauauguauguauauauguauauauaaacaacuauauauauaaacauauauaugugaaaacaacuauauuucucaugaauguagcaauggacuucgagauaccauaaaacaagauuuguuuuaaacaacaauaucuuaaaauagccaaaggugcaagcauaaauccacccuaauuuugcuacuuuuacauauauugcuugucuaaagauuauacuagguuuucccacugauaacaaacuauugguaauauacagaaaaggcaggaauuggcuuguaugaguuggaugguagcaaagaccaguagaagauucaguaugacaauuuuaagcccuggaaacauucuuagacuuucaagacauuuggcagagcagaagagaaaugccagugugguugauaucuacugguauuaguugagaagaauccuucugcaccaagacagcagcaagagcuuccuuugaaaaacuauucauuggguggaugagagucccaguuagggucuguuccuacuauuacuaauagggaagauuuggugaaaugcaggcaaaucagaccuaucaugggauguagauuuuuaaguaccacagcaacuagaaaugugccaugcuuauuuauuucuauggucauguuucauggguugcuuuagauacccuacuugcucaagcuacuaguuuugaauccuuuuaucuuuaaaaugcuguugguguguuacaaccagaaauaacacuucucaucaaaaaacuagguuucuuuagugaucuggagaaguuauaaaaauaaaacauaacaaaaugacuaaauuugauaaaaagugcauuggguuaagaagcagagaguuuuuaacaaaauuguggaggaguuguuuaccuagaaauggugcagaacucuagccaaucuugaaacaagacuaagucagaauaugaaucaacacugacuguuacuucaucaagacucuugcuaggaguaauggcagugacuugacaacauauuuguaucacacugcgaugaugacaguuccuuauauucuuucaguuuggauagcuuccaugugggccacaauguuucaagucgaagaauuuacuaacagaaaccuugugauggacuaucuagaacuuauuacaugguuuaugaaguaaaggaacgcccuagaaaacacauaaauaaaaggaaaggauaauaauuuuauagcugaaaaaauguauagcagcugaugcacuuacaucaugcgucuuaaaagacauggguuccuggcugccaagauggcucaguagaugaaggcagcuccugucaaaugugaugaccugaccuugcucccugacacaaacaugaugcaauagauugcaugcuuacacacacacacacacacacacacacacacacacacacacacaaauagauguaauuauuuaaagagaguucuuaaagucacagaagcucuuuaaacuuuguugcuuaugaauuuuugaugugaaugcaauaaaacuuuggcuuagauucuuguucuugauauauuggaguagcccagguucucuuaagaguuggugcuaugcucauuccugacagguaguucuuuauaggaaggaauguccuuauacuaccuaaaguguucuccaucuuuagguaccaauagcaaacucccaagugucuccugagggaaagggcaaacuuuccuccauugaggaccacuggaguauaccccugugguuacugacagacaucuagaaccuagcaguucugagcucagcuuucagggaugguaucuuauuguuauugacuuggaaaguuauuuguuuucuuuaucuuagaaauguuaugcuugugugucuguaauaugaagaggguaguuaugacacuuggugacaugcuguaaaaauuaucacugcugguaucauaaaucccaaaugcacauuuucugacccaaaucuaaguauugacuaaccagacuuauaacuggacuguuugaugaagauugacagggacuaaaccucuaaaauaacugaaagcaacaacaaaguaauaguaaaucuccuaaggucuaaauauaaugauuucccauugcaacaaggggaaacucuggacuuaauucauuuaauauacaacuauuuaaaaaaggagaaauguugcuuuccacacucaagggaaaguacagauuggggagauaugagcaagaccgauuguauguccaaagcucuaauucuaaaaggaguaacuucuuccuucuuguaaaccagugguucucaaccuuccuaaugcuauaacccguuaauacagucccucaugguguggugacccucagccacaacuuuauuuuguuucuacuucauaacuguaguuuugccauguggggggggggugugaaggucaaccuuguaaaggaaagagugggauggagaacgaggcaccacagcuccugccacuccucaagagugcuuaucugccauucuggacauuagaucuaagauggcucccgaacaccagcagaaaggaaccgaguucagggugguggcugcuucuccaaucuucacagaaguccuaacagaugacgauacucucccuuugcuuuuucugaguuacuucaucaggcagggcuuucauuggggcacgguggugggguggcaagauguacuuacuugaagaucuaggggcuugggauuggcuuaaauacuguauguaugccuaugagccaugcaauaagaucagaucugcauccugauguuggggggucccuggagucugagucccaggauucaucacaugacucugucaucucucaccacccccaucccugauccuucucccacauugcuacuguuauaaaucauaauguaaauauauguguuuucugauggucuuuggugaccccucuaaaagggugguuugacccccaaagagguuguaauucauggguugagagccauugcucuaaacccuaaaauguuaggaucgaaagaggcuaugaaaaucaauaacuacaguauggaauauugucacacugaauuaacccaagaaaucaugccaaagauaauauuuuaaaggacagaguuuguacacgugcauuucaaauccucucaagcacaauacagaggaagacaggugaaaccaugaauuaucaaaccacucucuguauaaaaauaaacucuugaacuucuguguuuugcuuaauggaaaaucuuaucaaacugcuuucuguauaaaaguaaagucuugaacuucuauguuuugcuuaauagaaaaucuuuucuuuugugacucaguuauggccuuggagacaugccauaaccucucuugguuauguugugaccuuagacaaacaccauaaccugcugcagauggaauaacaacuccaggugaaaacuuugacgaagugaaaaaacaaagcagaaacgaaaggcccgcauggguuuaaaaugcugcuuuagauuccuuagcauaggauggugaagcgggaguagguggguaggggaacacccucauagaagcgggguagggggcugauggggguaggggaauugugggggagaaacugagaaggggaauaacauuugaaaugcaaauaaauaaaauagccaauaaaaauuaaaugugaucugaaaaauauauuagucacauacuuuccuuuuggagccuuaaaccuacucagacgaguacagcucuuuccuaugaacaagcagcccuuccauucacuuuaccuagguguggugggauacuggaagguguaagagauggaaagcacaagaaucuaucagcagguuuugcugggaagcagaauccugauccagcaagucaguagcaaggacccucugaaggaaauugccguggagcgcaacucacagccgauaguccuagaaauauccuugcagguaaacugcaugguucaagucugugcuauucucccugugagcugagccauaauuaaaaucccuuuaccacuaaauuguacaaggaggccucgugaauaaaauauauucaacgaauauuuccugaugaccauccagugucuccuuaucucagcauaguaaaaguggaguaaagguuuugaggaagugacacggcucauuuaauacagcuuguccaggaagucuguccuccugaaauccuaguccagcucuggaaugaaagacagacccaagacccgcuguuauucuuguguccacauauguguuagaaacguguauauguucaucuacacuugcaugcaugcacuuauggaggcuagaggcaugcuggguuuccacuccauuacauuccaacuuuucuuccggagauaaucacugauucagcaagaccagcaggccacuaagcgccuaagauuacaggcauaucccgucacgcccgccuuuuccugaagguauggugaguguuggucuaugcuaugugauaggcauuuugccaauuacccccuuuccaguuccacacugaagguucugaugaagguuuagcugccuacuugccuaagccgcacuuggcuaccgcuauacauuucuuuguuucgcauuauagaugaacagaaauucugggagguuaagagaacgaauuuuguuguguuuucauuugcaagguuaauuguaccagaagaaucucaucgaagaaaaacacuguccacuguucugcuuccugggauccaagaagaccgacccccccccccaauuagucaaagcaagaaacugaaaucaaagaauauucaagauaaagagaauuaaauagcauagcguugcucaugcucgacaauugucacaguggcgcagaagcguucagccaucaugaaucucuuccgcuuuucaaaacaacgccaaagcuaggcuccagaaacauuuuagacaaaggaaacuuuaaaggauaaaaauauagcucucccccgguaccugguauccauuaaauauuggugucaguuuaaaaacacuuucucauguuacagugauuauuugauaacuacagugauuauuagaauuuuccaaagauggcuccaguagaguuuuccauaccauaccuccugaagucuuacauuucccaucacagaguguagaccauuucccaucucauuaaaucuagacaggccugugacuucucugaacauaagauuaaaaacucucccuuuagcuaggccagagaaggcagcacucuugccucuuguacaauaggacuuuuggucccuuccugccucccagauggcaaacacagaagacucuuaagcucaagauaaaaaaacuauggcgagacuacaaaauccauuggaucuccagggagaccucacagucuaugagaaacuauaaaaggcuuucugaagaccucagaacaugcugucucucuguuaaauguuacagggcuuccagguaucuaagggcccauaaugucgaccgucagcauuauagggaacucagaguauagaaaggauucucuuaaggauagcuuuuguucaugagaagaaaaucuaguaagagucauagaaagcccacuaaguucuguaauaucuacuuggagaaacacugucaguuugaagcuaaaaggaucaaaggcaaugcuacaggcagagaggccccugggcaaugagacugcuccagguaggaagcaaauugagaaguuacucaguguuauacaugaaucacucauuaacacaaaggaaagguuuuucaaaggggaaaggacucccagagggcagagcuaagaaccacggagaacaaagcucagggugagaauugggcccaaaacacacaacuggaaacaagauggaccaaagccugccaggagccgacuauacuuuuauuugcuuuucccccacuggaaaggccucuugugguuaaccuauguuuaucuauuauguggugaguaugugagaggcagguccuaugucucauugauuuauaagaauuuagaccaagaggguugguccucagaugcuucguguaaaguaacuuaccuaaggagaauagcugagucuacuauagacaaugagugccaggccccagacuaaugcugaaaggaacgaaauuggugugugugagugcgugugugugugugugggggggggggguguguguaagauaagcauaguuuggcugaaagacagagaagaugggcugucuacacuaugauacuaugcuugugaagauggccacaacucuacccucuauucugccuguucauauacaauacuaguacuuuuccaagugccucaaaucugaagauuggcauuggagcccugaagcacuagguaaguaguuuggcuucucucuuuccaaaaugccuugaggaaacucgaugucauccuggagaggacaagacguauagaaguguccaggcccuagcuucucaagcugcguagugcuucgucgccacccaguuguauucaauaggaaacacagacaagagugaucagcuaagccuguucugauauauguaaucuauaagauaauacaauguuuccuuauuguaauuguuuuaaguuugagacgguugcuauggaaacaacucuucugaauucaaagggcaguuguuuuuccuuccuuccuuccuuccuuccuuccuuccuuccuuccuuccuuccuuccuuccuuccaaguaggagaacacacagaauuuugggucaugauuacuuugguuucagccuguaaauaggaucaaagaacaacccacuggcuaccacagaaaacuccaaauuuggaucaaaauagguuuaagucuuuuuuaaaaaaaaaaucauucaguacuacagaguauagaaaguuauuuuauccuucugacucccaucuguugauuuggaauaauuagcacacagauuaaaaugaaugaauuaauguaugagagagauaccuauggugguaugguagugucugucaccaaaaucccggaaucuguugcagauuucuucuggugaugaucuuggggaucaggcucucaacguuaagaaccagagucauaaggauggggcuggcaguggaugagguguguagaagauagaauacuuccauucuuucuuuaaggaauaagaugcuuucuauauucucaguaacaagugggagacacuguucugucuuucuuagucuugaguucuuucuaggagagggcugggacuuuuaucucuggcucuaaagagugacucagccauaaagagaaguccaugaauacugaauggagagaggggagggggugcucuaacacaggggcuuccuccuaaauauagacagacauggccaacauuuaugagaaucagaaaaugcagacauuucuucucgcugaccuauuuauacuuugagacguuccaaguacauaugggguugugugugaaucaagggucacuauaauaaacaaaagugguauuugcuuucuaaagcacauugcauuaugaucucacucgaucacugagaggcaagaacaugucauaacgugcucaaggacacagaccccgagacagauuguauggcauccaagcccagcuuuagucagguaagcauggacgagucaagucaagugcuccgcuguuaaguuguauaucagagaugacagcguggaccuagggcuagugcaaggauuaaguuaguuaacccauagaaaacguuuucuuacuagggaugacuuacggauaggaauccuaacugccaacagcaucuuuuauugcuaaaggggaacacauuguuucaaauacuguaaaauuucugaaaauuaaaaacaaaaaaauagacaaaucuuuugaaaugaagaaaauugcuacauuaugcuauagaggugguuacauaaguaccuugaggccuccacacaacacaguacagcuagaaucuuuugcaguuugucaaaacgaacuaaagauagaagaauaauaaauacuaagcuguuaaugccagugucuacucacgauaauuuaaugacacuaaaucuaggcagccccacugggcucugccaagauacuguucuaacuauaucuaauuugguugacuuuuucuguuuaauuagugaauaguauaauuauguguccgaaaguuuguagaauuuaauaucaucaaguagcauuaaugcgaaguagaacaaaauaacaaaucuucgugguuuuucuuuucuuuugacuuguuuucuuacaaagaauacaauuaacuccccagagcaacuccgauuugcuuacauaacgaauaccguggggauggaaggcacugucacacgacuccucaucaacaccuagaagaccuugucugauucaguugaaccaaggucauuuuuaauaauugcaaguacgagcgagggucuacuggagaucugcuggagaaaauguaucaauguagcuaaagcagaugcaauucugcacaccccguccuuuuuaauuccuugauugccaaacuaaucaauaugacccuucaccugccagcucuaugugcaaaggaguccacaugccugcaaaagcaaauggccacgugaacucaguaugcugcucuccucgguuccuucaggcugacauacagaaacauuuugcugagauauagggagauacgcugaauuuuccuuccuuuuuuuuuuuggaaucaguaugccacucuuugcucaauuguauccaauuuguaggauauaaaauauucucuacucuagaccuauuugggaaaggauaggauauccuauaguuucaacagagacaacaaguuaaccaccuguaaaaagcagucauucugacacacguguaggagaauuuaacugcauguucuaagauucguggagagcauggggcuuugcugcaguauagaaggugugugaguuaacuucagaugugacacugacacuucacguguuucuuaguaugucgauuagaaaaauauuauugaaguacacuuuaaaauuucaugccgaaacauugcuaauaagcucauucaugauuuuuuuuucaaauuggcuaauucuucauuuucuucuuuucuuccaacuuuccuuccucccuucauucucucccucccuccuuuucucuuucucugcaaucaguauucacuacauaaugauuuguuuauggacaacuggacaacauacuacuagguuuuagagaucccaucaguaagucauggucucugcaccauuaaguuuauguacauguaauauaaucaguauuuaaaagucauuuaagauaugcccaugccccaaguauaaaaacuaauauuacaagaagaaaggacagagagaccaaaagaggccagaggcagauacuggaguuacacacuguccucacagaguaguaucuggaagaguauguguguguguguguguguguguguguguguguguguguauguguauguaaauguguguaugugugugcaugcacauguauauguauguguauguauauguguauguguguauguauauguauguacauguguguauauauauguguauuugcauauguauguguauacucauguguauaaaugcauguauauguguauguuuguaugugugcauguauguauguauauguaugugugugcauguacauguguguguauauauauguguguauuuacauauguauguguaugcucauauauauaaaugcauguauauguguauguguguguacauguguauguauguauauguguauauguaugugugugcauguacauguaugugaauauauguguguguguguguguacauaaaaguaaacauugcucccuaagaacugcagagcgagcauggggcaggccucugacaugcagggccaugagaugcuaaaucucuguuuuaagccaccauguccacaguaccuucuuguggcugccauaggaaaacaacucagacagguuggcucugaagcacagcugaaucacccacauagagcagucugggacacagaugaguuuaauaguuugaacuccagcuuaagccaaugauaaaaccuugcaaaaaacaagaguguggucaagcaaugaagccauaucuguggcugagacccuugaggggcagugcacaaauaagacaucuagaacccuggagaauagccagggggagagguacacacagaggacaacaaugauagagggagauggguggagugugguaccccagagccacuugugagagugccccaagggguaagcagaacagacuucucucaccauaucuaggaagagacaggucugcugagagcuauggaagagucuagccagggcaggcaacucuuucuaagagguugccugugaaggugaggaaacccacugugcuagaggccaggggaugcuggaagggcuuuccccaugacuugggcaucuuuguuugaaugugcuuuccucuaacgaggcaccuugaugcuuacacagugaugagccaaugaaugaaacagcaccuuauccuaauuacagcugguuggccguaaagcugcuagcugaaucacagcccagcacuacagaccuuuauagaugcacauccagacaucuguuuagaaccuguuguugguggaggcuuucugcauaauuuauaaagaggggaauuggaggccggauaauguuuugaaauguaaaacaucugacucauagcagagaggaugaacagggggauggcccaggagagacacuuaucucauuguucacauacugggcagagagaacucaagcccgauaagacaucaggcuucucaaagcaaaacuccuuuaaugagggugagucacagugcuacccagggaaaugaaucaggugcccacaugccuaggcggcuucguaauuacagguuuucccucccuuuuaaauuaaaaccagaggcagguaacgacugauguccccauagaaugaacgcagccagauggaaauauacagaggcccaaaaaguaaacugaaaauaucaaaggaaaguagcuuuuccagugaggaaaaggaggggggagggagagggagagagagagagaggaaaacaacaugacugugagccugaagacguugcaaugcuuguauuguguccucuauuuuggcugauucucucaucuuaaccccacggaguuaccacaauagcuuuuuuccaacauuauacuuucagaaauaagaccagaguucccuacaguuuccuguucaagcuaggagagugaggacugccuuuguuccuucuguccucauuuuccucucuagcuucugcaucuggugaugaucagaaguccuaugaguccuauaucuugaacaucuuccuccccagaauguguucagagcagccagugacucaccucugccagacagucuuacuuccugucccgggcccucuaagcaaagcagaagugagguugaagggagugaggggcagugcaaaucauagguucuuaaaaccuggggcaguuccccaucugggucaaaucaggccuaacagcaucuuagugagaaaucugacaauccaucugggucaagcagggagcuaaacugauauuuuagauuaauuuguucuguggucagugucucuaugcagugcagaaagcauagcuccuuuugcccucaaugucugugagcucuguguuuguguguguguguguguguguguguguguguguguguguguguaguauaugaguacacgugguuagaagcuggcagagaauauucacugucuuuuuccuuuuuagccaucuugccuugaggcaggaucucuuaucaaaccuggagcugcucaagaauuggugggaaguuuugggagggauguggaggaagacuagucugaugaccagcaaacaucaguaaaccuccaacuucuauguagguucuggaaauccgaacucaggcccucacaucugugcagaagugacuuacacuuugaucaacgagagcucuccuuaccuacugagccaucuucccauccuacaucuaagcucuuuaaaagaguuuagucucugcuaaccucugugcaguaaccucgugaugauccuuucacucaagggucaccaaccuugagguccuggaacacacaguccacuuacccagaggacaugccauucauuucuguuauguccaaucuccccacacuuuagaacaaucuucucuccucucuauccacauauucuuguuuauucuucgggucuaacucaaaauaucccuuuccaucacaggacuucucagagccucuugauuaaaacacaucuugccacacguuuccccagagaccuaaauuuguccucauauagcacuuacauagcacauaaaauuuauugcaauugcuacuaugaagucugucuucucucaugauaucaaagcaaucaguaugcaaagaaauaaacagagaguagaccuucuugagucagagcaacucaaccuaagucuuuauuuuacgacuuuucuagucauaaaguggauaacuuucuagagaaaaaaaaauguugaugucagcaccucaccuagagcccugcacaugauaauuacccauugugcauuugucuuucuccaucuuugggguucaugacagccuuguauguagcacagagaguaucuuaaucaggguuaguauuccuacacaaacaucaugaccaagaagcaaucaaucaucugcaaauaaagauaauuuuacuuccuccuuucuaauuaaaaaaagaagaagaagaagcaaguugggaaggaaaggguuuacucagcuuacacuuccacauuucuguucaucaccaaaggaagucaggaaggaacucacacagggcagggaccuggaugcagaaaugaaugcagaagccauggagggauguuacugguuugcuuccccuggcuuacucagcuugcuuucucauagaacccaggacuaacaacacagggauggcgccacccgcaaugggcccuucccccauucaucacuaauugagaaaaugccuuccagcuggaucucauggagccauuuccucaagggaguuuccuugcucugugacaacuccagcuugugucaaguuggcacacaaaaaucaaccaguacagauaguauuauccacauuuuuagaaggcaaggggacccaaacauugguuagacuacuugcuuugggucacaccacuauuggcagaaacaagacaagaacaucuccugcugcauugcucucuaagauccugacuuuucucuucaauuauuuaucccaucauagcggguuucuugagcauuuacuaagugucaccauauucaaggaacaaagucucugucuucucuaagcugaccacuuaugagagaaggucgacuucauaguagcaauugcaauaaauccuucugagugcuaugcaagggcacauuuaggucucuagggggaauguguggcaagauauguucuaaucaagggauucugggaaauccagugauggaaagggauauuuugaguaagauccaaagagugaacaagagaauaugaacagagaggagagaugguuguucuaaagagugaggaguuuggacauaacagaaaugaaugguauguccucggaguauaugggguaugucccaggaccucaaagccauauuucuuucagaaguuacuugucucauuccagguguggaggcucacauauuuaaucccagcacucaagagcuagaggucucuaugaguugaagaucaauuggguuuauauagcaaguucccagccaggauuacaaaguaaaccucuguccagaaaauauaaaaaagucaaacaacaacaacaacaacaaagcauuacucuuucagaugaccuguguucaggaucuggugaccuacucugggccucagaaaugcaugugaugagcacacauacaugcaggcaaacacacauacacgugacauaaaaauaaacuuaaaauugaaguaagcccauccucaagucccuugguccgaugucuugucugagcaaugagaaaagcaacggcuacacauucauaaccaaccaauaauuaaggcuccaaccacaguaauucaugcuucagguugcuaaaauagaacaucaguucuuauuuaauaacagagagccaauuuuagguaaauagauuaaaugaauuuuaaaguuuacagaauaauugcugcugcaaagguaauauaucaagcguguggggaauaaaagaacaauucagguucccuuuguguuugauauccuuguauuaaucuuuccuauuagcaauuucugggagcaaauguguuauuaguaaauagcaaacuacuuauagaacuugacacauuuauuauaauguugcccuuucuagaaaaguauagcuaauagcagaaauaaagcacagcugcaaauugauggucuacaccacaucacuggacuaggaacuguccuaucugaugcuaagauaacuaaaauagaguagaaauucccuucaaauuuaaacaaguacuauuuacuuaguacuaagauuagaagaaacacaaagcuacauagaaguuacgcgauauaugaucuaaauauuugcucuaagacaacagccucucaaaaugcuaaucaccagggauggagauauucguuuggcuaauaaugcucccuuugugugcgccuaugugcuucccagaagagaaucugcaaucuauuguuagcucuguauagucaacuccugauuauguggacuuauaaaagagaccauagauauaucugcuaauagaggaaaugaagaccaacaauaguccugauugauauccaagaagaguguauaaugcagaaacuacauccuuggcucuggaauaggugugauucuuugaagccuaggugcuuuccucguaacccauuagcugaucuaaaucaggaccauggacagcuugaccauacaucucugucacaguucacuccaaccuuugaaagcugcugcucagcagauggaauucuccucaagguuucauggcccaacacaauauauuuuaaacuuuauauucuaaugcaaaaaaaugagagaaacaauaaggaagucaauacuaggaaagaaaauauagccauccuauccaguguguugauccugugauaaaacagggauggcuuucuauaaaguuauuuuuaaaaucaagccuuaagccaaaaguccacuaaauaggaauaaaaaaaaagaauaagaaaauuaguucaaacuaucagacacauuacuuucuagaaugauuuuaauggucuugggaacacugagucaacuacuuuauaacugucuguaaaaacagaauaucuucccauuguaaaagaaaucucaucugaaaaaucagauuacauaacaagaauuuacauuaaaaugacaucucucugaggcaagacuccagggcuuaagggaaucaccguuuuuuuaaggaaaaagcagauccuggcuuguuguagagauggaauucaugagcccuucaccuucaagaccuaagcagcaucaccuuguugggcagguuacaacauaagaauuuggagaaacgaaagcauuaaguccagugcagcagucaccaucaugcagucacccagugccaccaaauuuuacaucuaaacuaaguucauaguagauaggagaauucugauagauagauagauagauagauagauagauagauagauagguagguagguagguagauaaaaaaaucaaaugaucauucacuuauucaaguauuuaacuucuguuguaaguuagucaccauucuaggcauuagggauacuuuuuguuuugagacucaaucccucuacuuaaggggcucaugaaacucaaauaaauguggccauauauaauuugcaagaaguacacacaaggcaccaaaccugguggagcuaggaaaggcuacaccuaggagauguggucauggggucauggagguagagggcucaugaauggugccugcgcccuaacaagagcuuggaaagaauccauuugucuccccacguagacacauagagaacguucugucuaugaacccaaaagcuaaccaccaggucuccucgauguacauuucccagcauccagaagagaaauacucuuccauuguuucaguuauccaguuuacaacugggugugguugcacaucuuuaaucucaguacuugggaggcagaggcagacagagcucagugaguuugagggcagccuggucuauauaguaaguuccaggauaaccagagcaauauagagacccuguuucaacgacaacaacaacgacaacaacagcaaauuaaccaguuuaaaaucuuuuaauauagcagcuuuaauaaaccuuuaauuaaauuaccugacagaauuggacucuaucaggcagacuggaugggaaaacauuucaaguugauagaauugaggagccauuugcacuaagaauaauacgcucaggagugcaugguauauuuggauaaaaauaagaaacaugauaugaguaaguuguauugaauagucauuuuuggucuugcucacauaaagauucuuuucuucaagaauggacagauaacaauuuuauuaacuuuaauggacauaauagcuaaucggcuuauaacauauuauauuaaaaguaacugugaaacgaucucacauuauuaaaguaaguaguagaaguccauaucaaauucauaaugaaccacuugacaagagcucuguguuacacacuuuauaaaauuucccuagagauacauaguuccuggggcaucauauggauauucauguguauuggcuuuuuauauugcuucaguuuauaagcuccuauaagcuuauaaaguuuauaacuauugcuguaaguuuauaacugucauaaucaacaguuuucagggggcuuucaaagugauuucuuuuaaaguuugauuggguuugcuugagacagaaucuaguacaguaauacaggguagccuggaaaucacaucacaaugucgucaaggcuggcuucaacucaaagcaacccuccugccuuagccuccugaauacagagauuaaaagcaggagccacccuaguuuaaaaugacuguuauaacugaaaagcuucuucuauuacgacacacauuuuuaacuauccacaagguaugcaugcacacauuuuaaaaaagaguuuucuuuuucacagugcaaaggaucaaacccagugcugcguacacagcgaugaagcacacggacuucuccagcaguagaccaggacgauccaguaugugcaugagaaaacgaaagcucugcuggcuuuaaugaagagcugggucucagagacaggaagucuagagaggaggcaucaauaaugcagggguuuucggucuggauggucccuaauccagucucccauccuuuaucuuauaucucaagauuucauuauuaaagcauuagccucacaauuuauuacuuauucauacaaaaauauuuuuucagggaaaauaggaaugauagaaaaugcauaagugauacccaggugggguuggagaugcgagguagaauccuucucucucaaucauguaaaaccacagagaacaagggauuggcauggaucugaacugugccuuggggccaggcaaaaugagaggcuccuuacccaaaugaauagaacauggggcacuguaauaauccucuaccuuuguauuccuugcagugaguuuagaggcucauaacacuguagauuuauccagaugguuuacaugagccacaagucuuaacuggguucugacuaaggucuaacuaggcugauauccaggcaauggucaaaucugcagugccaacuuaaguguucaggguccucucucaagauccugugaugcuggcagaauucguuuccucacaacuuuagaguuguguggcuugcuucuccaaugccagcagcacugggaaacagacugucguuucuagucacuagcuucuagaucuuguauuaagagaucacaugacagguacggguuuacucagccaacucugcuagggguugagucugucuguaaugcucaucuccugggauuugguuugguuuuaauacaugccuuccagcagauggcgcuguuucaugcuccuguacaaccuuaggacauagguaggguugguugcgaaguggguggcaagucuuaggagcuauggcccaacuccauuucaccuuucccuucucccucucccacuccuucauccuuucccucccccucccccucccccucuuucccuuuccuuccuuuuucucucugugugccucucugucucuaugugccucucucugucccucucucuccaucuuucacuuccugucucucugucucucucugucucugucucugucucugucugucugucugucugucugucugucugucugucugucugucugucucugguccuugauaugaaaagcauuguucaagcagccuuaugcccaugucucacaagaagcuuugaccucaucuuccccaacacaaaggacuguacucucucagacugaguaaaaaaugaaucaccucuuccuuaaauuacuuauaucagguauuuuucacaggaaugagaaaaaaauaguaugaucuuuucuuugauuaaguuaaagucaaugauggagaauucgauugcaucuaccacccacucccauacacacuuuguuauaaaacacacaacagaguuacggccuaucaucaccuuugucauuggcagcaguacaucacagcuuucauguacucaagaggcuaggguucagaacgcaggcaucaggugccgguuucagaacucugccugccacaggugccaagcaacaaguagaggagcgaucgcuuccaaagucgagcuagggaagcagagaggagcugcucucucugguacaucgaaagcugccuggagcuucucuggaacaaguucugccuuaggucuuccgaugacgucacacaaaagcaaagcccuugaaaagcaagcaccagggucaguacaaaacccaccuuccuucugucacagccagggauacagaacagagcaggaaacacucucccaaauggaaacaguagcaccagaggugcacagagagcaacgcccaguuguauggacauccuuuucaaccagggguacggagggguuucuccccagccggcaguauagacugcaaauccaaggagacucccccaaccccaacuccauuuucuguuugucugucugucuuuuuuuuuuuuuuuuaguuuuucaagacaggguuucucuguguagcccuggcuguccuagaacucacuuuguagaccaggcuggccucaaacucagaaauccgccugccucugccucccgagugcugggauuaaaggugugcgccaccacgcccagcccaacucuguuuucuuauacauuaaaauccuauuuccccucaguuucauauuuagccauaauaaucacacguaugucucacaaauauaacugauuggagaggggcaguucaagcgauucaaaaaaaaaaaaaaaaaaaaaacaaucucagcagagaaaaucaaaucaaauagaaaaacuauucaucacacugaaguagacaggguaauuagagagaagauacacgcuguggugaauuggauucucaaagaaaauuccagacaaugaagcaguuagauuuucaccugcauuagcuccggguaaaaagcaagaaaaaaucgaguuaauaaaaugcuguuugaaacaaaggaagaucucucacgacauaacaucugugggauugugccccucgaucacugccaccuugugucuccuggaauuuuaaccacuggcuguccccccuggugacacacauccaguguacggugccacccauccuagggcacauugaacuaggacauggaacaagcaagaagaaaucccaaucaugugcacaagucaguccacuugcuugcucggagcgacauuagagauaucagauucagguggccagccagacucacuucacccggaugcuccauacaugugcugaagacuuaagaauccggguugugcuugcugccuuaacuuggugauacccucccuccccaaaaguauauauucauuaagcauuaguaacaucaacucauuuaagcaucuaugcuuucccacguguauuuuuuuuuuuauuuuguaguacuaguucgauggaaaaaagaauuucaaagaagaaacuaauauauauauauccaccugcaaguucuguuccaccuacauccuuuccauucccagggcaggugaagagauguccuuggguaggagaagguggcugaucacgucaacagccuugaaaggcagaugcuaccuuaaggcagcagauuucggucugaagaacacgagcagccuguuucagguggggaaggaacugaccaaguuucuggugaaauuucagaaagaaaggugggcaugaggcagggaagacagagaaacggcacugcaugggucuccugggauuuuccugcugggcuuuuugucuuaaaaacaacaacaaucaaguaucugagaggccacauugaaagaaagaccugguuuccuagucucuuauagauuccgggcgucgccgcauccuguugaaguugauaguucuacauggaaaggaauaggauaaccuuggagauauauuuccugagccccccuucuuuuuuuauuucccugagguauugaugaaacucagaaguucuuaugacuuccugaagggggccucggaaggccacugggcugaaagcugggugggguggcauucagccagcuuggcaaaaggagaggugacugacugcagcaaagcacaggcacauauggcagagauucagaaagcuccccugaccccuaagagcugagccagccaacaaugggucugagacucagccagaaggguguuggcagggaauacuggcauguguuugucuacuguaggacacagguauagcuggugaguaagccguugacgcugccuucaggccucacacacuagccauucauuaggaauugaaacaaauauccgaguugaacugucuccacucuccauagcuguaucuuugcucucuccaagucuccaaggagaaucuugcuccuuguauccagagaaaacaggagcugccagacagauaaauggguucucucucuacuuauaacacuggccaaugucuccuuguucuuaagaugagccaagaagagacugaaaggcagcuuacaaugccagcaccuucagucccucuguggugcuacuugcaccaugucacuccucucucugaccuguuuugucaauguaacuucaacaacagggacgucaucauuauuauuauuauuacuacuaauuuuuuuacuuauuuauucacuuuacaucccacucacuagccccccuuccgcuuacccccuccuacaauccuuccuccauccuccucuccccuucuccucugaguggguuccccccaccccaaaagaauccucccucccuggcccuucaaaagccucuguguagccaggcacuuccucucccacugagacacugagacaaggcagcccaguuagaaaaacauauaccacagacagacaacagcuucugcgauugccccaaguacaguuguucaggacccgugugaagaccaagcugcaccucaguuacauauguguggggaggccuagguccagcccauguauguccuuugguuggugguucagauucugagaaccccaaggguccagguuaguugacucuguuggucuucucguggaguucccauucccuucaggaccugcaauccauccuccuauucuucccuaagaguccccaggcuccaugcacuguuuggcugugggugucuguauuugucugagucagcuacuggguggagccucucagaggauaacaugcucaaccacagggacuuuuaaagcugcucugugccuucacugaagaaucguuguucuccucccuuuaacauagucauuuucucacagccugucucccaaacagggcuccaucuccucucugaaaugaauuacuuacuuacucucuuagaaacuuucaccucacccuagcuagccuuucgcagaaugggacacacgaguaaauuuacuuccuguuguucagauaaaccauuagucuuuacauuuuuauuuuuaauuuaauuuauuuuaaauuagauguaggacuguguaaugguuuaguuaagagcagugcccuuagaagccaaaggagggcaucagauccucuggagguggagucacagggguugugacauaggugcugggaauggaaccuggguccuccgcaagaauaguguucuuucuuaauugcucuccagccacuaaaccacuacucuucuaucaacugauuucacuugaaauuacaagccuagaaccauauacccguacacaccacgcacuguauuuucauaguuugauacuauuaaaacacgacuucuccuucuuuuuuuuuuuuuuuuuuuuuuuuugucaagcaucuaguagcaaacaucuugccuccuaugugauucauaauuugucauaaagccacuacggaaaagucaugugaccccagaggacaaacaaacagaaagaccaagugagccauuucaugauuuguugagaacaguuuuauugccguuuugacaaugcaguauuuuucuuuuaaguaccuaaaauucugaucgacuugaacuccuguuuuucgcuaaugcugugcaaaauggacaugcugucaaaccaccauacaaauauuuauguuuccucccauagaugagugauguucucagccuuggucagagaggcuccuuguggcggugggugguaguaaaggcagccucauaaaaggucacagugauuagagugagagaccgaugggcacacaucccuaaggaggauguuuguaucgcccacuccaaggcuuguggacuaucucaggagagaagguagaaagaauggaagagccagaggaugaaaacauggguaguguaauaagaccuugucuuuuggaguugacauagcucuugcacugaacucacagcuauagaagauacaaguaguagucacaagacuggacccaucaauaguccaccacagauggcaguugugaggaaugcucauggggucucaucuaucccuaaguggcugggggaggaagagucacauguuucaguuauauagccacugcuaaguuguccugacucaaguaaauacuaccacucacacccuaggaagcgacccuaaugaaacauaggaggcuggggggugggggggggggaagaguuuggcaagaaugaaaaagagauaagagcuaaaagcagaagauaaugggauaauuaugaucacaguacuuuauauauguauagauuuauuaaagcauuaaaaauauacuggauuuuuuuggaugucccaaacacauaaauuauacaucacucucauaaauucuuaacuuccacacugaaucuuagauuggaacuuaaagaucuucucuguugucuuugauuucauugucaucuuggggccaaagugucccuccacaagcugcguccagaagcagcuguaauaacuaggucuugacuucgggggcucuauuucacauucccaugaacuaauuagaaggaaggccuuugccugccucucugauagucccuaaccagugggagagcucuugccacccucuccaaccugauuuuauuucuccaguguguccucucugcagaaagccauccuaugcugcugagcaccuaaugacuuugguuuuguuuuuccuuccauuuggaaagaggcacuuuucuaccuuacuuaaaaaaaaaaaaauccccucucuccagucagcuuucuccagcaggagguagaugguuugaaacuacaacagaacuggaagcaauuaguuacccaggacgucugacuugccuggcaggugcuccugugaaggugcuaauucaugaagugcuuuauauagaaagagcuuucuggauucaguuuucuagaagaaaggagauucugucacgauuuguucuucuugucucccugccuccccagaaucuacaacacaccuaucuggugccuucuuacugagaaacucaaacuuuggaaccaccaucauacacuaggcugcuguuucuugaucuuuugaucuuuuuuaccuuucgcuuuuuaaugagcauacaauuauuacaugguuucucacacugccucaacucacugacaaaccacugucuuaacaaucuauucaacuuagcuucuuuguuacucaaguuuagauugaaaugacuaaacugaguuuuccccaucccaacuacggucaacuccaaacuuucagugguuuaaaaagaucugaaguccuugaaucuuaucuuuuguucuuuucaucuuaucaaaucuugcauucaaacaccaaaaauauguuaucuccaccuucaaaauagauccaaaauuccaccacuuaaaucccacacuuaccaauauuaaaaagaaaucccugauaaugggggggggcugugaaggggagaagcauacauacugacagccacuaaggcuaccucaaggacuaaaauagcuaaggagaugggcucucugcucaaggaagugcucauaugaugcaugacgggcaagagcagagggcacuccuggggaauaaacaugcaaugaugucccaucucaauaguacuccagagauuagggaacagaauuguugacccucaaggaagagugggauagguuuauaacuuacugaacaaaugaagauuauuccaaguguuuugaauggagaccaaaguauauauagguacgguccuucacgccaagugucuccuccaggaaaucauacugauagacaauauuuggaggugcacagccccagugcuuauuuccauggucuuaagauagagucauuccuggguucauguccagucccacugcagaccccucgcuucauucuaucccucuucuuuaaccucgacuguaggagucucugucccucauggaagcuucagcucaauauccccguugaguuuugacuguuacuugucuuuugguuguuccuuuccuucuccaugcaaauucugcagucagaaugacacucuuucacccuuauuuccuugcuuuuccaucacuucagcauagccauacagccaguccacaaucuguguagaauucuucucuuugaguuuucugaauuuguuguggucuccagcugacccaggcuggagaaagcgcagaacuguguuuuguuugugauuugugaucauaagcaucuauugggccuuuccuuuggucggggguugggggaggggucacuccaugccucuuuucucuaagcaccuauuugagcucuuuucaaaugcuacacuuucacugccucucuucccagcuggagauaccaccuucugcuauauagagaaaauacaaacuaucagauuuucuguacauugccucuugcuagcauuuuacccauaccccaaauaucuugcauguuggaaacaugcuccuaucuggaaucagccuuuccacuuauuugacaagucuuucccugucucuccuccuucagcagaacuuaaauuuuccuuuggaaaaaauucccuguaaagacuaauaauggucuauacuugcuuucuuuaaguucuuaccucauguuuuuccuuguauacauuauguggauguuuugucuauuaguucugaucaaguuggucuuauugaggucaucagugacaucuauacuguuaaauccacaaguagcuauuccucauccuaguccauguaaggguuaugucuaauagagccaauucaccaaguuucuuccuccuccucuucugcuuauccuccuccuccccgccucuuccuuccuccuccucugccuccucuuccuccuucaccaccaucuucuacuucuuacaugcugugaauguguguaugugugugugugugugugguguguguauguguguauguguguguauguguguguguauguguguguguguguaugugcguauguguguguguguguaugugugugugcauguguguguguguauguguguguauguguauguauguguauguaugugugugugugugguguguguaugugugugugugugugugugugugugugugugugguguguguauguguguauguguggguguguguaugugugugugugugugguguguguauguguguauguguguguguguguaugugugugugugugugugguguguguauguguguauguguguguauguguguguguauguguguguguguguaugugcguauguguguguguguguaugugugugugcauguguguguguguauguguguguauguguauguauguguauguaugugugugugugugguguguguaugugugugugugugugugugugugugugugugugguguguguauguguguauguguguguguguguaugugugugugugugugguguguguauguguguauguguguguguguguauguguguguguguguguguauguauauaguaugaauacauggagagcagaggugacaccguaugucuucuacuagcacuuuccaccuuauuauuuuuagucuuucacugaaaccauagcaaacgaugagccagguuggccaaguaccagggaucugccuguuucugcuucccaccccaguacuggcaugaccgauguccaugaccauccucagcuuuucagugugcgcucgggaucugcacuugaauccucaugcucaugaggaaggaguuuacuaucaagucaucuccguggccucacacucuuuccuuugugaaauuuucuuucccuuaacuccagacuccagugccugccuggucaaggaugguggcuccuucuuugcacccuuugucagugcuuccuuuuaucccacccuccacauugcucaguuuuagucuuucuuccuuacauacacucaacaucauauauaucagugguucucauccugugagucacaaaccccuuugggguugaaugacucuuucaaagggcucacauaucagauauccugaauaucagcuaaauaccugauucauaacaguuaugauucauaacagcugaaaaauuacaguuauaaaauagcaacaaaauaaauguaugguuagggaucaccaacacaugagaagcuauaugaaagggucacagcauuaagaagguucagaaccacuaaucuauauaaugauggucacauuuauaucugucccuuggaccuuuagcagccugcucagccuaucuuuuaaaaauauuugauagacaccuagagguaaaauuaacaccagauauucaacuuguuuccuaaauccaccccuuccaccaguuucuuacacaucagaagagagcaaguucauucuuauugauguuucugacaucuuacaggcauccauaaaauuuuuucccacagugcccacauuuacuucucuacaaaauuuuguugaauuuacguuaacgauauguccaaaguaccucuguuucccucucccuucucuacuuugaucucaguuuaugucuucauucacccuacuugaagcuguacacuggccuucuaacuggacaucauaguccagacucagcacaguagucagaggcauccuccugggacagaaauuagauggcgugacucuucauuccaaggaaaagacagucuucaaaagaaauggccaauugggcuuuaagggaacuaagcauacauucuuaccugaagauauuacauuucaagaaacucauuuggcucaucugccuaagauagaaaaugcccuacaguggggagugggaacuuguagagcccaccuucaguagaaagacagggcaucaaguggagggaugggguugccaucccacagucaaaaacuaugacccagaauuauuccugucugaaagaacuggauggacaaaaauggagaagagccugaggaaaaggagguccagugacaggcccaaagugggauccagcucaaggggaggccccaaggccugacacuauuacugaggcuauagagugcucacaaaaagggaucuaucaugacugcccuccaaaagaccuaacaagcaacugaaagagucagaugcagauauuuaccaccaaccgucaacagaagcugcugaccccuguuguugaauuagggaaaagcuggaagaagcugaggaggagggcgaugcuguaggaggagcagcagucuuaagugaccuggaccccugagaucucucagacacuggaccaccaaccaggcaucaugcaccagcugauaugaggcccccaacacacauacagcagaggacugcugggucuggguugagucagggaagaugcaccuaacccucaagagacuggaggucccagggaguggggaagucugguggaauauggguugggggguacauccucuuggagacaugggguugggggaggagguauggaaugugaaacagaggguagaccuggagggggauaaaaucuggaaugugaaaaauaagauuaaauaaaauuuuuagaaagaaagaaagaaagaaagaaagaaagaaagaaagaaagaaagaaagaaagaaagaaagauagauagaucauuuuaggggaaaaaagaaagaaaaaggaaauggagacccuucacugagcuuauccugccccuuugcaugucaggcaauuaccccagugugguccuuccuucuucgcugaugacagcuucuccccacauccauccucaucucaaguccacuuccugcacacaacauuaauccuuccaguuaaaugagaugcuuuuuuacccauaagauucccucaaagcuuuucuugaugauuucuaaguugaaguuuuaaucacaguugaggaugcuuuuaaacgguugccucucaaaagaaaucuguugguucaccuaaaguuuugcaaccagcuuuaaaaguuauguuagcucuuguucuauuaaauaucauuuugucaagaugaauguauuguacaaucauuuacaaaaugaacugaucauauaaugcuaauuauucuucaaagucaagaaaaggcuccagaaaucucuucuguauuaaaacuuuguagauuucaaguaaacauauuaaaaggaaagauaaaaaccgaaaauguuaaguaauauagguuucuauaauuuacaaaguaaauucaccuaaguaaacccauauauuaacauagauacccaaggaugaaauaacccuuuucagaagaaacaaaagugaguugaugauuaauauugaggaaauccaggauggaacugacacaaaggcauucucugucaaaauaugccacguagugugucugcaaaggauggaucuuaaggccaaaguguaacacauuaacuaugucuguaagauaauguaaaccaugacuauuucaaguagauccaaaaaaaaaaacuaaucuaucuuaaaacuuuuaacauuuuacuuuuuuauuagauauuuucuuuauuuacauuucaaauauuauccccuuuccuaguuuccccuccuaaaauccccuaucccucccucccccuacuccccaacccacccacucccauucccaguccuggcauuucccuauacuuagguauagaaccuccaugggaccuagggccuuuccucccauugaugaccaacuaggccauccuuaucuacauauacagauagaggcacaggucccaccauguguuuucuuugauuggugguuuaguuccaacgagcucuggggguacuaauuaguucauauugauguuccuccuauggggcuucagaccccuucaguuccuuugauacuuucucuagcuccuucauuggggaccuugugcucuguccaauggaugauugugagcauccacuucuguauuugccaggcacuggcaaaggcucucaggagacagcuaucuuaggcuccugugagugagguaaccaaaucacaaaagaacacacaugauaugcacucacugauaagugaauauuagcccagaaacucagaauccuucuuagaaggggggaacaaaauacucauggaaggaguuacagagacaaaguuuggaguaaagacugaaggaacggucacucagagacugccccacuuggggauccaucccauaaaccaccaccaaacaacauuucacuuuuuaacucaaaucaacaugguccuugcacauuauuacagaacucccucuacugcaaagacugugauaaauugcugaggugaccauugcauuagaaagucacagcaauaccacuggaacccauuucaacagcugaagguuagguuuuggcucugcugaaggucaucagggaggcauccugaugcuaacuaacaacugcucuggacauuuuggaugauggaguaaauaugagaucuuaccuucccugcuugguggucagggcuuagacacuacacauacuacucugucuuauaaugaaaacaaacaaaaauaaauaauaaauaaaagaaggacaccaaguaaaaucucuaccuaccucaaaagauaauugaccaaagucaaauccuuaaaaacauuuuuaugccccaaaugaaacaaaacuaguaaagacuuuccuaaaaaauccuugccaaccccucgccuuugggggcuuuaagaucuagaucugagcauuuaaguaagugaugguugaauaauaauuacacaccuagaguucuuuccagggucuauaugccauuucucuauagaagacauaccagaauuucuaauccuauaaaauuguaucuguuauaugcaaaacaguauauacucauuaaaugagugugacacuugaguagacagcagaggaaaugagaauucuugcuacugcuguuaacaguuacuaguauuuauugagcacugacuuagcaccugauaggacauuaugcuaaucacggcuuuauacgcagugucacauuauaggcuaaggaaauauaauuaguuucuugcucauuuaauuuuuguauggaagaaacgcuguagcaccaaacccccaagccugucccauaauuaguaaucaauuugggcagccugucuucagggccuacaagguacuagacccaaguacuuagguguggguucuagaaagaagagagaagauaguaggcagcuaagcaaacagguuauuggcaucauuuuacauauugauaagaccacugaagaaagaaacaauuugauagaagugacucaagcaagccuguuacacaccuguaaucccagcauguagggagcugagggaggaccaugagugugaggcuagccugggcuagagagcuagccuguccuccuucacaugucaucagagugaauguguauuuuaaaaggcaugaacauauaguaauuugcacacuguaacggggaauuuuccgaggaaauaaagacuuuucaaugccuuaaaaacaaaaaagaaguuggggacauaaauguuggcaccagguuugagggcuagcauuguuuggaugggcagcuguuauuugucuucuuugugucugaauucccuucauacacucauccaaaggucaagauaaguugauauaacuaaaaagccuaaaacgcugucugacagaacacuaaguaucaccuuuuauuaucagaaugguuauauucacuuuugcuucuuucuuaccaugauucuuaucauauugagaucugaguacaaucugaagauuaugugaagccauuaugugcaaggcaaagccuaaaugauguucaaucacauacauauuaaaaugaugaagguggaaggaacuagagugccguaucccccaagccagaugccggaaaaaaaaaaaaugccuggaugccuggguggaucugcucaagguuaaauucaagguugaguugggaaccagaugacuguuggcuucauugccaugacaagggucugagugcccugacacacuuuaaacacagcaacggcaugcuuugauuuacauuuuauaaacaccagucuggcugccucaaagguuagauuaugacuucuagaauguguuuagugugaauuagacagaagagggagaaccauucagguccucguccucagugggauguccuucagccuuaccagguagcugugagcccauucuucuccaaaggacauuaacacaaugaaucugccaaggaagaaccagaaugcuuucccuagugggugguauuuacuucccuguuuccaaguuugccuggguuucagcaguugauugucuaccuuagugacagcauccaacucagccuuaccagaucucuuuaaugaggguucuuuagucucaaagcagcuguaaacaaugggcccauguguugauuagcuuauaaaauugugagagagcauuuccagaucucugucuaucuuacgcccauaauaguauuaaauuguuauauugaucuuaacauuggaaagacgaucaauguacuaaaaccauuguuauacccgugccaugauaaaaaucugaguacccuaaacuacugcucauauaaugugaaccagaaauaaaauugguauaaagauuucucuuaaucaccacagcucauaaaggcuuuauuaaagcucaaaaguauaccugcauaaagugcaugguuuuaccugcguguucagcucccucguucuugacuucugugguuuccacagaagaggugggagggcuagcagcagggcuggaaguaaagcugguacacccuguagaugugcugauuucaaaguauucuugguuaugauucauucgcuggaaauccagagaagacacaauagauguccguuguuuuggcuaaaauaaacaagcaggacaagaguauuaauacaaucccacuugccuuuaacucuaccccacugucuaagcaaauuaaggauggaaagguuaauuucauucacccaucaaacaguuuaccauccaaagcagugagggcaggcacucaaucagggcaggaauguggaggcaggagcugauagagagguuauggaggggugcugcuuacuggcuugcuuaucaucauggcuugcucugucuacuuucuuauagaacccagaacuuccaguccaggguggccccaccuacaaugggcgugauugucccacaucaaucaccaauugagaaaaggcccgauaggauugcuuacagcccaaccuuauggaugcauuuuucacaggacucuaguuuaugucaagcugaccuaaaacuaccaaguauaguacaguacaaagagacacuaaccaaucaguugaugauaaugaaaaguuaucauuaaaauguuauggaacaguugauauaauacuacaggcuauuugguuucauggaagaucacaaauucaaacacauagcauuucucuuaauagucaauuuugaaaguugcaacuuuaagucaccuuucauucaacuaacauuuauuaaacaucugccauuugcuagacccugaggauaacaaaucuaauaacaaaaagucccuccaauguugaagcauaauuaaggcaguuccauguuuugauucuuuauauaguccaaggaauugcuggcauuagauauuauccccaaguaacauauguuggaauuaaaucaugagaauuaaguaaaguuauauggaacagugucuaggaucuaagaaucuacuugguauuuguagugaacuuugauuuucuuuuuuaaggauuuuaauuaaucccuaaauagcaagaaaagucaauuuaaacauaaaaguuagaaucauggagcuauugaagauauaaucuauacacucugucggucacggauuacucccuauaggagucuucuggguuuuuuuuuuuucuaaaacaguauuaaucauuuucccauucuuccagccuauuaaagcuuagaacauuguacuguagaaaaacuucaauccuuuggcccucagaucuauguacauuuucuaaaaaccagccaugcucuacuuuuuaauauucuuauuuacauaagugaaauauauaggagaguaaguguaaguuucauucaauaaaguuuauuauaauucacuuucuucauaguacaauaaccuuugguuuauuggucuuuuuauugcucugcaauguuagguaaaaccaaucacaaguggcuaaaugcuuacuucagagaucauuuucuuacagaaaguccauacuaugucucuuguacaucauuguguacuguaauaaacaaguaugcuuugauacagagcaggcugugcccuucuucaucagacauauucagcaggagucaaaugcuugaguugcuaugggaacugccugauaucuaaaaccaaggcuucaccuuuuaugaaaacauucaugguccuccagccaaguauauucuccuucaucacuguucaugaaguacguggacagaccucucacuacuuggugagaugcaaagccaggcacaguaaggcagggucuugcuauuauguaacccugacuguccuggaacucacucugcagaccaggcuggccuccaacucugauccuaggugcugggauuauaauucacuuuuuuucauagcacaauaaccuuugguuuauuggucuuuuuauugcucugaaauguuugguaauaucaaucacaaguggcuaaauaaucacuucagagaucauuuucuuguagaaagucuaacacucucucuuguaugucauuguguuuuacuuuuuaaaguaaauaucuaaagauaugcagaaagcauggaaugcuuuauucuuucaucauuuuauuuuuuaaaaaaagcucgagaagcacaauauuguuauauaggagcaugcacaucauuuaugaugauagaacucaguaauggaauucagauuagugcccacacaagacucaguugcuuugcaaguaugacugaugaggauuuaaugucaggcuugguuucucgugaaaugucugcccuuggggcuacugaguuucaguuucacauucaguguccuuuccacuacacgccaugaaagccauuaaagaggcacaagcuauuacaggagcacuaacagaaacagaucuguccaucagucaggauuuuguuuuguugcuuuguauugugcuuuguuucccuuuaugcacaggcaagacugcuaucccacuaauguucuuucccacgagccuucuaaagggcaagaauacugaugcaucugaucuccaccuaaauguuucuuaaguauauguuucuaaaccucagcuguccacaauuuuaauugcauugaaacacaaguuguuuuguaauuaggaagacaaauaggcuaauuuuucugcauuaauucauccuacaaauauugcugaguguacacuuaauugcagagaccauggcaagugcugcaauagcaauaaaaaagugacauuauagcucugcagugggaggagaaaugcugcauggggaagagacaguguaguauauaaaggagaugcagggauggagcacaaaaaucauggaggccacuagggagccacuaccuuaggaaggguaccagaaaagcucuccugggaggugacucaccugaguggaagcagaaguagcacacacacacacacacacacacacacacacacacacacacgccagagucucacacacacagacacacacacacacacacacacacacacacacacacacacacacacauacacauagacauacacaugcaacacacaugcacauauguauacacauauguacacauaaagagaaagaaagaucaaaacucuccaugguuuaccaugaaguaucaugcaaaguaugugaaaguuguuuugcauucaggaagugaaauauugggaauugcagaaaccaauacauacaggacuuauauugucacaaaagagauuuugcucaucauuccaaauauuuuuucacuuuuuuuauuuuauaaguuaauuuaauuuuuacacuccauauuccauucuccacccccaccccgauccacccacugcuccacaucccacaccuccuugucuccacauggaugcccccaacccccaccccaccugaccucuaaacucccuagggccuccagucucuugaaggauaggugcaucaucucugaaugaacauagaccuggaaguccucuacuguauguguguugggggccucauauuagcugguguaugcugccuguuugguuugagagaucucagggguccaaauuaauugagacugcugguccuccuauaggaucguccuucuccucagcuucuuucagccuauccugacaaggacgaguguuucuuacuuaugacguuauuuuaguaaacuuguuuuaggauguaaagaaugaauuggucugagucaaagcagaggaagagaaaccagucaggaagcuguacaauucaaccauaacauugaagggucguaugguaaaagcaguaaugauuggguugggaaacguuaugguuuuggaagucuguaauguaguuaacucuuugggacuuggcaucugauaggccguggcaguugauuuugaguaagaagccuacagugacagacuucucauuuuagugaauaucaacagacaaguaauuuugugggaaacacaaauguuuuaagaucuacaccagaaguacaugaaauauauacuuguaugcuaaaguuacucaguguagacuauucaacacacguucauacuaacacaaaucuauaugauauaccuuguuuuauauuugagccaggaacuauuaucucacucugaaauauagcaucagaaaaagaauguugaggcuagaagacaggguaagagaaccuccaacggaaaaaccacugagcagagacuaucuggccuuggucuuagcuacuuccuccaaauugacuacagauuauacaacuagcugguacacacugaagagguagccagugcccaaaguucccuaagcaaggaaguugauggaaaagaaguauuuauuaguaauguucugagacuguggccagcacacuaugggaucaugaccuucgggccaaauuggccuuuuuucuugcuucagaaauaccauucaacugucuauucauuugcucauuguucauggucgauguuaaguuauacugggaacacugaauaauuauauacauaaguaaauuaaaaggucacacuacuaacaauacguaaauacuugcugccugacccuucagagaaaacauuuggcaacccacacucaaauaaaccaauucagacauguuuugcuuucgugugcaauacaaccauggccacguaacaccucuuagccuaagugguuugagucucauggacuacaggagcaacugccaaucaguaggagugaacuuucugcauccucaguguccagacaauauauuuguaacuugaaaggucauguaccucacauugggcuucaugaaaaccuaaagcaaaaccuccuucaugauagacuuuggagauccugagagauucugguagauaagcaucccuaucuuaauaaucacagaaugcaauggcugagagagagaaaaaaaugauucacuccagaucauaguauuacagcuaugagaauaaaugauagacuguagugauaauaaaauuggcaacugagaacauugaauagauuuuaauaugaguccauucuaauuuuuuaacuauauaaaaugggauucugcugagcuucccaguccaaggagggcuuuuuauaaaguucagugaaauuacugauggaacccaccaagugucccugcaucaacugagccguguucuccgugguacccacucuguaugacauuucucucucuagugguccagugcucauagcuacugcuucccaaacaccuauuuccuuaugaaacacaugaaauuacagcuuaggggccaaguucauggaggccacuagggagccacuaccuuaggaaggguaccagaaaagcucuccugggaggugacucaccugaguggaagcagaaguaacacacacacacacacacacacacaauacacauauacacauacaugcacacacaaaaucggcugccgauuuuuuggaaagcccaggaacuaaaauuguuuuucagcuguuuaauaguuggggaaaaaaacacagaauuuuuuacugacacgugagaacugucacaaagcacaaacaacucuccugaaccuggucagguacauucauuaguguaccgcccacggcugguuucugcuauacuagaguagucaguaguugccacagaaaccguaggaccaccaaagauacacugccuuacuuuauuuuacauucuggucuuuuacaaagacagcuugugcccccuggcccugaaaaaguguuauuaaaaguaugucugggaacuguugaaauagaagacacuagaagaccuuugagaugcaggacucacaguguagcauuguggucccagcacaacaugagaaagaugaauccuguuccuacagagaugaacaaggacguccaucccugccaagaccuuuuacauggaagcucacuacagggugcuuuguaucugucacugcaugucuuggucccucaggcaugaguccucucacagcacagggacuggacacucccuggcaugcagggaauaguuaucagagcaucagacuuaguguugggcagcagcugagaauugcacucucuauguuacgguugugacaagagggucuaagcuuuauacccaaagcauauguucuauugccccacaagccacauagcaaagcauauucagacauaaagcauuauuuagacaaauccaagcauaggacaugccagugugguuuauuuggaguauagcaaugaagccagacccaucucagccaagaacugcucaagugaaccaaugugugaauugacuauuaucauggugagggagaugugugucugucacacuuauuuuggauuaucuucaccagucaggaccuaguguaggaauaucaugauacacaaagaugcaagaggaauauauucuuuuuuaauuucuuuauuuccugccuuuguguauguguauguguguguauguguguguauauauauauauuauuagauauuuucuuuauuuacauuucaaauauuauccccuuuccuaguuuccccucugaaaauaccuuauccucucccccuucccccuguuccccaagccacccacucccauucccaguccuggcauuucccuauacuggggcauagaaccugcacaggaccuagggccucuccuuccauugaugaccaacuaggccauccucaucuacauauacagcuagaggcacagguaccaccauguguuuucuuugauuggugguuuaguuccaaggagcucuggggguacugguuaguucauauugauguuccucuuauggggcuucagaccccuucagcuccuuggggccuuucucuagcuccuucaauggggccuugugcuccguccuauggaugauugugaguauccacuucuguauuugccaggcacugacaaaggcacucaggagacagcaauaucaggcuccugucaucaggcucuuguuggcaucugacauaguguauggguuuggugguuguuuaugggauggauccccaaguggggcagucucuggauggucguuccuucauucucugcuuugaacuuugucucuguaacucuuuccaugguuauuuuguuccccauucuaagaaggauucugagcuucugggcuaauauccacuuaucagugagugccuaucauguguguucuucugugauuagguuaccucacucaagauuauaucauccagauccauccauuuuucuaugaauuucauaaacucauugcuuuuaauaguacuccauuguguaaacguaccacauuuucuguaucucuuccucugugagggacaucuggguucuuuccagcuucuggcuauuauaaauaaggcugcuaugaacauaguggagcaugugugcuuauuacauguuggagaaucuucuggguauaugcccaggagugguauugcuggaucuucugguagaacuauguccaauuuccugagaaaccaccaaacugauuuccagagugguuguaccagcuugcagucccaccaacaauggaagaguguuccucuuucuccacauccuccccagcaucugcugucaccugaauuuuugaucuuagccauucugacuggugugagguggaaucucaggguuguuuuaauuugcauuucccugaugauuaaggauguugaacuuuuuuaggugcuucucagccauucgggauuccucaguugagaauucuugggucaacuggugguuagcauguagaagaaugugaauugauccauucuuauuuccuuguacaaagcuuaagucuaaguagaucaaagaacuccacauaaaaccagagacacugaaacuuauagaggagaaaguggggaagagccucgaagauaugggcccaggggaaagauuccugaacagauggcuuguucuguaagaucaagaaucaacaaaugggaccucauaaaauugcaaagcuucuacaaggcaaaggacauugucaauaagaccaaaaggcaaccaacagauugggaaaauaucuucaccaauccuaaaucugauagggggcuaauauccaauauauauaaagaacucaagaaguugggacuccauucuaauggaacauuagaaacugcaugccauuauggcagaccauauaaauggcaucgcuuaugagagaacugagcaaggauuccugccuaggcaauucaauauuucuuuccaaacuuucccuaugcuucaaagaccucuuuuaucuuuccucuauuauuuuucaaauuauuuaaacuaauggggcugucaaauaaaaaaauccuccuauuuaaauuuaaguugauuuuuaaacaauuugaaauugccuaauuuaauuacgagggauuugagacacccuugaaccaaaagucaagcagaucugggggagcacccugguaucagcgcagagacaaaauggcucuagcaaaagucaaugguuacauuaaagaaaucagccaggaggcagcaagguucagagugaguucucaggaaagacuacagacucgaagaaaauuaguugugacacuaguucuuauuuauaugaauaaguaauuuauuagauauuaauagauuauuuaacauauauuaaauaaauuaaauaggacuacaugaagaugacaaacuuucuagacaccuaccuacuggcccagugucucaauacaagguguuuucauaaguacuuuuuuuuuuuuuuuuccgagacaggguuucucuguguaguccuggcuguccuggaacucacuuuguagaccaggcuggccuugaacucagaaauccgccugccucugccuccugagugcugggauuaaaggugugcaccacgcccgacuuucauaaauacuuuuugggaagagaucagaugauaaaaaauaaugaacagacaguauauuuuauuuugagggccuuaaucaaccuagagccuucugaguaaauacuacaugguaagauuuagucacaaauauguucuccaaaggaugacaggcuguugugccagcauccuggucugugcacuaaugugaaauguuaauuugucauagaauacauuucugaauguagaguguguuuaugcauuuguuuccuugaugaaacauuuauucauucuuaugcuaacugggcauuucccuauggugccgugccuuucucucucacaaguggcucuguugggccucgcugagcuuuuuggguuuuauauccuggaagcauuggauagcuucauuuacuauacuucuaucagcuguucucagcucuggagacgagucauaggacccaaaagaaaagaaacauuuuuuuaaaggcauuuguagguacagaauuuguuuugucuucagcucuagaauguccccaaaguauuuuugaaaugacccauuacuacaaauacugucaaaguuauuuuuuaaaaaggaauccuuacacauuguggcaaaguauacagccaucauagaaaucaguaugaaggguccuucuagagacauacuaaaacaaacaaacaaacaaacaaacaaacaaaaaacuuaagcugccuaccuuuauuucuugagacacaagcaaacaacagccaaguuauggagcucaucaaucaauauacacaggaaaaaauauaguaugcauauaugguguuuucuucagccuugaaggagaaaguauguuguguccaguaaaauggaugacaugaagauaaccaugugacaugaagaugaccaugucaagagaagggacucuaacucagaaggauggaggucaccuacuuucuuucauauguagaaucuaguuaucugccauucuugagcacacauuuuuggcucccaggaccuggucccauuucucucucuuacuccaguucauaccuuaggagcaucacagacuccuguagcuccuaggcagccauuguuaucuugaagacaaaccauggagcccauugcuccaaauacaagugcugauguucuuugagugcccuaagcucuucucgcugguauuggcaaccaugcccuguggcucaggguuuccuuccgggcucuaagaacaucaagcucaccauuucagugaugugucccccuucauccccuuccguuguacuguggguuucucccuuugaaguuuugucucaaucuaacaauuuuaaauuuuugagaauaucccauaguaacauggccauuuuucaguacuucuguagauuuauucuuaguuuuguauaauugaccacuuuaauuccauauaaggaggaagaaaaggaaauaacuuugauccauucaccuuagauuucccagugaacuaacucucucucucccucucuuucuuucuuucuuucuuucuuucuuucuuucuuucuuucuuucuuucuuucuuucuuccuccuaccucucugccucuguuucuaaaagggaucaaacacaggcuucaaacauaccuagcaagugcccuaccaugaacuauguuuccaaucuaguccugaauguucugaaaacagcagaaaaaaaaaagauuggaagaaguccaacaauguuuguguuaaagaugcaugaaaauuaaaaacauuaucuauguucguucuuuuuaauaaaauaaaaagauucccauaagaguuagugucugcaugcaugugugcauguguguguuauauuaauaggauuaaaacucauucuaaugaugcagaauuccuaaccucagguagguaaaauuccaugcuuccccucuacugaucauucauauauauauauauauguguguguauauaugcauacacacacauauuccacacagggguugaaguaaauguaaguaaaagucacauauuuaagaggagauguuguuagcagaagcagguguaucucuguaaguuucaagauaccagagcuacauagugagucauaauauauguguaaaacagaaagauaaaaagagaaaauggggagggggcacauagcucuuauuguuccccuuuuguggacuucagaugcaguuauggucugagucaguaagugggugugccaaacuuaaaacagggguauagaauuaaaauagaguaauccuccuauccugacuccagaucauaauuaauauauagauaagauaaagaaauaaauauaaaauuacaacuauagcuagaagcuuaauaucucccaacuuucaccucaccaucaaugggaaauuuuccucuuccauauauggagaacauugacuaaaaacauugacauugcuuuaaagaguuguagaaagacaauacaagcagguagaaaaaggagaguccuacuaguaaaaacuuuacuccuuuuagaacuuaaguuaaugaguucauacugauauauauucucuaaaggaauagaacugauagaaugaaaaauguuuuuuguugugggguauuaaaaggggaauuuauuggaguggcuuacaggcuaugggcugguaguccaacaauggugucuccugaugggaaauucaagcauccaguaguugcucagcagagaggcuagagucuccguaggaugagcccuggacuacugcugauuuucagacuauguuggaaucucgucacagcaacagcauaauuaaacuugccaacaagagggaggacaagcaggcaaaagccgaagcuuccuuuuuccacguccuugggggugggcugccacuagaaaguguggucaagauuuaggcugugucuacuuacaucaaauaaucugauuaggaaaaucccucauuccccacaaccccuugcaaccugcaguaagcaaaagagcuggcccuggggucaugcgagcccugccugcaccagcugcuacacuugggagagcaggcucuauaucuugcuugggcaaugcagagcugacccugguggcagggguacaagugagcuugucccaaggcaaugagcgugggagagcuggucccacagcuugucuauuaagugguggcaugggcaagggaaagauguuccccccuaccuccagcuggucucaggaacaugagaguaggggagcugucccuccccaucaccuguugcaccccuuagagcaggcccuguaccuugccugggcagcacaauauagcuagcccugcugguguggacacaagugaccuaaccccuagggcaugacagugggagagccggcuagcucugccccuugucguucgcugcaaugggugagcaagccugagcauuucuggagagcccacccugauggugugagugcaggagagcugguaggcugacuagcccagcugccacucagccccagacucaggaccccaacaucuaccccaucugugaaccguuggaacaugugaagggguuggucuuauagauccaacgcugcagaaucuccaugacacaggccaacaacaggauaucugagaggagacccaguauugauagaguagcagaagccagaagccuugaaucagacccauuagucauuagaaugaauauuuauaaguaaagaaguaugcacgaagggguacgcugugggacacacugugacacacuacagauucuacagugagguuggguuuuguuuuguuuuuuuuaaaucauuuuuuugggagaaagauuguaaggguggagagcagguaugaagggacagggagaugagugggauuggggugugugauaugaaauucacaaaaagucaauaaaaaguuuaaaaaagagagauaagauucuucacaggagucccuagcagcugggguuuuagaugauaccagacagagucaagaugauaacuaagaugaaccaucacagugugugugugugugugugugugugugugugugugugugugugcgcacgcgcgugugugugcuuguauugaauuucuguagucacagaacaaggcagaaaaaaauuaagaaucuuauuucuagcuuucauuucuuugauuuacuauauuuuauagagauacuaggcuauggauuaacaugcauucucaucuuuuauuaaaagagguagauuguacaacuacuagcauauuccuguauauuuaacaucuaugaguaugaauauaaaguuuucagagcaaagaauaugugauauguuucuuuuuaugaacuuguauugcaauaauuuuauauauaugaguuuuagacuugagccucagucaguaaaaaauguuagguagcucuagauucaauguggauauugaggaauaagaaagcacuuuguggagcuuacuucauaaacgaagcucugcucacaugaaaacagucacagcuaucuuacaaacauuuuaauuaaguauuuuaaauauucacacauuaauauuucagagauauucaugugaaauucaaugucauaaacugaauauauguaugaccaguuuuauuucccaguuuguuuuaaaaaauagaauuuuuaaaugauuugguucauuuuaagaacagcaggaagguaauuaugcaacugauuauagaagauauguucugagcaaccgaaauaggaaguauguaucacugugugggagaaaagaacuuuuacacauaaaugugcacagugcuuuauaaaaaaauaacagcuuaagguuuaaauuaagauauauauuuuugaagaacuauaaauuccaauguaauucuaauaaguaauuagaauuaucauguaucaugugacccuuuccuuauauccccagugguagcaucucacuaaacuauccuacauuacaacugggaucaaguaacacaacagauuucugucuucaccaggauuccuggagcuguuuauagccacacucauuuccccccugccucaccuccuccuuagcuccaggaaacacaaaucucuucuauauucuuuagauucaucaugucaagaauguuauauaaauagucccauccaguacauggccagugggaauaggcccuucucaguugagccugguccaagcucuugugcaguuccacagccugcaccuuuauuggcuggguaacaucagggcuauaaacgauuaauucuucacaacuguguggugacuggguuguuccaggucaagcucuuaguaaugauaccacuauauauuuuauguacagguuuugguguaagaguguuuucauuuagaugacauaaauuuccaaggguacauauucuggguuccaggguaguaguuucaugauuuaagaaaugucaaaccuuuuuugagaaugauguugcuauguuacuguucuaacagcaacauggguauuuucccgcuguggucuuccaaacaucuuacuugcugugguggugucucaauaaagccuuagcuugcguuggccuaaugaaucaacaauucuggaucuuaugugauucucauuuguauauucacagcagugaggggucucuuaauuuggggggggugcauauuauaguauuugcuuuauacugaagggucuuuauauauucuagacauuaauucuuagucagguagguagugugccuuuuagucuucauaacagcauuuccccaggccaagagguuuucauuuugaugaagcauacagaucaguauuucuaugagccaugucuucagugucaacuauaucucuuugcuagguuuagaucuuaaagcuuuagauagucuauauuuucaaaaaaaauuagaguuuuagauaacacauguacuagcuccuucaucaacuuggguuauuuuucacauaaguugggagacuuuagucaagcuuuacgaugaugaugaugaugguggugguggugguggugguggugguggugguggugguggugaugcuuuugucuguccaguuaguccgacucuggacccuuucccugugcugcauuugaaccuuuggcauugaaucuauuagaguggcuauuggaauuauuuuguuguuauuccacugacugacacauaucuccucucacuaaugagcauuaccaucuuaacuaauggauuuaugaaccaauucuaacacuggcuccucuguucuuauguuuuauaaaugucuuagcuuuucuaguuccuuaauauuucuauacaagugaugauuugucccuauuaaaacaucugaagugaaaauuaucuauaaaaaguauuaucuggcuuuugauaagaauugcaguaaaauugagaauugguuuuaaucuuuacuucguugaguuuucuagaccauaagcagagauaucucuguacuuuagaauuuaaauuucucaaaucaaaauuuuauaauauuuuucaacuauaaucuuaacauauuaaaggcauauucauaagggcccacuuaaucauauauucacuaaaaucaaagacauaaauaaugcaaaucaagaaaagacagaaauagauucuacuagaaaguccuaguauaacauucagauuucucagcccuuauccuccaggccaggaaggaguagaaucgacucuuucuacagagcugaaaggaaaguaugauucgcaaccaaagaugguuucucugucuaaaccauccuucagaaaugagauggaaauaauaaaaagucuccagacaaauaaaaguuaaaauuacuaaugggaauucauuuuguugcauuaaaagcuucugauuaaagacacaaaacacaugaaagggaaauuuuaaauuguaugagggauuauauugaaaauaaugcagacuacauuuauagcagacguacagcuuggucuuuuaguggguccccuaacaauuggaauggggcugucacugacuguugccugccuuugaauccccuucuccugacuggacaaucugacugggccucaacaggagaggaugcacuuaguccugcugcaucuugauguucuacggaggagugguacccaagagggcuuccucuuuucccagguuaaggggaaaggauaaggggagggauuuguaagggugggacugggaggagaggggcugcauuuggaauguaaaacaaauaaauaaguaaauuaaggggaaaagauaaaauacuguagacuaaacaagacauauuuaauggaauuuuauccauaguaugaugguuucuaucuuaaaacaacuguggcuaaaaguaauuguuaaagggaaauauuauaaaauuguacuaguuuugauaccagaaccacagaauguaaaaguauuacauuuauaguacaauguuagauuaguguuuaauacuucauuuaaauuuauuucuaauauuuuuauucauuauugugauuauaaauaauauauuuuuagaacuucuagauccacucacuacuacuacauacaaauaucauuucuuuaaaaaauuuauuuguuuauccuuggacaacuuaccaguggucauaacacugaagaaguuaacuacacuuccuucagccaucauuagcuuccauuggcucccuagggagagaugugccucauaagacccuccucuauuuaugauggaagguugacaugcccaauccugugcagaucuugugcagguaaucucagacuuuuauaaauuucuuagaauuuucuaaauagguaauucaugcacaaauagcaauagcuuuauuacuuaucuuuaaaaauacaauauuuucucuucuauuagauucaguguaucugguucuauguugaggcccuugauccacuuggacuugagcuuuguacaagguaacaaauaugggucuguuuucauucaucuaaauacagacagccauagaccagcaccauuuauugaagaugcuuucuuuuuuccauuguauauuuuuggcaucuuugugaacucauuggcacagggggaaaguuccuaaacagaacuccaauggcucgugcucuaagauccacaauugauaaaugggaucucaugaagcuggaaagcuucauuaaggcaaagggcauagucuguaagauaaaucagcaacgcacagauugggggaaaaaaacuucacuaaccccacauccaauagagggauaauauccaaaauauauaaagaacucaagaaguuaaucaccaaaaaaccaaacagcccaaacaaaagaugggguauagaacuaaacugggaauucacaacugaggaaucucgaauggcugagaagcaccuaaagaaauguucaaaguccuuagugaucagagaaaugaaaacgauuccaucuuacaccaaucagaauggccaagaucaaaaccucaggugaaaaacauguguuggagaggauguggauaaagaggaacacuccuccauugcuggugggauuacaaacuuguucacccacucuggaagucaaucuggagguuccucagaaaacugaaaauagaucuacuugaagacccagcuauaucacucuuggggauauacccaaaagaugccccaccaugccacaagggcaccuguuccacuauguucauaguggucuuauuugugauagucagaagcuggaaacaauccagauguacuacgacagaagaaugguuacaaaaaugugguucauuuacacaauggaauacuacucagcuauuaagaacaaggacauccugacuuuuugcaggcaaauggauggaacuagaaaauaucauccugagugagguaacucagacccaaaaggacaugcaugguauguacucacuaauaaguggauauuagacaaaaaacagaaacaaaaaacaaaacacaaaacaaaacaaaaaacuguacagaauacccaagauacaguccacaaaauucaaaaagcucaagaagcugaagugcccaagugaggacgccccagucucacuugggagagagaggaaagcaaucacaagcggagguggggggagggaccuggaaggaaaaguguaugagguggggaggguaaccugaucugauuaggugagguaaauggacugaagcccugagggccagcagaaagaauguaaacaggcaacuucaggaaauaggagguugggggaccccccagaaugcaccagagaccugggaggugagacacucccaggacucaaagggugggacaguagggagauggaccuuauagagaccacauccagcaggaagacaggacaucaagugagggaugggguugccauaccacagucacaucucugacccauaccuguuccugucugaaagaauuacagggauggagauggagaggagccugaggaagacaguccagugacaggcccagaggaggauccagcucaaggggaggucccaaggccugacacuauuacucacauaaagggaucuaucaugacuguccuccaaaagacccaacaagcagcugaaagagucagauguagauauuuacacccagccaauggacagaagcagcugaccccugugguugaauuagggaaggcugaaagaagcugaggagaagggugauccugcaggaggaccagcagucucaauuaaucuggaccccaagcucucucaaacacuggaccaccaaacagacagcauacaccagcugauaugaggaccccaacacacauacaauugaggacuucugggucuguguucauucagagaugaugaacccucaagagacuugaguccccagggaguuucgagguuagguggccugggggugggagcauccaugugcagacagggugggguggggagaagguguggguuauggagcagucggaggauggaugggauggcaaggaauggaauauggaguguaaaaauaaaaauaaaauaaaaauuaaaaauacaauauuuuauuaacucucuugagaaugucaugcucuuacucuuuuuuaaucuucaugcauuuauuuccaauuuugcauuuauugcacaguuagaucuuccagcacucugcuucauaacaguagcgaggaaagacaugcuugccuuauuccuaaccauggaagaaauacacucagauccucacucagaacaacgcugacgaagcacugcuuuaaaacguguacucagucacucugagaaaguucaaccacauccucuccuuuagggaguauuagaaacaugaauggacauugaauuucgacuguuuuacaacuaauaauaugauuuucuucacuauuaauuuucaguauuaaacaaauguaguuauggauuaaauuuuacuugauacacucauguaaguuuuauauaugggugcuuugaugaauucuguucucuaauacuuugcuaaugguuuuuaacccccguaaucaugagggcuacugcucuccuugcaccagugcaguguaugaauauguacaugugugaauaugcgcgcgcacacacacacacacacacacaauuuuggaagagaaaagggggauugcuaacuuccuaaauucuauuaguaaacauucuuccauuucuuagaauuguuaauucuuauuugccauaauuccaugguuaaacuaggggguuagauaugacuuuuuagaaaagaugaugaauuacuaauuaaacucacaucacccaaaucauauugggcgaacugugacagcuugauuugaaaaaaauuuagcccacuugaauugaguugucaaacuaauaugucuacuuuaauaaugauggauuaauaauaauaugucuauuuuaauaaugucuauuauauaauaaugaaauuucauauuccuucauuaucccuuugauguuucagaggccaucaugaaguccacugcuaaauuccgauggugaucauuccugucagaucuucaguuuaaaaauggcauaaaaugauaauuugaugauuuacaaaugacaguuuguccgaaggccagagaggugaugauaacacuguguaaagagaauguuugcaaguaugcacugcuuuauaaucucccagaagucuaccugcucuuucuaagucuuaagaaauuucucugaugacaacagugugcguugaauacauucuaugucauuugugcuauaugucuucucucauagaaaaccgcaauucugaaaguaaguuauaugcagggguggggguggggggugggggagugaagcuucuuaaauauaccaaagagcugucagauacucccagcucucucaaccauuuauagccaucaguauaggagccauuguaccauguuugcuauaauuauuuaaaauguacaaauagccaggcuuucuuaugaauaaggaaaugauaguuuaaaagaaucuaacugccaugguauuuauaaaggccauugccaggaaaguuaucauuaaggaauacuauguuagaagagaguaaaaguguaagccagaaacacaagugacaaugcacuucuaugggucaucaagaugacaugaaguuuagaauaaauacauguaacauucauugaaguaaauuguaguuguagucaguggcauagcaguuguugucauuagaugauagauauuauuaaauaaagaugauauuaaaauugauucuagcucaugguuucuaauuuuucugcuaaguuauuuucaaaaacacuuagcaaaauaccuacuuaaaguuuuuguuuucucucugaaccaugccuccugaaaaauguucaaaaugcacugucauauagauauaaagcaaaugcauaaagaaagugacucagaaaguaaucaauuucuaaguaaucaaaaauuugccagaguagcauauaguuuugugugaauuucucuuaaggaaaaagugcugguaaguuuuaauguccccuguaacucuaaagucuguuucuucaccuuuguaucagugaacaaauagaacaaauauucaauucauuuguauauuaaauuuaaaugacauauuuuuuuuucuguaaauucaucauauauuaagaaaaucaaaucagauuuggagcaaaguaaaauuagguugaaaucuuaacaacaauauuuauaguugaguaucuauauagcugaaauggaaguaaugcauauuuucccccaagaaaucacuguuugguuuaacugggauaauucauagauuauuacauugauaauacauuaauuauauuaggauaaugucuaauuuaagauaaagaugugguuauuuucuuuguuguaagaucuuugauggguagaaaguaacugaaagaucugcauguucaaauaauagaaaauaaaauaauaaaaauaauaauagcagaaugucagcuuccauguaaaugcauagaaccucacagaugcauuguguucuacagcggaaagagauggaacaaagggagaaccauuugguuuaggaggaaauaaagaaaauaaaaucauuuaaucaaaguuugauaauugcagcaaccacuuuaaguagaaacuuucagggagaauucaucugcaaauaugaauggagaaugccauaagagcucugucugucuucuggagaagggcguggggagggcuucuggugucagacacuagacacuagggagaaaggaaaguuuaauuuguuagcugcuguugcaugaguaaauuaauuuuuaauaauugcuuauauuuuaauuccaucuugcauuuaaauaagaacuccacugagaaaauauugccacaaugaaaauauuuuaaagauugcuuuccuaguuugggugagcauuucauuggugcagaggaagaauaaucauuagacuuaaauucguacaaaucucugcuaccuuuagugcaugccuucuuuccucugccuuuacuaagcacagggcauaucuucauuuuaaaagcuuuaaacacuuuguaacauagaaguuauaauuucagguuauauuuuuugauauuuuguaucaguaacuguuucuccauuugcacauuggcuauuuaucuuuuuauuucuugagaucuguauucugaucuuagcuugguuucuuccaguguugugguuguauuuucugugcucuuaggaaggacuguuauauaauaagcauuggucauuuaacagcucaauuauuauaaauaucuuuaccccaucuccacuuuauuucuauuuuaauuaguauuuuuugaugcuuuaauaacauuuacuuuuuuguagucauggcuauuucuuuucuuccuuugugguucacaguuguuauuuuggguaaauaucuucaccccauuuucaccuuuaucucuauguuaauugguaucuucugaugcuuuauaacauuuacugacagccugaagagcaaggaucuuuuauacuucucguuaguucguagagaagcaacugcugagcuaaucauuugcagcuguugugacaggagggggggcggaagcgcagggauaagaagacaggagaauaccuuucugggccguuauuaaucacugucaguauuuuguaauagcacacucucagauauuaaucuguuuucauaauuugacuuauuuuaaauaguccuuuccucacauauuuuuacuaaauuaucauaauacuuuacuuuaucuauaacuacaguuauguagauuuacacauguugauacugggcuacauuuuagugaaauucaacagaaaauauuagagauuugaaauuuuucauauuuaauaaauauaugaaagaauaacauuauaauaauaacuugguuuagaacuaaacccaauuuaaucuaguacuuauggauggcucucauaugauuuauucucucucucucucucuuucucuguguauacauauauauguaacacuugugugaauguguguguauguguguguauuaugaguguauauguauguguuauguguaugugugugaauguguguaugugaguguauauguuuguauguguguauuggauauuuuuguguguguaugugcauauguguauauguguguauugaguguuuauguguguauguguauaucuguguauguguguauauguauguguguauguuuguguacauguguguauguacauguauauuauauguaugugaguguauauguguguauguauguauugugugugcauauuauguauguaugucuuuauguaugaauaugugugugugcguguguauguguguguguguguguguguguguguuugugugugugugugugugcacaugcacacacacaugcauggaggucagaggcuaacacucaaugucuuucucaguuguucuccacguuauuuuuccgcacagcuucucacugagcuugaacuuuuuugguuugacaggcuggcuagccaucucucaggaucauccucuauccaucucuucagcacugugacuacagauacacacggcuaccccaggcuucuuuacauggugacacuggagauccaaggucagaggucaugcuuaccaacauauacuuuacugacugagccauccccagccucauagaacucacuuaagaacucauaccaaauuuugucguauggccacuagguaaauauuuaaguucuuugcugaaugucaagaaucaaagacgagaaauuucacaaauuucuaguagggcaucacuuguaguuuuugcuuuuaugaagaaagaaauuaaagaagaucucagaagauggaaagaucucccaugcucauggauuagcaggaucaauauagucaaaaugucuaucuugccaaaagcagucuacagauucaaugcaauccccaucaaaauuccaacucaauucuucaacaaauuagaaagggcaaucugcaaguucaucuggaauaacaaaaaacccaggauagcaaaaacucuucucaaggauaaaagaaccucuggugggaucaccaugccugaccuaaagcuguacuacagagcaauugugauaaaaacugcaugguacugguauagagacagacaaguagaccaauggaauagaauuaaagacccagaaaugaacccacacaccuauggucacuugaucuuugacaagggagcuaacaccauccaguggaaaaaagacagcauuuucaacaaauggugcuggcacaacuggcaguuaucauguagaagaaugcaaauugauccauucuuauuuccuuguacuaaggucaaaucuaaguggaucaaggaacuccacauaaaaccagagacagugaaacuuauagaggagaaaguggggaaaagccucgaagauauggguacaggggaacaauuccugaauagaacagcaauggcuugugcuguaagaucgagaaucaacaaaugggaccucauaaaauugcaaaacuucuguaaggcaaaagacaccgucaauaagacgaaaaggccgcaaacagauugggaaaggaucuuuaccuaucuuaaaucacacaggggacuaacauccaauauauauauaaagaacucaagaagguggacuccagaaaaucaaauaaccccauuaaaaaauggggcucagagcuaaacaaagaauucucaccugaggaauacugaauggcugagaaguaccugaaaaaauguucagcauccuuaacaaucagggaaaugcaaaucaaaacaacccugagauuccaccacacaccagucagaauggcuaagaucaaaaauucaggugacagcagaugcuggugaggauguggagaaagaggaacacuccuccauuguuggugggauugcaagcuugugcaaucacucuagaaaucagucuggcaguuccucagaaaauuggacauaguacuaccagaggaucccacaauaccucuccugagcauauauccagaagagguuccaacugguaagaaggacacaugcuccacuauguucauagcagccuuauuuauaauagccagaagcuggaaagaacccagaggcuccucaacagaggaauggauacagaaaauaugguacauuuacacaauggaguacuacucagcuauuaaaaagaaugaauuuaugaaauuccuagcaaauguauggaccuggagggcaucauuuugagugagguaacccaaucacaaaagaacucacaugauauguacucacugauaaguggauauuagcccaaaaacuuagaauacccaagauauaagauacaauuuguaaaacacaugaaacucaagaagaaugaagaccaaaguguggacacuuugucccuucuuagaauugggaacaaaacacccauggaaggaguuacagagacaaaguuuggagcugagaugaaaggauggaccaucuagagacugccauauccagggauccauccuauaauuagccuccaaacgcugacacuauugcauacauuagcaagauuuugcugaaaggacccugauauaacugucucuugugagacuaugccacagccuagcauacacagaaguggaugcucacagucagcuauuggaugaaucauaggguccccaauggaggagcuagagaaaguaugcaaggagcuaaagggaucugcaacccuauagguucauacaacaauaugaacuaaccaguccccccagagcuugugucucuagcugcauauguaucagaagauggccuagucagccaucaguggaaagagaggcccauuggucgugcaaacuuuauaugccccaguacaggggaacaccagggccaagaaguggguguggguggguaggggaguggggggggaggguaugggggauuuuugggauagcacuggaaauguaaaugaagaaaauaccuaauaaaaaguaaaaaagaauaauauaguuaguaugguuuucauaaaaauuuuccauuuucuauugcacauauuccuuugggagaagagauaacaaacauucaauauguuugaaaaagcugaguggcaaccugcaaauauguguguguguguguguguguuuguguguauguguauguguguguguguguguaugcauguauguguguguguauauauguguguuggaauuacccuacauagaauaaauguacguugcccaauuuaaagcccaaugccagaugcaggaucccuuccuuuaaguuguuggucagugguauccuggauucucccaaacaauauaggcuauuuucauugcucuuauuuucaguuguccaacugaaagugacaguaagaccccuacacacaguggucacaguacacagagaagucaagcugguauuuacucaggaagcuucccugcuggcuagcuuucauaguguacgaauguauuaugugggcugcugggggacaccagagucaccaacauucuuacucauaaucucugaacacuguaaacugcaguaaugacuggugugaugacaagcuaugccccaaguacauggaugcugugggcaauaaccagcucuaugacaguauucaaggccaguuccaugggaggaacacauaugauagauacuauaaaucuugcuugagagcucacaggccccagaagugaaccuacugcuauuauuccacuaaauggacauaucaaacugcccucuaaauuaguaucucuguaaguauauauuacugaaaaugucagacaucaucagaggagguucuuugugcaguggaugaugguuaauguggagacuuacaacugguuaaaggacagagaaaauugucaauggagugaucauccccaaaugguacaucgauaccauacccuuccacaaggcuuagggaccuucacaguagaagagggagauggauuguaagagucagagaucagggaggaccagagugaugcagugucuacaggacaugaaaggaccacuccacucaugaacuuacauucaacaugugaguugccugcaugagaucuacacaaagucaagccauccagaauucaagcauggugggaagggauucacaagcuccacaucuuaauugaagugguauggacaguugauuguuuccaaggaaaggaguacagguuuucuuuaagaguguggcuucuaagccgggugugguggugcaugccuuuaaucccagcacuugggaggcagaggcaggcggauuucugaguucgaggccagccuggucuccagagugaguuccaggacagccagggcuacacagagaaacccugucuugaaaaaccaaaaccaaaaaaaaaaaaaaaaaaaaaaaaaaaaaaaaaaaagaguguggcuccuagcucaaccacacuccagugaauggcccuacucccuagcguauaugagcuccacaaauuggagucuuaugguuuauuuuuuuuuuaaguacaugaagugggaguauagagguguggguugcuccugggagggguuagggguuagagaaagaguugagacugaauaugaccaaaauccauugccugcaauucucagaaauuaauaaaauauuuuuaaaauguagucaaaucaugccauacuuuugcuuaaagccuuagugacgucuaauuguaguuggaguaaaguggacaauucuuaccaugacuucacuggucuugucucuaaucuacugagcccugugcuguucuuguauauacuucuugucuguuccuccauuguaaguugaauucccugucagaucucuuggauuugccccuuagaacauugucccaaggacucuucuuugcuggucauuuaccuuucuucaagaucaguuaccaccucuucauagaagucuuugcucuaaaggacugucuuucccaauuccccacaaaccauuuucuguuuaguucauucauaugauuuaucacaaucugugguuauaguagucuuuauuauuuacugggucauugaucaucuaccucuuuuggaauauaagcuccuagaacauacacagaaauaguaauaugaguggagaagggcaucucaauggagacagcaugggaaaaugauuauuuuugucaaugcuuaggucuuacccugaaggagaaacagggugauaauggagaaguacaagauauguuguauugggaagugugggaauguguauuuccuggcucagugaguugcacugaguuaaguucacugggaugcuaguuauaaagaagaaucuugugccagaacacaaacagacuuccauauaccacugagugaggagcauagaugcucuccugaagguaauacagaaguuaauggccaugcacuaugaucauucucugcccaguagaaagcuaacauagauuacccuuauugcaucuccuaaccaaccacaucaaacauaaaaaaggguggagacucagcacucucauggugaaaguggaucguacaggggucagccucacguggacugucaaagcccaugaaagucagggaggaagucgcuggaugauguauaguauuccggcuaagugaaguugaauucccugagguuaugcuaaccuuagauauuggagauuaccugagaaucacaccugcucagacagucaaacacgggguaguggaaacuagguuuuugguugucagagaacagaauuauaaacacaggaaugaauucuguaguauuuagaucgaagcugcguuauccaugggcguucauauuuuuaauauguaaagauagauguagaaaaauagauguguucauuucuacauaucuucauaaauguccccauaugcaugcacagacacacuacacauauuacaaauauucccuucauccgguauccaacugguuaggagcaacaaccaaggagcacuuuggcguccagcauuucacauaugaaggaaacaaaggugauugggaagaugggugaguuuucauauuugagacuagaaaaguauauacaagcuaagucuaaaacaugagaaaguguucaaauaaugacagagagauauaucagaaguaaaaaagagcacuuguuuuggcaagacccucaaucauuaaaguguuaaaacaaugauagugauggauuggaacucacuggacaaaauaaaaagcccauggcucucugaagauaauaaaaauauuuuuaaaagaacugaaugcuuuuaaaaugagauaguagcauaauuucaaagaaucuuuucauaaaaauucaaauguaaaugaguaagcaauuucauaguggggaagccuggaagauaccacuguaauuacgugauuacggugaagaucauaacaacuaagagaaauccaaguucaagucccaccuaguacaacauaauuaaaaaagucuuucuggcucucucugauaaagauucauauccuggauuuaauaagagaauaucgaauaaauuuaagcagagagccauucuggcuggcucauuaucuuuaaacagguagaggauuucaaaagucaagacaagacuagaucuuuggaugggauucugagauuacauguuaguaauaugccaaaggcaaugaugugauuuugaugaugaguguucuagucagagauaaauaucucacuuuuaaggaguaagucacuccucguagcugaugagacaucaggucugugacaacuuagaaauaguuccaagagaagacgucuuugcauuguaucuccaacuugguuauagcuuuaaaaauguuuuaaaauacaaaacaacaagaaucaauaguaacauaaaugguacuguaugggaaguacagaggauaaauuagaagcagacgagaaagagagaucuaggggagccgguaagggagcuauuucagcaauaaagucuaaaggccucagacaguugcagggagaguagaagagggagguuugagucauaguuaggaagcagaacugacaggcuuugguggcuaauuagauauagagaguggagggaugagaggagccuagcgugacucagauuuccagcuugagauugacuagugcaaaaaagcauugacauaagcaaagaggaacaaaguuuuagagacaugacguuuugauuccuggcaagcagagaugaucucuucuaaaacucuggguuauuugaccaaaugagaugggcuguccucucauuguuaucugaacgucuguucuuguugggagccgcccccacauucgccguuacaagauggcgcugacauccuguguucuaagugguaaacaaauaaucugcgcaugugccaaggguaucuuaugacuacuugugcucugccuuccccgugacgucaacucggccgaugggcugcagccaaucaaggagugacacguccggggcgaaggagaaugcuccuuaagagggacgggguuuucguuuucucucucuugcuucuugcucucuuuuccugaagauguaagaauaaagcuuugccgcagaagauucuggucugugguguucuuccuggccggucgugagaacgcgucgaauaacaauuggugccgaauuccgggacgagaaaauccgggacgagaaaaaacuccggacuggcgcaggagggauacuucauuccagaaccagaacugcgaaucaagguuauaagguucccguaacacagacuguugagaaggauucaacugccgaauucagaacucaucagcuggggaacgacggugauaaagguucccguaaagcagacuguugagaaggauucaacugccgaauucagaacucaucagcuggggaacggaagugagaaauggcuuuaccagguauguuuggccuugaacuuuuucuaguguuaggagcccuuuuguuccuuuucacauguuauauagugcuuaaggcagggcuaaaaauucuagaggaaauucaggacagucuaucagaaguaaagcggagagagagaguaggagcaaggagaaacgguaaguauacaggccuuuccaagggucuugaacccgaggaaaaguuaagguuagguaggaauaccuggagagagauuagaagaaaaagaggaaaaagggagaagaaaaaagaucgauuagcggaggucucuaggagauacucgucacuagaugagcucaggaagccagcucuuaguaguucugaagcagaugaagaauccuccucugaggaaacagacugggaggaagaagcagcccauuaccagccagcuaaucggucaagaaaaaagccaaaagcggcuggcgaaggccaguuugcuaauuggccucagggcaaucggcuaccaggugcacucccgcccuaugcggaguccccgcccugcguagugcgucagcccguagugcgucagcaaugcgcagagaggcagugcgcagaaaggcagugcgcagacucauucauuccccgagaggaacaaaggaaaauacaacaggcauuuccagucuuugaaggagccgagggugggcguguccacgcuccgguagaauaugugcagauuaaauauggaaucaaugcuaauuuuaccuuggugcaguuagacaggcuugccagcauggcacuaacuccugccgacuggcaaaugauugcaaaagccgcucucccuaauaugggcaaauauuuggaauggagaucucuguggcgagaggcugcacaggcgcaggaccgagcaaacgcugcugcuuuaacuccagagcagagagauuggacuuuugacuuguuaacgggucagagagcuuauucugcugaaccugauaagagguaucaauggaaggucuuaccacagggaauguccaauaguccuacuaugugucaacuuuaugugcacauggaugacauccuccugugccauaaagaccuuaccaugcuacaaaaggcauauccuuuucuacuuaaaacuuuaagucagugggguuuacagauagccacagaaaagguccaaauuucugauacaggacaauucuugggcucugugguguccccagauaagauugugccccaaaagguagagauaagaagagaucaccuccauaccuuaaaugauuuucaaaagcuguugggagauauuaauuggcucagacccuuuuuaaagauuccuucugcugaguuaaggccuuuguuuaguauuuuagaaggagauccucauaucuccuccccuaggacucuuacucuagcugcuaaccaggccuuacaaaaaguggaaaaggccuuacagaaugcacaauuacaacguauugaggauucgcagccuuucaguuugugugucuuuaagacagcacaauugccaacugcaguuuuguggcagaaugggccauuguuguggauccauccaaacguauccccagcuaaaauaauagauugguauccugaugcaauugcacagcuugcccuuaaaggccuaaaagcagcaaucacccacuuugggcaaaguccauaucuuuuaauuguaccuuauacugcugcacagguucaaaccuuggcagccgcaucuaaugauugggcaguuuuaguuaccuccuuuucaggaaaaauagauaaccauuauccaaagcauccaaucuuacaguuugcccaaaaucaaucuguuguguuuccacaaauaacaguaagaaacccacuuaaaaaugggauugugguauauacugauggaucaaaaacuggcauaggugccuauguggcuaaugguaaagugguauccaaacaauauaaugaaaauucaccucaagugguagaauguuuaguggucuuagaaguuuuaaaaaccuuuuuaaaaccccuuaauauugugucagauuccuauuaugugguuaaugcaguaaaucuuuuagaaguggcuggagugauuaagccuuccaguagaguugccaauauuuuucagcagauacaauuaguuuuguuaucuagaagaucuccuguuuauauuacucauguuagagcccauucaggccuaccuggccccauggcucugggaaaugauuuggcagauaaggccacuaaagugguggcugcugcccuaucauccccgguagaggcugcaagaaauuuucauaacaauuuucaugugacggcugaaacauuacgcagucguuucuccuugacaagaaaagaagcccgugacauuguuacucaaugucaaagcugcugugaguucuugccaguuccucaugugggaauuaacccacgcgguauucgaccucuacaggucuggcaaauggauguuacacauguuucuuccuuuggaaaacuucaauaucuccauguguccauugacacauguucuggcaucauguuugccucuccguuaaccggagaaaaagccucacaugugauucaacauugucuugaggcauggagugcuugggggaaacccagacuccuuaagacugauaauggaccagcuuauacgucucaaaaauuccaacaguucugccgucagauggacgugacccaccugacuggacuuccguacaacccucaaggacaggguauuguugagcgugcgcaucgcacccucaaagccuaucuuauaaaacagaagaggggaacuuuugaggagacuguaccccgagcaccaagagugucggugucuuuggcacucuuuacacuuaauuuuuuaaauauugaugcucauggccauacugcggcugaacgucauuguucagagccagauaggcccaaugagaugguuaaauggaaaaauguccuugauaauaaaugguauggcccggauccuaucuugauaagauccaggggagcuaucuguguuuucccacagaaugaagacaacccauuuuggguaccagaaagacucacccgaaaaauccagacugaccaagggaauacuaaugucccucgucuuggugauguccagggcgucaauaauaaagagagagcagcguugggggauaaugucgacauuuccacucccaaugacggugauguauaaugcucaaguauucuccugcuuuuuuaccacuaacuaggaacuggguuuggccuuaauucagacagccuuggcucugucuggacagguccagaugacugacaccauuaacacuuugucagccucagugacuacagucauagaugaacaggccucagcuaaugucaagauacagagaggucucaugcugguuaaucaacucauagaucuuguccagauacaacuagauguauuaugacaaauaacucagcagggaugugaacaaaaguuuccgggauuguguguuauuuccauucaguauguuaaauuuacuagggcagcuaauuugucaaaaagucuuuuucaguauauguuacagaauuggauggcugaauuugaacagacccuucgaggcuugccaucauucaggucaacuccacgcgcuuggaccugucccugaccaaaggauuacccaauuggaucuccucagcauuuucuuucuuuaaaaaaugggugggauuaauauuauuuggagauacacuuugcuguggauuaguguugcuucuuugauuggucuguaagcuuaaggccuaaacuaggagagacaaggugguuauugcccaggcgcuugcaggacuagaacauggagcuuccccugauauaucuaugcuuaggcaauaggucgcuggccacucagcucuuauaucucacgaggcuagucucauugcacgagauagagugagugugcuucagcagcccgagagaguugcaaggcuaagcacugcaauggaaaggcucugcggcauauaugagccuauucuagggagacaugucaucuuucaugaagguucaguguccuaguucccuucccccaggcaaaacgacacgggagcaggucaggguugcucuggguaaaagccuguaagccuaagagcuaauccuguacauggcuccuuuaccuacacacuggggauuugaccucuaucuccacucucauuaauauggguggccuauuugcucuuauuaaaagaaaaagggggagauguugggagccgcccccacauucgccguuacaagauggcgcugacauccuguguucuaagugguaaacaaauaaucugcgcaugugccaaggguaucuuaugacuacuugugcucugccuuccccgugacgucaacucggccgaugggcugcagccaaucaaggagugacacguccggggcgaaggagaaugcuccuuaagagggacgggguuuucguuuucucucucuugcuucuugcucucuuuuccugaagauguaagaauaaagcuuugccgcagaagauucuggucugugguguucuuccuggccggucgugagaacgcgucgaauaacauguucucugguuucauuguuccauaagaaauaacauucuugauccauuuuuccagucuuuacuuauuuuacuuacuuacuccuaaagagauagagguacuuaaauacauuugggguauaaacuacauaaacccauaaccgccuuucuuugccuccacucuccagagcgaguccacaaguauaaugagcauguugucuguucuuugggauaugcucucugcuccucugugguaaaggcccccuauagguuauccagauaugcccaugauuggaauacacacuugacuggagagaaaaauuacaacaaggccauucaacaaccuaccuagaauggcauuaugcauuuaguucuacaaaugguuuuuaaaaaaucaagauauuuguuuccuguuuccugucacucccuugcuuuggaaucuugaagauugaggugguuaucugucuuucaaacuccaacagugugcaguuuuuguuccucauuuaaucuguauaauaaaguguuuaaaacacaagaaaaucaagaagagggaaaaccaacgguggauacuucauuccuccuuagaauugggaacaaauuacccaugaaaggaguuacagagucaaaguuuggagcuaagacgaaaggauggacuauccagagaccagcccacccagggauccaucccauaaucagccaccaaacccagaaacuauugcauaugccagcaaaauuuugcugaagggacccugguauagcugucucauaugaggcuaugccagugccuggcaaauauagaaguggaugcucacagucaucuauauaagaugguacacagggcccccaauggaggagcuagagaaaguacacaaggagcugaaggggugugcaacccuauagguggaacaacaauaugaacuaaccaguacccccggagcucguguuucuagcugcauauguagcagaagauggccuagucggccaucacugggaagagagaccccuugguauugcaaacuuuauaugccccaguacaggggaaugccagggccaagaagugggaguggguggguaggggaggagggcgggggaggguauaggaaacuuucaggauagcauuugaaauguauauaaagaaaauauuuaauaaaaaaagauaacccauucuagcuacuuguuucucaauuuuagacaguuaacaaaaacugauuucaaacuuauuuuucaacauagcaaaaaaaccaacauacaaggccuggagagaugacuuaguaguuaaaaucacugugugcuccuccagagguccugaguucaaucccuaguaacuucaugguggcucauauaaucuauagugugauuugaugcccccuucuggcaugcagguguacaaggagaguacucagguacauuaaauuaacaaauaaauaaauauauauaaguaaacaaaccuuuaaaaauacaacacacauuuguaccucucuuuauacguaauauuggaaucauaauggaccuaucuauaucacaugguuguuccaaggauuaaaguauaggcugcaaguauaacccucuguaacauauuaauaaaggauauaguuguugcugagucugagugcucucuuucucaagagugugaaagucuguaaggugaauaaaagaaaaaaccaaaccagaauaaaauuguuaagauugguacuacauaugcauaugaaauuccuuagaucauauuucuugaguugagacuuguggcucacuacucaugaaguacaucuaugaguuuccagagucaguaguggggaaagagucuggaaaaaauaucuccuuuggugagaaacuuuaaccacagacacaucucucauauaguugaccaugaaaaccuuucuacuaagagcauuucucauagaauaaauagugcuaaacaauaggguguuugacuaagaggaggauaaaccaggcaguggugccacacaccuuuaauccuagcacuaaggagguggaucucuaugaguacaaggccagccugaucuacagugaguuccaggauagccaggguuucacagagaaacccugucuuaaaaacaaaugaacaagcaagcaaacaaauuaaaaaaaaaaaaaaaaggaaaaggguagacuccugguuuaauaugacaccuuaauuuauuagaagcucuaaugguaaauucuacacugcauuaagucaaaggacuucaaauacuuugcucuucccaucuuuccuuugugggacacacacauacacacucauauacuaauucaccuuuaacucuuccguaagucuaaaauccaauuugagcacucucucagucgauaguuuucuccgauagaauccucaccucugcucaccuaaguaaggcaaauaauaccggacacagauuauguaucaggcagugguucuacaaguugaggguuucauuuuauuauuauuauuauuaaauuaaggacacaguuucuaauucucauggaacgcccacuggaguuggaaagaaaugugacaaaaaaauacaaugcuuguucaaaagcaaaaugcuaugaggcauuaaaaaugcuauagcauagaggagacagagaaugaaguauagcugcuuccuuauauucaagagggaaagcaucgcuuauaaaguaacacuuggguaaugagcugaaggaaggauaacaauaagccaugaccgcguccauauagauauuccauacaaucaacaacuaauagcaaaacccuaaaguaggagcuacuuggcaauucaugaaagacagcagggcaggacugaaaugagcugaggagaguggaugcugacagccuaaguaagacauuacggagagaaggaaauuacccgugcuguuauauaccuuugcuuugaaauggaagaucgaucuggugaaugugaccggauuuacauggcugccuguugacuugugaaaaggcaaaaggaacacagugauuaaugcccaaaaaacaagacagaaagauuuuccaaaguucccagauaaaagauguaaauggccaaucagccaugaaaguaacacaggaaaguaacacagggaagagaacaagaagggccuugcuuuaaaaguauauuuaaauagcauguuggugcugaauuagagaauauacaugaauuggaauaugcuuauugcugagcagugguggcgcacaccuuuaaucccaacacuugggaggcagaggcaggagaauuucugaguucgaggccagccugguccacagagugaguuccuggcuacacagagaaacccugucuugaaaaaccacaaaaagaaagaaagaaugaaauaugcuuauuaaagauaucacuaguauacaaugaguauauguaauaaaaaagcucuaaaaugaauaaagagggggcugacuuugaaacuauuugguuucaagcuaccuuaucauccauaaagauucguaaggauauucugagcuuuuggacuaauauccacuaucagugagugcauaccauguguguucuuuugugacuggguuacaucauucaggaugguauuuucuaguuuuauccauuugcugaagaauuucaugaauccuuuguuuuaacagcugaguacccaagauacaauucacaaaccacaugaagcucaagagaaaggaagaccaaaguguggguguuucaauccuucuuagaagggguaacaaaauacucaugggagcaaauauggagacaaaguauggagcagacacugaaggaaaggccauccagagaccuggggaucuaucccuuauacagucaccaaaugcagacacuauuguggaagccaagaagugcaugcugacagagucugguauagcuguuccuugagaagcucugccagagccuggcauauauagagguggaugcucacagucaacaauugaacugaucacaggguccccaguggaggaguuagagaggacugaaggagcugaagggguaugcaaccccauagaaagaacaacaauaucaaccaaccagaccgcccacggucuaaaccaccaaccaaggaguauacaaggagggacccauggcuccagacacauauguagcagaggauggcccugucaggaaucaaugggagaagaagcccuugauccugugaaggcucaaugccccaauguagggaaugugagagcagggaggugggagugaguggguggguggguggguggauggagggaaaacccucauagaaaaaggaggaguaggaugggauagggaguuccugggaguagggaaucaggaaaggggauaacauuugaaauguaaauaaauaaaauauucaauaagaaaagauucauaaggauacuacagcauuuuugcucaugagggcaauauuaaguugauauuuaguauauuaaaaucaauacugggcuauauauauaauguacaugcacagaugaacguuccauuagucaccagaggcuacacauacuauauagcuucuauagcuucugaaaaacuuugcagucauggaaaaaaaaaaaagcaaaucacuguuguacuaaaggaaaguaguuaugacaucacagacuuugagaguguuacagaugaccaagcaagcuguagcuuaugcugggagcugacuucugagacagugaacuguuggacugaauaugggauguagaggaagaaaugaaugacagauggggugugacgaauaugaagcuuagcacuguuuucuuuaaaagcuuguugggcagcccacuaguauuucgcggugccuuuagaacaugaggcuggaguucagcgagguggugaggguuagauauauaaacucagagcauuccauagcuuuucagguuggacaugaggugaggguacauaugggauggagaagaaaggggcuccaaggaugacucccgggagcuugagcaaugaauuccacuaaugaaauucaaaaaagcccccuuagugcacaggcucccaaucauuaaaggguuucuuagagugcagucuauauuuuagucuuugucacauuaaaaaucauuacuuaaucugcccagcauauggucaguauucaaauauguauuggaaaugaauuaaucaagaauagugcauacugggauucucucauugcugaauucugggacuuucuaaauuggcauagaaaaugauuagcuucagguuccuauauuagguuuacuguucacugagucgucacguuaguucaugugacuguaguggcaaaaguaauuggaaacuuuacaauuuaaccagagcaaucaacaaguuaccuaacaggaaagauggaauuagauuucaaauuauagucugccaccugugacauuaaagaaauaaugacaacccuacuuucuagacauuuuaccuuuuucaaggaaaaauuuccuagaaaacucugucaucuaugcagacaaccuagagaggugcucuaggguaaaggcaugccaaaaagaaaaaaaaggaaagccauccagugacaucuuuauacacauugaaagaagaacagugaauaggagaaaaacucaacgcuaaugccauggugcaauccaugggaaucuagaucauaguaauuuaagaaauuaauuuguuaaaaugcauguuuuuaaucugagaaaguauaaauaacaaauaguuacccuuugguuuuacucaaacucccaguuucugugguucauacuucaugaggcuuucguaugcuaauguugcuaagaaauaagaugcuggacaucaugaccauuccucaucaauguucucucugguagauuuagaugaccaagagaacucagaaaggcucucagauauguacucuaaaaucugacgcugugauguuuacagccaauauauuauugauagcuacuucccuggcccucacguugcugaacaacaaacagaaggucagagagguuaugcagagggugugugauggaacacacccucuaucaauuauaagauaaagguaccaacaggcaaaauuuugagugguccuccaugaguuuccucaauauaaccuaccuuggaaaacuggguuaaacauacacacagauaguuuccaacuugcaaugguuugaaugaacaacuucugaauuuuuuugaauggcauaaaucacccauuagaaaccauagcuagaauuuugaaucuucaucuauuuccaaacaaugauguacgcgaugacccucucucaagagaccaggauguggcagcaggucacaggucugagucaguuacuuaugcacgccuccugcuaagcuguauaguucccuaggcuugacguagucagugaaguuuugauuucuauuuuccauuuaaagggguuaucagucuguuccacacuguaaggccaggaccuugugcgcuagccuucagaugaauuuaauugguuuuggauggagcuuaacuauuuuuuagaaaagcuccuuagggaauccuaauuuguggagaauugcugauguauugguagguccaacagacuucuuuuuuucucacuuuuucuuucuaaauuuuaccuaugauuauuagguuaauguugauuggcaaccaucucuucuagcccagcuuuuguuuuaagacuucaaacaaaggacacaaccucuguguuucccuccuuugggcuauaaacuuuggcuauccauguuucugcucaucuuucuuuuuuccaguccauuauucuccucucaaacuucaucccucuggaauaugaaugcacaaccuugaucauuuucuccccaaugagcuaauuaacauuaauagaaagauuauugacauugaggauucagaguucuuccagucaguggcugugucacauugagaaaauuauucaaccucucuaagacucaggcccaauuauuaaaauaaagaaaaaguaccauuuucucauagcauuuuuaugaaaaauaaaugaaauauaugcucucuauauaauagaaaugguuuaauauucaauaauaaacauuuggagacugcucuuuugaagaccuuuuguucuuuugauccuuuuggucuaauucauugcaauauucuguuuucccccaauuauaugacuuggcuuuuuacaugcccacucuugcuuuuaauuuuaagauugaacauaugcauuccauaacccuacagugccgagggaaauauuauucuagacuuggcaagaguuuucuauaaucuugguucagaauucuauuaaauaauggcagaaggagaugacauuuaagauaguuauuaaaccaacuuguuguuagcuugcugagaacacacaaagucuagcagaauauccuuuagguugacaugucaccuaaucuaaccagaguccccucuguucaagucuauccuuaucucucuuaauauaguucccaaacacuauucagucucuccgaauuauucuucauucuugauacccucauaucuuggauagcaaagcaucugucuaccauggauacuuuauccagggucucaucugcauucagcacuacagaaauaaaauaacauauuauuuuuuuugaacaaucacuauuacauaagugcacaguuauauuaacauggauuuucuuaaggauguaaaauaugugauggagauguaguucaguaaaagaacucuugaccaauaagcccaagaccuugcacucaaaaccuagcaccugaaaacaaagaaauccugaaagauguuuugcuaugacauaaagacgagaggggaaauuauauguuuaucgcauacagacaaaaauaguuggaaaagcuguuacuggaccaccaaccaaagaauacacauggagggacucauggcucuggccgcauaugugguagaggauggccuuguuggacauaaguugaagaagaggcccuugggccugaggguguuugaugccccaguguaggggaaugccaggaagggaagacaggaguggguggguggguaggggagcacccucauugaggcagggguggggugaugguauagggggucuccaaaggggagaccuggaaccuggaaacauuugaaauguaaauaaagaaaauauccaauuaaaaaaaauucucaacaagccaggaguaaccucaucccuaaacaaaaguucaugcuacccguucauguugacacaauaaauucuuucucccacagguaggaaacaaggcagagauuuuuagaguugccacaucaucauaugauuucuacuggagucauaauuagaagaaaaggaagaaauugcaugaauuuuauaaaagcaaaggugaacugucaugauccuaaguuaacaucagagagcccuguggaaagcacuguuuauaccagcaaaaccuaggcccucugcacugcugugcagcuugguguucuugggggacuucuaacagugggaacaugggcugucucugauuuuucugcugccuuugggacuuuccuccuacuuggaugcccuguccagccuuaauacaaagggaggugcccagucuuaaugcaacucgauaugauauauuugggugauaucaauggggaagccugcccuuuucagaagauuaacagaggaguggauguuggggaacugaagggaguugugguggagguacugggaggagaggagggaggggaaacugaugucaggauguaaaugauaauaauaauaauaauaauaauaauaauaauaugaugaugaugaugaugaugauaaaagcaaaaucaacuauaaccuaacacacaacauaaaauuuaauugauuuuuuaaguaccaacaacauuuaggaauaguaaaaauaguuaaaauccaaaaaauauuauuuaucuuagugaguaaagucuuuaucuugguagucaaaaccaaaucuugacuccuaauuaacauauaagauagccuaaguagauuauaaaccugaucuuagauuaaacaugauaaaaaaaaaaacuucuacaauaaaaugugggagaauauaucauauaccagacaaaaaacaaguaacuagaaaagaaaacuaaaauuauauucaucaauaguacacauaauaauguguagccaaauuagagacuguaagggaauagucacaauacaugugucagccaauggauucaaaucuuugggaguuacaagagaacguaugcauuaguacucucaaccaaaaauuaaaaaguuggaaaauuccauuaaaaaugaagagaaguauguacaauagcaacagaaaaggcacuuaaugucauuagucaccagaaaaauuuaaaccauacugaugaaucauuucacguucauaaggauggcuaaaauaaaaaugaucaucaaguuuagcuguagagaaacuaaaauugucauauauugcuauuggugguuauaaaauguagugacugcuuuaaacuaacuauaggaaaguuaauuauaaaauuaucuaccuuaagcugaaucauccaacucaugaaaacguauaaaaacauacaaauguauuucauguguaaucgugaacaacacaacucacagcaugcauaagaccuguaaagcucaaacucgcuaaaaauucuaauaugaaguaggaagggcuccuaugucccuacugcuaugucccuauuggcuggaggagggaggucacuuuucucuggagggugagcacuaguagguuacccaugcuccaauggaugacaccacacacucaugcauauaugagcagcaacaacuggacucaguguuauuuuauuuaugugugugugugugugugugugugugugugugugugugugaaauugggaagaagauaaauugggggauuaagagaguuguuugggggaaggaagcggggaauggaucucaucaagaaacauuguacacaauuuucaaagaauaaauuuaaaggcagaacaacuacaacaaaacaacaaacaagcuaaaccaagcucuaaucaacaggaaagcaaagaaacaaauuguaguauauuaauccaauggaauacuauucaguuagaaaaaaaaaaaaacccaguaacuuggguggauuucaaaaggauuccguuuacauaaaaucuaauaauagauuauuuuaaucugcagcaugaaaccaacaugaggcagaaaugagggagauuuccugguaagggccaggaggaaucucuggagugauggccaccucuccuuucugcuuugagcaagauuacacccacaggcacaccagacuuagugugaaucuguucacuuaugaucugugcauuuuauuggaaggguuguaaggcuuuuaccaugaaacauuaaaaaaauaaaaacauuuuacuucuuuuacuuaacauccuccaaggucauauaugucaucaacaggacaugauugucuucauuuguaugguuggaugcugcucuaucauguguauagacaucuuuuuuucuauccauuucacucacugaaugaauccuuagguugguucucuauguuggcuacuuggacuaacguugccauagcacggaacacagaucucucauuacccaacugacuuuauaucuacacccagucagagagcuauggaagaauaugguaaguucucuuauuugguacucaaaauuuuagcuuccaaggagcuuccacacagaucucuauaauagcuacauuaauuuacacuucuacucacacuguacaagaguccagguuaucuuugccaaugcuuaucauucccacucucucugauaauagccaauuuuaaaggaauaaggugguaucugauuaugauuuuaauucgcauuucccugacaauuagugaugucaagccagacacagaaagguaacuguuguacaauuucacuuuucuauggaauacaagaauaaauaaucucacugauauacagaucagaauaguggguaccaguggccaggguggguagagauaaaguaguauugaaagaugcuaaucacagauaaauauuuauaguuagauagaaguaaguucaagaaagcuuucuagaccauggugacuauguaagugguaacauauuggauacgcaaugcuaaggcagaggaugcuaaauguucuuaacacaaaaugauggaagggaaggcauuuauuaacgacauugguuuucuaccucacaaaguauuuauucgucuaaauguacuacuguagauuauaaauacauacgauuuuauacaucaguuuaggaacaaaaagucaaauuuaagcaauauguaauuauuuaguggaaagaaaauuggcaugucaaugcacccacuuaauuuuucaaaagguuuuucuuucccaaguauuuuuaaguguaaaaaucauucauucuauucuuuucagguagaagucuguggguuauucuaaacagaaaaacucagccucguagguuaauauuuucgagggaaacaaagagaagccaguaccauauaaauauuucaguucuuauuaauuaaaaauaggauguuucacaaucuggaggcuuuuaagacaugaaaggacccaaagaaauguaggugaggagaucaaacaguacugugaaaccagcagcugcgacuuagguaguuaauaaacaggcagagcaaaaacaacuucaguagaagacucuggaaagucugaggcuugcagguaauuaacaugcuaaucagaacaccugcaaugcugugucucucucucucucucuggaagcaaggguuccaugguugcaaaggauucucuccauauagacuuagaauccagacuuagcuggguaaagaugugcaugaagccaaggaaauaaguggucuagcuccugcuaccuaagcaacauccauuuucugugaauagggucaaguuuacccuccagcucacauguucacauauuccucccauggucaaagaaugcacaaggaaggaaauacaaauugauaagguuugugucuuaguagggguuucuauuccugcacaaacaucaugaccaagaagcaauuuggggaggaaaggguuuauucggcuuacacuuccauacugcuguucaucaccaaggaagucaggacuggaacucgagcaggucagaaagcaggagcugaugcagaggccauggagggauguucuuuacugacuugcuuccccuggcuugcuaagccugcucucucauagaacucaagacugccagcccagagauggcaccacccacaaggggccuuucccccuugaucacuaauugagaaaaugccccauagcuggaucucacggaggcacuuccccaacugaaacuccuuucucugugauaacuccagccugugucaaguugacacacaaaaccauccaguaaaguuuguauauauucuuuaauuuuaaagcuuauuuauuuauugauuuugugugugugugugugugugugugugugugugugugugugugugugugugugugucugugugucugugugugugugcaugugggggucagaagacaacuuuugggaaucaauuccuuccaccaucugagaacugaaucaaaggucucuuaccucuaguuuuaaaaguguaacucuaccucaacuauguuguugauuuauuauuugugcuaagaauguagcucagugguagaaccauuucauaccaugaacuaggccaugccuuugauuucccacuuuaaaaaaaaauuguuaguaaauggauccaaagugcuuaaauacccagagugauucuaaccagauuucuuauauuuccagacacaaaccuaaaaucacaaaugcuuuagaggauuaacucguacuuacaauauagguacuuauauaagcuagccaauaaauaccuuuucuuuagaacaauauuucaucccugacuauggcuauuugaaugcacacuggagacuucuguuccaccaucuauccaucauucuugcagagcuucugguuuccaaacccugucuugaaacuagcagucuuucauuaauuugauguuggcuauaggcuugcugaauauugcuuuuuuuuuuuuuuuuauguuuaggcaugcccuuuguaucgcugaucuccccagaauuuuuaucaugaagggauguuggguuuugucaaagacuuuuucugcauauuaagagaugaucauaauuuuucuuucaguuuguuuauaugguggauuauauuuauugauuucuguaucuuaaacuauccgugcaucucuucgaugaaguuuacuugaccauaauagaugaucuuuuugauguguucuuggauucuguuugcaaauauuuuauugggcauuuuugaaucuauguucuuaaguacucucuuauauauaauagucagaaacuggaaacaaucuagauaucccucaacagaaaaacugagaaagaaaaugugguacauuuucacaauggauuauuauucagcuauuaaaaaauaugaaaauuucaggcaaauggauggaacuaaaaaauauccugacuaagguaacucagacuuagaaagauaaauauggcauguauucacuuauacauggaaauuauccauuaaauaacugauaaccaaccuacaaucuauagaccuagagagguuagcuauagaggaaggacuagagggagaacacaugaaucgaaucucccugggagagggaaauagaauagauuuuacaaagggacugagggcaaguggggaugugaacaagaggaucaggugaggaggagaggggagauagagaaggggagaagacagguagaauugagaggcauuuaagggaugauaucucuugucacuaaacaacgcuucaggacugaauugaauuguuggucuaaagguccaugaaaauccucaaacaacccagguugcggcuaagacagugaguuucucuuuccaaauugacagugaggucucauuaccaaagauaacacucacacaauucacugaacauggaaaauccagcuggugccuauauagaaccuucaugacccugugcucuagugccuuuggaucagaaagguacucuucaggcuaccaaaagagaaauguaaacaccaccucagcccccaaaccucuaacauacaacccguccugccugcaacauauacuaagcacugguggcauagaacuugugggaguagccaaccaaugucugauuugguguaaggucuacuucacaagauggaacccauacccaacccuguuuggaugaccaagaaccagagauuagauagcccagagaccugggucaaaacaaacaccacuggucuaaaaaacaguaucauaaaaugacucuuaaggauauucuacuauacuuauagaucagugcuuugcucggcagucaucagagaaaauucuuccuccugcagauaagacacaugcagagacccacagccagacauuacaaagagaaaggucuuggaacacauagcuccaaaugggaugucaccaucaaaucccuccccucagaguucaggguggcagaaagaguguuagauccaaagagaauggagagacaccaggagaacaagcccucuaagucaaccagcaaagcucauauaaacuuaugaaguagcugaagcagagugcacggggccuauacauacauguccauguucacgugaacauaacauacauaaaauaucucuuagucuaguauucuuaugggacuccugaaagugugaaacaguggaucuuugauucuuuugucuucucuuggguucuuuuccuucuguucauuugucuuguccagcccugauaguuucuguuuuaucuuauauuucauuuuagcaugcuugguuguuaucucuuagaagccuguucuuuccuaaugagaaaggaggagaggagggaggggaaacuauaaucaggauauauuaugagagaagaauuuauuuucaguaaaaggaaaaaaugagggaaaaagaauauaaaugaacaaucuuaacccguuauucuuucaugauuauguccaugugaauuuuauauuucugucuacaaugacugaggacuaaugagccccaggaaucauaaggggaacagaacaggaguagacucaagguacaauuucugcuagcucuaguuuucuuaaaaguuuucaaauaucccauccugaacuaauaaguagagauuacuuuuuauuuuuuugaaacaagguuuuacuguguaguucaugcuggucugaaauucacuaggcuauccaugaccucagauccuucugccucucaaguacugggauuaaagguguguaccacccaugccugauaaaaguuuuggauuuuguuuaauuuucgcuaaaagauaauuauagcauuuuuuccuuugucccuccaacccucccauaaucucuguuaagcccccugaaaucuaucuccuauuuuugaauaauuauuguuguaacacaccauauguguguguguguguuuguaucuguaugcaaugugcugcuuucacaucuuguugcuugcauguaaaucauuucaggguggaucacuuggugcuggauaacugacuaggggucuaaucccuggggaagacuaauucuuccucucguuugguggggaauccuuacccaguaucucucaagaaucuguuuuucauucaggaaugacuaagaaaauuuaaauuagaugguuuauaucaugauuaaaaauaacgaauauuuaauaauguauuuuaauaacauauguugaacagcaucuuagauaugugcauaagaacaaaugguuuuaauguaagugcuggaauuguguuaaguacauagccauaccaaagcccuuggauagagacugagaagcagugagcacaaguguggcacccaccauuggaauccggguuugguguuucuugcuucgaccaaguagacugaggugggaugcuugaaaacauuuucuuacucugcagacugagguauuauaacguaaccugugccuaaacaacgcuacauguguacauuagguugucaaaaagaugacucacacagucuccugaggagauuuuaaucacugaauaggacuggaugaaauagcuguuauaguaaaagaaagcaaaggagcucccuagaagguagccaguuucaacccauuagaaccccaguauguuucaacuucagccuacaacuucccugggaaucaaugauguuuaaaugaaaucauuuauacaaaagccuucuacaaacuacacugggauauggaguugaaaugcuauugagaaugagacugucauaaaauaaucuaaagcaaguuauaagaaagaaugcuauuuauuaaagcaauuguugcuugcauagucauagauaugacugcacugcagccuggcuucugggucuauucguguucugugucucagcaaugcagaaaggcauugauuggauccuaaguacccccucucuuggauuuuaugaagcccauucagaaagagccagguugagaacaccaccaauuccauguucuagguccaucuguuggcaaaaauauaaugcaaacagcuuuauaagugcuauuuucaaugaaauaucacagaacagcuugucccaaugauauuucuaaagcuugccugcaaaccgccuacugggaaauccgacagaaagagaagggggaugaggggggaaaacauucaggcaagugacaggaaugggaaaaagaacaaaagguaaaggcagauuaccaagaccgugaaccccggaggacaauacagagacuggguagugugguacccaacacagggguggggcaauggagagcaacugcaucagcucacugggguuggggauagaaaaaccagcacaaacagugugcccacagaaagcuucagaacacaguagcagaucaacaaccacagccucauaaaugcucagaggaaaaugugaaacagccauuuuuccaggcuucauugaaucccucucauaauauaaaaguucauuuuccaagagcuaauagagagugcagugucuauuaugaacuucauaggaagcaaacagccuauuuggaaucucuuucucuuaauguaaaaaaaucuauucuauauuacauaauagccccagcauugaaguacaguguuuuacacguauuaguucagaaccaagcaaccaagcguuacagagcaggcaauguccuccuggguacuuacuuaccugaggucggauaacuuuuacgauauuuuuuagggcaguaucuggggauggaggugagcagucagguguugggccuguagagcuguuucuauggugacuaguuccuggagcaguaauugcuaccucagaggcauuaucugugaacaaaaauagaacugccaugaacuuaaucagucaguuuaccccucaagacuugaaauuauuuucaugaacaugagaugauauuucaacuuaaagcugauaucaauuauaauaucauaauuaagacuaugcucagugguguauuuuuuauuuaaaaauacugauuguucuguuuuccuucaagauggugaauauuaaugcuuguaguguaauuccugaaugaaugagcaauauucaguuuauuauaaugacaucauccuccacagccccuaauaccaccaucaucacuauaugaaaggccaucuccuuauuugaaaauuaauaguuuugaaaugaugaaacuggccaacaaguuccaaucuuucuauugaaagcccauuuuuauuauguaggaauuucauaucuacuugauuccuaaaauccaaacucaagccccuaagauaacuuugcccagauagcccuagaucacagaacuuuuaauuaaaaaucaaaccugacauuuguauaggacauaaacaaacacuauuaucccuagaaggcaaucauauaaaccacuauguucaaaauuaaaaugaaugaaauuucaggaucuaaaugaacuucccuucuguuuucugcuuuggggggggggagggggagaggagaauaaaaacuuuuaaaagaauaacuuggaauucuacauuucccuuuuuaauguaaacccaaauaaaauaauauccaaggaacaguuuagaaauaugugaaacucuuugaaauggauagaaaauaauauaauauugguuagcacaacaggaaguuuaucugcuuaauaauaaaccacaaucuuucauagcuuugaaugaaaaucacugcaaaugugaauccucaagauguucacuucuguuaugcuuucaguucugucccaauaauuuuaugucccauacauauaaacugauacaacuuagacuaagacuguauuuacuauagauaaacauguuucucuguucuaugaucauugcuuacaaucccaaguaaaaagaaauaauuuaugaaggcacuuuguucauaaaaagaaaggauauuaauccccccuaaaacuguguccaucagauaaaauuauauuucagagccuuaggaggugguuuagucaguaaagugcuugcugcuuuugcaugaggauugaucucagaucccuaacaucuguguaacagcugggguaauggcaugcaucuguaaucccugcccuggggggaaaaagggguuccugcagaucacucaccaaccagcuuagccaaauaaaagagauucagguucaguaagagaccauguuucaaaaggaaagaggaaagugauuaaggaggaaacuggaagagaaucucuggucuuaacaugcauguaugugugcauaugagcauauaucacuagcacacaucuguauaagcacacgcacaacaauaucucucucugucucucccucucugucucugucucucugucucucugucucucucucucucucucucucucucucacacacacacacacacuauagucucacuggggaauaaugagacaaaaaauucaaaugaggcaccuuuagauaaaauggucauucauuaaaaaaaaaaaacaaaaaacaaaaaaaaaaaacacacaaaaaaccuugaauuuuccaggguacauuucuuuucuucucuucucuuuuauuuauuuacauuccaguagcugcccccucucagucccccuuuccauaguuccucaucccagucccccuccccaucaccucugagagggugcuuccccccauaccucccccuucccuggggccucaagucucuugagguuuaagcacaucuucucccacugaccaggaagaccucugcuauauuugugcagggaccucggaccucuguaugauccagagcacauuucuuaaauuuaauagaugcugugaacuuacuggcaucccaggauaaguggagcaauauucugaguagauaaacauugaaaucaaaaaaucauuauuuagcaggauaaaagcaaguuguuugauucucuccuuucagcuuucauucuuaccauucauucaaccauacuuaaaaaaaaugggucagggacaccuaugugucaagcaucaugcuauaucauaaagauagacauaaaagagucuugccagggucugugaaaagaaugggcaaauaggcaaaacacagaggacuuuuagagcagagaaaguauauccuguaggcauaauguggguggauacaucucauuauacauccauccacaucaaagaugugcagcuccaaaggugagcccuacacuaaacuguaaacucugcaaugcaggcucaucucuuacugcaaaugcuccauuccagugagggaugcugagagugggugagacacacacacaggggaacuaugggaguuuccuguauuacagugagggaugcugagaguaggugagacacacacacaggggaacuaugggaguuuccuguauuacagugagggaugcugagagugggugacacacacacaggggaacuaugggaguuuccuguauuacagugagggaugcugagagugggugagacacacauacaggggaacuaugggaguuuccuguauuccagugagggaugcugagagugggugugagacacacacacaggggaacuaguuuccuguggaucuauccaguguagucuaaaacaucaguuuugccaauagauaauuuuucauuucaaaaauaguucugugauauauugaauauguauagagaaagaaagaaauuaaagaugacuaagguccuagccugaaguccuaagaguauauagcugguauccauagccaugagcaaggcuguucaaacauucucuccuuucuuuauugcuuccaauacugcuucugcccuuuuucuggugccuuuuagacuccaaugaaauuauauuagcuagaaugcuuagcauuaucauuauuaguauuacuaauucauuuuccaugugcuauuguucaugcugucucuguauugcacucagaauagcuucuuauauuuauuuuccagauaauuuuuucuuucuucagcuguaccuagagcucugacaaacuacuaauuucaacuauacuuuuaaauucuaagucucguaguuauuuauuacuaaacauccaauauuagggauauuacuaaauaucucuaauauuguuaauauuguucugcuccccacaucuuuuaagguuggucuuuauuuacuugaaaguggcaaguauacauugcuuuaguguauguguuuagguagaguuuuuaacuauuuuaauuuggcauguaauaacuguacacauuuauaagguacacagugauauuucaguaucccuggacaaugggcacggacuggauaauuagcucaugagucaucgcagacacucaucacuucuucacauggaggaaagugaacagaugccuggggauggaugaacaggacaaagaacauguuuuaaaaaguccaugucugccacacgaagaccuacagagucgacuaaccugggcccaugggggcucacagaaauugaacccaaccaaagaucauguaggggcuggaccuaggcccccugcacauuuguagcagauguggucuucagugcugucucugacucaagguggccugcuaucggauuuccuuccccuagcuggacugccugguugggccucagccuuagaggauguaccuagcccugcugugacuggaugccuuacaguggggugguacccaaggaggggcuuccccuucucugagaagaagggaagggagcaauggggagacagauuuguaagggcaggguguugagaggauacaggggugcaaucagaauguaaagugaauuuaaaaaaauaaaucauggaaaaaagucugugucugauagugacaguacuagagccuguagugaucuucuguggcuuugguucucagcaccacuuaacuuucacuguucaugccuacagccauuuuauguuuucacucagguuguugaagcaaaaaccuauagcauuaaauguaauucauucucuuucuuccagcacacauuaguucaaaacagcaucuaaauuugcauucaagcucugaugcugaaaucugugaagagcaugccugugugccagacgguuuagcaaaccuuucugcugacuguguucuuuaugagagagagagagagagagagagagagggagagagagagagagagagagguguuaaagauuaucuucuguagucuauguauauagauaaaaugaaagacaacuaaccuaucugaaguuaggucuauaaaaguuuaauaaacguuucuuuuucugcuaucaaacuaaauaucauaguuaaaguguaaaagaugaaacaaauuccauagaaaaaguacgaaaauaaguagaaauguuuauacaucacauaucugcagaaauggucaugaguacuuggaguagauuugagauaauaucuuuuauuuauuaacacagauuaguauagauaagauuugguuccagaaaugagagauagucucuugaggccuuguuuugucaggguuuuccagagaaaaugagccagaaaugucuaaacaugcaaagagugccccgucaggaacuggaucagaagaucacagagccagagaggucucaagaucuguaguuguuaacuagaaacucagaggagccagcaugcaggucuacuuugaguccugagcacagaaaaccaagaaagcuauaggcuaaguucuacuacaaaggcuaauauauuucaaaucugcauagggccaagauuucagccuaacucucgaauccagcaaacacaaauucucacgcucaacccaacagucgggagcccccauuguucagccuguuugcucuguuuauuucguccaucgacuggaugaguuccacacaugaggaaagacaaauaaaucccuuuguucagucuaccauucacauguugagggcaucuacaaacgaccucacagacaaaaccagaaaaacauuuugccaagugugagcauucuaugggcaguuaaguuggcauaaauuuaaccaucauagaaacuacucaauaccucacucauuguuugaaaggagugacuccauacugaaacauaacuccauacaaagcauaaaccuaaagauccuucacugcuucuuaaauaguuuaauauaaaauacaaaacacugaguaaucauggauugaacuacuuagaaaccacaaguauaugugagaaucuucauuuucugaaucugugagcugucccuuuugauuuuauacugcauugauuuuugcaucguuuaucauguagacacacuuucucuuaucuucugugugaauccuuuaagaaaauucuuuaaggaauacuaagugagacaagaugggcaaagcaaaaucuaugccccauggauguucuaaacaacucagagaugcucugccuucucuaauucucuguuuacucuuuccagaaaaaaagcaaccaaguauaggguauucuagagaagcgguucucaaccuucuuaaugcugccaccuuuaauauaguuccucaugcuauggugaccucccccaaccauauaguuauuuuugcugcuacuucauuaugguaauuuugcuacuguuaugaauuauaauuauaauguaaauaacuaguauagagggauaucugauauaggaccaccaaagagaucucagcccacaggcugagaaccauuaauuacucuagccuauauauaaaaccuugggaaauuaauuuuaucuuaaaagaaccuugauacauuauuuauucaguuaucugguggauguugcaauauuaagcccauguccaagacaguuuucuauguucuaccugcaguugguaguaaaaauuaaauaaggugggaaaaguuugccuaaggaaacugccaaguauaccuagaauuucagguagaaaugagacucuauucagauuaaauuacuacauaauauguaauuugguauaacugucauucuccuccacacugggaagcuuagaaauaguggaaauuuauuugauauuuaacaagaaaaauaucugauuaauagaaaauagucccugugcaguuuucuggccuugcaucuguuacaccauucucuggcguguauugaaugacaguucaaggacacaaaggaugacacuagaugcuaaacaccugacaagugagauugagguuucuuccaguuggggauuuugggaaggauagcaagagguagaaguuuaucugaaagacaaauauugcaaaguguaacgucuauguggaagauaaaauguugaucgucuagaaguagcgugggguuagugguuaucagagguuuugcuggaugagggaagggagcaggugaugaaucaauacaaaguguagcugguaucaccuaagcugacagucauuuauuguauccuucagaaagcuagugcagagaaaucugcacguccccaacagaaggaaauggcauguguuugaaaggacagucaauuacccucuucgaucauuaugcacuauauguauugaaauauuauauuguuacccaauaauaugcacaguuacuauauuaauaauuuuucaaauguucuaugauguaucuguaaacuuuaugcagaaagaaaugacagggaaggucauucuaagacacagaagaagagcaaaagaaaaaaauagaagggaaaugggaauauuugcagaauucaggaaaguuauuuuuagaagaaguacuaagaacaggggagacuguauaaagaauucuggauuagacaaaucuaugcugauauccugcuauauuuaaucuguuuccucauauaugaaaugaugcuuuuauuguaguguuauaaggauaagugagacauguauguauaaaauucauugcauaguacauaguagguccucaauaaaaauuaucuaggaaaacaaacaguggauccauaguuaguuauaguuauauaacuaaauaaccauauguaguuauuuagucauauagucaucuuccaccugaacugcugccaagaauggcagauacuucacuugaaccagaagaaugaugaaacgcacaggaaaaagagagagauagagaaaggaggaagggaggggagggaagggacgggggaagggagagagagagggaggaagagaggggggaagggagugaguuauacacuauuuacccuugacuuaaguauuugaaguggaaaugauugccaucaguguuauuugguauagaugccuauauucauaaugaauaugaauauucuucccacauaauuaaaagccaagcuugaucuucaggcuguguauguauacacacacacacauacauacauacauacauacauacauacauacaucacuucuggaaaaaaguuauuaaaaaccacuagauucucucugagaugugucuucuuggguucuccaccucucugauugcuugugcugaggaaauagggauauagccauacaugaagaacuguaucaaacaucaauguaggauagugaagcucugaagcuaucaguucaaucauccaccaagagcuaaaaugugugcaguacaauacaaaucagcuuggaaacaaauccaccagcccucugucaagucuugaaaugacuauaguucuaucccauagacugacuguguccucaggagagacccucagccagaggcauaaaaguuaauccucccucauuuccugauccagggagauaaagaugcuugcugcuuuuacccacaauuucuaggauaauuugcuaugcaacaacagaucacuaguauguuagauguuugccuaacaucuacagcauagucaacauguuugcuacagaggcuggagggcugagaggauuuuuuuuuaaauccuuucuuucagaaauggguuuuuaugcaauggauaguauagagaaacaaauauuaacuuauaaaauuauguuauuugugcuucguauuggaguucagaugagugaguaaggggucgggaguggggaauuaguaguaaagcauccaaagcaaggaaaagagaaugugcacauggucagaaccauaaaagcauacuguccuuuagggagcuacacauuucuuagucuuguuggaacccagaacguaugugugaaagcaaauggaaaugauguuggcaggguaaguauucagaugaagagagaaagguguaugcaaaacaaaauuagcuguugaagaauuggucagccacauugcaugucuaaacacugguuucccccagccuuugaucaaaugaugcuugaaucuauauaaaggacagaauaaaaggccauaauuacuuuaaauucuucuaccuggagagaguccuacucaugcacuaugggauaauauaauugacaagcaacuugaauauugaguauuuuauccaauucaaccuguaaauaaccauugacccugaccauaccaggaaguuauagcaagccagccaccccagugcugaaaagacaugaaagaguccaagcucucgagaaggagccacauguagagaaggcugagagcacacacccauucuccucacccacucuucucucuucccauuccccaaccuggagcaggaaaagggucacacagcuuaacaaauccagaguuauacucaccaaugagauagaaagaggacaguaguaagagagaaguucauguguccugugugcucucuauccaggaggaucucaagaacuuggggagaauucggguagugucaauaggauuuauugucuuggcaauauuuuguguucuaagcccuauugauuucgaguccuauuugaguucaugagcuuuccauuaguuauugucaacaauuuccuuuucucuaccucaucucuauggucccuuauaaucaucuuccacaucuuuuaucucaauccaaaaugguauaagcaccuagccugaccaggcaacacccuagcauaaucuuuccaggcucaaauaccaaccaagucacccacucaucccaguaaagaagaaaaauuaauuugcuaaaacuucagauaaaacuauaacagauguuggagagaaaguaaccuuucuagaaguuagucuauuguauacaauauaauguauugaauauuauuauauuacagcauucaaucuucauguaagaaaugaauguaaugccaucagauuccauuauacuuuauacugaugcagauauuauuuauaaacuuuacuuacauuuauuauuuaacauccagucuugcuuucuaccccaagccugccauaauuuggaaaacuucagaaucuccaaagguaaccaaucaucuuuagcccacaaagguuuugauugcucuucaugugacuuuauuucuuuuuagguugccaugacuaaagucaacucaugagcaucuauauaaacaauuauugcaaauagacauuuagugugaaaaugucauuguauggacacaauauucgaucgcuucugcucucuuaugccccuccaccacaggauaccuacuauuuaauccuagaaugaccuccagcccacguacaacuaaugcugucucuuccaucacuccacuggauucucaugugcuuguuucuucauuuuagacaugaugaccaucauuuuguaacucucuagucaacaauuacauucacucuugcuauuuuuauacaauacaccaagaaguaaaaacacuguugugugcaacugaugccuuaguucacaaucagguugaagauuuguuccccugacuacuaguggugcugcugucagaugauuuauagcuguuggcuucaggaccagauugccucggugagaacugacuuuccuguuucugugaacagccuaucuucagugccugaccagaacaagcauacaaagguuggaacaacuuuuaaggguuacagaaguuugagauucccagggauauuguggaugacacauugaaauugcaucgucuuaacaucuuuuucccuucaauaaauauugcuuccaagagcacucacuaaaucuaugugcuaauggccaucucaaagucugccucuaggugaauacauccuggauuuaaccuaauccaauugcccucaaugguccuuuuugcauuucaaacaacaauaacaacaacaacaacaacaaaacaaaacuaaaccccaaaagcaaaaacagguacuuagugcagagaaaagcauacuauugugaaaaucagguuaacaauauaauaugcucucagacuguccaugccuugaaaaauaauuggaccccaaacuacccacugguacuuaaccaaaaggauaaaucaauaaauguauaaaccucuuaauuaaaugucugcucaaucuuucuauaggaguguacuguuuuguauagauuugauuaauauaaaauacaauauuaaacaauauaauaaauauaauaauaugugugcugccugauuccuuuuaaggucccuuuuuauuguguguucuuucaggaauucacaugaaaacaugggaaaaucaucucgauucucuguguauaucauauccacaucauuuucuuaugaaaauggaaguccauguaucucugaugucaugcuggguuagucauauucaagguucacauuauggcucugcuccauucucccguccauucugcuuucuguuuucuaaggaaguuagauuuuaguuucuccauuaaacaugguguaauuucccaaaccagagugguuccuaguacaaaagauuaggauuccuuuccuguguggguucgucugcacucuccuccucugugugaugcuucauuaccaagcugaacaaagauggcugcaagucugauaugaucauauuaaaguauaguagagggacaccacuucgugacauagguuaagaauuuaaugagucaaauuuguauaaaagguuaguaucugacccacccauugacaugagugggcuuagauaaguaaggaccuaccuacuuccugggaaguggaacacuaugaucugaaugcuuguguuccuucauuguugaaauucuaauuccuaaagaguagaaauuaggcuauguuuuaagugacuaaggcaugaggauaaagcccauccuaugaaugguguuagaguccuccuaagagugaccccagaaagaucccuugucccuuccaucaggugaacucccauugugaaaaacaaaacacaacaaacaaaaaaaaaauccauccaugaggaagcaaacccccaaccaaauccaauuugccagugccuugauauuggauucccagccucucaauauaagauaugaauuucuguuguuucaaagacaaucugucuaggguaugguauuuuuuuuuuguuauaggucugaauagccugaauuuccaucacuucaauaaagacagaauaugaacaaagaaguaugcauuuaaauguauuccuugucacccauuuuccuucuagccucuuccucucucucacuuugugaucuucauuuccauaaggcucuucauggucugcucccauuuaccucuccauccuuuucccauacuuuuuuuuccuugggugaugugaggauggagguaauuugagguuaucuucuaaccagcaucaaaucaagaguuauguaauuaagaaggacacccauagcccaacuugugagagacuaggaggagagaagggcacgaugaggaauaaggaugaaauuaggcauaaauuaagugaagucugauuugucucaauagcaacaccuguuacaggcugcaaucucuucagugaccccagcugggcagaucacggguucugucaagucuacauacaguguggcugcuuuguuccaaagccaccaucaugaccuagagaguaggggacauuucagaaggaaucaaucucaauuacugaagagucaaaguuuuauaaacauagauuuuuauguauuuuaagcaauauaguucauguugccuaauuaacaucuauauuuauacagaacuaaugaaaacaaaacuuaaaauauugaaaaauuagcaaaguuaaauguucaacuauaguguuuaaauuuaagugaucuuauuaauggcuguuuuauuuuauauucugccaaaucuuuuaucauauaaauaaaauuuuaaaaugaaaauggagguaggaaagugagagaagaaggggcuagaaggaugguggguaaugaggaaugcauuuaaauauauauuucuucuuucacaaucuuuuguuacugaaguaguagaaagcuuaggagaucuagugaacauucaugguuuuaucuuuuuuauuauccuuuuaauuauuuaaaacaauuuuaccuuaacaauuuuauguuuaacaaucauauucuuccccuuccccaaguccuuccagauucccuccccccucuacccacccaacuuuaaguucuuucucaacaaacaaacaaaacgcccaauacaacaaccccccuacaggcauaagaguauuuauuuuaaugcauauugcaacauaugaaugacauauuacuaaguguguauauauauauauauauauauauauauauaagcacacauacaauauugauuugagauguuugucaauuaaauaugucuuaaauauuuuauggagcuaauaaugguuuuguuucuaaaauucuagaaaauucugugaaaaucaacaauuaaacaagauauuuaaauauaggugacugaguuacuauugcuagaaguucacauuuauuuuauggaucuuauauuuuagcauaaaaugcccuucaauugguuucuucuauuauacauauauuuuuucuugaaauauuguuauauucuguaaguugugcauauagccauaaaaggaaaucacauauacuauaagaggaguaaaugccuguggaauuacacuuauuuagauguacuuuacuaaauuucuauauugcauuucuuacacuuucaugaaucagauggaauggucccaggauuuccagaaggccaacuggaaggcaaaugugcgauuuuauucucaaccaacucuccuuuauguacuuaugccaggagagcuugcagcaaugaugucuguuuuuccuauccuagaaagucguucuaugccaaucauuccauguucaaacuguuacacuuauucguccuuauugaagauucucuuucuggguaauaucauuaaacaaggaagcuauucuucagucccuuucugacagaugcuuucaaauaccauuaaucccaauaccaccauggucuuuuaaauuuauuucccauuuauauuaucuaagcuuuccagauuuagaaaaucagucauauaauuuccauaaaauuggugguauuguuuuaaaaacuuugauggaauuuuugcuauugauaaaguacuguuucaccacuggacacaaagaaauauauucaugcaaaggcauagaauuauuauaaagucucaguuucaauuaaaaagcugcauacaaaaauguaccauagucuugguuuuagucauuuaaagaauacauugaauaaacaguccugaaagccaguauuuauucaugacugaugaguauaaauuauuuuuaauuuauaauauuuuccuauuucucagagauucuucaaucagcauaugucaauucaauccauucguguuugcuucauacaucagccacauuuaugaaauagugcuguaagaauauuuaaaauuugaguuuuauccugccagaaacuauuguccugccucuuugucaugagucuagagacacuuaaauaagaggagcuguuugcccauguacuaauaauggacuuccuaucauuuuaaagucaaaaauagcaaaguaauuggcaucagcauaccaaaagauuuuacuauuccagugaugaaugagacagccaaucaagugggaaaaaauaaucuuuacagaaugaauaauauucauucuuacaaggguucaauauccauacagagaguagcaaggggaggaggucaauuuuaaaaagagacauggaacuaaacagaguucucaaaagauaaaauaacaauggcuaagggauaguuuuaaaaugcucaacauccuuagauaucaggggaaagcaaauuaaaacuacuuugauguuucaucuuaccccaguugaauggcuaagauccaaaaaaucaaaugaugucagauucaagcauggaugugguuugaaaugggaaauacuuauuuucugacaacaggagugcacaguggugcagccacuauggaaaucaaugugcaguuguauuuuuuuuuuuuaaaccuagaacaaaagucuuaccccaugauccaccuauaccauucuugggcauauacuccaaagauauacaucuuauuucagaguugcuggcucauucaucuuucauugcucucuguuuauaaugcccaggaaauggaaaagaaaucugccacuaauggaugaauaauaaaacagugguacacuuaugcaauggaauauuauucagcuauuaagaaaaaguacuuagguaaaugggugguacuauacauuaucauucugagugaagugacccaaaggcagaaagacaaacuucacguauuucucccacuuacagaugcaguuuccaacuuuuagauauguuucugauucauuuggaguaugcauuaaaucgugaaacuagcaaggggauacggaaguguucuuucaauaaaagaaagaaaggagauagagauauaaagggagaaaggggaaauaauaguacagguaggguugaaugaggguagauaauggaagggcaagguagaggggaauauugggggaagggcauaaccaccaccaaagacccagagaagacagaggagaagcaacgauugcagaagcguccuaaauuaucaacauguacacacaacagggaguucaaguggaguuacacuauaauaacacaacagugccccuaacuagacaccacaggcuaacaaagaacacagugccaagaaugcauuaucucuucugaggauauuggaagugaaguccaaccucuaaucauuauagguuuuugccaacacacuuagcuuauagaacucggugguaagauucuaguaauaacuagcuagaacuuggaagucucaugcuggcuaugcauuauuccagaggagaaaaguaaucuucagucuuauguagauauuaacacugugagcuacaauaaugauuagccuggcaagauauaccuacuagugcauuaguggcauaacuguuauaugaauaacaaccacuuucugaugagauuuaaggcccauuccucaagauaaaacucucauaccugacaccauuacuagggccaagaaccugugucuaggcaggucaugggccucagaggacagccuacuuacugcucugcugaagguauagaguaucaaauugacuccuaaagauuuacuuucucauagaucaguacaucucucgauuucauccgugaagcuucuauuuuuaguagaugaugauuaacacagagacccucaauuggucaaagaaugacugucagaaccagagacaguggauggcuacaaugaaaugguauuuuccagacacacagggagguugcacauaugagcuccuagcaacugugauaccuugaauauaacccaugcaagcucaagcuagacaaaaaucccagcagagagagcaauguggucaagaagucccacucccagcugaugaguuaguuauggguaacugguagggucaagaacuuguuuuaucaaggguauggccucugguagguggaacaagcaccagugccugcccacaaaccacagaguauacauccagcacuaacuacaccugauggguuuuaaauacugaggacacaaaguuugguggauguggaaugagggauggaucuaggaggaguugaaguaguugaaguugaauauaaucaaaacaugauguaugaaauucuccaaggacuaauaaaauauuuuuaaauaaaauacagcuuuaucuaaaauucacacaguuuagauguugcugauacaguuagacuuuucuauuccuugcccaggccagaguguagacacacagagucaaugccucaucagcugaaauagauucacaacuuggaagcauacagagacuagugcauccauguccaccaggaagaagccuggauuauacaucagagccaggcuagauugcaagagacaagaaaauacauaaaagcagagucaaaacccucuauacuaagagaacugguuguauaucucauuaacuugcuuaaacugaaaugauuuuucauggauuuuuagauggcugggauaucuuugcaauggugaggcaaauauuauuuaguccuaaggcauuuuccaauaaauuacuugaaucagugugguaauaaucauguuucagauguaaucaucauguuuucacuggagaguaagccuacaaaacaucaggucauaaaauuacaaaguaacauauuuuacuucuuggaauaaucuccuaaauuuuggccucaguuuuauuuauuaagguuugguaaaccgauccuauuaccaucacuauauugaguuauguguggcaauuaguauuuuacagaaaauuacacauuuugcuuaugucuauccauuuuaauaaaauaauccauuauaccauuucuauuguuauaaucacuucugaggcuuugauuguauauaauuugacuucauaccaauuauuuguauuuuuuuuucucuuggucagucuuucuagaguccuuucaaauacagguuaguauuuuaauugaauuuaucuuagccccuuauuuugaaaugcauuccuucucugucucaaaacuuaugaguaagcuuuccagaagaaugguggcuuagcugcauuuuucuauuuaccacaacccaucugccuagugaaaaacauacaguucuugugccaauguauucaaaaggaagaaagaaguggguacauuaauuaagguaucuguuacaucacaaaauucauauccuaacuagaacauggggcaaaagugguguuagaugucuuagcuggguagauauuugauaucuauuuuucauauacuagagaaauagauacuuuaaaauggagaugugaaaaagaagauagccauuuuaguauaauagcauauuguaaaagaaaauuccaaaugaauaaagaggaaauauuauuagcaauuaaaugaggccagaaaaauaaaacaguaagaaaauagauacuuaaauagauagauaaccuaaaagaugaaaccuagagaugaaaaaaaaaauuaagagaagcacacuaguuguuuugcuaaacauaaaaggaacuuucccaaguaaaaauaaagaugcuuuggaaaucaauuuggcgguuucucagaaaacugggaauaguuauaccucagaaccaagcuauaacacuccugggcagauacacaaaagaugucccaccauaccacagggacuugcucaacaauguuuccagagacuggacacaaccuaaauggcccucaacugaagaacagauaaagaaaaugugguauaucuacaaaaugaaauauaauuuuguuguguuaggugauuaaagguacuaaauuguccagcggcugagcagugccagcuucucucuaccggugccacaguuuuggaaucucaaaugaaagacacauauacagagcuuuauacucaaauauggcuuaaauagcucaauggcugggccacucccaaacuuacauguuguuaaagccuccccuucaauacuccugaguuauuacucaugugaaucuauauuucaucuuuguuaccguagacccaaugcggggcucccuggggccgcucuucccuggcucugacaugacugguuugacugguuugucucucuucugcaucucucaagcuugaaucuuauuccuucuccagcaucaagauucucuuucuuccucugcccacuugccuacaaauccuaaaguccugccucugucccacugccuaccagcaacuuuguuuaccaacucuucaggguuuuacauucaggauucucacguaaauuugggaacccaguuaaccuaauauaaguauuaaaccgaauccacaacauuucuccuuuuucauccauuaaaaaagccuuuccccucagauguacauugaacaaaguuauaacaguuauguaaacuauaagguauauuauauacuaauaauguccagucuaucaauuuuuucaguuuagguacauuaauaucucuccuaacuuaaagagcuuauaauucuauacccgaauucuauugugauauuuaacuuguauuaccaucuguacuggcugguuuuaugugucaacuugacacaggcuggaguuaucacagggaaaggagcuucaguuggggaaaugccuccaugagauccaacuguaaggcauuuucucaauuagugaucaaggggaaaggccccugauaagugggaccaucucugggcugguagucuuggauucuauaagagagcaggcugagcaagccagggaaagcaagccaguaaagaacaucccuccauggccucugcaucagcuccugcuuucugaccugcuugaguuccagcccugaauuccuuggugaugaacagcaguccggaaguguaagcuaaauaaacccuuuccuccccaacuugcuucuuggucaugauguuugugcaggaauagaaacccuaacuaagacaaauugguaccaggagugggguauucuugugacaaccuggccauguuuuggggaggacuguggaaggacuuuggaacuuugggcuagaagauccauucgguguuaagagcucugucagauguuguguaggagcuuggaagauaauguugaaaacagugcagaagauggaggccuggcuugugaaauuucagagggaaaauuaaagacucuuuucagggccauuguuacuuugguugugaagauucugugguucugguuagcuggggcugaagaaucagcugugauuaacaagauaccagaacuacuaaagcaaaaacuuugcauuacugggacuauugaugcugguuagcuggagcuaagaaauuagcagugauuaagaagagaccagcaucauugaggugacaucuucugggaaguguuuucugaaagcacagagacuguguuccagagauagccaagguuguaccuugugcuguggcuggacuugguaauguguaagagucacccaggugguacugguuuugaagguaugaaggagucacgcagaccagcugaggcucggcacugugagaggccauggaaggccauuggugaagguacagccucaguugcaauugacagcccaggacugaaggggucaugcaguguuuuggagaugccaguaccaugagaugaccaccaagagcagcagcagugaaguacaggcaucuggagccuagaggaugaugugugugcuacaaagggcauggcuggagaagugacccaaacccuuggaggagcccagaagaucgugaguuggaucccagacauuggaugguuggagauugauuuuugcuuuugauugugacugugcccugauauuuucucucuugaaggaagaaacuauuuuaguggagcccacaguuaagagacuuuuaauuguaaaaagacuuuggauuuuaaaagagauggauauuuuaaagagauugaaauuuuaagaauauguaaagacugugggauguuuaaaguuauuuagaccuuggggaugaauaagaauguaaggguugaggcuuacuagugauguguuugugugucaaguugacaaggggucaauuguacuggcugguuuuaugugucaacuugacacaggcuggaguuaucacagggaaaggagcuucaguuggggaaaugccuccaugagauccaacuguaaggcauuuucucaauuagugaucaaggggaaaggccccugaugagugggaccaucucugagcugguagucuuggguucuauaagagagcaggcugagcaagccagggaaagcaagccaguaaagaacaucccuccauggccucugcaucagcuccugcuuucugaccugcuugaguuccagcccugaauuccuuggugaugaacagcaguccggaaguguaagcuaaauaaacccuuuccuccccaacuugcuucuuggucaugauguuugugcaggaauagaaacccuaacuaagacaccaucuuaaaaaaaaucuuuuuaaauauccaucaucuuccucaauguuaaacaauuuagguuuaauuaugagacuauagcuagucuucauccccaucagagauccaagaacaauuaggagguggggagaacugguuucucagcugagcucaccugggccaugugguucuuccccaagccgcacagguucggagcuaaaacaugcuaaauugacccacauaauucugggguuuaggacuaggacacacccaagccaacccagggacacagguaacagacuaaagauucaacaagaugcucucucugggucacuacagagagcuugagccacaauuacuaagagcuccuacugggauaaggcaaaggaaacaggccuaaauaagauaaaaauaaucuaaauuaccauuuuuaagggcagagggagaaugaauaaaaauugacuuaauuacuuuuaaagauuaaaaaaagaaaaaaaugcuuuaaaaguuuuuuuuaaaggucuaugccagggcagcagcuggguuaaaugugggauacacagaaauucugagauuacuuagccuaauaggacaaauuaauagccugaaaauauucuuauacaguaaguagaaaggaauauaauuaaaguuaaauguggggaauugcaagcuguucuccaucaagcugaggucugaacccugauggucauaauucaccaugacacuucccucaugcuccuggaacucuggccccugccuaagguaccaccucccacagcccccacaagagaagcauggucaguagccauguagacaaauggcccaagacucugaccuucaggcuaaacuccucuccaguuaccuagcaacaguaaaaaccauaaaaagggguguucagcccgccccaccucccucucuuacucuuaugcuuuuacuuuuuacccuucacucucuccucucuucucuccccucucuuugucuucucuccucucuccuucucugucuucuccuccaccccccccuccuaccuucucucuuucucccugcauuucuauaauaaagcucuuaaaccauagucucugcuccaucaagaucugcugcgcacucuggucaguauugggaaccucuucccuaaucccucucuccuauaacccuggggcuauagggugucgccucugggucccagguugggggcugccccuuuuccaugcccccccugccugauuggggucagaggcuuagaugcccaccuggggcugagugaaaagugucccagcagccccccaacgccugcaucugccuacccagaccacaggaacucuggccggacguuuggccccuuuucccuuccccuucuuccccaggguucccccuuuuuuuguccccaacaguuaaauacacaggagaugauguaaauucaaguuauauaaagagaaaggugauauauaccaacagagauauuaaucucuacagaagggagaauuuaaauauacauagauaaauaaauaaauuuagaccuugcucucacuauuaaaaauuaaucauauaagaacaaagcugggacccucagugucuuacauauuagauucucguauaauuuuggaaaccuaauuaacauaguacaaacauaaaaccaaauccauaacacuauucagcuauuaaacacaaagacagcaugaauuuuccaggcaaaugaaugaaacuugagacuaucaucuugagugaaguaacccaaagccagaaagauacauaugguauguacucacuuauaaguggacauuagccauaaaguguaagacaaccaaagaaacuggguaacaaggaggucccaaggaagaaugugugaaucucacucaaaggggaaacuaaauagucaauggagguggauggagggagggaacuggauaggagagggggugaggaggggaaugaugaugguaaucagguguggggauggggucacgagaggguugagagugagaauggaaauugguaggggauaucucugguaacuagucagaggccugggaucagggaguauauggagagcuuauggggcugacccuaacugagauuccuccuagcaagggauagagaggcugaaguagcuaccuccuauagcagggcuauauacaaggcuuccagaaaagggagggaacaucaguccauucacaaaauuugucuugucuacaagaugugcugggacaaagauggaucagggacugaagaaacagccaaccaaugacugccccaacuugagacccaucucaugugagagagccauccccugaugcuauuaaugauacucuguuaugcuuguagacaggaaccuagcauagcagucuccugagaggcuucaaccagcagcuaaugaaggcaaaugcaaacacacacagccaaacaucagucagaguucagggacucuuaugaaagaaugggagauagaugaagcagaaauuucugguuucuuuaacaacucaguuaugucacaugauauuuuucuggaagcugucuuguagagggcauguaauguuuugcuaaaaugagacgagaggcaagauaauguuuagaagaaauauaaauagaaccccagagugagaggaugcucuugcauugcaaugccacauaauacuucgcuucuucacuggucuucacuggucuuugcuggucuucacuucauagagagaaacuugucaaagaacuucucauuggauucuagcuaguucuguccacuucugcuuauucaugccaauuugguggagccucacuguuucugcuggauugugacacccuuacugauucguguuugauguuugcuguuaaacuggacuucugguauccugacaauaaagagugaaauugcccccaagcaacuacuucuaaacaggaacacaacagccuuuuccuauuaaccuuuucccccuaccucuagacaauggaccagaaaggaucuaagccuacagauagaaguaggcaagcuggaggaguuaagaacaccacaagaagacgcacagagucaacucaccuaggacuaugggagcucacaaagacuggagcaccauccagggagcauagaggagcuggaccuagguccucuauauaucuguagcaaguguacgguuuggucuucaugugggucaccuaacaagcagagcagggcugucucagucucugaucucugugguuggaucccuuucucccuaccuggacugccugguugggccuuaguggcagaggauaagccuaguucuucugugacugaucucccagggugggcugacacccaagguaggcuccccuucucugagaaguggggggggggcaaaaguaggggaagggacuucuaagaguaggacuggaagaagaggagggagggggacuguuauugggauacaaagugaauaaaaauaaauuauucauaaaaaaguuuuaaauuaaaaauaaagauucaagcauuagguuggauuuuuguaugaaaaguuguauguuacuuugaagaaacacagcugaaauauagugauaaagaaaggguggaaguugcaaaugcuggcauuugugugcaguggaaggaacccuugaacacugcugaucugaaugcagaaccaacaguaugguugcgccucaaaaaucacagauacccuacgaucauccaauaccacuacaaggcauagacagccaaagcagaggaagcaguguaucagaggcacagcuguggugauguuuucauucucagcaccaucaacaauaauacaaucuaagugucgaucaauugaaggauagacaaaaaaaugugcacuauuaauucaucuagaaauauaaaaguaaaguuucuggguguuuucaucauaaagaaaugauaaagauucagagagagagagagagagagagagagagagagagagagagagagacccugugucaaaacuguaauaauaguguggagggcaacagagaaagacaucuaacauuagccugugauucccuccacaaagucacagacuaacaaaacucaagugcagcaagggaaacuucuuuuccaguuguugaucaugugaggccaagaacuuccuaaaacaauauagucuuuauugucauuucucuuggucacaaucuauaaguugaagggaagagucuguuucugaagacagcacaaaccuuggacaagacuuagaggacuagagcuggaucugacuuggaagcuccauccuugaagacuagcuccgugguaccucaaggggcuauagaagcugccaauggagaaaagcaaucaguagcccaacuaacuagcuuuaauaucauagcaaugaucaguauggcaagauaucacuaaggguacaaaagugacauuuauauucuggggacaaacgacaacuaucaaaucagacuuaagccuuacuuaacaguagggauuccaugucuagaacuauaaaccuauucuacuaccauggcugaugaggccucaaacucuaaugaagaauccauuuccuaaucuaacauaauuucuaauuucuaacugccuuccaaauacuuauuguuauacccaaagagaaguguagcucucaccccuuaucaaagaaacuucuuuuggcagcagugggagaccauuagagaaagccagaccugaccaaaaagcagagacuaucugacugucaggaacucagauccaguugauaaaucuacaauauggcuaccacauguaaggcucagauaauaucacagaggaggggauggaaaaaaauguuagauccaggggauaaagagaaugucugugagaugguaucuucuauacaugguacagaaaccgugacaugaaaacucaaccuucuugccuaaacaaaccugguaaaugccaccacccauugacauggcaaugugaacggcggaacuucacaaggccccaucacuagaugaagagcuauaggcaaguaaaggcagcuggaagagggauaaucagccuucuccagggaugaguucuccauugguuauccaacugcaaacagucaacccuuacaaaguauacacaugagcagcacggcagugucucaacagguuguauuuaugaauauauuauauuauauguaacaauaauaauuaaauacuaagaaguuguaaauuugagauagggucacaagaguacagguaggaggaaggaugaaagggaaaaaugauauaaauauaauaauuccauauaaaauucucaaaaauaaauauguaaguaaaaauacuuuuaaaauucuagugacugguccaacuugagaucuaucccuuagaugggccaccaaacccugacacuauuacugaugccguguuguguuugcagacaggagccuagcauggcuguccugaaagguucuaccagaagcugacugagacagaugcagauacucauagccaaauauugggcuaagguuggggaccccuauggaagaguuagggguaggauugaaggagcugaagaggauggcaagccuauaggaaaaacaacaguaucaacucauguggaccccucagagcucccagauacuaagccaccaggcaaagauuauacaugggcuggucuguggccuccugcacauauguagcagaggacugccuugucuagucuucgugggaaaggaugcaucuaauuguguagagauuugaugccccagggaaggaggaugcaugcuagacgggugagguguggggugggugaaugaagcccccucucagagguaaaggggagggaggauguggcgaagaacucuuggagaagggacuggaaagggagacaacauuuggaauguaaauaaauaaauaauaaauaaaacaauuaaaaaacacuuuuaaagauaaaauauuagaggaaaauuuaugguuaucuggggcauguaccacacacuaaaagaaagggauauaaguaaaauauaugaaucugaaaugucuaaaaguucuuuucauauuggcucauuuuuuaaaaagugucaaauaauuauaauuuggcgaguuuaugaaagggcuccauuguaguacuaguuuuuguacuuauuugucaauccaaucaacauuucauucccuuaaaucuuuaguuucuucauguauaguaugagauuaagacaauggcaaaccugcacugcuaauaccuuuaugcaaauacaacaaauguacuguggagcaauaaauaagguaagaguuggcauuuaauucuaaugauugaagacacuggacauagccagagcaucaaauacugauauuaaaucauuuuucuagacauugaugaaaaauugaauucauugguguaagacauuuuuuaacauuauugggugacuuuacuuauaguuugaagugaugaccuuaguuuagaaauuugggaguucuuugagauaacaaaucuccaaaguauuaaucauucauuaucucacguugcauguacaauuaacaaagcauaauuguaauuuaaauuuucuugagucaguuaacauuugacaugaucaucacgagggucuucauagucuaugaguaauuguuuggugguuuaauuaaauacauuuuacuuuagguaaaauaucuuaguucuucaucucauaauuuucuaguaaaauuuuaaucuucuaccagaccuuauuagaauagauuuauuucuaugcaagaauccaacauauguuauaguuggucaaaaucacugucagaugaauauacauauauauauacauauaugcuuauuaaaauuuguuuauauuagucaauauccuauauuuuauauuuucauucauuaauauucugaauauucaucaauauuaugaaaacacauaacauaaccuugcuuaaagugugaguuuccuucuaaguccuacuugucuuuuugaccuuuaauguuucaaacauagguaacacaaauuauuauauaugaaauuuuuauguuuuguauuccuugguauuauguuuucuuauguuugucaucuuguugguuuuuuuuuuuuuuugguaugguaccuaaccuccaauuaaauuauaacuggugauacugcucuuuaaugcauuuaguugaguuuguuuaauauauacuguguguguauauauacaaguaggaagugcaucuguacauauuauguggaggacagaggucacucuccaccuuauuucuugagacaguguuucucacugacccuggaacuugccaguucugcugagacugacucagguugcugcaagaguucucucgucugugccuacuuaguuugaggauacaggcacaugcugccauccgugacauuuacauaggggcuguggaugugaauccagguuaccacaugggcacagaaaacauuuaaccagacaagccauuuccgcagcccuaguauuuuguuuuauuuucccauucaagaaauauuuuguuacucugucuagcuagaucauuuuaaacaaaauagcaagaaauuuaaaaaugacauucuacauggccauguuuucauuaauuauuuuuucuuuugugcuuguguguguguguguugauuuucuucuuuuuccuacuguuagaaguauuuuaaccuccaacuauauuaauaauaauaauaauaauaauaauaauaauaauaaauauuccuuuauucgccaauuuuccaccauuggcuuagaaaauauaaauuauguuccugacuuucuuuuuuuguuuguuuguuuguuuguuuuuuugaaacaggguuucucuguguagcccuggcuguccuggaacucacucuguagaccaggcuggccucgaacucggaaauccgccugccucugccccccgagugcugggauguuccugacuuuaaagguuuucucuuaaaguguccuguagaaaugcauuuaaugaaaaaggcucagugucuuuguuugccuagcucacuuucacauguucacucuaugagcaggaguuauuaucuuccuuguucuuaggcccugggauuuuaaugugcucugccgcucacuuucagcaugggucugacuuuuggccuuaacucaaaugaagcucuucaggccccauugcccauaagugugcauucuguccauggcugugcccccauuucuuagacaagccauuagcugaacuaccauacaggucccacugagcuucuaguugagcauguaaauaucuugcuuuucacaaugcugggcuuauaauucugcauuuauccgucacuuuuaguuugauguaccagaugggagaaaauagggucaaggguucugcuaucaaaauccuuacagaucuugugaggcugauagcacauguuauauuucaauacuuagaaccauguuuaauuuaaaggugaauacaaagcaaaugccuguauaccaaaccuucauauauaugugaaaauaugcacagaaaaaaaaaauagaaaaagaaguaggcuagaauguuuguugcucugacaaguaggguauaaagauuuuuuuuuaaauuuuacuuuguaugucuuaagcgaaaguauuaagauaauuuauucgauuuuauaaugagacuauaaacauucauaaaagcuacuuggaggaaaauaagcauuaauuaguagugauguuaaaauucuaaaauaacaacacggauccaacaggaucuccuaaggaaaauaauuaaguaaaaauaacaugaauuuauggagguuuggaaacauuucuguaucacugugucucaagacuuagacaaaauguucucucccaugcuuuaucaaaguacuucugcuguaaugauaacccaggauccccauagaugccuaugauuaaaugucaguuaaucuucaaaaggaaugaacugcucaccuaauucacucugaucauggcauagcucuuagcaaucccaauacucuuuuuauucucuuuaugcacagguagagagacacaggagacagucacuaacuaacaaguuagauggaaauuaaaagcauaaacugugugauuuaauggugugaaguuucccuccaugcucucuauagauguggaagaguaagcugcccucacagaacggguguguuguuaggcaguaaugaaugcagauggaaauguaggaagggucuacuugggugccuauugcaucugcugggaaugcaaacagggucugacuggaugccucuugcauuauuuuaugcaauauauuccagcuaaaaucuauguuauuuugguugucuuuugucugugugagucuuuuuuccccccaaauuauuucucuguauaaucuuagcugcccuggaauucacucuauagagcaaacuggccuugaaaucagagaaccaccugucucugccuucuuagugcuaggauuaaaggugagggcccccacacuauuuuaugugagucuuacaaaccuacugagccuggaggcccagaaucuuugacagaugcugaugggacagauggaugagugaaugguuguguggaaagggaacauuccaaagggcaagaacaaacgcugacaaagaucuaggauguacguaugcaaaguggcagaugaccuuucagugaaucuucauuccuuucaacaaguuacucguuauuuugcccaauugcacuauuacacauuuuuagaccaaugugaugagcugagacauuuguaaauacguugcuuucuuaacugaggaaaacuaaauaaugaaauaguuuuaauucucgauuuuaaaaaacuauuuaaggagaaaauuaauaccaaaaaacuauaauuuuaucuuucccauauuuuaaaaaauugcuucaggaccauuaaaagaacaaucuaguuugcauuucucaauuuuguguauucuaauaugaauauaaaaugcaauucacuggauaaaaucuugaauacaauaagaacugauaaaaaaauuuuucccauuuaaauguacaguguaagugaagcuguaugucagcuaauuugguuaauguuucuuaauuggagugugggaguaccuaaagagagaacugcuguaguauaauaggcucugaaugauagagcaucuauauaaaggaauguaaagugaguuaguaagcuuaugguagacacaucuggcaugucuagacaauguagggaugggaauaaagguuuuuaaauauaggucuacaagcaucaugaaggaccuaugcaaauuuacauuugcagacuaauacgguuuccaguuucgugcucuauguaugcaucagugguuaaguagaagacuaccaaugaguaagccuauggaguaacagcuuaaucauuagaauggacugagauuaugcaacuaugaauugccaugagcuacaaugccauggccucuuaggagcacugaaaaauagcuuuuaucacaugguucuaucauguaauaguuaacacgcuggacucugaaaaaucacucuuaucaagguuucaaccagcauacagaauaagaucaugaaagugaaaauauucucacagcacuccuagaaagcaacugugcacucucuuucaagaagcuaggcgaaaggauauugaauauuucuggaguaggugaaaggauauugaauauuucuggggugaaauggugauaaacauuuuaggagacagauauuaauuacaugcuagauauacauauuaaacaucuugugcuaccaggugcaauuuuuguguuaauguauaaaacuuaaacauaacaaaauguaagcaaaaauaguuaaaaccugucuagaugaaauauugccagugucaucauuuuauagaucacauauauucaaaguauauuuuacuuuuuuucaaagaaggaaauaauguacauauuuaacaugaauuagauagaauccauaggaaaaauauagcuaaccauauagaugagaaaguuauuccuaaucauucucuaauuauuauaaaauuaauuuccauuaauuuuuggagaauacaaaauaugcaaacuaaauaacaucacauguaaucuuaccaugaaagacaguguugcaauguaacaucuuucugguuuccccauuuggacaugugcauaauaauaucacugaauggcauucaagggaaguauacacugauucacucaacagguaucuauugaaagguaacaugugccauagcaagaaucuguauaauccucacucaaaagcauugucuuugggaauggagagucgcucagugggcagcguugucuagcaugcaugaagcucuggguuccauuccccagcuccacacaaaucacauguacuucugcaagccucacucaggagggacagacagaaggauuggaaguucaagagcauccucagccacaggaaguuucaggcaaaucuggguguagugguuauuccugguugucaacuugacaauauuuggaaugaacuacaauccggaauuggaaggcucaccagugacccuuaucuggaggcuuggagauccuuaucuggaucuugguuugaagaucuugagccauaguggcuauggauuccagaagauugaaucuccgaguuuaaggaacacaccuuuaaucugggcuacgccuuucaucugggauuaagggugugguggaacacaccuuuaaucugggcuacaccuucugcuggagacaauauaaggacauuggaagaagggagucuagcucuugcucuugcuccuucgccugcuugcugcgugaggcugaguaacugcuagauccuuggacuuccauucacagcugcgacugaaucauuguugggaauugggcugccgacuguaagucaucaauaaauuccuuuauuaucuagagacuguccauaaguucugugacucuagagaaccuugacuaauacacugggauacacgguacccagucucaagacaaaacaaaacccacaacaagcauguuuucacgucuucagugacccuucccuucagaugaaucauuauuacuuuaccgucauucauuuugacuucuggguugucuggaauucauccauauacuuuagacugaugaagacauucugucaugcucacaggugggcacacacagguuuucugacaaacaauaaacaacuucccaaagcuuccuauuuucuuuugaaaagaaacaaauuuuaaagauuuguuuugugaagcuaaaucaaaaacaaacagaaaacaaaauaaaacaaaccaaacugugacaaaugacacccucaaagcugcaggcaucgauaauuggauauuuaauugugaauaugguugagaauauggacaaacccuuugugcuauaauucugguacucucaucugcuaaaaaguucuaauuuauggccugacucccuuauauguagaauaggaaggagaguacuaucuuacacacuaguuuaaaaucaaguuauuauggauaaauuauucaaacacauuaccuacuuuuuccuuuauacaguuuguggcaguuauuuggguagaaacuauaugguugggauagggauaggaaaauuuuggaugacagaaaucaaacaacugaaacacuaaaauaacuacauaauuuugaucacaaggcuuaucaaggaaagaaauauuagaaaaguugaaagcugaggcauuuacauuucuucuggggcaaagauauauguggaugccaaagggguuucccugagaaagacuaugagcuaaggacauagggaaaggaguuggguagcagagaguugggguaggauggucgguagguagggagauguuccucuugaaaaucugaagucacuaagaagucuggaaggauaauguggaaacuggucagggcaaagguuaaagguagugaguacugagucaccagcacaucuuaccagcgccuuuaacaccagucagaccuccuuauuaagaauucugaucauuuuucuaagagcaauggcaagcacaaaagguuuuuagcuguuggaauaaugcaauuggauucauggucuuugguauaaacacaagaaggcaaauaggacaauuggggaacuauuaacauaauccaugagaaagaaugacaguaguguaaugguuuguauaugcucaacccagugaguagcaggauuauaagguguggcugugcugaaguaggugugucgcugugauuguggguuauaagacucucauccuagcugccugaaagucaguauucuaccagcagucuucagaugacaauguagaauucucagcuccuauuaaaccaugccugccugacugcugcccuguucucuccuugaugauaauagauugaaccugugaaccugugaaccuguaagccagccacaauuaagcgaugcccuuauaagaguuaccucagucauggugucuguucucagcaguaaaacucuaagacaaguaggaacuaagagaagcaaguagaucugggagacaauaacgaccaaaauuauccuaucccuaaaaucccuaagacuuggugacugaauucaagaguugauaaagagggagguggcaagucugacacuuggguggcugcagguacauagauuauuaauccagcuauagaaauaagaaaacuguugagaaaaacaggaugugaaagaaaggucaugaaguuuaaguggggauguauaaacuaauuguggugcauuugagacacagguauagauuuucagcaaaacagugaguguauggggaaaugguuauauggguaagcuuuaaauuaagagaaguauuuauaacuaugaauaaauauaugugagucuucagcauagugauuguaacaaaagccucacuuugcaugaaaucaccuauaaagggguugggaggagcagaagagagaggcagggagacagagagggaagagagaaagaaaggaguagaagagagagcaggaggggugcaacccgaggaacagcaauauuauaaagcuguacaaaagaguuaacugccaagacagugaagagcauaacugaugaacacuugccuuggacagcagagggaggaaaagcugucacaggggaauggccagcagcuuguaugggugagagguuaagagaaaugggaauuaagaaauguccuuuaagguuuuguagcaucaaggcccuggcuacuuuagagagcagaguucaacagaggagcagggaauggaaaccucacugugguugaguuggaaagugaaagaggagaaagaaaacaaacauguaagugaggggucagagacaguagaggcuggguguccagugggauugugaaaucccucuuugcuuuuauugucgcuugcuuucauuuucaauugcuuuugagcuuugcuuguuuuuuaaauaaaaagagagcagauuuagacauugauauacacguccaauagaaaaagaccauuacaaacaaaaaagguacgguagguggagaaucuuggugguagauggagagacuaacacauggaaggaaggaccuggguuugauccaccagaacuuuauaugcauauguguguguuuaaguagguauauuacaaauacuacuuaauauacaaacacuggaggggagaagaaugaaugaaaaggggaaauggcuuagaaggcagagacuucuaaggcagcauagaggauauacuaacaagaaaagaaaaccccaccuauauuaacaaauggacaaauaaggaggagucgggucuaguuuuccuguucucuccauguguaucgcugucucugucugucugccugucuauuucuguuaucugacucugucucaguuucucugucucucucucuuucucuaucccucuuucugugugugucuuccugucauuuuguucaucugucuaucugccuauuuauuuuuucuuuguuuuuuuuuuuuuuuuggaugaauaaaggaggugguggcuaauggaccaggauuucaccaugaacaugugaacccacuuuuucuaucuguuccccuauggcuagcacacuguccucaauuuaccaaguacaugucugacuuaaugucuggcacagucucauguagccuagguugaccucuaaaucuugguccuccugcuucagccuggaaaguucugaaauuacagguguaaggcuuguacauucuuuaugaauuaaacuaugagaucagcuacugagacaaggaagaaaaaauaccuggaaucaaaacacaccagagaaauggagcagagcaaggggcugcugggauuucaugggcauaaaauguacaaauuaaguaauaacucucucucauuacuauacacagucugauauuauagggaaacgugguuccaaaagguaggcacaccauaaaagacccauacuuucagcuuagcagaguuugauguauuuuuagaagccuuaaucuauaauuuguguuaauccauuuaaaguacaaguaaaacucauguggggugauuuucucucuguuuagaauguaucaaaauauagcaaguuucuaucaauucaagcaaagugaaagaaauauuugccuugucaagaugcccauaugaauuaagaagguggcuaauggaccaggauuuuaccaugaacaugugaaaucagguuuucucuccauuccccucugacuagcacagugcccucaauuuaccauguagaugacugacuuaauaaauggccacaaaaccacugagcacagagcaaaugccacauaaaugacugcugucugacaaaaaugguucuuaucagaaaaaucaacauuuauauguagagcaaugcuuccaagggccuuaaaaauaguuuguucuuuuaaaugaguuaaacaugcccucagaaaucauguugacauuggucucuugcuuagcagagagaaacguuuguccugguccacuuggaauucuuuuaauuucaaaauuuuggcauuagaauucaggagucuucacucucucaaacacaaacacacacgcaugccauauauauguguguguguguguuugugugcgcgugcacguguguguguguguguuuguauguauguacauauguauguauguauguauguauguauguuacagaacccugcuccccuacaaaauugaacagaguuaaccaagacccccacuauccuagcaugucacuuuggaacaugcccuuuuaucagagaucauccauucucucucaacaggauuggaaacagucuuugcugguguuguuauaaauugcucauuaaucaaaauggauuuauugagcacccauacugugcaaagccugcacuaagugauuugaaauaacagguugcuuaguuaccacaaaauggaaaaauucccuugcgaaggauaaaauuaaaugaagggcagacaauaaaacaucaucuuugauggcaucuacucuuucauaaaggcuucuuacugacauuacagccauuuucuuuuaaagacaacucauucauuaauucacuuuuuguuguugcuacauauuuauauugcuuccaggaaauauacauuccucuguagcugccaugagaguauacacuccucuguuugagagggaaacaggcaguuuaauaguggcagcacagauaaauggaaccucagcaacccuuaugguaggaguccaguguuauccuucuuauuccauaugaaaucugcagccaccaaggcccuagcaaagugauccucagagggggaaaaaaaucacuuuuugauugaauuauaaaaucugguuguugaauauaaauaagcugcuaauuuacuuucauauuaaaauuaaacuaguagcuaugguuuaaaaaaguucagcucaucugcccaguaaauacagaaaggaaacuaauaggcauacaucacugauauuuucagaagagauguauuuuaucuaugaaugguuuuaccuguuaccaggaagagaaaucucucagccucuaagaugagaaagucugggaggauuuggcuuguacagacagauccaugcaugcuaaugcauuaaacaugugugugugguuauaagucucuguguuagauucacuagaccuuuguaauacaucaaaauuuaugguguacacaagaaacauuucuuuccugguuccuaggcugggggugggaggucccaaaucaaggcaucggcaggacagaguccuugugaggucagugaggaguucugcucaagccuuuuugccuggcuugcagagggcuauaaucuugugucaccucacacugccuuuucaauuucuauaaaaaacacaacucauaccguauuucugacaggcacaccaaaucuuggacauugcaacaucacauuggugcuaucuccaaaacugaugcuaggaaaucacacaauccaguuaucccccugccaaaaaaaucaggcaaaaaugcaagcaagcaaaacaaacaagcaaacaaacacagcuuccaauguuuuguauaaguuuacaauuauguucauagcuucuucugaagcauguggucauagguuggacaggcccaguaaagcuuacuuaauuguuuuacuacuucuaugaagaugcuauuucuaaauucugcaaauaaaaucacaccgaaagugccacgucgggauggaagcuguuaaaaccucuuuuguggaguauugagguuuggucuuuugcuaugugccauaauguuaaauauuggcccuccaaggccugguugccccuaggcaugagagaaucugcacauauacaagugauguuauaucaccuugccuccugccaacuuaucccugauggaugaauaaagaugccuacagccuauagcuggguagaagaaagggaggcagccuuucaguuucugggcuuagagccugaggagagaccacaggaaugggggaaagaagguaaagagaggagaagacaccaugggguaagugagucaugaaaacauggcuauggggcuggacaauuggaguuaaaagcagccaggauagaauauaacaaguuauaacuugggguuaaugauaaggaaguagauauuaauaacagaggcagauaucugccaagcucuggugcauaagaggcuuauuauaaauauaaaaugugugucuuuuaucuggggacuaaaugaucaaaguugggguagaaacccuuguuugagauuaaacauuuacugcaacaguggagggcaaacaauucaaaccuuagguguuccuuuuaagauauggccauccuuuuucaugucucucuugucucuuuccccuccucccucccacaaggaagguuuucaugguaguuccuaaacagaaucuucucucuuccaccuccucccaguuuccagggcaguuccuaugcagaacagccauuccaucuugcuguaaaccuacaccagaccauucaaccgagucaucuauuacaugcauucuuggagauaugguucucuaaugcacuggccauuuauuuccgaaauaucagagccuaugaagggagaaggaaugaucuuuauuccuacacagcucucagcaucucucucacucuucacugccauuaccuuuggcuggccagucauuucuuguugauuguauacuauuuaaguugccuuuccauuguggaaauaaacaccaugacaaagagaaacucuggggaauaaagagcuugcaguuccagguaaaaaucuguuauugaggguaaucagagaagaaagucaaggagggaucuugcagcauugagaaaugguacauguuggcuaacugucuggcccauguuuaguuaacuuuacuauauagccuaaauuguccuagauauaggacaugaaccuaauuaaugaugcuuacggcugggccuaugagcaucaauuaauaaccaagauaaucacccauacacauguucacaggccggacugagcuagguaauucuucaauugaagauucuccucucagaugacucuaaguugugucaaguugacauucaaggcuguaaccaggauacacauugaucggcuagauauucuuccugcuuccaaccucacuucuggacaauucaaacccauuuuguuuccuuguagucauucuaaaacaaauaccagaugaugccauuuuauccucucuuucuuaguacucauuuuaccuuagcagcauucuacacccuaugaggccagucucugaaugaauuucauucuuccaugcccauggaacuuuuauaacaccaucccuaggcuacagugucauucucccauucauccaucuaaccuuccauaguugaggccaaaaucaggaagcaucuauuggaagaaaauuguaacucuuuuccuacaauccaggaguacuuggcuuugcuuguuacacuuacuaacuucgaauuuucuaauuuggggggcuugcaccuuaacgcucuuuccuuggcaacaguuaacacuauacacagaccaccagaggugcucagugaacauauauuggauggggaaguagguagcuuccaccccauucagucugagacuugucugcauuaggaguugucucuacaccugcaaguccuaugguagcagagggaaaacauauguaauuccaagagaggucggugccucccccagguucaucaguucacuaagcuggucaugaaaggaugugcaaagcuaaacacaagucauaaaguacucacagcagugggagacuuggaaaugucaggauucaugaauccuaguguuauagguuaacugaaugaguagaacggaacagcagcagaauagggggugcaaacuguuuccuaaucuagccacuaaaaacacagcuaugcugaugguaugucacuagcuuugguguuuauugagagcaauuccuuagaagucccugccaggaaucuauauucauauuuauuccuauaauuaaaaaccacauaauuuccacuuuaauucuacacuccccacugguagaauucauaaacacagcccaaaagagcaaaguacaaacauuuaugaauucagcugggucaauuugucaagcugauuucuauacuaaacccaaguaucaaagacaaugagggggggucauauaucuaugcagauuaacuuguguuccauuuagaaaaggaaaugaaacaaaaacaaaacuguagaggaauuuuaauccagcaacauagcugcucuggcaagugauuacauccaaaaaacuacaucuaugugaucugccacacaccuuuaaucccucacguaccuuugagguaaaguuaguuuguagaaggaagcaacaauguuugaaagugaugucuaacuauugcauaugccagcaagauuuuggugacaggacccugauauagcugucuuuugugaggcuaugccagugccuggcaaauauagaaguggaugcucacagucauuuauugcauggaacacagagcccccaauggaggagcuagagaauguacccaagaaacuaaagggaucugcaacccuauaggaggaacaacaauaugaacuaaccaauacccccaaagcucgugucucuagcugcauauguagcagaagauggccuagucagccaucauugggaggagaggcccuuggucuugcgaagauuauaugccccaguagaggagaauuguuagggccaggaauugggaggggguagguuggggagcauggcggggggggggggaaggguauggggaacuuuugggauagcauuuaaaauguaaaugaagaaaauauauaauuuuaaaaaagaaagugaugucuaguugaaggucaggcaaagugacaaaucagagaaagaucugacagaaugggucagaaauaggauauaagaacagcagaagaaagagaagcuuccaaauuuugucucuguaacuccuuccauggguguuuuguuuccuauucuaagaaggggcaaaguguccacacuauggucuucguucucuugaguuuaauguuuuuagcaaauuauaccaucuagugauucccauauccagagauccaucccaugaucagcuuccaaaugcugacaccauugcauacacuagcaagauuuugcugaaaggacccagguauagcugucucuugugagacuaugccggggccuagcaaacacagaaguggaugcucacagucagcuauugaauggaccacagggcccccaauggaggaacuagagaaagcacccaaggaacuaaagggaacugcaacccuauagguggaacaacaauaugaacuaaccaguaccccccggagcucuuucucuagcugcauauguaucaaaagauggccuagucggccaucacugcaaagagagguccauuggacuugcaaacuugauaugccccaguacaggggaaugccagagccaaaaagggggaguggguggguaggggaguggggguggguggguaugggggacuuuugguauagcauuggaaauguaaaugagcuaaauaccuaauaaaaaauggaaaaaaaaaaaagaaagagaagcuauuuaagcuaugaagcacagggagagacagucaguugugagucagugcagugagugcagugcaguggagcugaguuccucugugaccucaugcaguucagggcaggucagcagagacaguugaaaccagaggauaagaaggagccagaagacuagaacaauuugucuguuaguuuaaggccaaguagagcaauucagugagaagcugugggaagccagauggaaacagucagcuuggagaggaguuugagcccaaacugcugaguugaaccagccagccagaguucagaaagagcuggaaagggugagcuuauucagcaguaagccucugagacaacaauuacaucuggcaaauauaaguuaguuuuacaaaacaacagaaacucagauaguuguauaaaugugcuuuccaaaagcaguuagaugaauaacuucuuaugcugugauagaguucccuuaucaagggucagagaaagcaaauucccuccacuuuaaugcaggaaggcgcuugacuauaggagaaugacgucaccauucagagcuaagucucaaaaagaaguguagcuucugucacauuuucucaggguguuugucaacauacaucaugagcaauccaaguaggccacaacagauaugaaagguaagauuuucauuugcagaucuguuuaaaauuagcccagcauucacaguaauccaccugccucugccuccugggucacaagcuugagccagaaaaccuggccuaugauacgaucugguacacagauucuacuacaguauuuagucaagaugcccuagcuuaauuaguuggagcagcaagcaagaaacuccaggagagccaucccagaaccgcagacuuaacaagcaaaaucaaugauuguauguuguuguugucaacauuauuucaacuaaguauuaagguugguguauugugugggaaucaauuaccacaagauaguuugaaaguuggaaauuggguguucuaguagaaaaacuaaagcauguggcuuuaacauugugacaugccagcaggcagaagcuggggaaccuggaagcaagugauuaugaaugccuaaaagcucaagggagaagccauaggaauccaaguagcuuugccaaagccauuggugaaggcuucaaagagagaaauggugacugcaagcugugaagaagggucuugaucuuucugaaguuguugccuuaaauguagucacuuaucauggcccaaaaugcaagaguguaucauagaccagguguauagacauagcuuaaacauaugaccccaauaaucaggaggcagaggcagggguaggggcaggggcagaggcagggcguuacugugaauuuuuggccauccucaacagcauuaugaacucaguacacacauaaagaacaggcacaagcacagugaaauggcagcuuuccacaagccagcaaaagagcccucaccagaagccuggacaugcugucaucucagauuugcagagcacaaaaugguaacagaauagaaguccuagcauuuugacugguaauggggaggcacagugaucuucagaauucagcuggugcucaaagaaaaagcaugccauccauagaagguaaauggucuccauaccacagccucagcuaagcucacaguuuauagccauuacaaucugccagguauccaacuaggcuccuccuccuuuuaagguuaagcaaguuuccaauuuauuucaaguagauuuuaaaacacucuaaauauugauaucuauggcaaacaauaguggguggguaagcuguuagcuccaaucagaacaugacauauugcaauuuuuuuacagccauaucaccccuauaaaugauaaagauguacuuuaaaaugucgauuaugaugaagagcuuucaagagaauaaccuaauaacuuuagauccuagcucaucaaagugauagcuuuauaaauguuuggggucuuccagugaguucagcuuuuuuuuuuuuuauaacaguuacgaccugcagaacaauaggcuccaucuucuaacuagaguuggcgucagugauucucuauaggcuguggauguagcucagaauuggaaugccuagcacacauagugcccuggguucaauuccuaacguggaaaaggcaaaaagugaagguggcuuuccaaauacuccaagugagcaauuacggcugacacaaugugacagaaaagcgguccuagcaaaaaauacccugauagacucaacagauccaugagacaauaaauuacuguuaucaguaaaagcuuagaggcuuuuaaauagcaauagacagacugcacaggcauccucgcuucauaaauuguaccuucugauuccaagagagguuaaaugcucuuucucaccgccuucaaaggacucuaugaauuauuauauccuuacauaucauaccaucugacaaaguuuaccauucacuuaacaaccuucucagauaucuuauggcaaggcuauuugggacacucucuccucaaauauuaucacuuucagaacccugaaacuuugauuagagauaugaggaauucuugguauguacacuccuugacauauaugcuucuauuuuaucauuuuuccuuucugcauaguguucugagaauuuucuucuuggcccauuucccauucuuuaacacuuccuucagcuggaaucucauagaccauccauaucauuacucuccugccuaaagaggguuauaauuguuucugcuucauucccaaggguauugcuuuaaacuaaauucaauuuucagaacuucuacaugagaugaauuugggguacuaaucuguacaagggcuaguuuacacugugaguuccucaggaauccucccccuuguuuugcucauaacaaaucaagacugugaagucuuugggauggagggcaugagacagcauuauucaugauuaauauucagggucaaccuuaaaaucccagucuacagaggaugguguucauaguagaggccucauacugggcaggcauggagaucucucuacaucuaaauuuaucucuccaagcaccaagucucaaaggcagguuacuuaggacaaauguggcuuugcugcugugcaggcuucccacacacucaaaugcuuaggaccaccugcuucucuaauguauugauaaaaugggcuccaaagcaaguaugauccaagcaugagaauuccucaugagauuuuuuaugcuguuaagauauuucuccucccucuauuuuuacacagcauuccuuguuugcagcagagaguugaccagaaccuaauuagccuuuguaccuuggcacaacucuucuuuaucccaagguccuuagcauucaggauauucccggcacaucaaggaaauaaagauguugacagaugacuaaggagaaaccuccccuucccgugucaaaacucccuuacagcuuugcacauguuaacaauguuuuccuaccucgaugagccauucccucaagucuaccacgugcuuuguuaccucgcuuaucacaaaguucuggcugucagccauuccuauagaugcuaugagcaaugguuuuauucucuaugauacuacgugaaucacucauuuaucuugccuucaucuguagccugugcucaucggagcuucugcuauccuuguaucuuuucugcuuuuuccugccacaugagaacuuuuaucugacugccacuuucccuaacacccaguucuguguucaccauuccuaacucaccuuguccccuuaccuaagguaguaccauagcacuggauaaacaacacaaauuccgucacucaaguucaagacccagguccaacccuauucacauaaucccgugauguucccucaugugucauggccuccauuucuucaucuaaagugauggauaauauuaauagcucacagcauccuaagaguuauaugaggugauaacauaaaauacugagaacaaguaauaaguacuucauaauuuuuaacuauuuuuauuacuauauuuucaccuuaucaaaaaacugucuuccuucuguaugcuaaugauucauauggcacuccugacucaggacucccccaagucuauuuguucaucucuuaaaaguuucuggccaauuauuuauaaugguuuucccggguuuuacuucagcuccucucuaacucuuccaaccauugcuuccucaccccaccccaaauacuaggaccugaaccaagaguuucacauacacuagacaagcacucugccacugagcuacccccacuauaaugugccaacucaugcagaaauaaacacauuugaaaauguagcagaauuucucucuaauaauaacaaccauguugaccucuuuccaucucugggcaaggaauuucuguacuuaccugggcuauugauggcugauaucuacccauucuuuucuuuuuugaauguuuuaacugcaggacuucccuccaccagaaauuccuuccuaccuucaaacuagaccaagccucacuuuuccuaaaaugaauuaccaccacgucuuucucuucccugcuuuuuuccugugcuaccuucauaacucuuugauauuguccauguaaccuguauuuuccauucccaauuuuauuuccagucuccagagucucaugguuuuaccauuucucaccuggguuuaugagcucacuucuauaagcagccauuagauugucaaccuuucuccugcuccuaagagcuucucauucacacuuugccaaagguccuggugauacacugaguagcaacuugaaccuuuccuccuccauucacuuuuauagaaacaaauuguauauaaucaauggugaggcaaaaacucagguucauucauagguccaaccauuaauucauuguaaauaaaauacacauucauuuucuuuagcagugaauggagacaauauuugucuugccuugccaacuaguuuguaacauaauuuuuuuuuaaaaaagucaaaguccaggcauuguuuaugccuuuaauuccagcacuugggaggcagaaacaagcagcuuucuaugaguucaaggcuagccuacuuuacacaguaaguucuaggacaaccagagcuacacagugagacccugucccaaaaccaauccucuacaaaacaaaacaaaacacaaaaaccaagcaacaauaaaagcagacaaagaaaaaaguacauauauaagcaugcuauaaagaauaaaauaaauuuagcaguaaaauauaauuugauaaguuagaaacaaacaggaugcuguaaggucuauauaaagacucuugcuaccaaagaaacaaaccaagguuaaaaacuaaacaauuaaaacacagccaaguagcuucaacaaagcagguccauguccaugaacaguccuuaaucauuaagaggucucacauugaaaccuguggcuuaccuguauucacuugaaaugcaaaauugaucauuggggcuauccugaggcacuuuucauuuugauaauacagaauuaaaguauuaauaauguacuuucaguuaugugaauaugcaaauugaauugaccaauugugagcaggaaauauuaccaguucucggagaaggugcccuugcgauuucuaaggagcaggguuucuuuguaacagcuguguccacgaguucacaaaggaaguucucguuuuccgaagggaauguguccagagaagcagaugguuccauuuccauggggaaauuccucuucuucggauaagacuccugaaaaggagauggaagaaaaagcuucuuaguaaaacuacagccuuguuugauguauaaaauucaggaaagaucacaggucuacugguaccaacuuagcugagaacugacguucuguuuacuuuaaaagguccuauaaccacguaaccccauugugaugaucaauguuuuucaaguguucuuaucauuuguuuccccugauacugcauugguuauuaauuuuugaucuuccucugaguguguguguauauguguuuguguguuccuagucacagaguaaacagcuuuaaucaaccauuauuuccaaugcccugcucuuugccugccuccuagagauaaccaugucacucagugugggccagcuagacacaaggagacuccucugggagguuucugaaaggauguuuuuccacagagaaguuugugaggaggcuacaccuaggcuccucucuaaaggaggggaagaauuuugguuuguuuguuuguuuguuuguuuguuuuuuuucuuuuuacuacaaugcaaacucaacauuaagauaagaguguugguaccauuggguagcuugaauagacccaggaccaguuucuucaggcuucauaaguaaauauuagcauccuuauaguuuaagguguuccuauuugaguuuccucucagauuuauaaguauuccauccaacacacuaacuauacaauuaauauacuauggcuaaccccuuuuaagguuaggauaugauguagaucuaaauuuuauguuacuaaauuccccaacauauuuuaaaaaccacaguucagugaauuguauaacaucucaauuucuuacuagugauguauuaacuaguuaccaauaauuauuggaucuuccccauguguuaguguguguguguguguguuuguuuguuuguuugaguguaugagugugugagaauaugugagugaauguguuuugaguguguguguuuaaguaugugaguauguuagagugugugaguuugagugugugggagugcauuugagugugugaauugaguauguguguguguguguguguguguguguguguguguguguguguguguguauguguguguguuaccauguuaagcccagagucuaagcacuggagauuuugucuuguuaguaaggcauaguccuugcccuuggggaguucaucgucuucuacagaagacaaauaaccugcacaauggauuucagaaugaaucacauuuuauuuuuuucugcuugcuaucuuauaaaguacacuuuacaacugagaaacaaauaacaagaauauaaacucauuuucaaacaaucuuccacgauguacuccagggugauacagauuccaugugagcuccuccuuucucuaugaugauauuuacagugagugcaauucaaggucaggguaauugcuuucagaccacaccagacccucacacaucaaagagucaauuauguucacucuacucuauugaaagcgggaaauugggaguaauuuauuuuuaacaacaaagggugacaaaguagaaagcauccagagaaagcaaucaggagggcaugugcuuucaaacccaugucagagaagaaaaugaugaaaggagacacagcauucuauccagagaagcugcacagccacacaaugguuuucucaacaaaucugaaaagcucucccucaagagcuauuucacaaaguggagggaagggcauagcucuuaaaaaaaaaaaaaaaaaaaaaaaccaacaaaauaaaacaaaacggucuaauguuuauaagacaaggagaagaaauuuggguucauacucaaaguaaguuuuaugcauuaauaguauuaauuuucuuuuuuuuaauuuuuuuccauuuuuuauuagguauuuagcucauuuacauuuccaaugcuauaccaaaagucccccauacccacccacccccaauccccuacccacccacucccccuuuuuggcccuggcguuccccuguacugaggcauauaaaguuugcaaguccaaugggccucucuuugcagugauggccgacuaggccaucuuuugauacauaugcagcuagagacaagagcuccgggguauugguuaguucauauuguuguuccaccuauaggguugcagaucccuuuagcuccuuggcuacuuucucuagcuccuccauuuggggcccugugauccauccaauagcugacugugagcauccacuucuguguuugcuaggccccggcauagucucacaagagacagcuacaucuggguccuuucgauaaaaucuugcuaguguaugcaaugguaucagcguuuggaugcugauuaugggguggaucccuggauauggcagucucuacaugguccauccuuucaucucagcugcaaacuuugucuauguaacuccuuccauggguguuuuguucccacuucuaaggaggggcauaguguccacacuucagucuucauuuuucuugaguuucaugaguuuaggaaauuguaucuuauaucuuggguauccuagguuuugggcuaauauccacuuaucagugaguacauauugugugaguuccuuugugaauguguuaccucacucaggaugaucuccuuguacuaaggucaaaucuaaguggaucaaggaacuucacauaaaaccagagacacugaaacuuauagaggagaaaguggagaaaagccuugaagauaugggcacaggggaaaaauuccugaacagaacagcaauggcuuguacuguaagaucgagaauugacaaaugggaccuaaugaaacuccaaaguuucugcaaggcaaaagacaccgucaauaagacaaaaagaccaccaacagauugggaaaggaucuuuaccuauccuaaaucaguauuaauuuucuuauaaaauaaacaugcacggacaaaacaauaagcuaacagucaugacuagaaaguaauagaguagacucuccauugcuggcuaguuaucuguggaugagaauccagaugaccauugcuggaaaucuccagcuaguuaucuguggaugagaauccagaugaccauugcuggaaaucuccagcuaguuaucuguggaugagaauccagaugaccauugcuggaaaucuccagcuaguuaucuguggaugagaauccagaugaccauugcuggaaaucuccagcuaguuaucuguggaugagaauccagaugaccauugcugggaaucuccagcuaguuaucuguggaugagaauccagaugaccguugcugagaaucuccagcuaguuaucuguggaugagauuccagaugaccguugcugggaaucuccagcuaguuaucuguggaugagauuccagaugaccauugcugggaaucuccagcuaguuaucuguggaugagauuccagaugaccguugcugggaaucuccagcuaguuaucuguggaugagauuccagaugaccauugcugggaaucuccagcuaguuaucuguggaugagaauccagaugaccauugcugggaaucuccagcuaguuaucugugguugagauuccagaugaccguugcugggaaucuccagcuaguuaucugugaaugagauuauggacgaagcacguuugugguguuauaccagagaacugggccuugcuccaugcacuuugcccugugcacuacccuggcuccagaaucugcugcagacacugcuguacaacaagaguugaauaagcccugugaaucugcuggguaguccuuuaagcagacagcacuauuguauaaaugauuuuuaccauuuugcuaguuuguuauuguuuacuucauugccuuucaaaacuaaaaaacuaugguguacauaugcaaucccagauacacaugaggguguggaaaugauauuuuacuuaaaauaccagcagccugggcagcgcagugaaagaaaggaaaauaaaagaaaaaacaaaagaaagggaaguaggaaggaaaagacauauugagguuacaacaguaaaauuguauagaaucuaaucagagagucugcauucuuuucccagcuggaauagcaaauaucaacaaaaaacugacaacaaauucugaaacaaauaugggaaauaaugagaaagaggaggaggaggaagaggaggaggaggaaaagaaggaagaggagaaagaagaaaagaaagaugaaaaagagaagaaaguaagguagaagagggagaggagaaagauuaggcagaagaggaagaugagagaaggaagaagagggagagggagaggaggaagaagaggaagaggagagugagaaagaagagggugaggaagagagggagggggaagaggagguagaagaagaaaaggaagaagaggcggaaaggaaggaaggaucgagagaaagaaagaaagaaagaaagaaagaaagaaagaaagaaagaaagaaagaaagaaagaaagaaagaaagaaagaaagaaaaaggaaggaaggaaggaaggaaggaaggaaggaaggaaggaaggaaggaaggaagggauuuucagcacugaaaacauacguacaagugauauuauacagaccaagcagagauauauauguauauagauauaugcauguaacuauaauuaaugaaaggacaggccaugcauuugaaagagaacaaguaggguaugucuaggagguuuuggagagaggacagagaagggaggaaugauguaauaacauuauaaucuccaaaauaaaauaauuagaagugucucuagguaaaacacugcauuaaaauuuucagagcaauucauggacuugguaaaguuucagugucauugcuuauaaagaauuauuaggcuuuuuaaauccuuaaagaugacuuggaaauuuaauucucaccauuucuucaugcacaggcugauuccaaaucgugacuucugggaauagggcuacaauaaucaugagaaucauuauaacuucuuagcauacugauuccauauccuauggguagauacucaggaguuggauggaucauguucaauauuuucaaauguuuuugagaaacucuaucccauuuaucauaauggcugcaucaacugauauuccauccagugguguuuguggguuucauuuucuccauauucuccuaauauucgugaauuuaguaucagccauuuuaucagcuaugauaucucauuguaacuuugauuuguauuucucugauuauuagguagaggccuuauuucuacauauuggucauccuacacauguucuuuaaggaacagcucuccacguccuuaguccauuuucuuuuuuuuuuuuuuuuuuuuuuuauuagguauuuagcucauuuacauuuccaaugcuauaccaaaagucccccuuacccacccacccccacuccccuacccacccacucccccacuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcucuuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggcuucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagcccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucugcauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuucauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuucuuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugagucuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcagaucccaggugguacagacucucaccuaagcagacuaaauuccuaaguuccuuggagucccgggaccaagauggcgaccgcugcugcuguggcuuaggccgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggccgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucucggaccaagauggcgaccccuuaguccauuuucaagaguucacugcuuccagcucuagaguuguuugagugcccuauauggugacauaaaccuuuuaaaugauguaugguauacaaauacuuuguccugguucauaaguugucuuuucauuuugcucuuucuuuugcagaacaaaagccauuuauccaagguaauucacuuguguacuuuguuuuuauugauuauuuuugcacauagauaaaaaagauauuugcccagacuaauaucaugaauauuuuaauuguuuucuucuaguacuuuuacaguuucagguuuuagguuuaaguucauuuuagguuaauuuuugcagagagucugagaugaaaaucuaacguaauacuucuaugaagcuaucagguuuuccacagcaacuuauaggugagaaugccccuuuccuauuuuguguuuugaguaucucuguaucuauaauugcuuuuccuacaaguauuuugcaacagcguuugaccacaaacuuuucaacccccugucucggccuccaaagugcugugauauuagaggaauguacugcuacaucuaacuuucuauaaaucauauaucaacauaaauuauauauaaauuuuauaaucuguuacuuacuucuaaaaauauauuaugaacuuuuuucaauguuaaauauauuugguccucgauuuugaaggcugacaagauuuucugauucuaugauauacaagagcaagauguauucucaggaacuauauuccaaauucugaguuucaucuuagauuagccuagugauaugugacugcgcaguccccugugauacuccucagugggagcaaaucacaggucucagugaaucaugugaucgaaaggguaacucaauguuauucuagaaaauauuuuauugcuaagcuaugaugucugccagcuuagguaaaguaaaugcacauuugguuuagaauauuuuuaacgugcaauggguguaucaagaucuaaccccauucuaaauugaacaugucugcacauguucaagugauaaauuuaagguuagauuucaguauacauguagucauaacucagucaguucuaucauauugaaauguaauguuuuccucuuuuaaaaacccucuuauuuauacaacuuguuuauguguuccacucuuuugaaauagaauucccacaauaaaagguauauaccauauguuuaggaaaaguuaaaucuguuucugaaauguucuaauucacuccauauguuggucgguucuaggacuagcaucauauagucuuauuacuggagccuuaagauucauuucguacauggauggauaaaucucuccuuauauucaucuacgucgaaucauucauuccuaccuucauguuuauuuuaauucauaaacaucuucugaguuauuaaauaauuccauaugcuuuguccacuaccaagaaaucauacuuccauguaucgggucaccucaccaagcuagucuucaucucugaugcuuccuuggugugauucccagucaaucaagaacuauacuuaucccucagugagcacugucucaaacacauuucuuucucuucacuguacuuuguccagauaucccgugcguccuacuuuaacucacagagcaacuuccaaacuagccucuuggcucuaagguugcuuuucucauauuuauuuuacuuccaaacauucauaugagggaguuaaggcuuaaucaugucucaaguagugcucuugauuuugauauaacuuuaugagaaaagaauuaaugcuauagacuuaguagguguagauacuaagcagaucccauaaaccaucucagaauucucauaugaagugauuucauugaguaaacuaguguuucucauacaaauuauauucauauaacaagagcgggacaaauaaccaagguaccguuuaaugagaugaaguauaauccuauuauuaugauaauagucuuaauguuuaaaguguuugucuagcauuuagcaaaauuccauguggacagcuggacagugaauacacgcugaggagaacgaggucauaaaauaguucuucauuuuuuuguucucuagccuucuuuuucuacuuaccugagagcugaggccaucuucuuuaaaaggcacauaaacacuucaucaaucuuuguuuaauuaagccugagacaaagccauuuaaggacaaccauacauuuggaucacuauagggagaacagcaauauacauuugcaaaauauuuuguguucugugaaacaaacccuacuuuauuugccaaaaugauucccauuuagugugcucacaacaauugaucuaauuuuuauccagaaaauaguuuggggaguguuaaaggacucaucuaauaaaaaccucaucacaguagaagggcugggcuccaaccuagaauucagauauuuguauugugauuuaaaaguacuauggugggcaggagaugggucagggcuaaagagcacugacugcucuuccacagguccugaguucaauucccagcaacuacaugguggcucacaaccaucuguaaugggcauccaaugccaucuucuggugugugucugaagacagcuacaguguacucacauacaugaaaucagucaaucaaucaaucaaucaaucaaucaaucuuuaaaaaaaggaaaugugggaacccgggaaacaccgaggaggcaugggaaagucaguuugauaaaacacauuguauauguguaugaaauucucaaaacauaaaugaacaucuuuuaaaauaaaaaaaucauuuuaaauagaagaggaaggaagaugaaacaauauuguaguaauguggcuugcuagccuuggaucuacagucagcuacaaggggccuggauauagcucauuggauaaagugacacuucuacaagcacaaggacuuaagugcagauccccagcccuuacuuaaaagcuagaugugggggcacccccuguaacccuagcacucucagcacuggagacaggagaccagcagaucccuauugggcagccagccuaggcaagcugauaggcuucaggguuggugaaagcaccugaccaaaacaaggcggagagcaagagaggaaggcaccaaacaucauccucuggccucaggagccauggacagccacgcaccuacacacauguacaugcaucauaugcacaaauaaagaaaaauuaaacaaaucagcuugaaaccaaagacagaagguagcacacagaugcagaaaagggccagaaaacauucucuacuagaaccucugcaaugaaguagagguuuguucuuugucuguuuguuuguuuguuuguuuguuuuagucuagugggauccauuuugaaugccccuaaaccaugaaauaauaaaacugcuuuuauccuaguaaauuuggggaauucgauacaagaacaacaggaaauuuauaacacaccagcugaggucaucaagaacugagaaagccugagaggacaucaaauuauaccugagugggggggaaaaugcuuugcuaucaauauucaaagccagugauuuuuaucugucucaaaguuaaugcggcacuuacuccaucugugugucugccacuuagcuggagucuugacacagaauccuaaagugagcuuggaaaaauaagugugugccaccgauggccaggugacaauuugaaagagaaaaugagggaaaggagagaggucagucuuucaucacauauuuaaauaaauauaaaugcucugauacaauaacugaaaggcaauaggauacaaaagguauuugaaaguuaacaguuuuaauguuugcagaaauuuauuauaguuauuauggcaacucaagucagaggggaagcaaugacuuauuuauuauuugcuaguuugaugacagauaaguuauuagaaauaaauaagaacucuggaaacacauccgaaauuauauauauauauauauuuucuccuauacacccaugucuguccuggaaccgacugcauagacuagacugguuuugaauuuauggugaucuucuccccucugucuucugaccacuauauuucaaauaaauguucaacuaaugagaagauacaucuuuuguuauauuaaucuuaaagaauggccuaugacuaaaagauugaacaagacaaauaaccagaauugaagagggaaaaaaggcugauaaaucuauguugaugcagggauuaaucuauuuaugagggagccauugaagagagucuuuaaaaauugugcgaagaugcuaaguguaguucuccauaguuuauagcuuuguguggugguugggggugagaaaggauucaguuuuaaggagcuggccacuggcaguuugaccaaucuccaaugaguauaugaugggcaacacaaauuagaguugguauauauuuuuucuuuacugagggggugggggugggagguggggaaggacacaaggguggaaggguggagcugggaagaauggggagugaguaugaucugggugcauuacaugaaauucccaaacaaucuauaaaaauauuguauugggagaaaaauggaauaaaacuuucaaugacaaacaugacaaaggacucauaucuuuagucucuaaacagaauuauaauuaaaauuaaagagaucaagaacuuaagagaaaaaugaacaagugaugagaugaucaugaaaauaacuagagacacuaaaaggagaagugucugcucuucuuuaucauucaacauacauaaauucaagcaaugauuccuaacuaaauuccuauaaacaaugcaaagggggcuuaaaaugggcgcuucauaaauuuuuguugaacauaugagcuaaaacaucuuccagccuaguuuguuuacagccacugguugauauagacuuuaaaacuuauauuuagcuuuuuuucuguuaccugguguauaguuaggguuuccauugcugugaagcgacaccacggccaaggcaacucuuauaaaggcacacauuucauuggggauggcuuacaauuucagugguuuaguccauuaucaucauagugggaagcauggcaguguucaggcagacauggugccagaggagccaagaguucuacuucuugauccaaaggcagcuagaaggagacugucuucuacaggcagccaggagaagaacuaucuuccauacuuagcagagccugaacacagcagacguuaaaaccugccucaacagugauacacuuccuccaagaaggcuacaucuccuccaauaaggucacaccuccuaauagugccacauccuaugaccaagcauuaaaacucaugaaucuaugggggucauucuuauucagaccaccauacuugggauaggauggaaucagaaaauuuccauaacuauuccuagagcauaacuauuuguauacauuacaucguugcuauucuauuaucacuauguuuuaguagauacuggaauggaggggggcagaagagugaagacugcuucuucuugucaggaaagugaaaaaauguaaucacgcuggguacaauagagaaugccuuggagggcagaggagggugggucacgguaacuucagggccagcuuagucuacauagcaaguaccaggccagccugggguuauguacugguagcauucuccucuacacuuugucuccauauuuuuucccaugaauauuuuguuccccuuucuaagaaagacagaagcacccacacuuuggucuuccuuccucuugagcuuuauguggucugugaguuguaucuuggguacuccgaguuuuugggcuaauauccacuuaucaaugagugcauaccagguauguucucuugugacugaguuaccucacucaggaugauauuuucuaguuccauccauuugccuaagaauuuuaugaguucauuguuuguaauagcugaguagaccucaauuguguaaauguaccacauuuucuguauccauuccucuguugaggggcaucuggguucuuuccagcuucuggcuauuauaaauaaagcugcuauaaacauaguggagcauguguacuuguuauauguuggagaaucuuuuggauauaugcccaggagugguauagcugggucuuuagguaauauuauguaaaauuuucugagaaaucaccagacugauuuccagagugguuguaccagcuugcaaucucacuaacaauggaggaguguuucucuuucuccccauccucaccagcaucugcugucaccugaguuuuugaucuuagccauucugacugguagaaucaaaguguagagcagagacugaaggaaaggccauccagagacugcugcaccuggggauccaucccauauacagucaccaaaccagacacuauuguggaugucaagaauaugugcuugcugaaaggagccugauauagcugucucccgagaggcccugccagugccugacaaauucagagguggaugcucucagccaaccauuggacugagcaaggggucuccaacggaagaguuagagaaaggacagaaggaacugaagugauuugcaagcccacagggagaacaacaaugucaaccaaccagacacccuagagcucccacagacuaagccaccaaccaaggagugaguacacauggagggacccauggcuccagccacauauguagcggaggauagccuugucagguaucaauggaaggagaagccuuugguccugugggaauucaaugccccagugaagaguaaugccagggcagggaggcaugcguggguggguggguagguaggggaacagccucauacaaucagcaggagagggcacgguauaggagguuuugggagggcacggaucuggaaaggggauaaaauuugaaauauaaauaaagaaaauauucaauaaaaacauaaaaaaagaaagacagaacgaagaaagagaaggaguagaagaaaagccuuuuuaaaaaagcuauaauuagaucuaaucaaaaucaaacauugauuguaaauguguauuaggauauaauccccuuagaaguucucaauaugcagggagcuagguccauugcaaaucuucuuucugauugaccacuucagaauggaagguuucaaucuaaacauuugaaaccaaaguagaaaucucacuggaaaccugcugagaaacccagguggguucuuccuagugugacuugcaucugacuacauaucagccccaaauugcccagaucagagccagaagccccagaaucuuugaauacaaccuuauuuggcaagaggagcauugcagguguguguaguucuuuaaagugaagauucuuuaaaauuagggugauccuuuuaauucaaugacugcugucaacaccuuaguuuccuguuuugagcuuugagaauugccauaugauaaaaugccugugguuuagacaggcaguuauaggagccauaggaaacuaauacaggggagagacuaacacagaagagagaacauuuaccacauaguccuauugaugaaaaaccuucaaaguaaaauacuugacugaucaucuuuagugucuaaaauuuuaucuguggaaagaaauuaaugacucaggauuaucaggagaggggauuaucucugccugucacaaaaucacacauguaaaacuuaaaucaacauauuaugugauccacaauuucuacugggaagaaauuuuucuucaauuaaaccuaaaaauaaaaauuaaaaauacagucuuaagaaugugcaccacaggugagagagugcagacuugcugaagccacacagcuuuugggacaggcacuguuuugggcuucagauuccccgccagaggagagguggcugccugggagggcucugaccaccagagcaggugagggaaccaucuugugucuugggucccucagagaccagucugugcagaugagcgcucagacugcagaggcaacccaucuucugggacaggcccuguuucgggccuucaucuucagccaggaggcaggucugaaugccagacuucugugcauaaaaaaaugggguucagagcuaaacaaagaauucucaccugaggaauaccaaauggcggagaagcacccgaaaaaauguucaacauccuuaaucaucagggaaaugcaaaucaaaacaacccugagauuccaccucacaccagucagaauggcuaagaucaaaaauucaggugacggcagaugcugacgaggauguggagaaagaggaacacuccucuauuguuggugggauugcaagcuuguacaaccacucuggaaaucagucuggcgguuccucagaaaauugaacauaguacuaccagaggaucccacaauaccucuccugggcauauauccagaagagguuccaaccaguaagaaggacacaugcuccacuauguucauagcagccuuauuuauaauagccagaagcuggaaagaacccaaaugccccucaacagaggaauggauacagaaaaugugguacauuuauacaauggaguacuacucagcuauuaaaaagaaugaauuugugaaauuuuuaggcaaaucgauggacuuggagggcaucaucuugagugagguaacccaaucacaaaagaaaucacaugauauguacucacugauaaguggauauuagcccagaaacuuagaauacccaagauacaagauaacaauuugcaaaacacaugaaacucaagaagaaugaagaccaaaguguggccacuuugccccuucuuagaacugggaacaaaacacccauagaaggaguuacagagacaaaguuuggagcugagaugaaaggauggaccauccagagacuaccccacccagggauccaucccauaaucagucaccaaacccagacacuauugcauaugccagcaagauuuuguugaaaggacccugauagagcugucucgagugaggcuaugccaaugccuggcaaauacagaaguggaugcucagucaucuauaggauggaacacagggcccccaccagaggagcuagagaaaguacccaaggagcugaagggaucugcaacccuauaggaggaacaacuauaugaacuaaccagaacccccagagcucgugucuguagcugcauaugcaucagaagauggccuagucggccaucacugggaagagaggccccuugguauugcaaacuuuauaugccccaguacaggggaaugccagggccaagaauugggaguggguggguaggggagcagggcagggggaggguauagggaacuuucgggauagcauuugaaauguaaauaaagaaaauaucuaauaaaaagaaucucaaaaaaaauaaugugcaccaaaucaggguuuauauuaaaggaguggacuuuggauugaaaggauugcuaaacaucauucacaagaaaaggcaauauaguauaauggggucugcaggccaagccacauaaaauccaagugggucucauggaaacaaugaaaacuugggauuuauaaguaaauuuuccuuaaauuaaaaacuccaaugaugaacacagagaccuguguuuuacaaauagcaggcuauuugaaugagaauuauuggugaaaaaugagauauaucacauaagauacuuaguauggugccuuagugccuaagugguccacagaugaagucaguauuaugacucacccauuuuaaaaugcaauacuauaaaauacuguagagguagcaagcuaggaaugaugucacaggauagcaaucucaggccucaggaggcuaaacgaggguggcagugacuuuagucuaaccugaacuguucaugaacuccuacucaaacaaauaaaaacaaguaucauuuguaauaaaacaugaauacacacuguaucucuugaaguaaugcuuacacaugcaaggguuaauaauggaaaacaagauaauauucucuuuuauuuuguucaaccuuuuaagagccauauguauauguucuauuuaggcaaaaaaaaaaaaaaaaaaaaagucuauggaucuaaaugcugccugaagaaggugaugaaacaauuucaaaaauaugcaauuuugacuuuuauuucugguaugguugugaagaaauuugcauacccaggugaaauuguaaauagugaaauaccaagaauaaucuuaaugaagcaaauaaaugcaaaugaaaccaugcccaacacuaagccgaaccagagagaucaucucaguaggacuccucaacaaaaauccagaugaucuacuuaugaaauaaaggggaauggauguaacucaccaacaguaugguaaaguguuuucugugaaacaaccgugaagcuaaaagaucagagggcauugccgagguggucugaauaaaaauggccuccacuagcccauagggagugguacuguuagguauggcccuguuggaggagguguggccuuuuuagagguagugugucacuguacaggugaaauuugaggucuccucugcucaaacuacaccuagugugauuucugcugccuagaaaucaagauguagaacucugugcuccuucuucagcacuaugucugccugugucccuccaucccuccugccaugaugauaaugaaccagaccuccgaacuguaagccagccccaauuaaauguuuuccuuuauaagaguugccacggucauggugucucuucauggcaauaaaacccuaacaaagaaaaugccuagggagagagagaucagaugaauuuuuugaaaugagagcagaaauaucccacucuuguuuugguggagggacagagaagcaauaaguaaaaauugaauauucaaauguaaauaguguuuacaauuaaguauugaaacccaggagaugccagugaauuuaaaagucaaucgauguucuagauaaauauucaaaagacaaagaacaucaucaauuucaaaaaagcaaugcuagacugguguaaaguuggggagacaaauguuuagaguugcugugauugaccaaaggagaccuguccuacuugauagggugacuaaauuggggcugauauucuugagaguguaugaucccucuguugcucccuuccucaggggaaguaacugguuuguaaauuugagacaggaacugagccugugucacugacuaaagaaagugagggaauggggcagacauuuugaaacaucuucagacuuuugaaaaugcuuugcauucuuuagagucaaugcgguuuaugaagcaacaugaggguguucaguuuuauaaagaguuaaaaaaagaaaauacguuggcuuuaauaaacaccaacaacacugaauccucaugauuguguaucuguuaagcaacuacuagguaagucaaguaaugcuugagaugucaaauuaagaauuccccauauguuaucuaucuuaguuuccuauugcugugauaaaggcaacucauaaaagaaagcaauuaauuuggauuuaugguuucagagaguucgcauaauaacggagcaaacgaacaguugugugcucacauguuaaucuacaaccacaagguaaagagauacuggggauggccuugaaucuuuugaaaccucaaaucccacccuuagugauacacuuccuccaucacagacacacuuccuaaucuuucccaacaaguuccaucaacuagggguuaaguauuaaaagaaaauaugagccuaugaaagucuuucucauucaacccauucuggccaccucaggcucauggccaaaucauaaggcaaaaugcauugaguccaacuucaaaagccucuguaguuucuacagccucaacacaguuuaaacacaguuuaaagauagaaagucucuuuacagacucaaggcccucucuuaauuguaacacccuauuuaaaaaaaaaaaaaagauacuuucaacauacaguauggcagaauauaaauuaccauuccaaaugggggaaaugaagacacugugaggaaauacuagacugaagcaaggcagaaauccagcagaacaauuccagacccuacagcuccaugucuaaugucaaagggcacgaaugccugaacccuucuggcuucgcuguuugcaacacacuugucucucucaagcacccugguuccacgcccuccuguaggcagcucuucucaacagauaucucacagcucuggcauccccagugucuugggguuucuaacacaauccaggcuucauuuuuacacuuugcacaauagccucucagggccuccaugcagagacuccccugcuauaagcccguccucgguggcuuuucuuagcuguagagggagauuucacaauccucucacuaagguauccuuuauaauucuaaagcuggaaccaugugggaaacacuuucaaguuuuaccugccuaccugauacagaaccuguccccacugaauugcauuuacagaagugacaaaagcuggguuggguggggucuuucccagagaacaucccucccuguauucuaccucagaauaugccuucuucccaucucuuucagugcaaaucuuggcuccaacauuaaauuuccugaugcccuuuuuacuucagucuguauauuuuguauuccuuuucucuacuugcucuauugcuuuguagaucuucacagaguguuuaauaauagccaugcaacagagucaauauuagguuguuuugaaaucuccaccaaggaaauuaacccaaaacuuuucaauuagcagauuauuaggucauaggcagaaaacagcacuauucuuugccaaaauaucccaagaauggucucuagcccaguugcuaacauugcucccuguugaaaucucuugaucuggauugcuauagcgaccauuacucucagcaccauugucuuccaauguccuacucggauaauccauuaagcuucaguuauagcauuuaacugucuccuaguccaaagucucaaagucuuccccaucccuccaaaacagcaugaccaggcuagucacaacaaugccucauucugagcaccaacuucugccuuagccgcauuucuauggcugugauaaaacaccacuauaaaaaacaacucguaaaaagaaaguguuuaauucaagaaggucagaauuccuaagauaaauagcugaaagcucacaucuugaucuauaaccaugaggcagagagagggagaccaggaaaggcauaagugcuuuugaccuucaacggcugcauccaaugacaugaaucccucagcaaggccacaccucuucauccuucccaaacaguuccaucaaacugggaacggagcauucaaccaaaugaaccuauggcaacccaucucauuccaaccaccacaucauuggucuuccucccacccaugcuugcucugguaaugcaagcucccucuaccuuccaguauucaaaaccagauucaucucuaucugguccagauucuauauuagccuggaacuucaagugcuuaacuucacuuucuaguuaacccuacgacaacauguuguuucuguauucaagcuuuucucuuauacagcaaacaccacagauugggccaugcauagcaucauuuuauaaugcgaucuagugcccucuucuggccugcaggcauauauacaggcagaaagcuauacgauguauacuuaauaauaauacauagaaaagaaaauccagaacccuccuuuaaaaacauaaaauauaaaaccaaccauaauccaguuauuacaggaauguaaagcauuauacaagccugauaucagcaaaaagaguuucucucuuaagccaugaccaugaaugcuucaaccugcaaauuauaacuccaauaugacaccaaaaaacaccucccuaucagauuuuauaauuaauuuaagguaauaauuuuagaacuaccauacaacaucauuguguagaagaauaccccuucuuuagaauacccuguuaaacucuugguuaucuguggaacaucgugucccaagucucccucacaaaugggagagaaucacaccacgcauaguuugugcucccaaggguggagaguucagccagaaaaucaaacccaagcgauucuguuugugucuauaacaaacauuuaccaacagcuugcagauuuuccaucccaguuguguggacacagagacauuugguuucaacauuugcuuggguaauugggccauguaaaugcuugcuuacucugcuguggcuuuacaaagaagauuuaugcauuaaaaauucagcuaaaagguuguauaaaauaacuucuuaggcaacgauuaggcacuaacguaguccuacugaagucuguauuuuacugaagccuaaagacugcauauuaaaacuuaaggaagcaaagcauuacaaagugagagaaaauaaaaggauugcuuuaccugagacugcaagaaucacacuuaaagugggagaguggaacugguaagagagaagaaaauauauuaccaaauuucccaccuaaguguucagugauuugugaaagguaagaauauaaacagaaauaacaccagaccucauaaggaaaacagguugccacuuaggauaaacuucucacuaaacuuuguaucaugaguguacagacuuggucucaagaaaacugaaaaccgugauaaggauuaaucaaagguucuauaaaaauucaugcucuuuaguauguauauuauaaugaguaugcauaugaauuacccccaccccaaaauuggccaaugaugacucuagcagaugauauggcaaucagggcaaugaacacucuugucugggaaugaauucaccuuuacccgacagcaccgaaucuuaaccguggguugcagcaguaccaggugagccauggauacuuugacaacaguaagagguuucugaauacacaaugaccuaauauuaauugaagccagauugcugcugggagugcuucccuauguugcauuccgagauuucacuguagccucaaugcacaguuaagugcacaggugaacuuugcaggaugcaucuuuccauacaguagcaaccaaagcuuccuggaaggcaucaacucuugggauaacguuuauucaccuguugugacuguugucuccgaggcuuacuaccugcaucugcuaaccuaggccuaguccuggaagcuucuagucuuugcacaaucuaaucuaggccaagaauguuaaacccuugguuaucugugaaacauagugucccagucucccucugagacuugcugcugaauaagcucacccuuucuucugcuuccugaacucgggcuggcugguucaacucagcuguucuggcucaaacuccucucccagcugacugacuccaucuggcuucucucagccucugaacugcucugcuuggccucaaacugauuuuagcaauccguucgaaucuucuggcuccuucucauucucuggcucguucugucuuugccugugucuagcuuguucucucuucaaucugucucuguaaaacucuccugguaacacugccuccuucucccucccugggcugcuccacucucccucucaacucugcugcacuguuccaugcacucuacuguauccuggacuguaucucuucuccuguacugucugucucucccuuaacugcuucccucuccucccucuucucaugagaguugggcauauccuauucugucacaucuuucucugauuugucacuuuuuucugcaacucaauuacauaucacuuucaaaaguggcugcuuccuccugcaaacuaccuuuucccucauuguuuggaauuaaagacguguauaaggaugugucuguauuccagccugagggauugaaggugugcgcuaaggcuugaucuacacccuaacuagaaauggguucaaauagccuguaacacagcucagauuugacacuguugucuguuaugaauugcaguguauuucccccuuucuauacauacaaagcuuucuucuauuagcaaaacacagcagcuuaauuuucagaaaacaaagaccuuaauuuucuugcuguuguuccccagcuucugaggaucaaauuagcucaucuucggauggcauuguguuauaauguuugguuuaaaauuuuguugcuacacuugcuaacacauuucaagaacaauccuuaaauaaauuuuaacuuggaauuaggacaauuucuagaaagaaaaaaaaaaaccuaaacacauuucugccauuuuguauaucuuuuugccaagcaacauuggcuauuguaauuaaaaaaaaaaaaaacaaucaaaucugaaaaagguugaaaauguucuaugcccugcaguaacagauauugcaccaagauucaauucuuuaugcaaaaauaaauauauccaucucauugaugaacaaauuugcuuucaauuuuaauaaauggugaaauuauaugaacuccaaauaauuauuuuaaauaaauuucuuuaugauuuauuauuauuguuguuugaucuggauacccauuuuauauaucuacauauuuggugcuaaauaaaaauuucucaaaaaaaggaacccuauaugaaaauguuuaagaaaccccuagucuaaaggauuaugagagucuugugguagagaaaacaaucaauagccucugauauguagacuguuaagagauguccaagauuaucauccuaaucugguaacacaaggacuugccuguggcaauaacaaggccaagauuaaucaaaugacagaaaggauaaaauaugaauuuuaccauaaaucagcacuucccaguguaggggaaugccaggguggugaagugggagugggugggugggugggugggggagcauucucauagaagcaaggagagggggagggggaagggguuugcagaggggaaaccaggaaaggggauaacauuugaaauguaaauaaauaaaaagccaauaaagggggguaaaaaggacaagcagaaaugugagucccacacugcucacauaaacaguuuguaucacuagcucuaagguaaauuggaacuugagcaucuauauuuuuuuggagauacuccacaucugucuaauuagauacaccauacucccacacuaauaaccuucacacgacaugaagucuuuuauaguuuucaaaaacacuaucuuaaaaaccuucaguguuuuuccuacuugggcuuaaaaaaugcuuguuauuuuaacuauucugaaaauauuuuuaaauuauuugauauuauugcauuucuucuuugagcugugcuaaaguaucugucuuuuuugguuaucugaguccauuuucuagaggcgaacucaccagaagaaagaaggaaagguaucauaaagcuauggacauaauucucagguacuuauuaauacuaauacauuuccccugcucuuuggaggaaaaaaggugagaaaaaucuggguaagcauuacuuuuaaguucagugcuucucaaccucccuaaugauaggacccuuuaauguauuuucucauguuauggugauucccccccccccaagcauaaaauuauucuugcugcugcuucauaacuaacuguguuacuauauuguuaugaaucgaaauguaaaugucuguguuuucugauaguguuaggcaaccccugugaaagggucauuugacaccccccccacacacacacacacacagggguugaaaaccacuguuuauguguaaaaagaaaacuggauaucuugcauaucuuucaucauuucuaagccacguuguuugcuugacucuuagaguuaggcuaucagguagcccuugagcuugcuguguugcugaggccacagugacaucuagaugguggugguucaccgccagagcguugaauuacaagcaugggcuaccacacacuuacagcuuuuguucuucacuucuugggaaggugaagcaucauagucuagcaccaaagccaagaaaaaugaaaugaacuauuuacauuucauuuugcuuccuaaauaauaucauuagcacauuuaaguucugcuguuuaucccaugcauugagcauucaaccaacauuuaucaauaucuuucauaaaauaaggaaaaauacaaugucucugccuugugucucuuauauuuaugcuuaaauauuauaaacaaucuaaagcaaagcaaaacaaaacaaaaaugaaauacagaacuauuuucuugaguuacaguaacucaccucaagcuuguucacuacacucuugguggguagguaccuuguaaagggaagugguucucucucucucucucucucucucucucucucucucucugucugucucucucucugucugucucucucucucucucucucucucucuguguguguguguguguguguaaguauugggguaauuggacugcugaaauauuugugaaauauuugcuauuucauguacugacugagaucaagacaaguccuuuuucauuugguuagaauuugaucaauucuuuuccuuuaaggagagaaugugggagaaggaggagaaggagaaagaagaagaggaggaggaggaagaggaagaagaagaggaggagggggaggagaaggaagaggaagagaggaggagaaggagaaggagaaagagaaggagaaaaggagaaggagaaggaggaaguaaauucccaaauuccccuucaguuauuauauagaauuuaucaaccaaggaccaaaauaaauaaauaaaugccccuuuucuauguuuguauaugucucuuucuauguacgcauauauacacaugcauacguucauauaugcauacacacauacauacacaaaaauacauacagagauauaugugaagagucuucuuuuuaauuagauauuuucuucauuuacauuucaaaugcuaucccaaaaguccccuauacccucccccugcccugguccccaacccacccacuccugcuuuguggcccuggcgucccccuguacuggggcauauaacgcgaagucuucuucguaaccauauauacugugacauuuugccuguauucaauaaaaugacuuuuccuccuuuuuauugucuuacaaggccucauugcaaaauguuacauggauuaauuuugauaaagauggaaucuuccuuccuuucagagaucaaccugaaacugaacucagagggaugcuaaaaacugccugaacuuaguagucagaaugggaaggggguggggcagaauucccaacucuugucagguaaaaugggcaaagucauauugaaugucaggaagaaaauggaugauugacguaauagagcuguaggcagcuggcacacacugacauucacccaugaauuuauaagcagucacuuauuccaccggccugaugaagacuuaaggcagaaaagauacaauggaacugaaguauaagucuaucagcugaaacaaaggcaauuaauugcuagcauucuugaacaucuaauaauaaaaagaagagugcuaguuagcuacagaaaggcaagcuuuacaagaauccaaugcucuaaaacauuucaaaucucuauuuaaacccuaaccaauugucuuugaucuaguaaauacagaaacauaaacaaauacucaacuauacugcaagguuucagagagucacaugugcugcucucaacagaagaaccaacacucuucccugcuaugcuaggcaguaaagagcaggugaucucuuugaaugcauagacuguguauaccaguauucaggagcuuggucaaaccaagaggaagggauaccuaaaagagacuuugaaaacugaaagugaagugugucuucuuuaugaauaaggaaaaauauaacggggaaagcauaaagucagcuccacuaggaggaaacguggcuaacacacauuugacaugagaugauccauuuuuagcaaggacagacaggcagaauauaguuagagaaguagguggauauuaucuuaagggugcaugugguguggcagaugggauugacuccaacaagggaacaugauucuuucagagugauggcaggucagagaugucccaguuggggaucagugauaaaguuccaggagaugcaaacuuggagaaauaaaaacaaagugggaaggguaaccauacaagcaggagaaugaaaggaccuggaaugcuauggaguuuuaccacuaacugauuaucuuuuagacuuaaugcaauguaccuuuggugguuugaauaugcuuugcccauaggacguggcacuguuaaaaggugugguccuaucagaggaagugugucacuguggagguggggcuuugaggucacauauauauguucaagucuggccaguggaaucagacccuccuccuggcuuccuguagaaaucagucuccuucuugcugccuuuggaucaagauguagaacucucagcuccucuagcaccaugucugccugcaugcuaucaugcuucuugccauguugauaauggacuaaaccucggaaaugguaagccagcccaaauuaaauauuugcuuuucuaagaguugucuuggucauggugccucuacacagcaauaaaaacccuaagacaguacuuuuccacuaaauacauuugucaggguugaaugagagcuuacgugaagugagcauagggaaugagcugcauaagcagaauuaugcugacaucaaauucuuguauugagaaagagcucaugaaaacuguuugguacugccagauacuuuccuaauuauuuuauccauuuuggcacuguuauauaauauccauaauagaucacuuguuuggacugaucccuggacauuagacccaacagaccaaacaaaacagucacacaguugguagaaagaaccaaccaacuucugcaaguugaucucugaccuccauaugcacacccugucauauguacacacacacacacacacacacacacacagagagagagagagagagagagagagagagagagagagagagaccgacuaaauaaggacagaugucagaaaagauggaagaaaaggcagccaaaucuccaaacagguuaucuaccaugauaaggaaacccuguuguuuggcucuuuacaagaaaugguaaauuuuaaaugaucaauucauuuuacauucuuuucugcuuuucucaguccucuucuacuuauacagcuaauucccuaugcucacuucaucuaagugcucaucuuccuuauagaaugaggucuuguccaauacuagaacugcaggucaaagucuaaggucuuuacauuuuguuguaauuuugucuuaugauaggaaaaaaaaaaccaccuuucuucucaggacagauacccauuuuuuauuucauaagaaugaagcaagaacauggggucucuauguaugguugugagaccccaguguaaaagagacuucuauucuccuguuauaaugauugaaugggaggcuuacugccuccgucugcuaaccuaggucuaguccuagaagcuucuagccccuguacaaucuaaucugggccuagaauguacuaacccucugagaccuacugcugaauauguuuucuccucuuguucuuucuaauuucuagcaggcugguucaacucagccauucuacucuccuucucaacuccacuuuacagcucuccaugaacucuacuauaauccuguucuguacucuuccuccugaacuaucugucucucccuuaaguagcuucucuuuccucuucucuugagaguugggcauauccaauucuggcaaaucuuucucugauucaucacuuuuucugccauucaauuagauaccacuuucaaacaugggugcuuuccuguacaaacuaacuuuaccuucauuguuugggauuaaagcuauguggaaagggcugagcaacacccuaacuagagacagguucaaauauccuguaacacaccaggccuugaaagaugaguucucaccuuagagccaaggccaacuuauagugcagacuggaggcugaggccacuggaauggaaucucacucuaaucuggccaaagugucucuacuguggcccaaaauuaccucuuaagcuaggagguaggaugggagcuaagaaaauguguaccaaagaggcuuuuauguucacauaucuaacacuuuagcguuaaauguuuuuaaaauaaaccaagaauuacugaguaaaugaauuauucucaugcucaaugcauaccaacaaaucugcugcaaagauguuguuaagauauacuaaaauaucaaguauguuuuuauuuuucacuuucuaucuccuagaauuauauuccaaacaaguaguucucugggauagaaaaagugaugcuaugaguuuugcuauagugauaacuucacaugaaauaaacaagcaguugcaaauuauaaaaacagagcuuguaaaaacauuugguuugguuugaaguuguaauuuaaugccugccacugacacugcccgcugcaucagagaacuaaaauaaaacucacaguuaauugacaggcaugauaaaccuacaauaacaaaauuguauugaaaugaucaaauaaaaacaucagauugauugaacucccaauuuaagaauuuucuguaguccaaauaagucuccuuaaucuccuuuuuuguguucuccucauaaaaguuagcauauaaaaagauaaaagcuuaucauuaggacccaagauguagcucagucaauaaacagcuugcugugagcaggcagaaagucuuagguucuauucccaguaccacaugaagugggggauguuaaugcaagcguguaaucauuguagagagguggaggcaggaacggaagagguccaagaucauccucagguacaaacuggauuuaaggccagccagaguugcgcaugugcagcaaauuuuuuuuucuuaccaguuuuagcuaaauaacucuucuagaagucuagcuaagggaaacuaucucauuggcaaagaaucucaaacugaaauuauuuuaccuaguccuuggugguucuucauggacaccacuuugcccuuuccuguacaccauuuuguuuucuuuuccacaaugguuuaccacagagaggcucaauauuuuuaaaaggaaaaucacggaaagauaacauggggaaagccuguagaaguguuguggguuuugcuuguuuugagggaagagauagaaacuaucccuuauccauccuacaauacaucuccccauaauaauucaugaaaaauguauuauuaaugacauaaugauaugugaucaugcacuaucuuccuuaaaaaccauaaauccugaaggccagcauuaaugaaguaacucacuuaucaaugcucuccuaggcaacacucugaagccagagugaaagaaggcaguguuuggcaaacauguggaaaaguuacucgggcaaccuagugcuugcugccuuguuuuuccuaaauuuauucauucaaugacaaucacccaacaauuauugacucgcauacguuauaggaauacaagcauucugcaauaggaauuauuauaaguucaaacaauaagcacucugcaaauguuauuauguuucuaccgugggccagauaccuaaauguugggaugagacugucuggccagaaaugcaaacccuaaaaagauaauuacaagauucauacgugcgaugauggaggcuucucaugaggacauauaacuaaggcacaccagaaggaaccgagguaggacuuacaggagcuugauacauuucaaacaguuguuauuucuuucucucuuuuuguuccuuuacuacaauggauuuucagcucagaaaauagaugccagauacccaucuccaaacagaaugaaaagagucuuucaaaucaagauauuauuguacaugauuuuuacaauacuguuuguuuguuuguuuguuuguuuguuguuuguuuguuuguuggggcagggucucacuauguagcccuggcuggccuggaacucacuauauagaccaggcuggccucaaacucacaagaaaauccuggcuucuaacucugcugaaaggacccugauauagcugucucuugugagacuacgccggggccuagcaaacacauaagugggugcucacagucagcuauuggauggaucacacggcccccaguggaggagcuagagaaaauacccaaggagcuaaagggaucugaaauagguagaacaacauuaugaacuaaccaguaccccagagcucuugacucuagcugcauauguaucaaaagauggccuagucagccaucacuggaaagagaggcccauuggacuugcaaacuuuauaugccccaguacagggaaaugccagagccaaaaagugggaguggguggguaggggaguaggggggaggguaugggggacuuuugggauaguacuggaaauguaaaugaggaaaauaccuaauuaaaaaaauauaaaaaauaauaauaauugaaaaaaaaaaagauuuggugacaggacccugauauagcucucucuggugaggcuaugccagugccuagcaaauacagaagcggauacuaacagucaucuauuagauggaacacagguccccuaaagaaggagcuagagaacuuaaccaaggagcuaaaggggucggcaacccuauaggaggauaaacaauaugaacuaaccaguaccccacagaacugugucucuaguugcauauguagcaaaggauggccuagucagccaucaaugggaggagaggccuuuggucuugcaaagaucauaugccccauugcaggggaaugccagggccaagaagggggaguggguggguuggggagcaaagccggggggaggguauagaggacuuuagggaauaacauuugaaauguaagugaaaauaauaucuaauuaaaauguauuuuaaaaaaauuuuagcgauugauuuuagugcaaugaucauggugccaacagauauuucuuguggaccuacuaguaagaggugagguaaaucuaagaaugcuucauaaaaauaugcugaaagcacagggcacaguuacagucugccuuuuaaaauucugggucaugaugccacagaguugcauaacugcguaggaaagucacgaaaaaugugaccuuaguuaaagguuucugaauacacaauuaaaaauugauucaaaaccaaauguguaaugauucuaaaguucuccugggagcgcucacucauacauuagcucguaacuugacgacggccuugauucugaacccacagcaugugccuaugcacauguaugaaauucucgacuaaugaaaauguuguuuuuaaaacuuaacuguggagaauguugaggauguuucauguacuccaauauuaaauaucaucuacuauuuaauucuuuaugcaaaaacaaagaagcccauacaugcuauuaauguauauauuggcuucgguguuuaauaaaugacaagauuauaugugcaccaaauaauuuuuuaaaugauauuuucugacuauuaucaguaaaugguuuuuucauuuuugauacacauacacacacacacacacacacauauauauacacauacauauauacauacauaugugacauauagcaucauacaaaaaauucucagugaaaagagacugcaggcagaaaaacuguagaaguccuguacuuuacaggaugauuuuucucaagaauuuaaaacucccauaucuuuuauguaacugggauggaugaaauggccucugcuauugcugaaaccccugcugcaaugauagagaacacuaaguggaaagggguguugauugacugacuccgugaaaagagugcuugguggacaagcaugggcaccugaauuugggucucuagcacacauauaaaaagcugggcaugacaccucaugccuaaaaucccagcacuggaugccagguggcuauuaugagcuuauuggcagccagucuagcccaucagugagcucuagguucagugaaaaacccuacauaaaauauuaauauuuagaauaugucaauccacaugaaggccaacucucugauucagacauacuauaugcugggguaauaaaagacuuuacauauauucauugcuucggauauuguccauaauccuucagaauucaaguccauuaagagagcugggaguaaaccagagcgagggaaaacauuaacacaguuuccaaaauagcaguuagaagcagaagaccaggaaguugaacacugguuccugccaacuuccuuucuguuaagcagauggucugugagaucucaguaaauaaauuauuauucaugaaaaugaaaaaagauugauaaaucaaguuuagauacagucaccuuuucccuucuuuuucuucucucacucuuacacugcuuagucucuuuacugagcaaauacuuauacauacauauacacauucauaauacauauauacauacauacacauauauacauacauacauacauagcacauauaaacaugcauacacauauacauaaauauauacauauauaauacaugcauauacacacaugcauacaaucauauauacauacauauauauauacacacacacauacauaugcauauauacauacauauacacacaggcauacauacauaacauauacauaacacauacauauauauguguguacauacauacacacaugcauguauacauacauacacacuuacacgcauaauucauacauacacacauacauauauacauacauaauacacacacacauauauuguacaaguaugcaccugcauguaaugcuacauuaaaugauugccaaauggugaccaauugaguguugaaggaagaguuuuguaugcacaauaaagagacugaguuuagcaacagagauuagauaagaauaaauuuaccuaaagaggaugcaaagacucuaaccguuggauuuuauagugcuguguccauugagcuuccuugugauauucaugaaguucuguaagugaauucauuaagaucucagagucaucaagcaaauaaggacaaaacuguggccccaggaccuagagugcuugcugacgacgcacacuccuagcugugccaaguuuuucuugaucagaauccugaaguuacauaugaauucauauuuucuauuaacaccaugaguaaaucacuuugcacacucagaucuaggaauccucacccaacacucaaguaacagcuucuacccuuaauugcuaaucccacaggucacaaaauuaagucaucauuggacguccaacucucaccagacuucagaauucucuacacaauaacuccuggucgaugugugacuguuuccugacaaaacaaggcuggaggcagagaacuguggggccaccuucagugaagcaaacaaaacacugaaagcacauggucccugauuagcuucaauuugauuuugucgccacuucugccaugcuucuauugucgagucuggucauguaaaaucacuugcuauuuucgacuguaucauuaaacugagaaacuacugugcuguccaucaaaucuucccaggagcuguaaguccccuuccugccauccagcuuggucacagugguguucuguaguucucugucuuuaucaaagcacuuuucacuccaaguuacgaucucaaccaaaaggcaaguuugucuacagcaggagcugagcauuagcaucccauguaguccccuagcuggggggaggggcagauucuuaggauauguauaucaggaaggagugguggauugugggagugauggauggaugcuguaggcgcucacaggugagucugguacugacaggaacgucuccacaaugccuuggagugucuugaauuugcauaaauguuuuucuuuacaaaagaugcuagcaucagcuguuugaucauacuagugagaaaaguuaaacacagagccuacuuaaaacaaggacuuuaucuaccauaucagaucaaauucuaccuacuauauuacuuauuuucuaaguuaaccaaagguaguagauaugaaaauacaaagcagaaaauuagcacagaauucuaucaguaagaaauuucuuucagggaggacuaggaugaaaucauuaaagugguucaccaugcuuucuuaauuuacccauuauuauguugaaaaucaaagccaagcaugguaggcaggaacaccaucacugagagauaccaucugagcucaguauaaauuccuuaaugcagcaucuacaaaucuuaagggccucuuaaagcaguuuucaggauggcaaccaccuuuaccuaauccuacgguuaccuauucccugugagcuuuaauuuucuuuguggagaauaggaauacagagucaggaaccacauggguuuuugcaggccagguggccucuacugcagcuacucaacucuacagauaaaacagagaaacagucauaggcacauauaacugaagggauauggcuguguuccaauaaaucuuuauuuacaaaaacaaguagcagcagauuugguuugcaggccaauuuuucugaugacugcuaaguagacaauugcuguuuuaacugccuaacgucuccuaacacugcauuuggcaaacacgcuuugcuuuuauaugcagcgugacugcucuucaaucacugcccauagagucagagggaacugacccagcccaguagcaacaggguuagugaugcagcucaggacaguauuuauuccuuuaaguggcugccaguuauuucugccauagugauaagaaaaguaauuaagacacagauaggagcagaaacaguugagugagagaccaaaguuggguucaucuacgacccgaagccugugaauccaaacauaucugaggcuagaccagccgcaacagaagaagauccauuaaguaccugcgugacaucaagagcgguccuaaagaagaaaagcaccuuacaugggaugcccaugagacacuuuauacaaugugguuauauuucucaguugguggagaagaguuaggauguuaaagaagaacagaacaccaugggaugaaugugaguuagaauuuuuuggguauuuuuucaagccacaaaauauuaagucuuuaacuuccauguuggcacugaaagcaccaugaagugcuaugaagacagaaauuaguccuacaaucauaaggaaagacauugaauaaaucauccugaauguccaaauaauauucccaaucuccuuaaguaugccuugguaaacaccugcagacuccaggguaagagauggggaugcaguaccaaacggugcaguguaguguucuuccuauacugcucugaauccacagagaaaaggaaaucacaacuuuucuggagugcacaucuuagauuaccccaguucaagauagaaacugucauuuuagaaaaaucucaucuugacuaagauuugugcagagcucaacuugaagaugcaaaucugucagucuagaagggaacaggcagugucuuugccuucucguuguaucgcuugaagcuggucggugauuuggagcgauuaauuucucaagaguuuguaagccuuccaaaaggaaucaacagugaaucaaacagcuacggaaaagccauagcuauggaucuuuucaagauucauccuuuuauauaucuuucugagaacuccgaugcuugcuuaagaaaaucugaaagacacauucuaaaucucuugaaaggaaaacgacugugacugaaaacaucagucagugguguggugguuugaacaggaaugaucccccacagacuuauagguuugaauucuuguuaaccaggagcacuaaauacccuuagugucagcaaugaaacugacagaaaggagaagaauaagaugagcgauuuaaaguucuugauacaaagcaauaggagauauuagaagguguaagaggggucagagcaguuagaggcaaaagcaccaagauaaaggccaggcaaucauccuacgauggagaauaaagcccaguaaaaagacuugccaaagaaauucuuggaggggaaugacagcuucccuccaugcuuuaaagaagaaaugauagucaaagaagccuucuaggacagaaauuguugagacagacuguagacgauauguauaugaacagaggcagcugaaggacaugagucagccccacccccacacuaucucccacugugugcuucucauaguugaugaggaccaugcauuauuuuauauuuuaagagaucaagucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcuaagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguugguggaauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucccaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaaaaaaaaagagaucaagugacuacaugguaugauaaucuaugguaguuugaauaaaaacagcccccauagguccacagggaguggcacuauuaugagguuggugcuucuuuguuggacgaaggaugucauaaggggcgggcuuugaggucucagaugcucaaggcaggcacaguauggugcucucuucuugcugccugccaauccagauguggaacucucagccaaucuccagcaccaugccugccaggaugacaacgaacuaaaucucugaauuguaagccagccccaauuaacugcuuucuuuuauaagagcugccauggucauggugucucuucauagcaugggaaacccuaguacgacauagucccacaauauuagucuucaauuuuagccauagcuaguuacaacagacacuaucuaaaaacaaaguuauuguuuuagaacugaguaagucagaaugauagaaucaaggcagaauaaaucauggugaccagcagggcaacauuucuucuggaaccuccuggagaaucuguguccucaucuuucucagcuucuguaagaugacuauuuccaacucacgacaucuuccuccaucuucaaagccaacaguucggcaccuucauaucuauuuccuucucugacauugcuaccucuguguugugcuugugauugcauggaguccauccagacuaccuaggauaaccuucauauagcaaacuccuuagccuagucauaucugcaaauuacuuuuguuauaacagauaauacuucacauuuuuuuggggggguaaugguguagacauggguggauauuauucugauaauuaucugacauagcugucaaagaucuuuugaauauucaaauucgacccguucauucagcuacugaucagcauacaccauaacauauuguugaauuugguuuuaaagcucacuuacaauuuauuuauacauccccuuuuguguagguaacauugcuguguauccacauauucuucuugggagcugguaagguuguaacgaaguuucauguaucaaacuccuuggagagccaaagaaaaccuugaacccucaucuccaagcccuagcuguuugaggucaugagaaacaguagcaacuuacucuuaaggaguuaccuuaaugcauuuaaaauaucaaaugcacccuuuagcaaucacuuagaagaagggaaagacaaauaauuuugcagagaagaaaacuaaaacauacagugaguuaaauggcucaagaucacucagggagaaagacugggauggggggauacgaauagaacucugcuuccuauauucccauucagugucuugaaagaccugaauaaugguuucaaugaugcuacccgauccgaucgcccagugagucgacuccaaagcacugcuaacacguaagagaaaccaccacaaaaacagcaaauagcuuuuacuuuguuuccuaccuaguaauugagaaaaggcuuuaagugggaaguauggaaagcaggcagcaaccuauuuguaaaauccaccugaccuugagaaacuuccauuugaguuucuaacauguuuggaagguuuuaaguuaauaugacuugaaaauuuaaaaauguauaugguuauccugacugguagguaaaaccaaaaaagcaaaggaauaauagaugugcuaaucugcagccccucuguguguauugcuaauuacaggugcucugagagguguagggauaggcugugaguggcauggaggagagagcuagcaagucauacagaaauugguugacacaucucagcucuucuauuuauaccagcuggcaaugggaugauguaucaaauuucucaagaguccucaucuuaaaaauuaaauagcuaaauccuccaguugaucuaaauaguauaauuuauguaaaauaccuaauacacaaaaaauguuuagcaucuuuccuaauuaagggaaaaauauuggcacagauuuuuuuuuuucugcuaaaauuguuugcagugugugcugcccagauucccuuugucaccuccaggacuugcucuccaggcuacugggaauacugcuaauggaaagcccacuguuaucaguccuuuauggguauugcuuuggccuccucaccugcuguucacaccccucaggaugcccuuccuccagugcaugacccuaagaaccagcauagcagaucaaaacugaucacgaggcugucugauuccucuuccuaagcugcuuaucuuaucggcuucuccaucuucuaccuuucauuucucucuuccugauguucucagcacagucacaaacaagcucuuacauccuagucacuggugacagggugacagucagcucucuuucccuagaguuccagagaaaaugcaaacaggugcucagucuuuccacacaagaacaugugacauaauggacauuuuuuuuuccuuuguucuuaggauucaaaguaaggauggcagcaaggagucaggacaacccucucccccuucaacuguccugcccuuuuacucugcaguuugugcauauuuagacugucauauucaaaacguugaugauuacagcugaggaaacguuaacaugugugcauuuggcgggaacaauaacuaagguucuauagcucuggaauauucuagaaaaaaagagggaggcuauguuacauuauuuuggcagaauguugauggcagauuuggcugagugacaggugucuguuauauuaauuuuccuaccucugcauaccucuuaacuuuuucacaaccaaauaauucauucauuugcuuuaugaaagugugccccauguagauuguuaaaguauguaaaauaaaagcccuuaaacaauuuuaaguaagguuuaaaacuacacuuaaauccaguuuugcuuaugcucaguaagaaaucuaucaaaauauacacaaugcauguuucccuaagcagauaaaauaagugugagauaacucucaaacuuacuccuuucaaauuacuggugauuccucuaacaacaagcuuaaucuaggacuuagaaaucaauguuuacucuaaaagauuuccucuucauacagguguucugcauuuuauguggacuagaucauaaagacuuuuuuuaugauguaauagaaaauuaucucaauuucagaaagcucuacuucauaaacauugucuucgggaauggaaugaguuauaaaaauguguuuauaaaaugucacgcaggcuggggaugcagagcuccugccuacacagugagugucuggguuagauucccagcauuaaaacaaaacaacggaaaaugagcacaagugaaauacagccaaagcauucuacugccuuuucauccucgcuccuugaggaugcuguugaagacucgacaacuggcaucauugguacuaucugaaauaggaacaaaaaccucugucuuauuuauguguaaugguugggaacuggaucauccagcaaggacucugacuagcaucuucaggcuguguauaaugguauuacuuauuuuaaaugugccaugauaagaaaacuaaaauaugauauguguuucuuaucuugcuauucuucuauguuugaaauucuuucugaauuuugaagucucauccgccugcggugauggcaccuagcaguuugggaaaugcuaucauucaggaauuuuuuuuucaaagauaacugaucagcaaacauaagggugaucuaauguauuucuucauaaggucauuaauauacccacacuuuaugcacauacauaaggcuugguauaucugagaccaacagaagggacuggaacaugcugagggcagagacauagcuggugugacuugggagguggaugccuaaaugccagugaaggcuggauuuuuuaagguuuuccugcuaucucucugagccaccacugaacaaauaaugugugcagugggauacgugacaugcuuaagaaugacauguuaaagaagaugcugagcaguggcugcaaucaggaaacccagcccccaguucagauuuacuacuaauuaucuccaugauccuuggauucuaucuuucuggccucaguuuauaauaugacgagauaaaggcuccuuauaguuauuauuaugccaggauucaugaaccacuuucaauauuaauaugcaaucaucaaaguuuuaugcaauuugaauaccauaauuuugaguagaaaugaagaaagaaaaugacauuuuaaaaaaguucucuuuuauaguugaaaauaaauguuacuuauuacauaagaauuuaggugcccaaguuacauauauucuaucugccauaccauagucuccugaagcuuucugaauuaauaugagguugucauuaugccaggcaguauagaggacucugcaagccugccugcaaacauaacugauaacaauauaccauggaauuuuauguuucaguucaggcuguccaauggguguauauauacacacagaaagauguuaaaauucaacaacugcacucuacaauuccuauaaauuucaguuuuccacgcucuguaaaauuuuaaaacuacuaugugcugggucccuguggguuuauuaacaccaaaaguacuuuauauugaugcaauauaaaaauccacacuguaauauaauuuugaggcaaaaugaaauugguaagauuaagguagaaagccagaaauuucaagauaaucguaaucaaguacuauagaaauaauugcuacaucugugaugaugauaauaauaccaagcauggauauguagcacuaacuuagagaagcaauuaauuauguugcaaagaaaucaaauauauaauaaauaucauauucucacucuuauguaucauaauuuguauauuauuaucaccacucauugcuaucaucuguuuuagauguauagaauuuaaucagauaagacuuccucaagaaauaacagguugucauaacuaccuagggagaaucagaauaagguugccuguugguauucauauccuguggugacucggcagaauaccaagacagguauuaagaauacauucaggucaaaaauggauuuucaucauuacugacucacuaaugaguucuuuuucuccccugauuuguugauuugcugaucuuuaacuacucucccauuccugaaaugagcucuacuagguuauguguauuguccuuuagcgagauuaccugacuugcccauagaacuaucuacacuugcacugacaugugauauaguuaauuucccuuuuaauauuaauacucccuuaauuggguuuagggaucaacuaacuuaacaaaaugaaacauucccucuuccuaucgccacaaagaacgucaauguuucagcgauaaaucaccccagugacgugcacuuaccacaauuaccuuccucuuuuuuucuguguauguaucugaaaauccucaccccuugcuaaauccaacucaaugcagcuuacaagguuagaagaaaaugguguucucaccuuccaagguggcuuucagaucuuccuucuccaccagcccaccauuccucagagcuaucucaauccagagccacgcuuauuauaauccagaaaaaaaacccaaagagaccgucccaguucucccaguggagagucucaaaaucaucauguaucuagauguguauagucucauuucacuguuuaacaauaauuuaauauaauaauaauaauaauaaauccaucuuccucagagaacauuauggucuguuuaucugaauaguaagcauugccccacuaguacuucacuuuggaaaaacaaguuuuuaaaggaaaaaaugucuccccuuuauauuuuuuuucuugugcuaaaugugggagauauugucagacauuauguguaauacaggagccagcauucacucaacucucccgguagcagcauccccuucuggacaaccuuauucccuauacuuucugauuagguggauccugacagggcauccccacccccaccccuuagccacagaccugcaaaguucuguguuaugcucugcuuucugaggauccuuaaacugugacacauguugccaaagaaauagguaaagaggcuaaauugucccuaaacuagagggugcuguggccuucuuuuuagucaaugagaagccaguguuaauacaaaauuaagcaauuauaaauaaaaaaaaacuugugacuaugcaaugauuauaaaauaaauauuaacaagagaagccgaccaaaaaccaagugagguguaucuuuuggaaugucacauuugguuuucauuucggucaacaaaguuauucacauuaaaggaaaagauguuuuaaaauccuauagucaucucagugucagcagggaaagugauugacagcguuugacauaugcucaugauugauaacacucuaauuuaaaaagagaagaacuuccuugaccugaugaaggaauuuuugaauauuagaguuagcaucugaaugcuaaauggcugaaccauuucagcugggugaggaugcaggagcauggacccucgggauggauguccacucaccgcugagugggaagcacuaguuaguaaaguaagaugagaauaauagguaaaaacaaguggacuagaaagcaguaaaccugccuucauucacaaacacugaauaccuuauaccuuguacagacaacauugcaaaaucaacagacaucccagaaaugaugagugggcgcaguaauuuugcgacauccaacuucaacacaaaugaucugauacaccucuguguaauuaacaauccaucaaaaucaggaaggcauuuuguaauauccagaaacaaacacauuacaaguaagucuagcuacagcaagaaagauaaggagaucuaaaaccaugaagagaagcacauucauagauuccaaaguucaggaugcagacauugccauauuuguuacauuucuccucagcaucacagagaaauacacaaacugacaggcuaauaauaagaugcauaugcaaauacaaacaacuugaaaaggauugaaacaacuugauaaaaaggaauaugaauaacuaacacuauuuaaguuuuauacuuaccuuugagcuugauguucacugccaugaaauaaauauguuuuuaaaagcaaagucucaaagucucuauaaugcuacauucauauaagaauauguauuguacugucugguuuuauuugucaacuugauacaaguuggaguucucacagagaaaggagccucccuugaggaaaugccuccaugaaauccaacuguaagggcauuuucucaauuugugaucaagguggaagggcccauuguggguggugcuaucccugggcugguaguccuggguucuauaggaaagcaagcugagcaagucaggggaagcaaaccaguaagcagcacuccuccauggccucugcaccaguuccugccuccaagguccuacccugcaugaguuccuguccugacuucauuugguaaugaacagcaauguggaaguguaagcugaauaaaccuuuuccuccucaacuugcuucuugguccugauguuuugugcaggaauagaaucccugacuaagacugguauguauuguggagucugagcaacacucucuuggauccacaguagaccacagugaaaaaauuuaaaacuagaaucaaaugaaaaugaaacacaacuuacagagucuucagaauauccuaagacaguucuaggagaaacuuuuagagauauggacacuaauacgaauaaauuaagggaaugugggggauggcuugguaggcauaaaauguuugcugcaugaggcuguguaacugaguuugauacucacccacaacccacaguuaugagcaccuguaaucccagugcuggggaagcugaggcaggaggauccccauaacuuugcaggaaaauuaauggaacuggagauuauuauuuuuaaaugaaauauggcagaaucagaaacacaaaacauuucuuaucuucucuuauauguagaauaucuauguaucugucuaucuaccaucauucaucuaccauaucuagcuaucuaacuauccauccaucuaucuaaguaucuaucuauccucuguguguguucgugugugugugugugugugugugugcguguguguguguguguguguguaaaguauccaugacauagaccauagggcacuggaagaagaagaugagagagcaaaaaaggccaugugauauagaauacaggugaaugaaaucagaaaggauuauuugauggaauaaaauaacagccacaugaagagagauggacagauaguguggaguauaugaacaggaacaaaauauaacgucacauauguacaaaaaugucaugaggaaacaugcuacauuuuuuacuggcuuuucaaaacauguuaaguggguccugugaaauggaguugaggcagauuauaggaucugcagucaucagcaguccugaacacuccuguuagguaaaacugaauauucuguaucucucagcucuaguauauaaaauccaggguaaacaaaugagcacaaauaaauauuuuacuuuauuugaucauucuaagguaagucgaucuagcaaugacaaaauuuccaauaaaugucacuaaaacauuuggguauccaaaugcaaaauaagugaacauuaccucacaccauauauaaacauuaaccugaaauauauaacauaccuaacuauauauaauaaaucccaacauuucuaaaauaaaagaggaaauaacaucuuuguaaucuuggcuaagguaaauaagucuuacauaagaccaauaacguucaaaauauaaaagaaaacacuaauacuaugaaaaccauccaaaugaaaucugcuucacuauaaaaaauauauagauaagcauaaguaagggcuuuugaauaagauucuggucauucaggaaauaaggccaacaaauggcaaaugagaccccaggaaacccaagagcuucuggacaaucagagaaauaguaaaucgauggaaagaauaaccuaacgaaugggaagaauguuuugcuaauuauucaucugaccaaggaauaaugucuagaaugugcaaagugucaagaacaaagaagaaaagaaaaacaaaaugaacuuuagaacagaacagagaguucucaaaagaaacagcugggaaauacuuuaaaagguauucagugcccucagacaugaaggaaaugacaauggauaccacuuuaagaugccaucuuaaccuaguuauaauggcuaucaucaagagaauuuuagugugcuuucaguggggauguaacuggugcagccaguuugaaaaucagucaggagguuucuacaaaagcaauaaauaaagcuacuacauuauacuacucuugggcauauacacuagaacuaagacgugagcagagcaaguuuacaacauccaacaucaacagaaacuauccaguauaucucuauauaauuaauuaaaauuaagaacauaguuuguaauauccagaaacagacaugauaagcauauguagaaucuaaaaccaaacaagcauacauaacauucucaaagcaggacugcgcaucuuaccauagagacauuuucauguccauguucauugcuguucuauuuacaacagaaauggaagcgcacaugcuccagaugauagcucugcuuccacgcccauguagguaggccuaguuaaacuaggugagccacaaaaaccaaacaagauuacuugaaaauaggaaggggcacuuguaaugaggaagggaagaugacaugggaaccagggguauaagagaguggaggaaugggcguggucagagagcauuauguacaugaugaaguuggcaaagaaucucaucugaaagaaaagaaaaggucaaguccuaaguaugguuuaaauuuuuguuuuaaaaaaugcaaacaaaguguaccucugauaaagcaucuucauuugaaacaaauaacuguuccaauuugaaagaacaaauuagcugaguuuuaaaagaagaagugaagcuauggaaucaaccacauuuccaggcaucaaaugaaaagugauagaaacaugguuugugcugucucaacaaagaauucauuauucagccaugaggggcaaagcuaucauaucacgggcaggaaaaugaaacugcagccgccauguuaugugaaacaugcuaggcauggaaaaucaaguaugucacguuuccucucauauagagaaucuaaaaacagacaagcuuacuugacaaucucaaaguagacgauuaguuaauaggaggagggaagaaaauugagggaaaggauuggggagauaggaaaggguacuuccgggagugggggaggggcgggcuagagggaagcaagguauauguguggaagugacaagaaacccacuacuguuacccacccaagaauauucacugauuguaaauaaacccaaauaaagacacuuaccauuauuggucacuaggaaaauucagaagauaugccucagcauacccuucagaagagcccaaaacaagaagaugggcugugccaaggccugggaaggacaugaagaaacugggucuuucauuccucccugauauaaguccaggaugcuaccacuacucuggaaaacaucuuauucaucccaucaauuuagauauauauucaccaucuggcucacauccacacauguagguauuaucccaagaaaagagcagauguugguuucauaaaaagacuuguaauuaaauguucaagucaacauuguucacaauagucaaaacuuaacuccaaauauucaccagcugaucaacaaaauaaaaauuuacuuuauccacacacacaaaaaaaaaaaaucgacgcuacuuagccauucucacuuaaaccacaaucauguccauguuaucucuaaccucugcauaugacacucaguguuguuugauguuagcgaaugaaauuguuaugguugacacacuuuggcauuugcuucucagcucaaugaggagacaauaacccuaacauuggaagaauaacaaugaaacuagccaaugacagaaaaugcuaguaauucuagauguggggugguaggugguaucaacacaggauaaugcagaggaauauacaagaaguuucacauuugggcauguugccauccuaagaacuucggcuguauccggacuguaauaaucuucccauaaagaguuucaaacaggauagucaccucgaggaaggcaaucaggccaaaaaaagaugaauccaugagauaaguugaggugaauaucaaaaugcagggauuacaaugauaaagaagaguuguucgguaaagcaguaagaaccaagaaccaagaaagagauuguguuguagaaggcaaacacugagagguguuagaauuacauaguuauucagcaucuauugcacaaugccagaaacacaaggucagacaucugaaggugucaucuccagaggccggaggugaacaguaggaugcuagacccauccuuaagauaaauugcagggcacauaaaaauguucugagcaaaacacuccuggaauuaauaagcugcaugguuacucaguguuacuucccaugauuuauuuauaccaaagauucaucugcagucuacagagggggaaauaauccauuuucuucuucuucuucuucuucuucuucuucuucuucuucuucuucuucuucuucuucuucuucuucuucuucuucuucuaaauaauccauuuucuucuucuucuucuucuucuucuucuucuucuucuucuucuucuucuucuucuucuuuuuuuuuuuuuuuuuuuuguaugggacuucugaacucccaggaaaacccuaugaugauuaauagcaggcugcuagaaauuuguguuuauagagaaaaacgauucuuuuauacauaacaaauauuuccagcaaacuaccaguaaaaauuacccuuucagguugcuuuucuccagaaaaauuacaaacuguauuggauuuuccagacuuuuuagcaaagcauaccccagccuaauuaagugcugagcugguggcauacacagaguaugugagcugcuucuagucaccuucacucucagcucgccuugacuuagugucgugauaaacuccuaaacacccuaucuaggaagaacuuaauggggaugaaauucaggaaauaguaaaccaauguauuuucuccuucucccugauuuaagacaccuugcauggucaugccccuucuaucaaauaauguaucagguaaaacuagaugcuucuggcaacagggcuugcucuacauuguucccuagcacaaaacagauagaucaagacucuccuuaaaagaauauuguguccacaaugggacuuuggggcagugguucagaaauagcucauagacuguuaggaagcauagauaagcaccucucagaucuccuccaguugaagagagaggaggcaaaaccaaaaacguauucagauuucaaaagcucuucagaagaugagcaacaauagcugaaaaggaacaugcagggcaggcacagaagugcuuaguguuccagagucucuaacuuaacuccuggugugucugacucagagacaaacuccuaacagcuuccaagucaccuauuuaggacuuugaaaaucucccaccucacacuuaguugccucagguguuucaaccccaucccuccagaugccaccauacaagaggcaccuguccugucuccucaauuguuggggccuuugcuccacucuccuccuucugauuacguuauauacacuguuaguuucaauacucgaugaaauugcccuuuaaugaaguauaaccuuuggggaaaauagcuugucgaucucuaucuacaaagacuuacaacuucaugugcuguuuauuauguuucauaacaauugaaaacuccaugaugcauguugguuguacggcacaaagcuagugccaugagaagcagaaacaaaacaaauaaauauuauaauguacugaaagcagacuuuuaaaaucucagaggaaauauuauaaaggguguuucuacagcagaacacuaaauuugcagccauuuguugaauagugcauauuaauguagagaccauugaaacacaagaugauguuuauugcauuaugucccuuguauccacagcauuuaccagcagacacaaaaucacaacaaugcaugaguuuaaaggauucuagacucuaaauaaauguguuugagcagcaggcgcaauaauguugcuuuacacuugcgaguguguacugcugggaccaugaccucaagaaugaaucaagagagucuggaagaggguacuaagcagaauaucacuacaagaaaaaagccaguauguccccugaacacaugggugugaaccagugaccaucccauguaagggauuuacaguaaggugguuugcaaauuuucuccaauuaauauuuuuuuugugguaagcacaguaacaacauucuaaaccaaacagauuuuaaaacucugacuucuuggucaucaccuugauccugcacauuaguuuucuuacacugaacucuguccauuacuauaagauguugaaaaaaguuagugaaaauuaaaugcucugaucuagaaacacugugcaucaacccuuuauuucuaaguucucucaaguaacauauuuuuucuuugcucuauuugauaucuucuacagcauuagauuguguugugcccucaaauacauuucaaaaccaauuaaagcauuaauauauagccaugcauagugacugaaccgaugaaaccugucaugaugacuagcugucauucaaauaacuuuacaggcagaauuccagaggaacuucaugagaauuaugaaauuuccuuugagauauuaucuuuguuaaagaagguaucucacuugacaaagugcuuuagccuucaauuaagauaaauuaauguuauuuauuauucuaaaaccucagagacagauguuuugcuuucuuuccaggauaaagaaaaaaaggagggggccaggauauuuuaaugaucaaaguaaccaugacaacaguuuucagacucauuacaaguguuauuuucauacacacucuguugguuaaaauaauaaucuauucuuguaaacaaaaucuguuucuagugaagcuuccuuucaugguguaacaaaauucuuaaaauuauucaucaauccaguagcaaguaacauugaggaauaauuauuuuuuccuauaaauaccacaaugucacaagcucuugagaaaccagaaauuaccuccaaccccaaaacacuuaggacuguuacauugguaacuacuaaaggcauuuuucaacacuguuuucucuugucuaaagggggagagggagagggagagggagagggagagggagagggagagggagagggagagggagagggagagggagagggagagggagagggagagggagagggagagggagagggagagggagagggagagggagagggaggagaguuuccuuuuucuaaaaacaaaagaaacccccaaaacucuaagcagugaaacaauguuucccuccauacuauuuauuaucgauacuauuuauuauugauacuauuuauuaucgauacuauuugaaacuuuaaauuacuuuuacacaaugguuuggguuuuaucaugacuuuucaaaaacaaggaacaaaggauauuuauuguuauuugaacuaauauucaaguggacugaaaauuggaucauaguuccaaagcccaucuaugagaaagagagcaugcuauuuuuuaaguugacacuguucuucauccuaaggcaacagcaauuaacaccuuccccugucugaaugaucugaguuuuguucauuuuagagaaacuguacaacuauaacuauggugaggauuauguaguaggauacauguguacaugagcaaugccaacacaauggcuugguuucuuucgguggcacugcaaggugauguaugugguguuaucauggcuaaacagaaggaaauugaccauuaguggccagggcauuugucacuauuugccuaaaacucagcuguauaauacccaacaucugaauagugucuagaaaugaaagcaaaauaaaagucuuuguauuuucauuuuauccuuuuccaaaauuuaaacuauugccaucaaacacagaccaucaaaagaugacucugagaaugacaagaaaaagaugaagaugaagauauggucaugauggugaucaugaagaaaaauauaguggacugugguggugugaauaugcuuggcccagguuguggcacuauuaggagguauggccuuguuggaguagguguggccuuguuggaggaagugugucccugugggagugggcuuugagagaguguccuccaagcugccugcagaugacaguccucuucuagcugcuauuggaucaagaucuagaacucucaguuccuucaaccaggaccaugucugcuuguaugcugccaugcuucaugccuugacaguaauggaccaaaccucuaaaauugcaagccaguaccaauuaaauguuuuuuguuuuuuggguuuuuugggggguuuuuggguuuuuuuuuuuuuuuugucaugguguaucuucacagcaauggaaauccuaacuaagauaaagacuaugaaggcucucaugaaaccaaaugauauuacaacuaccaaagaaaacaauaacuuuaguuguuagaggcauugauaauuuuggccagaauuuuuggaacagaagccuaaugggaaaguugauuuuaaaguaucuaaaaucaucucaugaaauaaaaaagguaaguaucaaagaagagccaauaucuucugcaauaaaacuaauugauaaauaauuuacuaaaaauaauuaacauucuucacaugaauauuacuaaacgcuagcauauuaauaaaagauuaauugacuuucacaaacaaucccuaguuaaaacaacucaagcaucaagaaguaauuauagaacaugaauuacuaaguuaguaguauagugcuauauuuaguuucacccauuaaauuaagcaaguaaguauguugcaccaaagaagccuucaacaaaugcaucagcaguaauaagcugugacaagaaaugcaucagcaguauuaagaugugacaacaguauuuaaauuccauaaacacuuauuacaaggaaaaugcauaccuucacaguaaagaagagcauguauaauaacuaaccuuucguccaccauuuucugcaaagugcuuacaacacaucauuuaugcuaauauccagccagugcaauggaugcuauuuaucuccauccuguggaaggcagugaugcccccaggcuuaaaugccacagcucauuccugacccucaggagcuugugauucugggcaguuacuuaaacugucugaaucucauuuucuucauauguaaagagggagcauuucucuauauccuagaguuguuaggggacuucaaugaauaaagggcugcgaaaugcuuaaauggcuaauuguacuggcugguuuugugugucaacuugacacgagcuaaggccaccacagagaaaggcgccucaguugaggaaaggccuccaugagauccagcuguaagauauuuucucaauuagugaucaaggggagagggcccagcccaggguggguggugccaucccucagcuggugguccucgacuguauuaaaaaaaagcagguucagcaagcuauaaggagcaagccaguaagcacucagccauggccucuauaccauuucccgccuccggguucuagcacugguugaguuccugcccugacuuccuccagugauggaucugaaaguauaagccaaauaaacccuuuccuccccaacuugcuuuuaggucaugguguuucauuacagcaauagaaacccuaagacaccaauuggcuuugguuacuacagacaaaauggaaauauugguguggauguggaaaacugagacauuugcauucugcugggaagaauauaaaaauggaaaaauguuuucaaauuucucugaaagcuggaaaaugaacgaccacauuaucuagcaaucccacuuuauguuauuuauuccaaagaaaucuauuaauauauucauggacucuacagugauaauuaauagccaagaaaugcaaacaacccaaaugaccacugauaggucauuaaaaauacgaugcaugcacaugugaacaugcacaugugaaugugcacacaggaacaugcacaugggaacaugccaacgggaaguaccacucagcauuuauaaggaaucuugcauugcagcaacauggaugaacuuuaaggcauguaugugaaaugacccaaccagaaggagaaaaacuucacgauccuacuuacauauguaauucaauuuaauugaauccagaaguagaaaaacauuugucauaaccuuggggaacuggaaauggagaguugucacccaagcaaacauacgaggcuuuaacuguacaaggugugaaaguccucguucucuacuguacagcauugugccugggauuaacagcguccagcagacacuuaaaugccuguuuuaaaagccauguaaaaugaaaguucaaagaaucugacugaagaaacagcacaguugggauucuaaccuuuuaccuaagauccagugauuuuaacaaguguuagcauccauucuaaauuaggaaaaacaacacgguuccuggugggccauggacucugaggcagaaaugauagcaccaccacuugggugggucccauaacagagagucuaaguuuuauuacuaucuagcuuauaacauaauuugauuacacagaagcaucucucugagaccaugagggaagacuacagagcuaagacuacagaguuaagauugacuauuuccuuuuacuagaaauacuugaaauuuucaagcucaugacacuguggcuccagcacaagaaggguacuacuagucuguucucuuauugcaaaagacgcacuaaagggaucugcaacccuaucgguggaacaacaauaugaacuaaccaguaccccggagcucuugacucuagcugcauauguaucagaagauggccuagucggccaucacugcaaagagaggcccauuggacaugcaaacuguauaugccccaguacaggggaaccccagggcuaaaacgggggaguggguggguaguggauugggggggggggguauggcggacuuuugggauagcauugaaaauguaaacgaggaaaauaccuacaucaggaauaaaaaauguccaccuauaaacucuuuaagacuaaaaguacauaaaacaauuuuaaacagaauacauaugcucggauauagcauguggcauacaucauuuaugauuuuaaaauucacaagcaucuaauucucaauucuaucauuaaaugaaucaucaggggauucuuuccucggcuuucuaaauugcagccuccgcuuuuauaaggaccaguggucaacacaaagugguuauuuaguagccguuauaacuucaacucagagagacuaugaccccuauaaaacaucaacuccuguggggccaaguauugcauaaucugaaaucuagauaagucugugcucauaaagcaauuuagugauuuauuugauaauaaaacaucuuuauuuuauuuuuuuaacaguacaugaguuagacucuuagcacucuauaauguaccacgaauuguaccaagccauauauaguuccagcaaacauugggguucuaagcucacgcuacagcagugguucucaaccuuccuaacgcuggaaccacuuaauacaguugucauaacccccaagcauagaauuacuguugguguuacuccauaacuguaaucuugcuacuguuaugaaucaaauguaaagaucugugcucucuggugaccuuggggaccacugugagagggccauuugaccccaaagggauugcgaccugcagguggaaaaccaccgaccuaaaagcuccguggaaggacuucucuucuucacaucuuguggcaccaauaauccuugagguuccuaggcuugaagcuucauaaccccaaacccugccuccauuauuagauggucauuucccugugcaugucucugugucuuuuccuauugacaugaggguucaagccacacuguaauugaaacucacaguagucaaauauaucuauaccuucagugcuuagauuugcaaaagucuauuguuaaauaaagucuuacuugggguuauaauucucaugaauuuggaaagagaaguguacuauaguaguguuauguuuauuugucagcuuuaauuuuuaaaguauauaucagcuauaaagauaugugauuccauaauuacauggucaaaaggaaccuauaucuaauacaaauaugcacauuagauauuucccuaaauuaucaauuuuucuagugcaaaaaagauauugccaaagcaaaaaucugacauacaaaaaugucaguauugccuugccuuucuacagcugacaauguagaucauugauugugauguaagcuuaggggaaagggagagaagaagucaucugcgugcugugugcauccaccuagggauuagagaacacuggugagcaaaaagaagacucuuccccuccaagcagacacccuggcguggagcagccgagucaugggguaaagugaaaguuuuaaguaaccacaaacuguccuauaaaacugacugcaauuuuacacuucugccaauaacaaauggguacuguaacuuugcuguaccuuugccaacacuugguauugucuuuuuuauuauauccauuaaaguuacauuauaauuauaguuugcauucccccccccccagugacuaacaauguaccagguagucugcuuggugcagauauuaaaaacugaauaauacauaauccuguccuuaaagcaauaucaauauuauuaugaaucggcucauuguagagaauauaagacuaauuauguuccauuuaacagacuagcacugccaauagucuagcuaagcacaccaagagccuuucuuuauacaguuacugucauggauugauauuaaagagaaaaaaauagucaagaaaaccuacugauuuaaaacuacccuugugguugugaggccuuuuaguaccuauaaauaaauaaaauuuaagcugaaauacauguuuugugcauaauacauggcacacacauuugcaucagugaaauucauaacucuuaacucuugguaaaugaauuacagauaacuaugaaagaguugaggauuacugcagcagauauauauuuuacuaaguggcuuuaaaaaaaaaucugaauauacuuucuaugagcagaguguuuuguugagauucaaccaaacaaagcccaagguuguauuccagucuuugauuuaucaaguguuuuccucaauauccuucagaucucuaaagcaaucauaaucauguaagacuuucucuuggugacuucauuaucuuugaaaggcauuugcgauaaaagagagcguaaaggaacuguauuuaaguucccucuaggggaaaaaaaugaccacuauuauuuuagaagaauuuccacaaagaugauuucagcacaauagauuuuuccagugaaugauaucaaucauuuugugagcuuuucaaaagaugccaaguggguccuguaaaaugaggcugagccagaugauaggaugugccguaaucagcaauccugaauacuccugcuugauaucuuuaucucucagcuucugugguggcaaagucauacaaaugaguugcacacaugaauaaguuuccuuuaaccaucucuuaaagaaacuugguuaaagaaaacuuuuuaguuucucagauagucuaccugcaaacucccuaucaagucaaacuagaacuuucaaauuauauacaaagcuaaagaauauucugaaguacccaccaagaagaggagauacugagccugacaucuguaagaaccccauuauagacaugauauuggacuacccucucugacuucaucauagaaguuucuuggugcagugaacaguuguuaaugcagaaacucaacaccaaucuaagugcagacaauaagagccagggaguguucagacuccaugaaacaucuaugccaaucccuccccaaucuuaacuaggaggccuuugacaguugaugguuucugugggagggagagcagguugucugugagaguauagguauagccccugguagguugaccaugcuucaguggauaggcccacucacaugagcauauggauaacuucauggguuguuuagagagagacagagacagagagaaaacaaagaagauauaaaugaacuucaacuuuugggguaguaugaagaugcggauauaucuuggagaaguuggggagaaagugggaugaauauaaucacaacacacugaauaaauuucuuaaugucuuccugaauuauuaauuaauauuccugaauaaagaugaaaggacugccaugauaccaagcuguauagauaaaaauguuacacugcauuuuuaaaagaugaaagaaaacaagacuggacuuuuaaggguuccacauaagagaauaacauauuaucaucuaggccuauguuaaaacucauuuuuagucauuuauccauuauacauacacacacacacauauauacacacacacacauacauacauauauauacauacacacacagauauauauauauacauacacacauauauauaauuauauaacuuaaagacaaacuaucacccucauauuagguggcauuuccuugaaaagaauucccuuuuccuuucaaaagcuucuaguuuaguaaagagaaaacaacaaagguagaguuuucaaagagcaagcagcuaacacuugcugggcaucuacuuccuaccagauauaaucuuaacauagaucagugcaagccucacaaagaacagggggcuuauuauuaccauuuuauagauaaggcuuagagaucuaacucauacucuaucacuccaaccaucucuuaacugaaccaaguggccuggccugggucccuaaucaccagcuaucaugccucuuggaccacaaccauaaguaaagaacacacugaaaacugaauacaaaaggcuuacagcaggcaggccaggacaccaugccggcuugccugagucagaaagugauucacaaauuaccacugaagauaagcagacaguuguuugcuuccauaaaaauguuuccacagagaaaacaaagaagaaacauucuaggcaguaggcaaacauguuacaacacuuagguucuggggaauuaaggaggguaacaguuguaucaguuuccaaucgcugcuguaacaaguuaagacagaccugcuggcuuauagcaauagaaguaauucucuugcaucucuggagaguagccuucuaaaauuaauaugacucagcacaaaucaaggugccaauggcccugcuccuucagaagauuuaagggaauuucguuccuugauucuuuuagugucucauggaugucagcaucuguugguuucugauuuaucacuccaguuuucaaaucuauuacuugggaguucaccugggaauauagacaucugccuaugcuccuuuuuguaacgauacagaugacugcaaaugaaggcccaccuagauaagacagugaccucucaucugcagaucccucauuacaguugcaaauagaucuuuuccacauaggacaacaguagucaggcuguagggauuaggacaugguaccuaggggacugguuuucagccuagcucaugagccauagaggagucuaugggagucaccaaaaggugccagcuggagguaaugggggcugagcaggagaugacaacugccuugguuaaggagaaguguucauguuauccugaacgugacggguaaaauuggaaggugcugauuugcaguaugacacugugauacuugcauaguacuccacagcuaauauggaagagaaauuauaggagggaagagaucguuaagcuucuuaagagcucugggauagagggagggauagauaagaugggaggacagccauucauuauaagaacagugauaguugauuagagagagcauggaaagaaauccagggaagcuccuuaauuuccauuugggggcaacuggguagauaagaaggaugguagcuauggcugguaauaucaacuaaagcccccaaaguuaagagaaaaaagcuccaaaguaaaaaaaauguuugcuucuauaaaaauguuuccacagagaaaacaaagaagaaacauucuaggcaguaggcaaacauguuacaacacuuagguucuggggaauuaagaaggguaacaguuguaucaguuuccaaucgcugcuguaacaaguuaagagauugugugugugugugugugugugugugugugugugauggacuuuugcagaccaaggccaaugcacccccuaggcuaucucuaacacaaaaaugggcaacaauuccuugcccauucuagccucugaccuuuagaauagacagaaaucauuggaaaauguaaaaucaaaccauuagcuuguaccaagucuaagaaugucaccagauugcaccuuggggucaccuuguuguaaacauaccugcuugauggucucacuaauguguuuuaaauacaccuugaugugugucuuucauuguucuguaacuaauaaggucucauggaaccacuuccauugugguacaugauauuggaagcaaccugaaucuguuucuggggcauggucaguuauauuuggcuccaggauaaacuaccuuauauuacguuugagggaagagucaguguguguguguguguguguguguguguguguguguguguguguguguuugcgggagguagcagaacaguguugaggggagagagaagcuuuaccuuagaccugcugauagagaauuaucuauguguccccacccaggcugagaugcugauggaugaucauguaugaaaauacagaguacagaagaagaaacuuaagauauauacaucuaaagauggaaacuccaauuuacauuuguggauccuuagcuaugaauaggcugaaaauauccaguaaguuaauacuagcaacugcuuccacugcagaugugaacauguuucaaggaaguccuucaaguagguguacacuauuuggaugcuucugccuggucacugaugaauuacagucaccuagacuauaaccuaacuggcucauuuuccauagauauuaugugcaccaaucuauuaaaaucaccccauagaagauggaguguucacugcucuauuagucugauuuuauacauugaagaucccaaaacuaaggaacucauaaaugcuaaagagagcuuccauuccccaaaggcuuugaaggagaaaaaaaaaggucauuuauauaaaucuaucuacaggggauuuuauaugaaaugaaaaaaaauuaucuuagccagugguccauagaacguuuucauaguaugacugucuaaacucuacaucacacacccgcaguaauuuggggcugcuaaaagaagagauuaucaucccucugagagcacgggguacauucaauaaauguugaaaaggggaacaccaggcagaggcuggagaacaaaaaagcuacagggagacagcagauccugaggguuugacaagcaggugcuucuguggccaucacaucgcuauucauagauguguguucugggccagagaguccugcucugggaaacaaugccucagccauuagccccaggagauaucaaucacucuuccuaaggcacaguuagcucaggagggaacucaaaacuuaacugagucaaaaauugcuucuaagcagguuuuccccuaaucuaaucgaaaggaaaacuugagagaaaccaaagguauucgauguuccuucaaauuuuguucucuaccuacaucuucagagcuauuuuuaucacuuauuuuucaagcacaaagucugucgguccaauguaacacagcuaugcauugcuuuuuguaagacacucaaacuccugccuacggucucacaucacuuucuaccuggagugucuuuccuuuauucucucuacuuucagaguuuaguuuuuuggcuuggguccuacguaacacaugggaacccaauggaaucgugccagaugguagccacggugucucuucaguauuccagcuauuauuucuacaguaggcuuagcagccuuggaggacccuuccucauguuagcuuugaguccccugguagcaccagaaauguaaacauccacuucuuaggguuuuuaauuaccauuaaauuaccauuuuaaugaucauguaaaaagcuagagguaucuggccuuuguuuaaaaagcaaguugcuuccccuggaucaggaaaaaaaaaaaaaaaaaaaaaaagggaucuucauucuaacucuggcccuggguggaggucugacauucuaaacuacccaaggcacugcauacuauuguugccucaguuuuaaguccugauccugggccugcagagauaaagcccuugcugcuuuuuacuggaaggaccugauuucaguucccagcauccacauggggacacacagcuagccaggggaucugauacucucccuuggccuccacaggccugcaucuauguauguuguacacugacauacaggcaaagacgcacucauuuuuaaaaccagaaaaaaagauauuuaaagcucgagcuaauccaacuauaccuaacaaucaggaggucaugaguccacccuguucccuucccccaccguccauaauucaccugcaggugcuaaggagagggaagaacuaauuauacccuuaagggaucuuguaaguaucagaguuucccauacaccacugccagcucuucugaguccugauucaauucaagcaaguccgaacucuaaaccaccaaguaugaucucagaaaggaacuucuuccuuaccugcuccccaccucuuucuuucugauacuugggaaagccuacgcuugcuuucucccucuucuccgaagcugccccacccuacucucuccaccguaccucauccuuaccuaucaacccagcagaaggucuucauggaccaaaacgacuugaagccucugugauaaggcucaaggccuguguacuugagccaucgagcacgaagcuuaagacccccccaccucauauaaaaguuauauaucuguaugacaaucaaguguccguaggauuaucucaaacucccauuuaaaaaauaacagugauuuuaugaaaggcauuagagaccacaugauucgacucaauucauaaggaagauucauguaaccagagcgcccaugggauaaaaugaagacguguuccagaaacuuacuauuuaaaauaagacuaaugagguauugaucuuuaauuuuucacaccaaaccauuaucccuaagauuacucaguuaaauuuccauacacaaagagcucucauuuaaauuuucugaaugucuauacuaacuguguuucucuggcaagagcauacuauaguguucaugaauuaggcuucacaaggcuuauagaagaugauuauuaaaggaaaacuguccauuaaaaaaauaccagcaugauuuaguuggguuugaggaguguguucuaaacaacuucuuuuuaaaaaaauuuuauuagccgggcaguggugacucacgccuuuaauuccagcacuugggaggcagaggcaggcagauuucugaguuugaggccagccuggccuacagagugaguuccaggacagccaggacuacacagaagaaccccaucucgaaaaacuggaaaaaaaaauucauuuaaucuuuuuuuuuacccuccagauuuuaucacucucccaguccacccucugacuguuacacaucccacuccucuucucccacccccaucuccacgaggauguccccacaccccuacaccccaucccaucagaccuccccccucccuggggccuccagucucuugaggguuaggugcaucuucccugacucaacccuaacccagcaguccuuugcuguauauguguugggggccucaugacaucugguguaugcugccugguuagugguccaguuugagagauuucagggguccaggguaguugagaagacugcugguccuccuacagggucgcccuccuccucaacuucuuccagcuuuuuccuaaaucaaccacaggggucagcugcuucuguccauugguugggugcaaauaucugcaucugacucuuucaauugcuuguugggucuucuggagggcagucaugauaggccccuuuuugugagcacuccauagccucaguaauagugccaggccuuggggccuccccuugagcuggaucccacuuugggccuguugcuacaccucuuauuccucaggcucuucuuuuuuaucccugcaguucuugcagacaggaacaauuauggaucagaguuuuuugacuaugggaugacaaccccaucccucacuugaugcccugucuuccuguuggaggugggcucuauaaguucccccauccuucuguuggacauuucguauaagguucugagagucucuugccucccaggucucugguacauuccagaggguccccccaccuucuaccucccgagguuaccuguuuccauucuuucugcuggcccucagggaucaaaauaaauuuguuaaaugcauggguuugaauacccuggagauggggaaauaaaugggccaagucuaugucuuauauaugacggcugucacucaaaugaaggcaugguguacucugauuggcauagcuuugcuuuuguuuuauucuaugacagaacagcggcccauggcuucuugaguaucaguauccccuucccacacauacauacacacauacacagacuccaucaugcacuggguauggcuuuagaccuuuucuguauuuuccuucacauuauaucccuaacaaugucacgaaguauuacagcuguugaaacugauuucacagauucauggagucaaaggaaacuguccaagcucacacagccuguaagaaacaaguucagccuaagagacagcuuuagcacuaaacacacaccagacuugaugccuauuucuuuguugaaucaccuaauuucaauaugacacuuaaacuuuauuuuuaagauuggaucagugguaagguuuuuccccccuauauuucuuuguaccacauguaaguacauucuucccccccccccuauacuucuuuguaccacauguaaguacauucuuucccccccuauacuucuuuguaccacauguaaguacauucuuucccccccuauacuucuuuguaccacauguaaguacauucuuucccccccccuauacuucuuuguaccacauguaaguacauucuuuucccccccccauacgucuuuguaccacauguaaguacauucuuuaauccaucaugacucucuaauguguguagaaucaacucuguugcaccugaaaagguaagugguuauucccagcuuuaguauuucugugcuaaaaggugggaaacuucugcuucucuggccugugcugauuaagcaucuguggguagcaaagaaggucauggagagacgucaaggaucuagcucacucacugagugcacagcaagaaaaaggaaggcaaaggaaagcuucgaggauugacuggccagaugcuggggaaccuggcagaaagcugcuggaaaaaccuucaggaugcauccucggcucaaugucugugguaccguuugaacagaagcaaccucucuguagccuaacuaccgacuuucccaauguuaacucucaccuccacaugaauucucuggguuguguggaagacccugacagucaagaaugccugcacaaaauggaaaguguguguacgugugugugugugugugugugugugugaugcaugugcaaaucgugcacacuugcaggccacagguuuacuucaggcaucuuccccuauuucccucuaccuugcuuuuuaagacagggugugacacugaagacauaauuugcuucccuuucacaccacuuuaaugguaacaggcagcccauguaaauucacauacauggauacacagguauuucugaagaaagaugggauggaaguggucacaggaauaagcaucuagggaucucacucaucagugacagugaagaguaagggaaggaguaggagcugaguucagugagagcaaggaaagccacagacuggcagagcugaaugacagaaacccaagggaugcuguuuccaugguaacuaagaccuagaagagucauccaaacaaaaucuuccugugggaaaugggcacuugguucuaugaucuugucuaugacgugacaccuucuuacacagcccuaagaggaauguugaaacuggaguauuuaugaucaaaauuaaagucuauaaacucuuucuacaauguauuucauuaccauguuauaaugacuacauggugauauguuuacuuuuauaucuacacaaaaugaucugagcuuagcugcgggcaggaacaggaggaaaagcucuuuaccaauccuauaucugacagaggacuaauagccaauauauacaaagaacucaagaaguuagaauccagagaaccaacaacacuauuuaaaaauggggaacagagcuaaacagagauuuuucaacugaagaaacucaaauggccaagaagcaccuaaagaaauauucaacauccuuagucaccagagaaaugcaaaucaaaacaaccuugagauuccaacucacacacuagucagaaugguuaagaucaaaaacucaggugacagaagaugcuggugaggauguggagaaaaagaaacauucuuccauugcuggugggauugccaacugguucaaacacucuggaaaucagucuggcaguuccucagaaaauuggacauaguacuaccugaggacccagcuauaccacuucugggcauauacccagaagauguuccaacauguaauaaggacacaugcuccacuagguucauagcagccuuauuuauaacagccagaagcuggaaacaacccagauguuccucaacagaggaauggauacagaaaaugugguacauuuacacaauggaauacuacucagcuauuaaaaacaaugacuucaugaaauuugcaggcaaauggauggaacuugaaaauaucauucugagugagguaacucagucacaaaagaacacacacaguauguacucacugauaaguggauauuagcccaaaaguuuggaauacccaagauucaguucacagaccauaugaaguccaagaagaaggaagacuaaaguauggaugcuucagugcuucuuagaagagggaauaaaauacacauaggagaagauauggagacaaauuguggagcagagacugaaggaaaggccauucagagacugccccaccuggggauccaucccauauacuguaagcaaacugggauguuauuguggaugccaggaagugcuugcugacaggagccugauauggcuguuuccugaaagacucuaccagagccugacaaauauagaggaggaugcuuguagucaaccauuggacucagcgcagggucccugauggaggaguuggaaagggacugaaggagcugaggguguuugcagccccaugaagggagcaacaguaucaacuggccagacccccugggagcuccuggggacugaaccuccaaccaaagaauacacauggagggacccgugacucaggccgcauauguggcagaggauggcuuuauuggacaucagugggaggagcagcccuugguccugaggguguucaaugccccaguguaggggaaugccagggcaagaaggcaggaaugggugggugaguggggagcacccucauaacaggcaaggagggggguugggauagggaguucccaaagaggagaccugaaaaggggaaaacaauugaaaugcaaauaaauaaaauagucaauaaaaaauuauaaaaaagaaaugaaauauauuuugggcacuucuuagcuaaaucauguuacuaaaauauaaaacaauuuauaaauaaauuauaagcuuaauuaccauaaaaacaauucauccccuuuuccagcauauuuuagguagcuaucuguccacuuguugcaaugaaaaauggcacaucaaggauaugugagauuuuguaauuuucccuucacacacaagugacaaugacaaauggcucaaguucccgccuucuagucccaucaugaccacacguuugaaaaaucaauacaucacuuguggccaggaauuccaaauacaaccuacgaugcuggcauuuuucucuacccuccugcuucacucccauuauccccaccuguucgucucucucccucgaucccuguucuugcucaacagcuggauuccauucccaccuaaaacuuagggaguagcaaugcuuuggaaacuuuucaaaaagauguucuaauaagucaagcucccagccaugagguuacagacuugauugccucagggcuaggguauaaccacccugagaagcuaggaugggcagaaagcaagaaagggaagaaggcaaaugggagaagaugacagccaggucuuagugcuguauuacaggcucacacaguaggguccauuaucugccugaggguccaucuucgugccagaaauaaaggaaagaagagagggugagggucaaucaucuuguuauggcugaaucuuccuuucaggauaaauuacagacuggccauuagcaaggcaucauauacugagaguuacaacuuucuuuccuuaagugaggcuuggcuuaauuacacgcaggauugguuauguugaguugaguaacuggugaguugaaccaaaucugaguuuggucaaaaaucugaggggugggggauggggaaaggauccuuuggaguuaauuuaaauguagcuuuaauuuugcuaccaugaugaguguaaaaucuauacagagagcaaauauuuguuaacaaaaguagaaaauaacauaauguucuagcauugcacaccagaaugagauguuguguguuuuuuauuuuguuguuauuacuuauuauuacuguuucuaauaauacaguuacuacauaggguaguaaggggagagaaagagagggagagaaugaaugaauacaucccuuagcuauaacaagguccaguauuccugagcuggggaaacuuaaacugucaaaaggggcuugauauuaucaguuuauuuaauccuuucaaaacaguauaucuuugaaauuauucucauuuuacagguaagagaacugauuuggagaaguugauuuuauuauuggaaagguacaaaaugagcaucagagagccccucucccuauggugacaucaaagaacaaccuugggauucaacacaugguccaaagccaucacgaaugcaaggcacggggguugggggugggguguuaagcaggccacagaugaaagcaccucucagaaacagaaaacuccuaaucuaaaaacacaagcaagacaaaugacuuucaaaaggagaggcaaccacacaugucaaaaauccucuuggcuauuaagagaacugaaacuguuucuagcugaggaagauuaaguuaugauuccagaaggcggcaucguuugagucgggcuuguuaacaucugcaguugugcagcagcuuguggcucaccagcauuuggaaggaguugacaucucacaaccuccgacucuacagacuuuccaauaaucucugagaaaguaacuguguuggcaccuaaaacguaucuguagaaccacauaaucacguuuuuggcuuaaaggguuuggggccugguacucuggaguccgaccccagcuaggaauguucugcaguaauuuugugugcuauuauugaccucuacugagagucugauacaucuggacacuauguuaagcauguaguacgccuagugggucauguuucccucuaggauaaaagugccagcauuauucaaauuuuacaaaugaugaaaucaagacuuaaagcuauuggucucugagguccuauagcuuauacuggggaaagcugugaguuugaagaaugugcuuuuguuucuggagauagugguucuggagauaauggaauaagguuggauggcuucuaaaaauaggcauacugguauauagucucaaaggaagcaaaauaauaacaguaacaauaguuaccauuugcugggacccuauuaugggccugaccuuauuauguaugauuuaaacacauucucuaauuuucuuaucaaaaucuuuccuaauuuucuuaagauaagcaugaagucucuguuuugaagauaaauaaaaagcaacagacagggaugagagcaguauaugguuaagaagaggcacauauuuaauauguuacaaagucaagguuucaaaacuuagaucuuucuaacuuuucauuauauaacgcuauucccauuucuuuaaaauguaagggugcuuccauagaccaugaaaccaaauagcauuuuaaaaugaaagcagaaacaagguguugugcacagccauaaugacugcauucuggaagcugagguaaaagaaucaggacuucaaagcccaggguggcuacagagagaaggcaugucucccacaccccacaucccacaucccacaccccacccccaaaccaaagggcaggacaaagcagcuaauguucaagugguggaaauaagacagccacaggcaaaucaaggaacaauuacuaugugaauuaaauagcacagagccagagacauggcucaaggcacuuacacuuugugaaggacagaguucaguucccagcacuuagcaccuacgauggcucacaacuaccuccaacuccagcuccaggggauccagggguccucuuucguucuacauaggcaaugcacacacaugguauaugucuggacagacacacacacaugcauauuaaaauuauuauguacauauuuauucuauuucaaaaaggaacauauaggagguaagaggaaaguuaauggccaaaguaguuuauaaauccaaguagacgaagaccacuagguucacaaccuaaggagaauccuuucaaguccagcuccaucuacagguuucauaaauguugguaccuaagaggcuuugcaagccuguuuccugucuguaaaaguuuaggaaucaaaaggcuucucucuccucucucucucucucucucucucucucucucucucucucucucucucucuucauuacaccauucucaaaaaccuuucuauacgucacucuagauuauguugaaauauaugagaagaccuacaugugacauguccaauaucaaagaucuaugugauuuuuguuuuuguguuagguauugucuuaucuuacugaagcaguagaagaaaauuaucuagacacaccuuuggccccucuccauuauauccuuucuugacaacaaaucucuaaauauuagcaucuuuuuaaaucuggagaacucaagcguaucacacccuuaaaugccagguuccuuuucagcuaaagguuguauaccuagcuuaucucuuuuauuuauuguaccacuucagaauuuucauuuuugauauuaaauguguugcuacuguaaaagggauaacaacuuucagauggaaggagucaccuggaauaucuuaucugucuuuuugcuuugaaauagagagguugauauugcucaucuguguaaacaauggauuucuuauguucauuuccaggcaaauacccugaaacucagagaaugcacacggucaagaacauaacagaucugaggcugaagcuggaagagacaacauccagucuucgaggaacccagauaagccacagguacuaacaguucugccuaucauuugagggauuuaaaaaacaaacccacaaugcaacaugauuccaaauaucucugcugaugucaaaaugugggaauucacaguuacuggaaguggaagcuuucaaaaagaaaggccuccuguacauuuuaguuuaucucuuauuuagaaagaagaagucaucccuucuggucccacaagcaccuggguagcuugggugcagagucagcugacacccacaggcuacccacaagacccuccacgggacauuaagaccucuggugaguggaacacagcugcugcuccaaaccaaucgugcgggaccugagacugcauuaauuagggaagcagaaaacccguccugaucaggggcacaagucccuuccgguccugacaauaccaggguagcuugggcccggagucuggggacgcccgcgagguauacacaggacacuccacaggaucuuaagaccucagugaguggaucacaauuucuaccaggaggcagguucaaacaaaagauaucugggcaccuucccugcaagagaauagcuuacuugcagagaauacucugaacacugaaacucagaagagagcuagucucccaggucugcugauagaggcuaacauaaacauaugaggaacaagaucuaacaagagacaacuacaacaacuaacuccagagauuaccagauggcaaaaggcaaacauaagaauguuacuaacagaaaccaagaccacucaccaucaccagaacacagcacucccaccccacccaguccugggcaccccaacacacccgaaaagcuagacccggauuuaaaaacauaucuuaugaugaugguagaggacaucaagaaggacuuuaauaacucacuuaaagaaacacagaagaacacugcuaaacagguagaagacuauaaagaggaagcacaaaaaucccuuaaagaauugcaagaaaacacgaccaaacaggugauggaauugaauaaaaccauccaagaccuaaaaaggaaaguagacacaauaaagaaaacccaaagugaggcaacacuggagauagaaacccuaggaaagaaaucuguaaccauagaugcaagcaucagcaacagaauacaagagauggaagagagaaucucaggugcagaagauuccauagagaacaucggcacaacaaucaaagaaaauacaaaaugcaaaaagauccuaacucaacacauccagaaaauccaguacacaaugagaagaccaagccuacggauaauaggaguagaugagaaugaagauuuucaacuuaaagggccagcaaauaucuucaacaaaauuauagaagaaaacuucccaaaccuaaagaaagagauguccaugaacauacaagaagccuacagaacuccaaauagacuggaccuaaaaagaaauuccucccgaaacauaauaaucagaauaacaaaugcacuaaauaaagauagaauauuaaaagcuguaagagaaaaaggucaaguaacauauaaaggcaggccuaucagaauuacaccagacuuuucaccagagacuaugaaagccagaagauccugggcagauguuauacagauccuaagagaacacaaaugccaacccaggcuacuauacccggccaaacucucaauuaacauagauggagaaaccaaaguauuccaugacaaaacaaaauucacacauuaucuuuccacaaauccagcccuucaaaggauaauaacagaaaaaaaaaaauacaaggacggaaaccacgcccuagagaaagcaagaaaguaauccuucaacaaaccuaaaagaagacagccacaagaacagaaugccaacucuaacaacaaauauaauacgaaacaacaauuaauuuuccuugauaucucuuaauaucaauggacucaauuccccaauaaaaacacauagacuaacagacuggcuacacaaacaggacccaacauucugcugcuugcaggaaacccaucucaggggaaaagacagacacuaccucagagugaaaggcuggaaaacaauuuucuaagcaaauggucugaagaaacaagcuggaguagccauucuaauaucauauaaaaucgacuuccaacccaaaguuaccaaaaaaaaagacaaggagggacacuucauacucaucuaaaguaaaauccuccaagaggaaaucucaauucugaauaucuaugcuccaaaugcaagggcagccacauucauuaaagaaaccuuaguaaagcucaaagcacauauugcaccucacacaauaauggugggagacuucaacacaccacuuccaucaauggauagauccuggaaacagaaacuaaacagggacacagugaaacuaacagaagugaugaaacaaauggacuuaacagauaucuacagaacauuuuauccuaaaacaaaaggauauaccuucuucucagcaccucaugguaccuucuccaaaauugaccauauaauuggucacaaaacaggccucaacagauacaaaaauauugaaauugucccaugcauccuauuagaccaccauggacuaaggcugauuaacaauaacaacauaaauaauggaaagccaacauucacguggaaacucaacaacacucuucucaaugauaccuuggucaaggaaggaauaaagaaagaaauuaaagacgcuuuagaguuuaaugaaaaugaagccacaacauacccaaccuuaugggacacuaugaaagcauuucuaaaagggaaauucauagcuuugagugccuccaaaaagaaacuagagagagcacacacuagcagcuuggcaacacaccuaaaagcucuagaaaaaaaggaagcaaauucacccaagaggaguagacagcaggaaauaaucaaacucaggggcgaaaacaaccaaguggaaacaagaagaacuauucaaagaaucaaccaaacgaggagcugguucuuugagaaaaucaacaagacagauaaacccuuagccagacucacuagagggcacagggaaagcauccuaauuaacaauaucagaaaugaaaagggagacauaacaacagauccugaagaaauccaaaacagcaucagauccuucuacaaaaggcuauauucaacaaaacugaaaaaacuggaugaaauggacaaauuucuagacagauaccagguaccaaaguuaaacgaggaucaaguuaacgaucuaaacagucccauauccccuaaagaaauagaagcagucauuaauggucucccaaccagaaaaagcgcagaaccagauggguuuagugcagaguccuaucagaccuucaaaaagaucuaauuccaguucugcacaaacuauuccacgaaauauaaguagaugguacucuacccaacucauucuaugaagccacaauuacucugauaccuaaaccacagaaagauccaacaaagauagagaacuucagaccaauuucccuuaugaauaucgaugcaaaaaauccucaauaaaauucuugcuaacugaauccaacaacacaucaaaacaaucauuaauccugaccaaguagguuuuauuccagggaugcagggaugguuuaauauauggaaauccaucaacauaauccauuauauaaacaaacucaaagacaaaaaccacaugaucaucucguuagaugcugagaaagcauuugacaaaauccaaaacccauucaugauaaaagucuuggaaagaucaggaauucaaggcccauaccuaaacaugguaaaagcaaucuacagcaaaccaguagccaacaucaaaguaaauggugagaagcuggaagcaauccuacuaaaaucagggacuagacaaggcugcccacuuucuuccuaccuauucaacauuguacuugaaguccuagccagaguaauuagacaacaaaaggagaucaaggggauacaaauuggaaaagaagaagucaaaauaucacuuuuugcagaugauaucauaguauauauaagugacccuaaacauuccaccagagaauugcuaaaccugauaaacagcuucggugaaauagcuggauauaaaauuaacucaaacaagucaauggccuuucucuacacaaagaauaaacaggccgagaaagaacuuagggaaacaacacccuucucaauagucacaaauaauauaaaauaccuuggcgugacucucacuaaggaagugaaggaucuguaugauaagaacuucaagucucugaagagagaaauuaaagaagaucucagauuauggaaagaucucccaugcucauggauuggcaggaucaacauuguaaaaauggcuaucuugccaaaagcaaucuacagauucaaugcaauccccaucaaaauuccaacucaauucuucaaugaauuagaaagagcaaucugcaaauucuggaauaacaaaaaaccuaggauagcaaaaacucuucucaaggauaaaagaaccucugcuggaaucaccaugccugaccuaaagcuuuacuacagagcaauugugauaaaaacugcauuguacugguauaguaagagacaacuagaccaauggaauagaauugaagacccagaaaugaacccacauaccuauggucgcuugaucuucaacaagggagcuaaaacuauccaguggaaaaaagacagcauuuucaacaaauggugcuggcacaccuggcaguuaacauguagaagaaugcaaauugauccauuccuaucuccuuguacuaaggucaaaucuaaguggaucaaggaacuccacauaaaaccagaaacacugaaacuuauagaagagaaaguggggaaaagccucgaagauaugggcacaggggaaaaauuccugaauagaacagcaauggcuugugcuguaagaucgagaauugacaaaugggaccucaugaaacugcaaagcuucuguaaggcaaaagacaccgucaauaagauaaaaaggcuaccaaccaauugggaaaggaucuuuaacuauccuaaaucagauaggggacuaauauccaacauauauaaagaacucaagaagguagacuccagaaaaucaaauaaccccauuaaaaaauggggcucagagcuaaacaaagaauucucaccugaggaaugccaaaugggcugagaaacaccugaaaaaaaaauguucagcauccuuuaucaucagggaaaugcaaauuaaaacaacccugagauuccaucucauaccagucagaauggcuaaggucaaaaauucaggugacagcagaugcuggcgaggauguggagaaagaggaacacucuuccacuguugguggaauugaaagcuuguacaaccacucuggaaaucagucuggcaguuccucagaaaauuggacaugguacuaccggaggauccugcaauaccucuccugggcauauauccagauaagguuccaacuaguaagaaagaaacaugcuccacuauguucauagcagccuuauuuauaauagccagaagcuggaaagaacccaaaugccccucaacagaggaauggauacagaaaaugugguacauuuacacaauggaguacuacucagcuauuaaaaagaaugaauucaugaaauuccuaggcaaauguuuggaccuggagggcauuauccugagugagguaacccaaucauaaaagaucucaaaugauauguacucacugauaaguggauauuagcccagaaacuuagaauacccaagauuuaaguuacaauuugcaaaacacaugaaacucaagaauaacgaagaccaaaguguggacauuuugccccuucuuagaauugggaacaaaauacccauggaaggaguuacagagacaaaguuuggagcugagacaaaaggauggaccauuuagagacugccauauccagggauccaucccauaaucagccuccaaacgcugacaccauuacauacacuaguaagauuuugcugaaaggacccagauauagcugucucuugugagacuaugccggggccuagcaaacacagaaguggaugcucacagucagcuauuggauggaucaaagggcccccaauggaggagcuagagaaaguagccaaggagcuaaagggaucugcaacccuauagguggaacaacauuaugaacuaaccaguaccucggagcucuugacucuagcugcauauguaucaaaagauggccuagucggccaucacuggaaagaggcccauuggauuugcaaacuuuauaugccccaguacaggggaacgccagggaccaaaaagugggaguggguggguaggggagugggggggaggguaugggggacuuuugggauagcauuggaaauguaaaugagaaauaaaauauaaaaaaaaaagaaagaaagaagaaaucaggccauaccuucaacaauaucuagcauucuacccagccaaugagccauguucaucacuugccagucacauguaaagcaccauccaccuauacuuucugcugcuccauugcagugucucucuucuguuuuuaaugguguacuuucagcaccuucaacauccacaagucuaccgacauccugucuguugugauucauauauucuacaagauaaauuuucuccaaaacuuuccucaguuucuucugacugcuaaccuguagagcuuuuaacauucacauuucuacaagcauucuacuuagaaccauuugggucuuuucuaagaaauauggauuuuucucugcuaugccaguuuauggguccuaaucugcagaauauuugaucauuaacuauuucuguucuagacaaccuaggcuuuaacaaccuccuucaaauucuucuagaacuuuccucaacauucaggcucaaauccacugcuaugugagagagugggacauuuuuauagcacgauucccacuuucagguaccaaaucuguaauuguuuccuagaacggccaaugcaaaugaccacauacuuaguagauuaacaaaauguuaauguauucucauaauagucuucaaaauccaaaguccaacuguucucaccugacuaauuucacagcauuagccgggugaauuccuccuagaccugcucuagccaugguucucaaccgacuucaugcccugaccuguuaauacaguuccucacauugucgugacccccaaccauaaaauuauuuucaucgccacuucauuaacugugauuuuugucaccuauaucaaucauaauauaaaugauucuauuuuccaauggccuuuggugaccccugugagaaagucaguaauccuaggggguugugacccacagguugagaaccauugcucuacugguuaauccacuuucugucucucuaauauuuggaaguugccuuuacuuaggcaaugauuacaucccucugacuucucccagcaucguaucuccucugucuuugguccaacugccuuccucuaugaaaaccacugugauauauugcaccucaauucaagauccuuaaguuaaccaccuaugaauaccuuugucacauaaauaacauuaguuacacguuguaaaggcugggaaagugacaucuuugguaaaaauuguucuacagcagccauccuuauuauugauggauguauguuaaaauguuuaacucauauaaucaaguuuuaaggauaugaccucccauauccuacccaucucacagaaguaacaucuuauuaugcuuuccaccugguaagcauugagucuauuaaaaguuucaguaaaaagaguucagacacagagaagauucuguuauuauauuacugaacuagacaguuuccaaggcuauugcucgauuagucccuugacucgugauuauuauucaaagagucucaucauauuccagguauauuacacuagggauaaaguuaaaccucucuggcaaaaguauagcuauucuaagcugauaucuaaaggaucaugucaauuuuaagaauguaaaaaauaugaaagucagagaauuuaaaugauuaacccaaugacacggauucugauguagacgagaguauaauuuugugaauaucuaaugacuaguuacauggaaaucugaucugcucauagagagagggagggagagggagagggagacggagacggagacagggagacagagagagauagggagacagagagauagaggcagagagacagacaagaaggcagggaacaauagagaaagaaggaugggagagagggagggagggagggagggagggagggagagagagagagagagagagagagagagagagagagagagagagagagcucugcuuuuauaugaaaugacuugacuuacucucaggcauacucaagcagauuuuuauuuagccaucugaguuucuuaaacaugaagguuaauacuaauaggguaauuuccuaaaagcuucaggaacuucaggaaaaccuaaucaaauucauaaaaauacagauacaugugucagagugcuacacaugguuaucagguccagugaaaaaauccucuauugccuuuggucaaauuauugguuuauaaaaucuacauaucuauaaggucuacaagugaucuguuucugauuuccuuacagacaagauaacuaacucacaaaaccccaagauaaauaugcucauauuuguucaugacagaagcuauuuuaagaggaucacuauuucuauagacaacacucaaugcuacuagucaguuguuccuguaaagaaaaaagaagaagcacuuugauguuucaagaugucaauuuauuaaauauaucagacuuuuuguucuuguucacuaugaaauaaauaacauaaaauucaaguagaaacugggauucaaagaccuuggaaagcucagucaaaauaauuuuuuaugugaauaaguuccucaccaaguaaaagaaaaagacugauaugaucagaaauacccauucauuucaacauggaaggaauuguuuguguucaucuauagaagcaaacuuucaguaaugauaguuauugguauguaugguguacuaucaugaauauuaccaugucaacagaaaugugacagcuauuucauugauaagaucuacacuagcuagcaagguuccucagauuuuuuaaaaacaaccugacagugaauaaugcaggacaaauaugauauucaaguauauuucuacuauauagucagggcacaggugucuagauaaaauauucaaauuaucaccaauucaguggcaagucaaaacagaaaauguauauuuguuguaagaaaauauauugcugggcuggugagauggcucaguggguaagagcaccugacugcucuuccgaagguccagaguucaaaucccagcaaccacaugguggcucacaaccaucuguaacaagaucugaugcccucuucuggagugucugaagauagcuacaguuuacuuacauauaauaaauaaauaaaucuuuuaaaaaaaaaagaaaaaaaaagaaaauauauugcuaauauuacaguuuuauuuuucccaguacugucuuuuuaauaaaaauagaaacuaucaagaugaaaauaaaaaccauaucgacacacgauaaacacccaacugaauauaaguguauauccacacagauguggaugauuuuauguaaguucaauuauauuacuaauuuuaaaaucuguuugauauuuuaaugaaaaguucaucaauaauaaggagcuguauaauaauuucuauggcuacauauauuccauaauugaguguuccaauuuuauuuaaccaaucuccuauugaggaugcaaaucuuguuuaucaugcaaaucuauggcuaugcuauaauauacauugaugaaucucugguguucugucuaccaaaaaucuccaguugucucugagguaaaugcccaugacuaaaaguauggauaaaagaacauagaaaguacauaauauuuuaaacuaagagaguguuuauauggaaauagaaagcuuaugggacccuucugaaacugacauaugcagcuuguuuuaagacauccagauagauauacugggcuguuuucuaggguauggacaggugcugagauagggcaggccacagggaacuguaugaaugauauaaaaggcaaugucccuggccaaaggaggggucacuugaugacagagucacaggaugugugacaaguacaggucacaauugacagggggauaaaagcuggaccuguacaauuggaugcuagugucagaggagagaggaaaagacuaugguuggaguuuggaauuuuggaaucagagugcagcgcuguugggaagccaguauuuuaggcuccaauauugguuuuccuccuugaguacuuacaucugcacauccuaccaaugaagggggcggggguugugacaucugcaauggccuuaaauuuaugugcccucacaccuuacauacggggcagaacacugccugacugugugcacggcugagcacuugaucaacacuucucaguagguccucaguuauccaaggacagaaaagcuggcugcagaaguccaucaacuggccaccugccagagaggccaaaggagcaggaugcccuguaaguaugucuagaaagauguggcacagacucuaagaguugucuugaucaaagacaaucuauuagcaaauaaaacagcccagagaagcccugcaaugagcauguuuuacaccucuggguagaaauuguaacaggaacaguagaaagagaaaugugcuaucuucaaguuuaagagugacuucauccugaccagcaaaagaagagcggugauucaugcacacaaccaugccugaacgguggugacuguaggcacugcucacagcagucccaguuucucacuaucugauaacacacugcuaggaaaaacaacugcugugugugaggacuuggccagauauggccaugccgugcugggaagagauaagcaugaaugcaucuuagagcuuaaccaagcucuuucucuugaagucuuuauagauaaugaucuaucaaaacagcuccaaggauguuugcucuuggccaccuuccuaucugaaacuguguccuucuacagauauaagauuucaguggaaaaaccuugguuacuauccugaaaucaccagggaaaccuuacaggcacccuguuugaggguuugaggaagagaucaagggcccagcagaagucuguauagacuaaaagaugaaaccauuguacuuggaggagagcagaugaggucccuggugagccuuagaugcugagcauccuacucuauacuucgggacaggcaucauauuuggaaaggcuccaggccaaaugacccaucauuuggaaccaauaacgcuagcgacauuucuagcauuucauaauagaaaugauguccaugaaaugccuaccacauagaauauacugcuaaaaggcuagccaucacuguggauagcagugauucaaagagaaacuuugaaauuggucauauuuucuagaaaaggguuuccauaaauguccuaaggauuuuaaucaccugauguuacucaggauucugagcuuucaugaguuuaagaagaaaagguuuccagagaugccgguccagucaaaacaaaaagauaacacuccauacaauucauucacaggcugaacuugaaagcguccaccacuuagccuguucauuuuugcuuuuaguauuggagcaaggagagagagagaucuaaagucugaaguauugcgggcagugguggcgcacgccuuuaaucccagcagagaggcagaggaggacagauuucugaguucgaggccagccuggucuacagagugaguuccaggacagccagggcuacacagagaaacccugucucgaaaaaaaaaaaaaaaucggaaguauuaagucaguucaaagccuagacaaaaacugggaauuaggucuucauucucauuucacacauuaaaauacuacuugaucuuaagaacacuuuaggaucagauauauggguagccuagauacuaggugagccuauauucuuuccauaauaguuaggauugaaaagcugaauaguaugauuuaaacauaaaacauauuuaauacauguuaguuagauuccauuaaauuaagugguaguaauaugaaauacaagaugcauuguauaugguguuuacacaucugggcaccauauuaaugacaccaaguacaauggaacccauagcagacuauauggaaaugguuauucauuaagaucaauuuguauauauugacuuuaauguuccccgaaaugagcuagaaaugugaaaaauagcuucuaaaugggaaaaauguucugcauguugaaugcucuaauuuugaaaauuccaagguuauauuauugagaaaauauauuuaaucauaggaugcuuuggacaaaguaccuaaaauggaaagaaauuaaacaccuuaauauuuuuacagaaaaaaaaaaaacaaacaauguuucaagugguaugucgguacgugauuucaacacaauccauuugaugcagaugaccucccuaaaaagucugaaagcaaccacacugucagcucccugaggguagggacucagagcucagugcagagucggcccuggguccaucacugcagagauacacaagcugcuuguguauccucuguuuuuuaaggcuucguuggaaauacucagugucuuuucaaaguuuauauuccuuuggugaugaguguuaacucuuccugcuucugaacagaacucaggaagcuuaucacaaccuuagcauuaggucacagaguuuccuuaagucccaacgugauucaugucuucuccugucuucgaaaaaaagcugagcaauacugaauaaucuuuuuaauauuuuuauuagguauuuuccucauuuacauuuccaaugcuaucccaaaaguccccuauacccccccccacuccccuacccacccacucccacuuuuuggcccugguauuccccuguauuggggcauauaaacuuuguaaguccaaugggccucucuuuccagugauggccgacuaggccaucuuuugauacauaugcagcuagagucaagagcucugggggguacugguuaguucauaauguuguuccaccuauaggguugcagaucccuuuagcuccuuggcuacuuucucuagcuccuccauugggggcccugugauccauccaauagcugacugugagcauccacuucuguguuugcuaggccccggcuuagucucacaagagacagcuauaucuggguccuuucagcaaaaucuugcuaguguaugcaauggugucagcguuuggaagcugauuaugggaugaaucccuggauauggcagucucuagaugguccauccuuuccucacagcuccaaacuuugucucuguaacuccuuccauggguguuuuguucccaauucuaagaaggggcaaaguguccacacuuuggucuucguucuucuugaguuucaugcauuuagcaaauuguauccuguaucuuggguauccuaaguuucugggcuaauagccacuuaucagugaguacauacugugugaguuccuuagugauuggguuaccucacucaggaugaugcccuccacguccauccauuugccuaagaauugaagacccagagaugaacccacacaccuauugucacuugaucuuugacaagggagcuaaaaccauccaguggaaaaaagacagcauuuucaacaaauggugcuggcacaacuggcaguuaucauguagaagaaugcgaauugauccacuccuaucuccuuguacuaaggucaaaucuaaguaguucaaggagcuccacauaaaaccagagacacugaaacuuauagaggagaaaguagggaaaagccuugaagauauggguacaggggaaaaauuccugaauagaacagcaauggcuugugcuguaagaucaagagucaauaaaugggaccucauaaaguugcaaagcuucugcaaggcaaaagacaccgucaaugagacaaaaagaccaccaacagauugggaaaggaucuuuaccuauccuaaaucagauaggggacuaauauccaacauacauaaagaacucaagaaggugaacuccagaaaaucaaauaaccccauuaaaaaaaugggguucagagcugaacaaagaauucucaccugaggaauaccgaauggcagagaagcaccugaaaaaauguucaacauccuuaaucaucagggaaaugcaaaucaaaacaacccugagauuccaucucacaccagucagaauggcuaagaucaaaaauucaggugacagcagaugcuggcaagaauguggagaaagaggaacacuccuccauuguuggugggauugcaagcuuguacaaccacucuggaaaucagucuggcaguuccucagaaaauuggacauaguacuaccagaggauccugcaauaccucaccugggcauauauccagaagauguuccaaccaguaagaaggacaaauacuccacuauguucauagcagccuuauuuauaauagccagaagcuggaaagaacccagaugucccucaacagaggaauggauacagaaaauguaguacauuuacacaauggagugcuacucaccuauuaaaaagaaugaauuaauccugaauaaauuaaagauaauaauuuuaagauauuuaaaauaugcuuacuucuggaugaguaaaucaugugcuuggaaaauccucuggaaugaaauaaaagcagugggcuugaagaugaugcaauuucuaaaauauauaaaauacacacaggacuggugggauggcuuagcagguacuacacaagcccaccagcuugaguuuuauccuggaaucuauauaaaggugguagaaaagaaccaauucgucaaaguuguccucuaagcuucacacaugcacaaugguacauguacccauacauacuaguaauaaugaaugcaauuuaaaauagauguguguguauuaauuguaaaacugcaaaaucccuucacauacuuuuugaaauaaaaaucuauaaacauacauauggcucacuuauguguauacauaggcuuguuaaaggagaacccauggauaauaguauccagauacauaaaauacacauuuucaagaacuuauaugaggagagcauuaguaagagacccauuuccagauugcuggaucaaauccaauuaaaaaaauacugcaucauaaggaacuuuuauauuuaauauagcaacaauuaaaauccaagaagaacaccuuuuaaacauagcauaguaauuauaaaauauaaaaguuuaaaagcaaacaagcaagccagggaauaguuuuaauguaauaacauggguuaauaacgucaacacuuagccaugcaguuuaacauauugggaaagcagaaauaaaugagauuuuagauguaaauccaauccauaaggaugaaauauaauaagaggaauaugugauuguucauacaauaccuaggaaaacuagguauuaacaagugaaacccaacauacagucguaucuguaauugaagauaaaagcaauucuaaaagcaauaaauuaaaggaaaaauagcucugaaaaguuuaaugaauuuuauauuaaaaacugcacaauauacuugugcaugugcauacaaauuaagacaacagaaaaauuaaagauuaagaacacucugugguaaauguaacugcugaaauauucauaucuagaauaucuaagaaauuuauucaagcaauacuggucuucucagacaaguuaucaaagaaaacacaccauuuuaaaauugcaaaucagaagaaauuuacuacuaauacuucaaaauauacuuaaagcaaucgugagucaaguguuggcuggccagauauagucauaguguuaaagauuuggguugcagagugugacaguaacaacucugauacucuauuuugauccaagaguccuacuuuuuaagauauauaacacaaacuauuaaaaaaaaacauaguuugacaaaaucuugaacauuauuaaaaugggcaaagauguucauuaucauaaaacuauuuaggauauccacaaaacaaaaaccugugcuuuuuccuucccuuugcauucauauaaauaccaauauagauuaguacacugugcaugaagaccuuaagggaagacaugcccacggcuccucccacuauucugacaccaacaagaacuuugcugucaugauccacagauauugaauaccaaugaaaugaucuuccuucuucacagaacucacaguucaucauuucuuuuaugauuuauuuauuaauuuuauguauauauggauacacuguaggugaacaaauggugguaagcccucaugugguuguuagaaauugaauuuuuaugaccucugcucacucuggucaaacugugcuugcucaggcccaaagauuuauuuauuauuauaucuaaguacacugcagcuaucuucauacacacccgaagagggugucagaucucauuaugggugguugugagcuaccaugugauugcugacccaggacauccauuagagaagucaguguucuuacccgcugagucaucucgcuggcccacaguuaaacauuucuuaauaacaaauuauauauauaauauuuuucuauaauauguauauauuaaagauuggggcagauauuauaaaaguccuaugaagaaaauuuuaauauuauauaucaaauauuuaaauacauaugcguuaaaauauuauauaucauauaauauauaugaauauauuacauacuacauauucauauauauguauauaugaauauucuaugaaucuuuucacaaaaauucuuauugggaguuuggggggcuaagaucaaacuuccugcagcaugaccauaagaaaaaggauauuuucuagacccaggugcaaaacagaaauuguauuugugauacacauuucuagacaacguggcuuuuaccuguccuagacaauguccuuuuaccugucuccuggugacaaauuacuuuucuacccauuuucaauauaguuaaccuuauuuuaacacuaucuucaucuguaugaagucaaucucaucuuauguagaaauauuuuuauugcagcuucaacuuuccuaacucuauuaugucauuuccgaaccuuaggacccacaauacaauaaagcugacuuacuacugaaauguucauaaacaguauaaucaguauuuuaguguucuguucucauuuuuaaaaauucccagugggacauagaauauguucauauuauucaauaaugcuuccauugugcuaaaaaaauuauguauugcuaccgaugcuuuuaaacaacuucaauaucgccuccucuaacuauagcuuuaggucacaucuuaauauucuuuuaaauggcauacuuauggaucauaaacauuaaacauuuauaagugggaaaaacuuccaguauuacaaccaaaauuuagaaacauaacaaaggugcaaauucacuaaaugcugcacugagacucaaggaagcuaaagaggaagaagaaaagccuuacaaaggaagcagaggaccaagcacauuucugaauggaaaagacugaagcaaauaaauaugcgaccaccucacagucguguguuaccuuaacaaaagcgaaguuuuaccugugcgagcaugggaaagccaagguuccuacauccguuacaaggaguuagcgcuucccagaguccugugggcccacaagaguuuggauccuccucuucgucuuccacuucuccuggugacaaauuuauuguagaugaaguucucugaaaucaaauuuauauuacaccaauauauuauaccaauguuauucauauaucauaacaucaaucaaagcauauaacugacucgcuggugugucuuagcaagccggcugacugcuagccuuagugaccuggcucugccaucuugcuaggccagagauaugcaugauucaauuuuaaauugagagcagagaaagugggugggaaagaugcaaacgaauaaaguucguuuaguaacgggaacaaugacccaagaaaauaugugaacagcaaugaaugagggaaaucuuaugguuuaucaagaccuuaagauuagacauagaauuaagggaaauguagcaaggaggccaauaugacagacuugaaugaaauaggaauuacuguaggaaaugcuuuaagggggccaccaaaagcaaaccccgugaacuccuuaugauaggcaggacagggauaaauaauccuuuuuaauuuucacauaaacauucgaacuuacuuucacuacaucuuaaaucccacuaaagugacuacaccagguuuaucaaaaugcauacacuaugagacaaggguaguaggggaaacagaugguaacggaugagcagcaucaagaacauguguggacaauggcaggggacuucagaguagcagacagggagauauuagcugacagaugagaaccugaaagaaaagcaguugugugauugaguaacuggagagacagacaacuugugaaacugugaaaacaaccccuaaccaguccacuagcaaaacacuuauaaugcuucagcuacauauacauaacggucaucauauauuugaagaaagucucuaauaaaacaaacuuuuuaaauuuacauuuuccucagguauagaggauaucuauauaacaauaacugaagaauaccaccaaauacauagauucauacauaaacacauauguuugcauacauauacacauacauacauacauacauacauaaguacaaacaugugcugcaguggaagaacuagaaaauaaaucaauaaauauaacagauagaauacaaaaaagauguuaguaguuaggaaaacugagggaguuauuuuuuuaaggccaaaacuuuagcaagagcucuauacucauuagaaagagaauauaaacgagaaguucaaggaaaugauacaagaaacuuuucaggaacuaaagaaaaugacuauuaccaaaggccccgcugaauguucaguggacuggauucuaauaacacauauguauaaauuuuuaaaaaagaacaaggaaugcuggcauagauguggugggaggaaccacagauucacaguuagugggagucccaacugaugcagucacuaggcaaaucuuuggauagcggauggauuaaucauggauggaagaaugaauauugcgauccgucuacaucauggaauauuauuuagaugcaaaacugaaauuaaaacuucaaguauauagauggagccagacauauucagucugagugaaauaaaauccggauccaguaaaaucccuggugcguguuuucucucacuuauagaugcuagcuuugaaucuuuagauaucucuguuucauuuaagauacccaccuaggucagugaggugugcuuagggaacuuuuaagggaggggagauagaauaaagugccauaaaggggggaagauggauaauggaacauaacggacuaacuggagugcgggaugugaggacagaguagagaagggaacacuagaagcuuccacccuagugacuggcuuucauagugcuaugccuucucccaacauaaaacaaugaaucaucaccuuuacccagcggugaacccugugagcugaaccugauaaguuaugcucacuggcgcaauaugggcaugaagguaauggaagguacccaagcacuuucugaauguguuuaaggccucaaccacaagauggaacuuuagcaccauuaucaggacuagaacuugaagcuagaccuguggcuagauaggccauagaccauagggaagaggcugacauuccucuaaauggacaugguaguuaacuaacuccuggugguuugguauuuuaccuauagugccucucucaaaccucaugaaauaagcuucuuuugccauagauggagauuaacccagagacccacaauguaucaagaugaaggcaacaagagacuccagaguacucggcucuaaaugauauucuuauaauauaucccacccucccaggaaaucauuuuccagacacuacagggaaguugugcauaugacugggacagcagacagaagccaugcaaaggccugagucaggcaaaaucuaagcacagagcauggagguagacguuaaguucugcccuuagcugaagaguuaauagcaacuaacagcugcuagguaugucauuuucuugaagccuguggugccugguaagguuugaagcuagaccuguggcuagauaggccauagaccauagggaagaggcugacauuccucuaaauggacaugguaguuaacuaacuccuggugguuugguauuuuaccuauagugccucucucaaaccucaugaaauaagcuucuuuugccauagauggagauuaacccagagacccacaauguaucaagaugaaggcaacaagagacuccagaguacucggcucuaaaugauauucuuauaauauaucccacccucccaggaaaucauuuuccagacacuacagggaaguugugcauaugacugggacagcagacagaagccaugcaaaggccugagucaggcaaaaucuaagcacagagcauggagguagacguuaaguucugcccuuagcugaagaguuaauagcaacuaacagcugcuagguaugucauuuucuugaagccuguggugccugguaaggugaccacccgccugugggugccuauuuccaaguguauauggguaacagaaauuggacucaaugggauuuuugguuuugcuuuguuuuucaaaagguuggauauguagggaagggaguguaucugggaggagauggggguaggguaaauaugaacaaaaugugauguauuaaauucucacagaauuuauacaacuauucuuucaaaaaauuuaaguuaaaaaauaaucuucaagacuuuuaucaugaauggguguuggauuuugucaaaugcuuucucugcaucuaacgagaugaucaugugguuuuugucuuugaguuuguuuauauaguggauuacguugauggauuuccuuauauuaaaccaucccugcaucccuggaaugaaaccuacuuggucaggguggaugauuguuuuaauguguucuuggauucgguuagcgagaauuuuauugaggauuuuugcaucaauauucauaagggaaauugguuugaaguucucuaucuuuguugggucuuucugugguuuagguaucagaguaauugugguuucauagaaugaguuggguagaguaccuucugcuucuauuuuguggaauaguuugugcagaacuggaauuagaucuucuuugaaggucugauagaacugcacuaaacucaucugguccugggcuuuuuuugguugggagacuuuuaaugacuacuucuauuucauuaggggauauaggacuguuuagaucauuaaccugauccugauuuaacuuaaguaccugguaucugucuagaaauuuguccauuucaaccagguuuuccaguuugguugaguauagccuuuuuuuguuuguuuuuuguuuuauugaguauuuauuucauuuacauuuccaaugcuaucccaaaagucccccacaugcucccccaccuacuccccuacccacccacucccacuucuuggcccuggcguuccccuguuacugaggcauauaaaauuugcacgaccaaugggccucucuuuccacugauggccgacuaggccaucuucugauacauaugcagcuagagacacgagcuccagcagguaggugggggguauugguuaauucauauuguuguuccagcuauagaauugcagaucccuucagcuccuuggguacuuucucuagcuccuccauugggggcccugugauccauccaauagcugacuaugagcacccacuuauguguuugccaggccccgccauagucucacaagagacagccauauuuuguagaaggaucugaugguguuauggauuucuucaggaccuguuguuauaccccacuuuugauuucugauuuuguuaauuaggaugcugucccugugcccucuagugagucuggcuaaggguuuaucuaucuucuugauuuucucaaagaaccaguuccuuguuugguugauucuuugaauaguucuucuuguuuccacuugguugauuucaccccugaguuugauuauuuccugcccucuacuccucuugggugaauuaaaaggccaccaacagauugggaaaggaucuuuaacuauccuaaaucagauaggggacuaauauccaacauauauaaagaacucaagaagguagacuccagaaaaucaaauaaccccauuaaaaauggggcucagagcuaaacaaagaauucucagcugaggaauacugaaugggcugagaaacaccugaaaaaaauguucggcauccuuaaucaucagggaaaugcaaaucaaaacaacccugagauuccaucucacaccagucagaauggcuaaggucaaaaauucaggugacagcagaugcuggcgaggauauggagaaagagcaacacuccuccauuguugguggguuugcaagcuuguacaaccacucuggaaaucaguuuggcgguuucucagaaaauuggacaugguacuaccggaggaucccgcaauaccucuccugggcauauauccagaugagguuccaacuaguaagaaagaaacaugcuccaccauguucauagcagccuuauuuauaauagccagaagcuggaaagaacccagaugucccucaacagaggaauggauacagaaaaugugguacauuuacacaauggaguacuacucagcuauuaaaaagaaugaacuuaugaaauuccuaggcaaauagauggacguggagggcaucauccugagugagguaacccaaucacaaaagaacucauacaauauguacucacugauaaguggauauuagcccagaaacuuagaauacccaagauauaggauacaauuugcgaagcacaugagacucaggaggaaggaagaccaggguguggaugcuuugccccuucuuagaauugggagcggaaugcccauggagggaguugcagagacgaaguuuggaguugugacgaagggguggaccaucuauagacugccauaucuggggcuccaucccauaaucagccuccaaacgcugacaccauugcauacacuagcgggauuuugcugaaaggacccugauauagcugucucuugugaagcuaugcuggggucuggcaaacacagaaguggaugcucacagucagcuauuggauggaucacagggcccccaguggaggaguuagagagaguacccaaggagcuaaagggaucugcaacucuauagguggaacaacaauaugaacuaaccaguacccccccagaacucaggucucuagcugcguauguaucagaagauggccuagccggccaucaguggaaagagaagcccauuggucgugcagacuuuauaugccucagugcaggggaacaccagggccgggaagugggagugggugggugggggagugggggggacuuuugggguagcacuggaggugugaauaaagaaaguaccuaauaaaaaaauaagcuucauaaaaggucuucagaauauaguguuccaugcaauccugacagaucacaauuacuaguguuaggaaagguauuugauuauaaaauuaaagauguucuucccuucccauuauaaauaaaguugauuuuucuacacccacauuuuagcuuucccuuuaucaacugccaacaacuagaauauaaugcaauuaaacagucuuuuaauuaauuaguugucaucucacaucauacuggaaacuuacuauguggucuguaacaucaugggacaacucugauaaugauccguauucacaaaacaacuuuuaaggagaacauuauuuucccuugcuuuauaaacagggaagccaagguacagaaaacuugaguagaacccaaggccacaaaacuuuucaguggcagaaaaaaagaguuuaaacccagauugucagauugaagaccuuccuuagcugcaagauuacaagaguucucaucuugcacaaaaucccacaaacagcaauaaauugaauaaguaagcuguugcacugcacuuuaaacaaaauaugcauauuuugaaucuuguaugacaugaugauaucccugggaacauuuugccaucuguaacagccaauuaaguuuucuguaacuucguccacaucaacccaugguuucauaaauacguauuuucuaaauaagcaacagaaaguguuuaucacaccaacuuuuuuuacucugaaggcucuuuaucuugugaagucuaaaacauuaaucuaauggauggaacucagaaccagaaagacaaauauaguauguauuuguuuaugccuggacguuagcuguuaagucauuaauaagaaagccacaguccauauaaccacagagguuagguagagaguauuggacuaugggggagggguggauuucccuaggaaggagaaagagaauaguuauaaguggaugaagggagagacugaaauaagagaaucaaaugggaggagggagauaagaggaagggcaaggaagagaauacagaaagggacaccuagaacuaaaggucauuugaagggucauauggaaaucuaauacacuagaagcuuccuacaauauagacuuauauagagguguucuaaaugaaagugucaaguaacagaggagacagagccccaaugagacaugccugaucaccaaaugaagcuuccaacauuggaaauggguuacauccaaaugaguuguuggccagaggggucccaugggaacccccaaacaauccaaggcuaauacauugauggcucuccacaagcugauggcaaagcccuauuacugaagauaacacauacacaacucguugaacacggagaaaacaaagcuggugccuaccuaaagcccuuaccaccaaaaacugguauucauggaaauggaagguacccugccuucuaucaaaacuaaaaauguaaacaccaacccaguuacaaaccuacaagagugaccugccugaaagauauggugguucacuagugccacaaagccugugagagugaccaacuaauaucugauuugaauuaaguucaccucuauaagauggaacccauacuuaaugcugcauggguggccaagaacuugagacuaaauaggccagggaccuagggggaaaccaaauucuacugugacacuaagggauacagcaauaaaaugaucgcuaaugacauucugcuacaagcauagauccaugccuugcucauugauuaucagagaaguuuccuccuacaauagaugggaacaaauacagagauugacaaccagacaauaugcagaaagugugagauauuggaaugcucagcccugaaagggaugucuccaucaaaucccuccccucaaggcucaggguacucuguagaagaaaugguggaaagaacauaagagccaauggggauggaggacacuaagaacucaaggucuccuagauacaacagggcugacacacauaugaacucagaccguggcagcaggcacacaguugcauaugccugcaccagaugguauucuagagcugggagaaguggacauguccauuauaucaugaauagagaagcaaguggcuaucaaauagauuaauucaagagucucacuggggaaacaagcuagucuuaaggguugacccuauguccagcaauaguuggccaacacaaaugaacucaauagcaaccugggggauuuuuuugucucauaauguuaaagacuuuuuuuguuuuguuuguuguuuguuuguuuauuuauuucuaucuuacagguccuuugcauauauauuauggaguucaguuugggguuuuuauggauuuccugaguaugcaaacauguggcacuguaucuaucuaugugcaucucuuguguuuuuaaauugccuuucucuuguuugguugucuugucauuucucaacucacuuuguuuugcuuuaucuuauuuuaucucauuaucagucuuuagaugcuuguugguuuucuaucaagggagaaagggaguguggaucuggaugggagggcaaguguagaggaacugggagaaguugggagaggcaaaccuguaaucagaauacacuacacugaaaaaaauucacuuuaaauaaaauuuaaaaauggcuuuaauugaauaugaacauguacaucuuagauccuuguugcacacacacacacacaaauaagaacuaaaaaugucaaaggcaucucacucaccaauuccuaacuaguuuauugguuuggccaucaacagggaccccacauagcacuauaaaauggugcauacucaacuaaaaucuaccaauuuucauaguuuaauauuucacaucauuaguucugcuaaugguucuacacuuaauauauucaauuaugcaguuaacuucuucccuauauaucuucucuuuuuaaaaaaauaucuguuuguacugcaucccuguucauaaaucucuaauuauuuuccacuaaacaaugaacaauaugcaaauuauucaauuuaucuuaaauguucugugaucaaauuuauucuuuauauuuuuuacucagagcuggaauuaaauuuaaaguuccugcuugcugagcaaguguucuuccaugaaacuaccacuuccagaccccuauuuucaacuuuaaaaaauuguauugcuuauuccacuugauauuugcuauuaguuagugauuuagcauuucuaaguuauuuuuauuagauauuuccuuuauuuacauuucaaauguuauccccuuuccugguuuccccuccgaaaaccaucuauccccuaucccucccccuacccccuacucacuaauccuacauccuggcccuggcauucccccacacuggggcauagagccuucacaggacuaagauccucuccucccauugaugaccaacuaggccauucccugcuacauaugcagcuggagccaugagucccaccauguauuuucuuugauuggugguuuagucccagggaguucuagggguacugguuuauucauauuguuguucauccuauagggcugcaaaccccuucagcuccuugaguacuuucucuagauccuucauuggggacccugugcucuguccacuggauggcugugagcauuccuaaauuauuuuuauuacuuuuauuuuuuuacaguccagcuguugccccccuccuugugccccccucccacaguuccucacuucauucuuccucccccugucuccaagaggauauuagucccccacaagaccucccuacucccuggggccucaagucacuggaggauuaggcccuucuucucccacugaggccagacccggcaguccucugcuauauaugugcugggaaccucagacaagcgcauguaugcugccugguugguggcucagugucugagagaucucagggaucuggauuaguugagacugcugaucuuccuauggggucacccuucucaucuucuuccagccuuucccuaauacaaccacagggguccccaacuucaguagguuccuaagaaaauugaaaauagaucuaccugaagacacagcuauaccacucuuggacauacccaaaugauacuccaccauaccacaggaacauauguuccacuauguucacagugaccucauuuguaauagccagaagcuagaaacaacccagaugucacucaauggaagaaugguuacagaaaauaugggucauuuacauaauggaauacucuuaagcuauuaagaaugaggacaucauaaguuuugcaggcaaauggauggaacuagaaaauaucauccugggugagguaacucagacucaaaagaacaugcauggugugugcucacuaauaaguagauuauccaaaaaagacaagaauaccuagaauacaauccacagaacucaggaagcaaaaaauuauuugguuuuuuuaaacuucuuuuugguuuauauuucuauacaguauauuuugaucaugauccccacaaccaaaguuuucccagauccuucucaucucucuacccauccaauuuuagggccucacuaagugccaaggcugaccuugaacucaugucauaaauaacugggauuacaaaccuguaauacugaaacccuccuuugccuuuucauuuauuucauuauauucaguccagacuacagucaaguagaauuauuuagccuuacacagucaugucccacauuuuuauccaucccgucuaccuuacuucucuauucaguauauaauggggguuuaaaauauagcuucuauaagcagauaauccuggauucaaauucaaacugcacauuuccagaucugaccaaucccagccuugcuugccuuacuuacacaauaaaaaaauaacacuuagacguucuuuuuccuccuaaucaaaugaggugauagauacagagugacuggcauaugauaaguuuucaauaaauauuaauuauuauuuuagccgcuauuguaacucuauggauucagguauaguucagauuuugcccuuuagguaaacauuucccagauuucucacaaaccuaaauuauaucacucuguucuacaugucgaccauugcuuaugcaagcaugcacauuauggcauuucacauaggccuugaaguaaggaagcacagugccaaaaagccuuggcugcuuugaagucaaacaagaacacauuaagccuuagcucugcaccuucuuagcuaagcagcuuugaguaaauacuuaaucucauuaauucucaguuuccuugcuugccaaaauaggugcauugaucauuucuacuuuuguaaggcgcuaugaggcuagaauuacuuccauaacuaacacauaaaaucgucauuauugauaguuuuacuaucacaaucacaaaaggauugggauugcacacagaacacuuuggcauuuacacauauauaguguguuuaacuuccccauucaguuuuaauuuauuugaaagaaaguacagacuuauucauuuuugugucaucuacaauguguugucuauaauaaacuuacuaagugucuauuagauaaaguacuggauaaaugggcucuuguuuuaauuuuacuacauagaaaucauauuaaggauuguauugcaaauaucaugauugaaacuucagcuuuaucuuacaauaaccauuacaaguggcuauaacaaaagcauggaaaauuagugguuuagcacugcccucuaaagucagaauagaaaucugcaauguaaaacuuauuuugaaaaagaaaauauuuuuauuaauucuuugagaauuugacauaaaauuuugguccuauucauuccucuaacuccucccaccugcacagucuccucccuuucuguccaccuggaguccucuuuuuuuaaaaagggggucuacauagcagcaaacguccuaauccuuugguucuuacaauuuuccacacguuuuucuuauauguucccugaguauuaagugugguguguugucaauguacuaauuggagaugggcagcccauucuaauugaccuaugcacuucggccaguuguagcuuugaguaacaauucccaucugcugugaaugaagcuucuuugaugaggggugacagcuacagugaucugugaacauaaggauggguauuuagaauacaguuauuguuuauucugcuuuaguaauguagaagguauuucaucuaggcuccagggccuuacuacccucaagaaguugacuaaguuuacagugucaggcuuggauuuccucccauugaguggacaggacuauuagaguuguauaaaagguauuugaaaagccuuuaucaaaauaaauauaaucauauauaugcauauauguauauggaaaagaaaccucauggacacacggaaguauuucuuuguuucaaaugccuuuuaaacuuuuuacugaacaccuauaguuuuaaagguccagaaggaagaaggugaaaauuccacagaaaguagaucuuuauuuauauagucuaagcuuaagaaagauuaagauaauucugcauuacuagacaaagagaaaaggagccacaaaacauaaauuucauggagagacuauuugaauucaauuugagaaaaguaaagucauguuacugacauaggacugaaaacaggauuuccuuucaaauuauaucuguguuucauauaaauuguuugaauauaaaauauauuuacacacacacacacacacacacacacacacacauauauauauauauauauauauauauauguacauauauauacauacauauauguaauauacuggcauuaauaauuuauaacauacuucagauauguaauagccgguaaaguugggcaagaacuuucccuacuuuaaaagugaauaaaauauuaucaaagauauuacuguuuguaaguuaaucucauagauaaagcuaguuuaaaauuauaaguggauauuagcccagaaacuuaggauacacaagauauaagauacaauuugcuaaacgcaugaaacucaagaagaacgaagaccaaaguguggacacuuugccccuuccuagaaaugggaacaaaacacccauggaaggaguuacagagacaaaauuuggagcugugacaaaaggauggaccaucuagugauugccauauccagggauccaucccauaaucagcuuccaaacgcugacaucauugcauacacuagcaagauuuugcuguaaggacccagauauagcugucucuugugagacuaugccggggccuagcaaacacagaaguggaugcucacagucaguuauuggauagaucacagggcccccaauggaggagcuagagaagguagccaaggagcuaaagggaucugcaacccuauagguggaacaacaauaugaacuaaccaauacccuggagcucuugucucuagcugcauauguaucaaaagauggccuagucggccaucacugcaaagagaggcccauuggacuugcaaacuuuauaugccccaggacaggggaacgccagggccaaaaagggggaguggguggguagggguuuggggggguggguaugagggacuuuugggauagcauuggaaauguaaacaaggaaaauaccuaauaaaaaauguuuuuaaaaaaauuauuaguucaaugacuugagggccugcuacauuugaccacauuguaaaagaagguuucuaaucauuagaaauccaaaugagagcuuggcaucuauuugauuuuauuaaagaacacuuucaugucaacuccuugaguucuaugcaggugucaucaaaaauccuagaagagaaagaacauuaaaugacagcuuaccacuucucacuccuccaucaauauuucucuuuuauaaagugaaaaaaaaaaucuuaaaaguucugaggagauuuuagagagauuuguuuaacuuggcuuggcuuuuaccaaggcuuagaacauaaggcaaaauuuauaauuugaagacaaagauucuguuuuacaaaaaaaaaaaaaauuaaaucagaugauugguuaaaugacaggugcuuuucaucaacaacagaauuucauuuuuuuuugugggcuuugcucauuggugcuucaaauuccuguacaauuauuaugcaaagcaauauuaccuuaggguguaucuucucuccaaacuugcauaaucuuauuaugcaggagauuucacaugaaauuguuacuauucaucaauucaaaggagggcaggaguuauauaauagcauggcaggucaaaacacugaguauuugcucauaguuuucuuucaaaaauuauucugacugguaaccuaaaacacccuuuaacaugaccauugaaaugcaugcccaggcuagagacacacaucuacuauaaauauaccuuuuauuugucagauguaauuguagucucagaggcuuacugcugaauaagcucagccuuuacagcucuuucugaacucugaccagcugguucaauucagcuguucuggcucaaacgcuucuccaagcugacugauucacacuggcuucucucagcuucugacuaaauugcucugcuuugccuaaacuaagucuugcaaucuauucuaaucuucuggcuccuucucauccuauaacucuucugucuucaccugcagccuaucucuauuaaaaaaaaaaaaaaaaaaagucccaguaaaauugccuuuucugaccuguaaggaacugcguggagugaacucauugaacugacucaacugaaucaaacugcuccaugaacugcucuuaaauagccucuucucugucuuguucuugugagaguugaguguauccuaucucugacucacuguaucaaaucuuucucugauucaucacuuugucugccccucaauuaaaggucacuuucuaacauggcugcuuccuucuauaagcuaaccuuacuuucauuguuugggauuaaaggugugcacuaagggcaugucuacauuccagcaagauccuacuguaauacagagcacugcugcaaucuggccaaaucauacagaccuagaaggucuuuggaugugauccuuugccagggcaaccauacugcuggauuaaaauuccucaaccuacacuacacuuuaacauauccaaucguguacaugcccagguuagugacauccacaaaagcuauaauaauaauaauaauaauaauaaugucuucugaaaagcauaauugugccccaaaucaucugaggugagccaugaauccuuaaccacaauuaaaucugcaagaaacaaaaacagaagaagaaaaucaaauccauauacuaaguucacugggacuacauccuagcaaccaugagccaaaugauauugcuguguuuuguggauuacucaaacaugaagcuuucaagugccaacuguauuucacacuuauuagcacuuacuucaucugcaguaaguauaaaagaauaaauuagggaaagcaauucucuuuauuuaaaaugaucaguuccaacauacuuaauccuuaccugcuguuuacauaguugagcuucuuuacaaagccacuuggaaaauuaaaaaaaaaaaaaacacuugcuuuucuauucaauuugaauacaaugaauuuguaugcugauaauaucucuuaaaacauuauucaugugucugacuuuggcuugauauguaauaugcuuauuucaaagggggagggaucagauuuacaugcaacaugcaaaaguuaauaucaaaacugcuaagguuauuuuaggaacuuaagugaagguaaguuugguuaguaagacaguacagaaggaaaaauaugcuauuuuuggaaguaaaacuauccuccaugacagaccauuucauuugaguaaauauaaucucauuaaagauuucuuuauuccuaaaauuaacuguauuauggcauuauuuauaucuauaaacaucuuguugguuuuaaacauacucuuauacacucuccauaauccagcuauagaaugccuccacugucucugacuguauuccucuacauaaagccccaagaaucuuuccucugcuauucuaguagguuuguccuuuuuuaaaccuuacaaaaauaaaaucauaagauauacauucugcgugaacuuuuuuccuucagcacauuuuuagauuaaccccuacauuuuauauauaaguaggaaauuaguuacuauuacuaaccaccaccaccaucaucaucauuaucaccauuuuguggugccaagaauugaacccaaggaccuuaugcaggcuggacaauugcuaccuacaucucuaagccaccccuuauugcuuuguaauacaaaauaguacuuuggcaaaugaaugacaaauuuuauuuacauagucaacuauuagguauuuguguugcuuucagcuuggggccaucaugagacaauuugucaggaacaagcauauaguauauguguuugcuuguuucucaaguaaaaugucuaagaugcaaggccauaugguaaauauauauuaaacuuuccaggcaacuacuaaaauaguuuucaaaauguaugcuuguacauuccuaccagcuguguaggagacucuaguagcucuacauccuuggcaauggugaauuuuauccuuuuagccaucuucaagugcaaguauugcauggugcuuuuaauuugagauucuaguguugguggauguuuacugucuccuacuacgcuuggagagcauucacuugccugaaucaguggaaacugcuaagucacacacauguaucuaucgaucuguuugacuuuucacuguaaguuauaugaaugaauaucuauuacccuuguggucuuugaggaacaauaaaacacucuuuggucuguucaucccugcagauauccuacuauaccuuccucugauggauuaagaauuuuacucuuguacugugcucucugacccucaccgagcuugaugcuguguuguguaucuuaaagccugggauucauuuuacuuuucuuaucugaguugaaacugucccagccccauuaguucaggauugcuugguucccagugaagagcccugaaauuuuuaaauuucuauuuuuuuauuuguauuuauguaugauguguuuugugcuuguuuaauaugugugguugugguguguccacugacacauacaugcucuugcgucuguccuugccuuuuccuuguucuuugcugcucaccauugccuccuagcuuccagggagucuuuugucucugccucccaucucgccacaggagcacugagauuacacaugggugacacuuugcucagcuucagcagguucucaggacucaaauucugguccucaggcuugcagagugaaugcuuuaaccccugagaaucuucugacucccuguaaggcuuguuugcauguuuguuuuuaaaccgacuaaccagcacuugucuuaugagaaagaggacuggagugaggaucccgaguuaugguggugaacuaagcuaguccuucggaaauauacuuacuugugaugcauaaugauuuguuauugaugccuggcuguuuuuuuacuaucuaaacaucuuuguuaauguguuuaugaaugcuaccgauccagaguucuuauaggguagggggacuuuauguaauggcacagcaauaaaagcaucauaaauuacauuggaaaaagcccucaauuuuuauuuucuaaaagauuuuuuuaaccacugaaauaacuaagccugaaauuuuauccauuuuuaaacuuggauaaaagauaagacuguguacuauaauuggaaagaaaauagauucuaguuauaaaucaauauuuuaaaguuaauauacauacauauguuuccagauucuaucuuuauuaaguuguuuucauaaucuguaaaagaaaggggaaugggggaaugauguaacugcauuuuaauuuaaacaauaaaucauuaaucaaaaauauuaguuuauccuuuacucuagaaguagcuuagacucaucacuaagauuuaaguuuccugaauagaucagcaauaucucaccaaugggcuagugguaaucauaauucaugauacuucugaacucuuggaaauuuuauaauaacauucuccuaguauugcuuuuuccaaugaauuuuuuuuccugucuucaugaacauacauuguucuaugucuguggagguuaauauucuguuacaauuaaaagacaauuuuaggcaaaauaucucucucucugucucucucucucugugugucucucugucucugucucucugucucucugucucucucucucucucucucucucucucucucucucucucucgcuuccucuuucccuuccucucccccucccucccucucucccuccuguauguucuucugucuggaaacuguagcugccccaaaccuuacucuuuguauguacaacuuaguggaauuauauaacuccaucucuguuuuccucccuguaacauucuuauaggauauuauaucuaugcagaaaacaggagugucuggugagucugucaacuuuccuuugauaaugaagguuuucuucuuuucaguguucugguaguuuacaugaggaguuuuucuaugccauuaucaauguauguaggucugacaugaaucauuuuuagauaagacacauauuauuuauaacuauaucucuaguguacagcucucuucauugccuacuuccugcuggcugggucauaccauuuuucuauuuugaacaaaugcuuuaauuauguuaauauucauuuucuucuuauugaaaguccacauuuaucacuuggaguuagucauuuccugucuuacucaugcucuugccaauuucucaauuucuaaaaaauuagucaccucucacauaguauuuuuuuucagugauuuuuauaccaaugaaggcacaugcuaaaaaauccuaagcuugggagccagcaggucucugacuccuuugcgugcucuugggacucucuuccuccuguuggguuguuguguucagcuaauaugaggguuuuuaccuugucuaauuguaucauguauugucuuguuuggcuguugucucuuggagagcuccucuuuucugaaggaaaauggaagaggaguggaguugggagagauggaaggugggggaaacugagaggaauggagggaggggaaacuguggucaggauguauuaugugagagaagaauuuauuugcaacaaaaacaggaagaaaaaaaaagaaacaguaaaugaaaacuuccuccuguacaaauaucaguagcaaaaaaaaaaaaaaaagugucaaauuaacccgaacuugcuaugaacauaauuucacuaccacuuagaaggaauauauuuaaaauuauauuauuuauaccuacuaccucaaaaaaaucacuucaauuucuuaaauagucauugaucaaaaacagaugagaacaaauagcuaugcuacaaaagcauacuuguaucucauucuguaggaaggaaucuaaacacacauugcucaacuuauuuguuugguguugacucuugaucuacacaauguaaacccacagauaauaggagacucaagugugguauugcuugugaaugacugccugcuaccaagagaggaguagauaaaaagaaaggcacccugaguuucagaaacaugaccaggacaggagugacaauaaagaaucucugaaaaaaaucugcugcuuaaagacaauauguaagacaaauuuuaggacaugcacccacuuucuucccagauuucuagcucucugaauaaagcaguuuaaagauucaguuccugguuuugccugugugucugucccgugucaugaacucaaguacaaaacuacugcuuacaaauugagaaaaguaaagaaacaaaacuaucucaggacaccugaacuugguauauaaaaggacauagcuagacaguaaaaccagacacaauuuguaaguaguuagagaugcaauaggugcuagaagaaugaacagauauuuccaaugagggagaaagaaggaaagaagacaacgcucuugcauuugagcaccaauccuucagaguaugagaauucuaugcagagaagaaaaaaugugaauggagcugaacaggcacaaaagcacagcaguaugaagauaauggcugucugacaaacucuuccauaaaggaaagcaggauggagaaagccagagagacucuaucagggcucugcuauaagaagaagaugauuuagaagauguucaacacaagucaagacacaauuucuaccucuaguuguacucugauaagaaaccagaaagcacaagaguugaguacaaagcauucaugagaaaucucccugaauucccuauguaagggugguccagacaacaggucuacccuuuugaacuaugcuacaugguacaugaaguauaucucaucuauaugaguauaggaauaauacuaucuauuaaugguauagucuaggaaauuaguauauacauauucuuuaugagacaacucuuauuucuccuucuuuuaugcuuccauuuagacaacuguaauauaaaaaugcucuuggcugguauauguauaaauacguaugugugcaugugcuuguguguauuauacugaaaaacagcaauacuuaaaauguuuaacaagaugcauuaagaucuucaauaaucucauaguaaaauuacaaaauaccaaucuauuauauaacaauauaugcuuugucaugcccaucuuuauaugauauuuuuauucaucuuggaggaaauagcuauucaauuauauaaaguaaaauuuagaacaacccaaguacaccauugaaauauauauguguuaacuaaacuacaagaaguuaaccaaagcugaggaaacauuuuauacuaaaaagcacaugagcacaaguuugacauuaaaucuguuaggucagcaggaaaguggcaacuccagccuauaauaacacuaaaaagauauaauaagaaaauaaauugaagauuuugagcagucuguuuuaauauuaauguagccaagggaagguugggggcacagagcugcuacagagcugagaaacagaugguuuacacugaagauuugauacuuuugggugacuuccacaguucgcguuauuggcuagagcaaauggcacguuaaggauggccgccgauuucuuucuaaagugaaaaaacauauuuuacugcaagcauuaacacaauaagccucaaagcacacagaaaugaauaucauuucccucaguccauaugcaaaaacaagcuaugcuaauccagaacgcagugcucauggaacaaugaaauacaugaacaaaacuagaaccuggaugacaauuugauuuaaucauuauucaggaaauuaauaugagcagagguagacaauauuugaaaauauuucaauauacuaugacucauucauggaaagaaaauuggaagacucuuuuagaacacauuugguguuaguuaagaaaucauaccucugcagaaaguauuuugcuaaucuuguuuauuucauaaaguaaccugcugacuuuguuuuccaguggaaaaaaaucugaguuguuguaaaguauauaugaagcuacuaaugugaaacacauuaauuugacuguuaauaugcaaacacuaauacaaaaauaagauaaaaguuauguguuccuauaagaaacuaccuauucaaaggucuuaguuuauaauauugauguucuauuuacuacauuauagguaauucaccaaccugaaaguuucuucaacuauguuauucaucacuaugaacauuguggugugaacacuggccaagagaaaacggguaaagguuuaugauguaaaacuucugggucagucauuauaucaagguccaucauugagcaaguugauuuuaaguaaauaaauaguaaccugcucuuagaguuaacaacuugggaaguaggagggagcugucuuguguuuauauuacuauuaucuaaagcauuguguggcauguacaacauuuaaguacucaaguucuggauauaacauguuuucuauguucaaaagcauucaaugaaugcauuuugauugagguauuuugcuaauguacaguauccaaaggaaacaaaugaucacauuucuauacccuccaaaucacaucuuuaauuagcaagcagauuaaugaugcuaguuaguuucaaguuuucuugacuuucuugcaacaacaauagcaaugaauaaguggaaaagagccuuggagauauaucagaguacauuauaaaacauggcacuucagcuuguguggcauuuuuaccauacaccagaauguaaugaaauauuccugaugcaacccaaacauccuaauugcaauaccuaagccauauccugucuccccaagacaucaacacauacuugggaaguuacuucucugagguacaucuaugaaaagugccuggcacucagagaaguuucugauuuaacauauuuuauuguugacucauuucccacucucaaccuagacuuuucuaauagucaaucauucaucucacagaaaaggaaguuuucugcuccuuagcuauauagucccauuaucugacaauaguucugaaguguauauaacucuggccaaauaaaaguauuucaaauggaucuggccuuauacuauuaaaucuaucacaacaucuggaauaucauuuuguuuaaaaucaaagccucuuucuuuuuaaaaagauuuauuuauuuauuuuauguauauguauacacugaagcugucuucagacacagcagauaagguaauuagaucccauuacaggugguugugagcauucaauucccaggaaagccucuuucuuaaucauccugcaucuaacaacugguagguuacaucuaagcaccuccucaaacaggucaaaucugagggccgcugagccuccagacucccaacaaggcuggucaggcagauggaccaugugguagcuucuccaaucaagucugaaucuaccacuguugggauucagcaaagcugucuccaaucaccauccuuccuaggguaauuuaccuagccccaggugucuuuauagcuuauuuuaugucuuuauaguugcucuucaugcaugguuuauuaaucaaugaugcuaauuuuuuucugaaacauuaagcaaaaaaucauaagcaaggaguguuaagaaauggcuagagucaaaacaaagacacaaggaaacugguugaaauaagauaauaaauauacauuaguacuuuuuuuuuuuuuggaagacucuuagagccaaaguggugcuacauaaaaugaagcuugcacuugggugagcaaugagggaagcugaguaaucccauuccaugccaagaauaauaugugaaaaucccccacccgcucucucucauuguaugucugucugucugucugucugucucaucugauguauaaaaggaaagaaaauaauguggucucagagcuggagagcugucucagagauaggaugcucugaguucagccaggcauuuguauucauuacaauaauaaucaaaaccucaauggguucucuaaguuauaagugagaacuuaaauuggggucuaaaacuauaugagugaugauauucaaaugauaaauucuucuaaauuaaaauuuaaaauaaucaaugcuaguuggaucugaugagaagaaugguaaaaaaaaucuauuagaaacacacuaaaacaauggugagugaaaacacuuuaaauuuuaugaaaaggcuugugaugcgugucuggugguaagguacuucuccagcaugugcaaagccuaccuucaguaucuagugcaggacgaaugggcccuggguacacagcacaaaaagagguggaggcaggaguccucuucggccaccuagugaguacaagccuagaauacaugggacccuguuccaaagaaugaggaaagucgugaacaugaagauaaguacuacagaaagaaagacacuuauaaaaaaggcaucaguggaagagagcaagaaagaggcagggugucacugggccaugaauaugggcaaagcauaaugauacaaaugugugaacuaucagucaaugugauaaagagaauaaaaaagaaaaacaauauacuaacuuguaaggaaaauaacagaagaaauauuaauaguucaauuauacuaaauauuaccucaauauuaccaaaauccuaguuaauagucuuuacuacauaaaaacaguacaugagaaaaagccucaaagggggaaaaauuucuggagaaagagagauuagccaauaaauuauuguuagacauaagcuuaaggggcuggggagaauuaacaucuuuaaaauucuccuuacauacuauagcacacuugugauuagucuuuguaauggaaaaaauaagcaauuucauuuaaagaaguuucuaaugaaaauaacaguaaauguaauacaaaaaaaaaagguuauuuagagacuuuaccacauaagccuuuaaaaucaaaaguggaaugaguuugggguaaugauaccuauaaacauauuuuaagggauucuuuaauaaugcauuucugaaauauucagaagggcuuaaaaagugaaucauagcuuucuuucuaaguacacuuugcuccaaacccauuuugcccuuuuuccucuucccuggcucagucuaugccuagcccuuccacagaccacuguagccggguaccaucaaaaaacugacaggaacaccaguuacucucaaaacuuuuguucucauuauuaaggcuguucuugcaaguaacaaauaguauacccuaaauaauacauaaacugguaaggacuuauggcagaggccgaggagaagaggaauauaauugcuaaauuuaaaacuauacaaacuuggaaauauuuucugaauguuuuuccauacaguguuaaauuagaaccucuccuggaacugcuagaacuuucaaccaaaaucaaauccgcugcuggaaggcuguuggauagcagcugacucccaccagugaucagagugacccccgcuagaacuccagccgauuguauuauuuugaauaaaauuuccacuuuuaaaaaauagauacagcccaugaaaguucauuucaacauauuccacucuaucuuggcaaaaauggccagacuugaaaaacaaggaagcagcugcuauacuguauuaagcuuucugugaugcuccuuaccagaagcacaaagaaagagaggaggaccuugccaggacaggggugguggagugaggaauugggggggggggggcugggaggaggagguguuaagacuaggacuguggaagaggaaagucugugcuccacucuccacucuuccuaaauggcugugguuccuuugaccuucacaacuccagucuaauugcgaaggguaaggaagaaccuaacaucugagaucucagucuugaagcaagaagcuaauauucuucccugguagucaugggugucuuagucaguguucuguuguugugaagaccaugaccaaggcaacucuuaugaaagaaaggaucuaauuagggcugguuuuagaggcuuaguccauuuucauccauagcacacauagcacaggaugugagcucucuugauccacaagcaaagacagacagagacacaaugggcauggcuugggcuuuuaaaaacucagagcucacccccauugacauacuccuucaacaagacucuacuuacuccaacaucaacacaccucuuagucccacuaauccuuuugaauagugccucucccugaugacuaaacauucaauuacaugaaggccauucuuauucaaaccacacaacugcucaggagccccuucucagcucccucucuguagaacuaaauagaauaaacaccacagguuccuggauacccuuagcaaugacaaaagccucucaccuggucacagacaaaaagacaugcacugucagaggaauacaacacauucuugauugcaaaacaccauaaagaacucucauuuccuaagccuaaauucuauaaaaaguacucugaugcuaaacccugaccuuuuauuuaccuuucuguuuuaaauuaugccuucccaagagauucuuaaaaccuaagcaucaggauugaaggagcucauaccaaaaauaaugaacaggcaggaaauggccaacaagucacguuaggugcugugaaagcugaaauggaggugacuuggcugacaaucauagcagagguaaaaauaauggagcacauaggagaaaaaugagaaaaaaauauacugugacauaaaauuagaauauguaaauacacucucuagaacuaaaauaaacuuuuaaaauuuacuuaaaauucagcuaagaaaaagucaacagggaacaagcaauuuaguguuuuaggauauagcauaaucaacuuuaaaugagagagagagacagagacagaaaagcaaguuuaaaugagagagagagggggagaaagagacacacagagagaagcaaguuaaaaugagaggagagagagagugaaagagagagaggagauggagagagagagggagggggagaaagagacauacagaagcgaguuaaaaugagaggaaagugagagagagagagagagagagagagagagagagagagagagaacaggaacuagcaaccuaaguaggucuccaguauagaggugguauuuuuaaucucauuaaggcugcaaucaaacaaaugaagauguaauagccaaagaaaaaauaaagggauaauuucuuacucuuaauuuaugcucaaauuaaaagggcuugcuugcuuacucuuaaaaaugagugagucuaaccaauauauagagaaagaaaacuuaauaagcuucuucucugaggugaaagcaagcaucuuacuaguaucuagauguggacugggcagaggcaaagauucaugaggauccaaguuaacaacaagugucucaauuuuaacaucagaagcuaaaagagaguggcccaacuaucgcaaaugauaaaagagaagaacugggaacaaaaaaaaaucccauuaucuaugaagauauuccuuaaauguuagagaaaagaauacuuauaaaagugagacaaucauuuauuuauuuuuaaggcaaaauaagcacuuuauuguuuuaaugggggauuuguuuuuuagagaucagccuuugugugauaguucaaauauuuauaaacuuuuuagauauucuuucuaagaauauuaauuauuccaagcacuuuugacuaaaaauuuucacagaaaguaaaauaaaaggaguuaaagccuuccggucggcaccagcaccaggucaccuugggcucagagucagcggacacccccaaggucccaagaggacucuccacaugaucuuaggaccacccaugaguggaacacaacuucuauuccauuccaauugugcaggaccagcacuagggaagcagaaaacccagccugaccaggaccacaagucccuuccugucgacaccagcaccgggucaccugggcgaggagucggagaacaccccaaagguccauagaggacagcuucugaggcagaccccauuucagacuccagacauccgggcaccuucccugccagaggacagguguccuccccacccaggagggcuuugucagaacaccuggggaagucaucuggguucccugauccuuccuagacuagucugcucaggugagaguguggacuacagaaacuaacagcuucugagacagacccuguuucaggccuucaucuucugccaggaggcagguacgaacuccagauaucugugcaccuucccugcauaaggagagcuugccugcagagagugcucagaccacugaaacucaggagagagcuacucuccaaggucugcugauagaggcuaacagaaucacgaggggaacaagcucuaaccagagacaacuauaacaacuaacuccagagauuaccagauggcaaaaggcaaacauaagaaucuuacuaacagaaaucaagaccacucaccaucaucagaacaaagcacucccaccucagcaguccugggcaccccaacacacccgaaaaccuagacccggauuuaaaagcauaucucaugaugugguagaggacaucaagaaggacuuuaauaggcucugggcgucgggcacugggcgggcaggucgccucuccgagaguuggagcucgcccacgcuggggcgggaggcccgggcagccucggcugcgagggaagcgaggagcuagggggcugggcucuguguuccugugccgcgaucuccaagacucuggcuggaggggugccugccuguagcgccccguccgugacuagcugggaccagccgugagucccguguacccgagcgaugugcgguauugccuguugugcacgcaggccgggcagcccacuucgggaaggcaccccagcacgucuguccgguaucccugccagugccuagugugggaaacccugaagggggccuuggggacacacgagucccgugugcggccugcagaauuuugguuucuggaggaacguaacacaaccaggucucccaguggacuuucuacagcuaugaaaccuacacuguggggcaccaugaugcuuccguuggccauaugaugaggaggagaaguuggcuuuggagugcugggagccuaugaaguugcugagcacccagcgcccccagcccgcccacuggccagcccuuaacacaaugaacaaacugaccuuccauaacaacaaagucaugcaggaccgucgcagaguguguauuuuccuccccaaugacaaguccgugagcauuaucauaaauguuaaaauucugugucaccaguugcugguccaggugugugaccugcucagguuaaaggacagucaccucuuuggucucaguguuauacaaaauaaugaacauguauauauggaauugucacaaaagcuuuauaaguauuguccaaaagaauggaaaagggaggccagcaagggcaucgaccaguuugggccccccaugaucauccacuuccgggugcaguacuacguggagaaugggaagcugaucagugaccgaauugcaagauacuauuauuauuggcaccuacggaaacaggugcugcacucccagugugugcucagagaggaggccuucuuccugcuggcagccuuugcacugcaagcugaccucggcaacuucaaaaggaaacugcaccacggagacuacuuugagccagaggcuuacuucccggcauggguuguuuccaagagggggaaggacuacauccugaaacacaucccaaacaugcacaaggaccaguuugcccugacggccuccgaggccuaccugaaguacaucaaagaagcaguccgacuggacgacgucgccauccauuacuacagaccguacaaggauaaaagggaggcugaaggcucacugacccuaggacugaccaugcgagaaauacagauuuuccagaaucuagaagaagagaaacaauugcucuaugauuuccccuggacaaauguugggaaguugguguuugugggcaagaaguuugagauuuugccagauggccuucccuccgccaggaagcuggucuacuacacagggugucccacgcgcucccggcaucuccugcagcuccugagcaacagccaccgccucuacaugaaccugcagcccguccugcgccaccuccgcaagcaggagaagaaugaagagaaaaagcaguacugggaauccuacaucagcgacaaccuggaccuugacauggacccgcuggaaaagcggucccgagccagugggagcagcgcuggcggcgugaagcauaagcgccugucccgccacuccauggccagccacagcagcucccacaccuccggcaucgaggcagacaccaagccccgggacccagggccggaagacagcuguucaggcagcgccaugcaccggaagcugaagaccugcagcuccaugaccagccacggcagcucccacaccucugggguugagaguggaggcaaagaccgccuggaagaggacucgcaagaugaggaaauagagaugcugguggaugaccccagggaccuggagccgaugccugaagagucccuagaagucagcccagagauguuuaucuacaucacggaagauaugcuccugucgaggaagcugaacggacacucaggguuaauugugaaagaaaucggcuccuccaccuccagcucuuuggaaacgguugucaggacagagcaccgacucccuuccacagacgauaugucgaaaaccaaagacuuccaccgaucgccauagccugagccuugacgacaucagacuguaccagaaagacuuccugcgcaucgcgggccugugucaggacacugcucagagcuacacguucggguguggccaugaacuggaugagagcagucucuacugcaacagcugccuggcucagcagugcgucaacauacaggacucaaucccagugaaaagagccaguaaguacuuuucucuggaccuuacuaacgacgaaaucccagaguucgucgucugagucgccccugcgggcagccgcugucugcuggaggcuguggagucugagggucuuuacacauuauuugugccauaacguuuucaccccaaacuuagcuuuuucuuuauaguauucgagauggaaacaaaagccuugggacaguugcacuuuaaguauuaugcagagguaaaagaaacacagaauguaagaggaagacaaguacccagaugucuagugccccuuuggaaggaagugugcuuuccagcuuuacccagauuucagacugucagacugcaguguguuuguucaucucuuguguuccgguucaaauuuauguuuaucacgugaaagauguuauaggcuuaucuguuugcuuaugaguuuuuuagccacuuccucauuaggcacgguuugagggggaggacaaaggggaguucucucuucuuuuauggagagccauucuuaguacauagccauuguugccugacagagguagguccgaaaugaacacugaaguuggugggagucuuauguucuagccaaagauguguaugugauggaagauggaagccccacucagaguccagaaggcgugugccgggacacugggcuccuucacaaauggacagugcucuguccgcuguuuuguucuuccaugaccuucccaggaagcucugggauuggccugugcuugugacaugguacauuuugcaguuuacaaagcugguguauguuaacaaccauagggaaugucucagaagacauuuguuugguuguauuuccuuuguuggauuuuaaugguggccaacagauggugaugcuaguuucugcuuuaacaagauacccuaacuguauguauguguuauacguaucuagauacgugggacucuguguguuuauguguuugaaguuuagugacucuucauuuggacuucaguauaugucuugcacacauagaauuucuuguuuaauguugaggaugcuuagacacagacaaucaguugauaaauguagaguuaagagugacuuuuccaugugugccuuuggccaagauucucaaccuugauugcauaauagacuuguccagagagcuuuuaaaacaugcccgggucccaccaggccaguuuaaaccagucuucuguggcugggagauugauuuaaaguguaccagguugagacaguaaugcacaguaggauuggagauccaagaguuuuuuuucuauucauuuugaaguaaaaguauacagaagauauuagugauguagaaugggccauuuuuaagacagggccugcuacuguuacaguguauaaugaaaccaagccaggagaaugaguuuggucaacuugauauacauugaagacugcucgcccuucaggagagaacuucauagcacaaugucuuucuaggagauguuuuuaaugauuuaguauuuuacaacauuuguuuaccauauuuugauacuccauuuuugcuaucugccagguuuuauuaaaaagaagacuauguauuauuuucuaaagaaacucauauuuuuguacaaacuuauguuuccaaguaaggaagaaauagauuuagggucaggcagaacauagcaguguuucccccuggcuaggucagugucccagagcccgugguggccacaggcaugcccggucaccaugcugcccucaugugccagcacagccucagcaaggucacauccaguaacucucaccugauacuuuaaugaaggaaaaggaaguucugugcucauaacuuuauuuugcuuuugucgaaugcuuuuagaagaaccaaaguuucagaugccagaauguauaagugucucaguguccacagauaggcgaagggugaagggguucgucaccugauggcuucuuuugcuuccgagucauugcauagucucaucauugcucacagaugcuuaggggccacaccuuggugaaguacgcgcucuccagagcccagauggccguguguccccacagcccuuggcgucucuugcagaugcagagauggaaagguugcuuacuuggcugugugcuuuauaccuuuuuucucuaugcuccagaauccaaucuucaggguucugcccaggcuaucgaucgccauuugcccucuuccaugcagacuuggaaauagucuuaaacgguuuccaaagacaagaucagccaggaaacaguuucucauuucugacccacgggagaaucauagacauauauguauguggagcuccacuuugaagaauugacauucuuguauugggcaauuguuuuccaaaguaaaaggaaaaaaguauaaagccguuacucaugcugcacuugcuagcauguccauggcuggcagacgcaccagugcaucugucaccucccugugucaccugcaucuguauuugcaacggugagcuuuguaucuaaguaagcuguaaacaguccuuucugugaaaggaucaucguaucgggaugauacugaaaguauguuuuuaaaaaaaaaaaaaaaaagcuacggcguuauuuuguaauuauuucuuagagguguuucaugguaugcgcgaccaucaauaaaguuaacuuuuuugccuuuaaaaaaaaaagaagaaggacuuuaauaacucacucaaagaaauacaggagaacacugauaaacaggugaagaccuuaaagaggaagcacaaaaaucccuuaaagaauugcaagaaaacacgaccaaacaggugauggaauugaauaaaaccaucuaagaccuaaaaagggaaguaaacacaauaaagaaaacccaaagugaggcaacacuggagauagaaacccuaggaaaaaaaucuggaaccauagaugugaacaucagcaacagaauacaagagauggaagagagaaucucaggugcagaagauuccauagagaacaucggcacaacaaucaaggaaaauacaaaaugcaaaaagauccuaacucaaaacaucuaggaaauccaggacaauaugagaagaccaaaccuacagauaauaggaaaagaugagaaugaagauuuucaaaugaagauuggcccuuaaagggccagcaaaugucuucaacaaaauuauagaagaaaacuuaccaaaccuaaagaaagagaugcccaugaacauacaaggagccuacaaaacuucaaauagacuggaccagaaaagaaauuccuccugauaaauaauaaucagaacaauaaaugcacuaaauaaagauagaauauuaaaagcaguaagggaaaaaggucaagugacauauaaggcaggccuaucagaauuacaccagacuuuucaccagagacuaugaaagccagaguuccuagacauauguuauacagacacuaagaggacacaaaugccagcccaggcuacuauacccagccaaacuuucaauuaccaaagauggagaaaccaaaguauuccacgaaaaaaacaaauucaaccauuaucuuuccacgaauccagcccuucaaaggauaauaacagaaaaaaaaaaaaaaagaaaacaauacaaggacagaaaccacacccuagaaaaagcaagaaaguaauccuucaacaaaccuaaaagaagacagccacaagaacagaaugccaaaucuaacaacaaauauaauaggaaacaauaauuaauuuuccuugauaucucuuaaaaucaauggacucaauuccccaauaaaaagacauagacuaacagacuggcuacacaaacaggacccaacauuuugcagcuuacagaaaacccaucucagggaaaaagacagacacuaccucagaaugaaaggcuggaaaacaauuuuccaagcaaauggucagaagaaacaagcuggaguagccauucuaauaucgaauaaaauugacuuccaacccaaaguuaucaaaaaagacaaggagggacacuucauacucaucaaagguaaaauccuccaagaggaaaccucaauucugaauaucuaugcuccaaaugcaagggcagccacauuaauuaaagaaacuuuaguaaagcucaaagcacacauugcaccucauacaauaauagugggagacuucaacacaccacuuucaccaauggacagauaauggaaacagaaacuaaacagggacacagugaaacuaacagaaguuaugaaacaaauggaucaaacagauaucuacagaaugguuuauccuaaaagaaaaggauauaacuuguucucagcaccucaugguaccuucuccaaaauugaccauauaauaggucacaaaacaggccucaacagauacaaaaauauugaaauugucccaugcauccuaucacaucaccacaaacuaaggcugaucuucaauaacagcauaaauaauagaaagccaacauucacguggaaacugaacaacacucuucucaaugauaccuuggucaaggaaggaauaaagaaagaaauuaaaagacuuuuuagaguuuaaugaaaaugaggccacaacauacccaaacuuaugggacacaaugaaagcauuccuaagaggaaaacucauagcucugacugcaucaaaaaagaaacuagggagagcacacacuagcagcuugacaacacaccuaaaagcucuagaacaaaugaaagcaaaaucacccaagaggaauagacgacaggaaauaaucaaacucaggggcaaaaucaacuaagugguaacaagaagaacuauucgaagaaucaacaaaacgaggagcuaguucuuugagaaaaucaacaagauggauaaacccuuagccagacucacuagagggcacagggacagcauccuaauuaacaaaaucagaaaugaaaagggagacaaaacaacagaugcugaagaaauccaaaacaccaucagauccuucuauaaaaggcuauacucaacaaaacuagaaaaccuggaugaaauggacaaauuucuagacagauaccagguaccaaaguuaaauaaggaucagguuaaugaucuaaacaguccuauauccccuaaagaaauagaagcagucauuaauagucucccaaccaaaaaaagcccaggaccagauggguuuagugcagaguucuaucagaccuucaaagaagaucuaauuccaguucugcacaaacuauuucacaaaauagaagcagaagguacucuacccaacucauucuauguaaccacaauuacucugauaccuaaaccacagaaagacccaacaaagauagagaacuucagacaaauaucccuuaugaauauugaugcaaaaguccucaauaaaauucucgcuaaccgaauccaagaacacaucaaaacaaucauccacccagaccaaguagguuucaucccagggaugcagggaugguuuaauauacggaaauccaucaacguaauccauuauauaaacaaacucaaagacaaaaaccacaugaucaucuuauuagauguggagaaagcauuugacaaaauccaacacccuuucaugauaaaagucuuggaaagaucaggaauucaaggcccauaccuaaacaugauaaaagcaaucuacagcaaaccaguagccaacaucaaaguaaauggugacaagcuggaagcaauccuacuaaaaucauggacuagacaaggcugcccacuuucucccuaccuauucaacauuguacuugaaguccuagccaaagcaauucaacaacaaaaggagaucaaggggauacaaauuggaaaagagaagucaaaauaucacuuuuugcagaugauaugauaguauauauaagugacccuaaaaaugccaccagagaacucauaaaccugauaaacagcuucagugaaguagauggauaugaaauuaacucaaacaagucaauggccuuucucuacacaaaggauaaacaggcugagagggaaauuagagaaccaacacccuucucaauagucacaaauaauauaaaauaucuuggcgugacucuaacuaaggaagugaaagaucuguaugauaagaauuucaagucucugaagagagaaauuaaagaagaucucagaagauggaaagaucucccauucucauguauuggcaggaucaauauaguaaaaauggcugucuugccaaaagcaaucuacagauucaauucaaucuccaucaaaauuccaacugaauucuucaacgacuuagaacgggaaaucugcaaauucaucuggaauaacaaaaaacuuaggauagcaaaaacucuucucaaggauaaaagaaccucuuguggaaucaccaugccugaccuaaagcuguacuacagagaaauugugauaaaaacugcaugguacugguauacugacagacaaguagaccaauggaauugaauugaagauccagaaaugaauccacacacaccuauggucacuugaucuuugacaagggagcuaaaaccauucaguggaaaaaagacagcauuuucaacaaauggugcuggcacaacuggcgguuaacauguggaagaaugcaaauugauccauuccuaucuccuuguacuaaggucaaaucuaagcggaucaaggaacuccacauaaaaccagagacacugaaacuuauagaggagaaaguggggaaaggccuugaagauaugggcacagggaaaaaaguccugaauagaacaacaauggcuugugcuauaagauugagaaucaacaaaugggaccucauaaaauugcaaagcuucuguaaggcaaaagacaccaucaauaagacaaaaacgccaccagcagauugggaaagucucuuuaccuauccuaaaucagauaggggacuaauauccaauauauauaaagaacucuagaagguagacuccagaaaauuaaauaaccccauuaaaaaauggggcucagagcaaaacaaagaauucucaccugaggaauaccaaauggcugagaagcacccgaaaaaaaauguucagcauccuuaaucaucagggaaaagcaaaucaaaacaacccugagauuccaccucucaccagucagaauggcuaagaucaaaaauucaagugacagcagaugcuggugaggauguggagaaagaggaacacuccuccauuguuagugggauugcaagcuuguacaaccacucuagaaaucagucuggcgguugcucagaaaacuggacacaguacuacaggaggaucccacaauaccucuccugggcauauauccagaagauguuccaaucgguaagaaggacacaugcucuacuauguucauagcagccuuauuuauaauagccagaagcuggaaagaacccagaugccccucaacagaggaauggauacagaaaaugugguacauuuacacaauggaguacuaaucagcuauuaaaaagaaugaauuuaugaaauuccuaggcaaauagauggacguggaggacauuaucaugagugagguaacccaaucacaaaagaacucauacaauauguacucacugauaaguggauauuagcccagaaacuuagaauacccaagauauaagauacaaauugcaaagcacauuaaacucacgaagaacaaagaccaaaguguggacacuuugccccuucuuagaauugggaacaaaacacccauagaaggaguuacagagacaaaguuuggaucugagacaaaaagauggaccaucuagagacugccauuuccggggauccaucccauaaucagccuccaaaugcugacaccauugcauacacuagcaagauuuugcugaaaggacccugauauagaugucucuugugagacuaugucggggccaggcaaacacagaaguggaugcucacagucagcauuggaugggacacagggcccccaauggaggagcuagagaaaauacccaaugagcuaaaggagucugcaacccuauaggugcaacaacauuaugaaccaaacaguaacccggagcucuugacucuagcuguaucaaaagauggccuagucggccaucaguggaaagagaggcccauuggucuugcaaacuuuauaugccucaguacacgggaacgucagggccaagaagugggaguggguggguagggguguggggggggaggguaugggggacuuuugggauagcacuggaaauguaaaugaagaaaauaucuaauaaaaaauuuuaaaaaggacuuaaaauuuacaaauacuaaaagacuuauuucuaauaacauucggguguuacuuuauacauuuauuugacauauauaauaccagguaggaagcccccuucauuuucucuuucagaaagaccaugaguuuucacugguuaaaacugaacuaaaaccauuuaugcaugagaaaaacaaaucuaaaucucauuuggaaaaagaauuuuuaaaaagacugauuuauuuauuuaugcuuaaaauauuuauuuacuuuguguaaguacacuguaauugucuucagauaccccagaagagggcaucagaucucauuacggauuguugugagccacuaugugguugacgggauuugaacucaggacccuaagaagagcagucaaugcucuuaaccgcugagccaucuuuccagcccuggucauuuguuuuuuaaaaguaugcauuuuaaccacuuugcacauaaugugaaaagcuaaccaauuuauuugcaauugcucuagccauucuuguauugugacuaugucuaauuuauaauauguauaauuaucauguaacacuauguaauguguguucuagaccacacaauauacuauagccauuuuuagcuuuaaguaauuaaauaacuuuaaagguacuauaacacaacaaaaggaauugggccuuuuugccauacaauagguaaacauuggaauaggauuuauucaacaucaguccauuuuaaaauucagucuacuuucaaguuccuucuacaaaggggugauuauugccaucaauucaagaaauuaugcagcuagccauuauugguaauaacuaauaaaacuaugguacaguggacauuuauuaggcauuauaaggaaaagcaugaugaggggcuggaaaugcuaccaggaaaagagcuuccagggcauguuugaugcccuaaauacaauucuaucaccaaaaagaaaggauaacagaaaauugugauuauuauugaaacuguaccaaauauaaaugcaaacagaacaugucuugaggcacauaaacaaaguaagaacacagaaggcacuaacucuggugaugaauaaagaauacagcuaaaauuaagcaauaaauugggaccuuugaaagacucuacuuggacucaacaagagacaaauuuaaaggugauuuuaccuguuuuacaaaaaaacucaaguuucgcccaugcuagucaaguacucugcagcuaaguuccaucccaacacaauuuuucauaauuuauuaauuaauaaacaugcaugauaaauuuacaggaagaaaaaaauaaaauuucauuaggaagaucucuauaaaacugauaucacaccauuuccaagacuuauguugaauaagaaacaaagaauucacuuugugucuuuuuagcuucaagauguccuagaaacugaauuaaucaagacacuaagauacuauuaaaagaacugacauauacuugugucacuuaaaaacaagguuguaucgcgagcaacagaucacagggcaacuucaucacugcugauaucaugaaagguucuuacacaaaccuagaugguauugucuauuacaugccuaaacucaacgggguaaguggcuauugauccucugcuacaaaccuauacaucuguuacuguacaaaauaccauaggcauguauaacauacgggcaauuauuaauauagguaaacguaccuaaaugugugaaaauauaauaugaaagauaaaaauggucugagugccauucaagggcauuaccaugauugcagcuugcaggacuauaggcugcccugggugauucagugaauaucauuauuguacauuauuguagacuugaaagcacugugaacuuagguugcaucaaauguauuuuuaaauuccuuaauaacaaauugacauuuucuuacuguaacuuucauacuuuaaaaaccuuuuaacacuuuaauaucuuaauauuuucauaguaacacauguauuaacaugcugaacaaccauagaaaaauucuuuauguccuaauucuauaauuuuuuguuuaaauauauuuauuaauaauuaacauauaaacacacagacagguuuguuaauaguagcauugucauagauacaggggcaaugugcuguacucaauuguuacagugcaugucuaucuaucaacagaacagaacagaacagaacagaacagaacagaacagaacagaacccagaaauaguccuacaccaauaccaccauagguccugacaggggaacacaggcaauguucagaacguuguaaguguaaugaagaaaccguaggaauccacacagaugcauggguuuugcuucucguugugguuguuguuacuauucuaaugccuccuaguuucucuacugcaaggcucucuugcaaacaccacaaucuucuauuguauauuuaagacccagcuuaggaaccuaacacucugccacccacaggugagauaagauagucucuuucagaaauccuucuuuuuccccacuuuuaaccugagggaugcugacuaacugugaccucuucuagaauauaccaaacaacuccccagucccuacuuaaaaggugcuaugauggugccuuccuacucgcuagaucccugauagacaauaucuccuuaggggaacaguuguuuuuaucagacuagcucggcugucuuccaaguuugggucccucccuccacaucccuggccuuucacuauuuuuuuuuuaucaacuagacuugcuuauuauucagauuucacuaauucacuuauauguuccuuuuuuauguauuuaggaucaagguguagauuaaugacagugcauguuucacaggcacaagaccuuugguccaauccuagaagugcccccaccccccccccaaaaaaaaagacagggaaaagaaaucaaguucacucaaugacauaggcaguuuuuccccuacuguagcuagaaacacaucaauggccucccaccccaucuugccauaaacacgaaugugcuaagacacaguuacuauaaacaagcacauucuccucacguuccauucccuucuaugaguuuuccacuaauuaauagaagauccucuugucuuucccuucccuccuccccuuucccuucccuuuccaccuccccucuacucuuccuccucuucucccuccucuuccuccuguuccuccuccuccuccuucuccuccuuuucuacccuauucaugaguugacuuuugaguggcagugauucuuuugguaaauccuuucauuauucuuaucuauauucaggaaucccuguauuuugcucagaucuugccucuucaguucuaccuuuuucaacccacaaaguccugcagaaugcgaagauauaguuuucacuacuuuagcuguuacucuaacaagcaugcccuuaagaaagacuuggugaugaccaugaugaugaucacaaugguugcgcaauaaauaagcauggaauaaagauaacauccuugacaaguguugaagggcagagucuucuaucgcugcuguuuuaaauauucagcaaguucuugccaaaucccauuacuuguuuaaaagaugcaaaaaaaaauuuaaaacuccuacuuuggagaaaagaacauguauucaucaagucaaguaacugaaacacagagagcgaaaugaggcaauuuugauaaagucauuccaucuuaauuucagugcacaggugcuggcgcugauaaaccuaaccugaagguuuaauucagugaaaccuuucccuccaagcaaguuuuaaaaguaagcuguuugcugucccugcauacaauuauucuaaccccaggagcauccuuuacacauggauuauauggcagcugccuuaaaaugaaguuaaaggcucuccuuucccgguccuuuuguggaaguauggcuaacguagucaaacugcuuggaguuuaggggguuaaauaaucuggaaaaauaacuuuauucuugaauauauuuaugaguuuguaaaguuuguacaaaagauagcuuuuaaccuaggaaaacguuuuaacuucaugugcuaugucuccuucugaaggaacaucuuacaaaagcauguauggauagggcagcaacuacucaguauaggacuuggaaaccaccugggguguuccuacgacgcuccuaucaccaacacagggucuaccauuucuaaccagaaacuaaguucagagccuccuuggagaauucaccuucugugauugccauugaguggcuugguucacuggcuugaagcagaaagcugacuuuaaaaauuucagaguuccccuccaucuuagacagugcuuaacucuuacuugcaauaucuugagaagaaggcaagauacucacagaugcuauuauuauaaugguuuccuacaauugggaccucugauggucacauggccuaagccccaagaaaugacauauuaugguguaauuuugucaccacauuaccuggaauagagaaccugacuggguuccugacccacuugucuauuccaugcucccgaaugcccuggucaugccuccacuucuacaaaccagugaaaacacuuugagguggcaaaaacugugacugaaaaagaggaaaccuaacucaagcaaguuuaaucauaacuugugauucuuauugcacauuuguugcuccacaggucacagaacauagccaacccaacacauuuagcuauuaaaacuacugccuucucuagguucccauuuugaaauuguaguagcuauuccugguugucaacuugacuguauauggaauaaacuacaauccagaauuggaaggcucaccagugacccuaaucuggaggcugggagauagaaguuucugaucuggaucuugguauggagaucuugaggcauaguggcuauggauuccagauuaauacagagagaucuccaaguucaaggucaucugggauuaaaggugugguagcacacaccuuuaaucugggcuacaccuucugcuggagaccauuuaaggacauuggaagaagggagucucgaucucauuccuucgccugcuugccaugugggacugagauacuuggacuuccauucacagcuacuacugaaccauuguugggaguuggacugcagacuguaaauuaucaauaaaucccuuuacuauauagagacuauaaguucugugacucuagagaacccugacuaauacagaaauauuucugacugauuugacuuguaaauagccuacuacagagaagauaugugacuaucuuagcuuuuaaaggaauuucuuggggcacaagacccucucaaugcuggaacgugggucagacauggcaaaccaggaagauggugauccuaggucaaguauaugguugaucucuucauauacaggagagugagaaggaggguagggaggagucccugugacugcacagacaagaccaucgauaucuaacugggaagugguagaugacuaaggggacuuuacuucuuuagggauaaucccaucaauacauacaguuuauuucucuauccuugguuaugguuacuuuucuguugguuccaaaucuaugcuucuuugaugcuucugcuuguacaugucuucaaugucauacgaacugaggcuacuugaggaaccagucuagguaaccugcuagacagugcaggcucuugugagaguaaugcuauguaugcaucacugaagcuaagaggaggccaugauuaauaugaaagucccaugaaguacccauuaauugccaucagauggacaagaccagugaagauuagccaggucagcucacaccagaaccaucccugcugguuccaaauuagauggaugacuagugauggccuugaggccacaagguuuagggugguauguuguagaauaaaaaaaauagcuagaggaguuauuaaccugugagauuacaauugauuaguuuugacaagaaauauagcaucauccccauuauguuccgagugcugaauuguuuuuaaaacaagcugaauuaacuagcuaauuuccucuguucuucuggguaucaacugugugggcuaucucccauccuuaugcuucaguauucuugaaagacauuacuuuguuucaugagucacaucuuuccauaugaaaucuauucuauuucauauaucuagauccucuucuucauucaaauucagcucaguuaucaccuauguaaguauuucggggcccugcucuucucucugggagauucaaucauuugcuguuuugcucuuuauucucaggauauauuuucccauaauucuguuuuauaacuauuucucuacaaauauauccuugcuauaucguaagauuaaucaggcacggggcacaucucuuuuguucccaguacccaucacaauucugguacuauuuacacuugaucuuagccuagauaugaagaggcaauaccugguauaguuuaaaugaacauugaaguuuuaaaaauaaaaaaaaaaauaaaaacuuuuuauaaauuaaauaauaaaucucacauggagauauaugaauuugguuuggaacaaaggaaaccagaucccuguuauuucugugaacauucucugaauagcacccauuacauuuggcauauguauauuugcauuuaaaucacaaaaauagaauuuuuaaaaagcaguaguguaauuuuggccuuuuagaaaaguuaauuucaagccugacuuuucuguggucccagaguuuauaacauguucauaaacagaggcuaaauaacauaaaaguagaugggcaaauaggaagagaaaguaugaagagaaucaccccguuaacugacaggugggcugggcugggacaaaugcagaagcaaggugaguucucugugaguagcaugggaagggcugacuuggcuuucucucuguaccaacagauggaggcuuuccccugcacaguucugagcauccaaggcagaaggaugauuggaacagaaauaguauuuuguugagaauaaaaacuagaugagccaggugcaaugccacacaccuguaaucuuagcaccugagaugguaacgcaggagcaucaugcauuggaagcaagccuuggcuacaaaagcaagacuuugucucuauaaaauaaaauaaaauaaaauaaaauaaaauaaaauaaaauagcuacagcaaaccuagagugacaugaguaucuccaggggaaauaccuuucucaaaacauaucuagacucauuuccuuagugcacuggaacauacauauacacaaaaaauaggguagaugacugauauagaaauaauagauaaaugcuagauagacagauggauauagauaaauaauagauagaugauacauacauacaucauauauauguauauauagauacauauauauauauauauauauauauauauacagagaugauauauugauaauagauagaugauaggcauuacauuagauagacagauagauagauagauagauagauagauaaguauauaugauauauagauuauagauaggugauauacuaauagaugauagguagauagacaaauagcaucgaauuaaagaguaaaauuaaauuagacuacagcuuugccuucucucaucaggagaggcuccucacagcagaacugccauuucaugcccaaauaauaaaagucagaucuaagacauuaucuuguaacucuagcuaaaccucuagacaaguaggaacaucugauaguucuucaaauuauaaaaaaacuaccaagcuuuauuaagaaaacuauggcagauugaauaugugcauaccuucuuucugccucaaguuccacuaaaauggucagaguauauaguugugcagacagaagcacucaggcaagcauaacucaagggaauaacauuucucaaagcuacacgugacaauugacuaagcagacauaagaacucagucuacagcagaccacgggaaaagcugaugacaccaauuucaugacccuggagaagaggaaugcacuuccuuccuaguagguggaagcaguccaagaugaaauaggaacaaucugagagugcuuaguaaguacucagguucccacgcacuuccaggcuguaugccccagugacuggcccuuccguggucaaguaaggaacugcggauugauugauucauccagagggugaauuagucccuaguaguuuagaguagagggaugcacugaaaacagaagaccaugaaagugauaucauacugcacaaugacaucuaucaacagugucagggucuccuucuguaaugagccuuagggguuucucauuaggagcuugaaagaaagauuucuaagacacagcacggccaaaaaaauauauauauauccuaaauaaaugaguauuacacucacaaugauagggauaucuagaagauaacaugcagacugcuuuacuuuccuugaaggaaauuauuuccaaaccuauaacuucacacucaaccgaaaucucaaucaaggacagaaauagaggacaucuuuuagaauuuacuggcauaggcacagcacaaaacaagaggugugugauaaaggaagccggauggccgacaucaaagagauaaacagaguucccagauacaggaguagaaagcaaccugucaaacuuugaagaaauagaaagucucagacaagaucacucagguaugagacucacagaacgaacagcagagagauaugacauguugauaaagggacuuguauucacacagaaauaucagucacaaugaaaaaaaaaauacaauuuaaauucuagagaaaacaaacaaaagacauggugauguaacagaaaagaaaucagaacuuaguuuauguaauauuauauggaucaacaaacacuaacaaauacagaacacugaucucaugaaacuaggaaaugaauguacuaaagguagagugauaggaaccuauguguguuuaccuauggguguuagcagguaaaucucuuccgcauggaacuucuacugauaguaucuaaaguugaaaggcuaagaaggaagagagcuguuugauagcaaaaagauaaauacggaggguauuagaaaaaggagauuaaaauauuagcagacagagagaaaggugagcaagggaucaauuacuaaaaugcuagcacuccaaaaacauguagugauuuuaauaaacgcuucuaaaacuuaacgguuuuagccaaaccaagagacaaaaugcauucuaauuaauaguaagcaugguggaacagguuuaggaaaucccaccuggcauggguugauugagcccacuaccucaaaaaaauacaagagaauuaauaauaauggcaggaugucaccagcugugaaucccagguuucacggugacuuguuuugaggcugaucuucuguuucucuaacaugaggaugccugccuucaacccugucacagaacuaccaugaggaaaaacaguaauuucagugaagguucuuuaugcauaaagaacucucaaaauaaagcagagauuuuacccuauaauauauauauauauauauauauauauauauauauauauauauauauauuuacccuacacacacacacacacacacacacacacacacacacugugucuucagacacaucagaagagggcaucagaucucauuacagaugguugugagccaccaugugauugcuggaaacugaacccaggaccucuggaagagcagucagugcucuuaaccacugagucaucucuccagcccuauuccuuuuuuuuuuuuuuuuugguauaguguuauauaaccuaccuaaauuugagguauuaauucuuaucauaacuaaucuugaguuaaccuuuaaaauugguggcaggggagggggacaguacuccuuuucacuugcuucuguguuaggaaucuguguuacacucuaaaauaaccccuccccuaauuauucuggucaucuguuauuuguguccuuuguaaucuuuccccgaguauaagcacgacuuaagacauacuuguaagugacccaauuugauaaacacuauggaugggaaauccaugaucacaauggguaagauuggcacuuacaacuuauuaauagauaaucuuuguugauucucuccuccucuggcugccauaggaagaggccugaaggaagucucgcagcugagaccaugauucaaagaacugaagcccaucagcaagaagcagagcuccucccgcauaacagaaacaacccgacaaguaacacaacccugucuacaggagcuugggagugcauccaggucaagccacaucuguggcugaccggacucaagucucgauuugugauaagccacacagugaggaagagaacgguguucaugucaccaaaucugugaacgaggaggaacuguuagucaagccucucgcagacucuugagugucgucaaucaaagaaugucacucugcuugucacagaggcacaaauccuaacuacaaaagcucaacccucugccuguugucaucaagcccccugaguugaacccgguguaccucacuauuagcaucgcaaccucagauggcuucauucgggcuacgucauccagaagucaucaaagucucucuucaauacuaaaaaauuuaaacaauuuacuauuguuagcagugucaaucaaacuucacccacaagauaaaguaacaugcacuucauauuuuauaagaucaugagggaucaugcagaguggaaguuuucuauuuaauaacacauuaaaguaagaagaagaagaauggagauuuuuuuaaaccuuucugaaccuauauguuauaauucuaacacauuaaaugcuuaacaaacucuggcuucugaguaaaagggaaggaaauauuuuuuuacuuuuaauucagaauuuuaaaaaacggccugugggcaaugaggcacacagaucagacaucauuguauaggggagaaaggcagugguaacgagacucgcaggagcagagaaaaguggcuccccagccagguaucacuggcuacccaacucuccucagcuccacagaccuccuugccuuaccacuacuguaucaaauaaaaauacaaaaauggacgagagccuggggaaaaggagguccagugacagcccaaauugggacccagcucaagcggaggcuccaaggccugacacuauuauugaugcuaugauguacuuaacagacaagagucuagcauggcugcccuccaagaggcccaacaagcagcuaaaagagucagaugcagauacuuacacccaaccaauggacagaaucccaggaccccuaugcuugaauuaaggaaaagcuggaagaagcugaagaggaggguugaccccauaggaagaucagcagucucaauuaaccuggacccccaagaucucucagacacuggaccacuaaccaggcagcauacacuagcugaucugagaccccccgacacauauaccacagaggacuuccuggucuggcuccagugaaagaagaugcaccuaacccucgagagacuugaggccccagggaguggggaggucuggugggguggggguggggaguggaggcauccucuuggagaugggggagaagguaugggauaaggaacagucagagggcagaccaggagugggauuaaagacuggacugcaaaaaaaaaaaaaaaaaaaaaaaaaagauuaaagaauaaagaauaaaaaaaauuacaagacuauucaagaaucagaaauaaucauaaaaacagaauuaauuuguuagcuuuagucacucagugcuauucuacuacuaauaaagggaccauauaucuuauguucauauguucaguaaauauaaaaaguauucaacaaaaaaaugcagcuauuguuuguucagauguccuaccacacauacucagagaaguaugcaugugugggaaagccuuuaaaagagaauccacguacagcugugacucauucaccugagaaagagugagcagaacagacagucgcugaggcagacugucacuuagaacacuccuguaagggaugugaggguuaacauggggugucugaaccugucagcuccaagaguuugcagcugucacaguuggaaaggcugucucccuccuaaacuggugcucucgagccagauuggacagagugggacucggaggagagaucugaaacuugacaacagcagcugugcugugucaaugguuuuguaauaaagcuggcugacaagugauugggugugacggggcauguauguguagagaucucacuggaggucaugagaagagcuugacaaaucaccaaacaaguguggguuuuggguuugguaggguuuuuuguuuguuuguuuguuuguuuguuuguuuguuuguuugagccaccccauuaagaacuaaggucuaugugauucuccaacagaugcccucugaguuuuguauuggcuuucauugcacucauaauuauuauuaacuuaccaauacagcuucauuauuuuccagaucuagaggccagaauugagacacuuguuucaggaagcugacaucaaggugucagaaaaacugcuucuuccagaggagugguucucagccuuccuaauguugugacccuuuaguacaguuccucauguuguggugacacucaaccauagaguuguuuucauuucuacuucauaacugaaauugugcuacuguuaugaauuguaauguaaauaccagauauguggcccucaaugggaaugcaacucacagguugagggccacugcucuauagguuuguauggaaauccaucccuuccuucuuccaggcccaaagacaaucagaaugcauugcuauuuauggccauggcuccuuccucaaucucuaaagccaacaacaguucaacacagugcagcuucugcuacugauuacagcugcagacaaaccagucuaucuaaaaugcucuguaccucaaaauucuuaacaaauaguauuuacaauuucuuuuugaugcauaaagcaaguuucaaucuccaggaacuggaccuagauauccuuagugaccacuacccaucccaucacagaaaacaucacauauauauuucaauaggaaacugauuguggcaaggggcuuauuauacauauauaagaccaucuaaaacacaauaguaaugaguugucuugggaacuuuugaugucaugucucuugguaaauacaaugugaagaaaguaaagaggaagcucagucgauacuauauaugacuauugcauauacgcauaagcaauacugugcauaggagaggauggagguguaugaugcucaaauguacaagcuuaacaagggauugggucaaagucaaccaaacccaacugacagauuccaaugauaccauguagcaguauucacaaauagccauggguacuaaaaaguucaguagcaagcaucagaaaacuuuaauccaagacacucugagcaggcucugcaccaaccacucugacccuagagaaucuaacugcaggcauaugggaugcaugaaggagaacacuaauuuuuauuaaaugguuaguaugcagcacgaaguaauggccuuacaaguuuuagaauuaauucaguaaaguaucacaacaagggaugguggaagcguuaaacggagaggaaaauaaagcccaaagacaauuagggagcuacuuucucccuguuuuccagcuaacaaaggauauagcaaaagucuggcuuauauguuuuacaauaugaagaccaauaaugguuucuuuggcauauagaggcauacuguaacauauggaggagucaagaaagcaaugauuuuguuuuuuagaagagcuuugaaugagagaaagggaaaguaauaugaguacauauccugucaguugauaagaacaaccguucauaaugacugugugaucacgugcagggacauggacugauggcaucacaacauacagcuuuaaguaagcaagcaaaguuccacaccuccagguucccauuuuacuguuuggacccuuucucguuuacccaccagagaaaucgauggucucaccuuugccauaaagugagcucuaugugggcuaaagagaugucucagccaauaggugcacuugcugcucuugccgaggaugugaauucaauucccagcacccaaaugauggcucacaacaaacuguaacuccaauuccaggggaucuggcaucucagguaccaggcuuguacaugguacacacagagaaaacacucauacacauaaaauaagauaaauacacaaaaucuucuuaaugaacucuauauguaaauccaguuucuaauaucacuucauauaaaacuauaucuuuaguugaacugagaucaaguauauggcucuuccagaauaugguucaugaaucuuccuuccuaugguauuuaguuuguaaaacuggucaacacagcccaagccuuuacugagaaaucucuuaagaccuaucaugaaaagaacuaaaaggugaguuuucauuucuucuucuucuuuuuuuuaaugauccagcaacauaagcaauauuccucaucaggaaggguccuuccacaucaugcauaaaccacaaggaagaauacaugccuagcacuuuaggcaacaucagaugaaagcugaaacacaaguacaaacuucuucucaagaacauucuuguauuugcauauauauguguguauauauauauguguguguguguguguauauauauauauauauauauauauauauauauauauauaugcguguguguacauauauaugugcauacacacacacacacacacacacauacccaacagaaacacacacacaugccuuuaggcccauacauacugaaaacaggcugacaugaaugucagugacaccuagacucaucagguuugcacauaagcaauaaaagcccauagacuugagacuagcugauuaauccacacccuuuacccauauccuuccaugguaauucagauuucuuugguuauaucuuuucucauuaccuccagacuccugacacuuucuuccuugggaaaaaaaaaaaaccacuggaaaucaauaaauaaggcccuucuugcagcucuuacacccuacaauucauucuguagaaucuacauacaacuucuucagucuguuuguccaacucugguuauauuugcauguaugagcugaaggggaucagcuaauaaaagaaccaacaucauuacaaugaaaucacuuuauaaauggcaauacacugugugccaguguuauuuuuaucugugcuugaaaaguacacauugguuuauguacuauaaaauaaagacuuuagaaaccggaagaugguuccgucggucaaagagcuugcaggaaaggauaagggccugaguuugaguccccagaauccaugcuccuguaauuccaguauuugagaaacugaggcaggaggauaucugcuucaaggccagccugggcuuuccagauggacccugucucaaaaacagacuacaaaacuacuuaugugcaaagugcucaauuagacaaacacaaucauauguaaacauaauacaauauaucccuacaaccaccacaucgaauauaucaacacaggcaacauuaugccaugguucuaaugucccauuuccuucucuuccagccccuauccuuucccucaagacagacaaccauugaccauugucgacacaggguaauuuccauuuuauagaauuuuagguuggcgaaauugugcaguacaugcuuaacuuugaauauuuucucucaaaaaauaaucuccucagcuugucaauaaugcauuccauuuugccguugaaaagaacagugcaguuuacuuagccaauccagggcuugggauugaauguuagccuuccagagaggagcaccuucaucagaaccugugaauguugacuuuguguggcaaaaacaaaaaacaaacaaaaaacaaacaaacaaacaaaaaaacagacguaggcacacacgaaaagaucauucugaucucuaugacacucaguguagucacagggucuuucuaaguggacaguaagaagguaagaagccaacauguuaagaagaaaagggcccugggugucccagucugaccuaagaccaauucaauaaaaaaugucaucuacacuucauccccucuaacaucccaaauguuauuaucuaaacuauccagggauguugcucuggguaaaauguguuuuaaaacaaauuaucuuuuuaucuguggauggguaaagcaagaacacaaaauaacagucccgaaaaagugcaacaguggcgaaggcauaggguaaauacagaauuccucauuugaaaggacagaagaacagaaaaaaaagggguguuaccaggccugagaaauuaugaaaucaaacuguaugcauuccauuagaacuugagacauaagcacaaucucuuguggcucugcccuauuaggugugaucuuggaccccaguuuccuuuucucauaaaggauaguauguauuuguagcugagugguuuaauuaggccaucucuugccugugggagacauuugauaugcauuaguguuuucucuuucuucuuucuguaucucaguccaagcuugcacuaugucuacuuagagaacguuccgaagaacucaguaggccuccuguauaugacacagggauugguccauuaaacaaguaacucuuccaacauaugcaggaugauccaauguauuccuggcuucugucacgaugccugggggcacccaagauacacacuucaacucuucacagcucucugugguugaaauauuagccuuuaucaaaaggacaccaacagucuagccaaggcucugcagccacauggguggcuuucuccccaaagcacagcuuuccugugcuuuucaaaucuuuugaauccuggagagaaauaaguucucugauuguguagucccaguuccucuuugcuuaaugauguuuuucuagaacuacuucuuucaccugucaucugacuaaaaaauaccaaaccauagcuauuauucuauuguuugaaaaagcucaacuauucagccacauucauaaauuauagguucugaccauacacacuacacauucucccacuacaaaacacaaacaaaacaaacaaacaaacaaaaaaaaaacaaaaaagacaaagacucuucacuuccccuauggcacuuccuuugacauucauauucaacagucauugauucucuaagacaacacgagucuucuuuaucauggcugucauuuuccccuuagucuuuguagcuggagccuuuacauuaacaaccuauuuguaggaaucuagucuuuauaaaaauaaacauugugccucucaaaaucagucccuacagccauaguucagugccaccuuccauagguauuuuaaauacccucaguauuauucucauaucguuugcauuauuuucgugaucucagcacuuuuuaaauuuugacugugacauaaucggugguguuuuacuuuuuuuuuccugauuaaaguuuauucaucgucauggaucuuuggcuuaauugucaucagacuugggaaaauucuggcuauuauuucucuaauuauuauuuauucuaagccuuaucauaauauuaauuauaucuucuauaauuucuucaguacucuuuucauaaauuaaagaagacacauucuccucuaauguacaucuaauguuuaucaaaauaagcauguauuauaacucgaacuuucuugccaacuuugguuuucagcaauuuuacaacguauaacaucuguuuggaaagcauauugguuuuaauaugugaggaguuuguugugcuuucuagauauacagagugcuguguuugaauucauuugagaaauccucagacagccuaucuucaaaucuuucucugcuccuuccuuuugguaccuugugcguguaacaacagccugcauuucucuacuacaaaacucuuucuuucucuguguuucuuuucucccuguuacucaaacugauuaauuccuauccugucuucaaagaaucugguucuccuuugacaaaucagacuggccauugagaccccagaagugaagauuucaauuuaguucauauuacacuuuccaaagccaggcacucuauguuacauauuuuuuuuuaucuuuccucagacuuuauuagcaguccucauuaucaaaaccggccauccacaaaccuuuccuucuuugguuauccuugaaccaaagugcaugugucuguaagagcugcuuugaaguauuggcuaaucugaaagacauaugaccauucucagacaguuuauuuugucuacuuuuuauguuguguugaccagcuuauccugugucuuugcacauccugcaguuuuucccccuaggaacuggauguuuuagauaauucacuggaguaacucugagcgaauaagcccugcccugcugcugcuuccaggccagcuggauggauuuagcgaagucagcuccccuugcagugcugagccucugcugcucuugcuacuuuacaugcacauccccauguugcucucuuaggaaggugguuagggcaagacucugucacugccuuugagcagacacagcucgcaagcuacgugaauugcuggcugcuuguuguuuuauuuucagcaacaccuggguuccugagcuguucugcagacuaauccaacaaaucucagaccccuugaaggagcaguuuccaaggaugaugucuggaauuuggucugaccucagcuggcuucucuaauuccucagacuaaaucucugagucgugaugcuacccuuaugauuaaagacaauggcuuauauucacuugaguagcugaaugcccacugggagcuagagagggagaauugggaauaguauucucugguuuggcgguauugcuaauacccacauuacaacaggccaaggaaaaucaaauccaggcuuccaggacucucaguagugugguacccaagagaaaccuugcaaaguaugaauggggacuagauggaaacaagagucuacaugucacucacacucacuuggaacucugucucaucaucacgucacugagauaugaugaauaaaaguguaugcugagacucuagcugagcacagcccucuaauggaaacugauggggagucuuagggugggguccguguucuugcugagcuugucuggaauggaguuuccaucuugaguuggggauggguacaggaaaaggaaguuggugguuuuaguggucugacagaaaugaugguuuucuugaucaaaugucuccucauuuaauuauuacuuaaaaauucccagagacacucucagacauaguucuauuaggaaucagaucugucaggcuacucaugcauccuccugacagaagcuccuccaaucaacugauuaacaggugggaaaggcaguucaauaaauaaacugaguuuuucauagaaaugaagaauggguauggaaagaaaugaaauuccaccuuuccuuauaccaccuacaaaucaaauugaacuggaucauagccuaaaauauaaagcuauguaguucuagaauaaaaugcaggagaacucuuugcaacuccaacuuuaaaauaagcaaauauuuccuaggacacaaaaucaaucaaucaaucucucucucucucucucucucucucucucucucucucucucucucucucucacucucacugccucccuuccucccucccucccacccucugucccucucccuauccuacucccucccucuuuucaaugcaugugugauacacacagagagacacauaugaauauuagauuagacuucaaauuuuuuuaaguuuggccuuuaaaauauauugucaucaaaauuaaaaagcaaucuauauagagugugaaaauaacuuuauauaccauaaaucugauaaggagcucauuaagauauauauucuuuuaauugaauaaauauauaaaaucuaauuuaaaacaaaagaagcuggaacaggcauuucaccaaaaaugauauacaaaauauagcaaauaauagaacaaaauuauauuaaguagguaauuuucagaaaagcacaaauuaaaaucacagugagagcaguagacacccaccagaguggcuaaacuuuaaaagaccuaugauaucccuacaaaggcauggagcaacugaaauauguguagaauucucauuacaaagaaauauggccacuugggaaauuagcuuugcaauccucaaaaaguuaaauguaaaauuaauauaccaugcaucaauuccaguccuagauacuuacccaggauaaauaaaaacacaaagacuugcaugcacauguucauagcuuuauuaauuuagcccaaaccuagaagcaacccaaauauccaucaacagaugaauggguaaacacauugugguauauucauacaaugaaacacuacucgguaauaaagaaggauaaauaucuucagugagagaagccaggaacaaaaacaacgguacaauucuauuuauauaaaauucuuagagacagaauuauagucauaguaaaugaaucugugguuugguagauaugacaaagaaguggaguauuggcaggaacugccugaagaagguauguggacucuucuggaaaaugauagaaauauucuguaauucuaguuuuaguguuauauauauauauuuauauauauaacuauauaccacuaauacauauaacauauuuacauauuacuauacaguaauauacauuugucaguuucaauuaacugugcacaacucauaacuauuauuuuauguaaaauauaccucaguaaaacuuuuuaaaagacaauagaagaggaauauucaauaguuauauaauagaaaaauauuuucagauacgcgcagcuauauauacuaagucaaagcacuagauagcaaacagccuaaaauuagguuauauaucaauucaacauguuccuugucacuauuuucauuaaauuauaaaauacaugucucugacgugagguuuuugaaaauuauauuuuaaaacuaucauaugggcuagaacgauggcucaauggauaaagaauacuggcuauucuuccagagaacuaaguuucaaaucacagcacccacguggcagcucacaacugucuguaacuccaguuccaagaucaaacauacauguaaacauacaugcaagcaaacacaaaacccaugaaauaaaaauaaauuauuuaaaaaauuaaucaugcuuuuaaaccaugacgucacuugaaggagaaaauuugagaugugugaauugacaugucauaucuaacaaaacucuggugaccuagguggaucucagccaugugcauucuucaggucagaguuuaugucccaucuccacugccuucacacugaaccaucuggcuugcucuggccaaugaaauagcaucaugcaagagguuugcauaguugcggguaugccugcaugacuuggcuugcaccauaacaccuauaacccaaguguaguucuucagacuagaccagagagugaggcaugaggagcaaaccugaaccugccucaaagaccgagucacagauaaauaagucacuuuuaaguaagggaauuauaagcuugccaugauacacaauggaauuaauagguauuuguggucuacaccauccuuuugggaaguguuggugaacauacagcuaacauuuguggagaaaauauucguaaguaccgagcuaaaagcuuuaugugugccauuuccuuaacagccucagugacucugcgggggaagacuacaaaaaauacacguuuaaacuccaugaugauggagcugaagauaggguaacugcauugcccaaagucucucuguuauuaagugacccaugauaggcagaguacccgucuccuucacuguguucuacuggcuaaauggagaauuuagucagugccccuaaaccaaugcuuuugaaaggaaccccaccucacucacugauuucccaaaugugaguaacagaaucagauccagggacagcaaugguugacaagacacccugaaguuguaagaucuugcaguuggguugcuagacauugauggacaugugccaauucuaaauacucuuucucuuucuugcauugaaucuaccaaucuuuguaacuguaucgaaacaaucaccaacacacuccaccuucugggccaucaguggcugaaacauugugcugucaugacucacaagguuguggcugaaauaccgaagacccucacugaggcucugcaauauuguuuuuaaucuguauugauuccauuuuuaauuccccaacuguuccaaacucuagucacuaacuuaagugcuaauuuuaguaucaaguccucccaggggaucugccuccaacuucccagaaaaugaauauuccguaggguauuaaauccucaacuuuccucuuccuccuuacaccuaucuuuaccucucauuacccuucagcucuccugucuuggugacuaaucccaccuccauauucuggcuucucuuccucccuuccuguacccuuaccucuauccauuuaacaucuuccccuuuccucucuaucagaaaaccuacauacucacuccucccacaucucaaaccacuuuccuccaauccuaauggcuccacaaacgaccaacuuucucuccuugauuucauuacuaaacuucuugacaagguagccuauuugagcuauuuucaaauucccaccuccaaucuguuccuuaacacacuauugugaaguuuugcuuucugcaaacuuuuucauaguuuuucucucaaguaauaguuuccagcaugaucaagagucucauuuacauucugaccaagucucucuguaguuuuaccugucauacauacuccagcucaacagcccaccccacucacugcccaccucacugcuccucacuauucucugcuauaguuauugguaccauauucagccacuccaccacacagagcuucuuaauaucuucaauauuucacccuaccccuuacuucaucucacuuuaaucccucccaguuggucuauuccaaaagacugccaacuuauuuucuggcaaacaguauagcacacauucaauccacccuugacacuacccauaacaauaauuaaaaugcaaauuccaucaaaugccuccucuccucuuccuccuacaucuuucccugaugcuuaaaauuucucaguggggguucaaaugguuuuucacuguauagaaaaugagguacacuguguugcuagggaauacagagaguuuccgggacccuccaaugccuaucucaucaccagcuuacagcagucccucuacaucaucuuuauauuaacacaaacuuauauauuuuuccagaacacaucgucauuugaugcacuguuccuuggaguuacaccgcuuuuccuaugugaaauucccagccauaccucuguucaauccuguuuccucuugguggaaaccucauaugcaccaguucuccuacuaaguaccauccuccugggaucucucucucucucucucucucucucucucucucucucucucucucucucucuccuucucucuccucucucucucugccucugucucucuuugugucucugucugucucucuuucucucucucucucccucugucucucuccucucucuccucucucuccucucucucucucuucuaucucugucucucuuugugucucuguaugucucucugucucucugucucucuccucccccccccugccuccugccugauuuaauuuuccuuuacuugagucuaucugcccaucucuggaauggaaacacuugcuuugugugcuugacucaaucaaacauuaagcuucuaaagaacuggauuuuuauaaccugcaccccuccauugcugaguaccccaucaaaaacuugugucuuucuuggguccucuucuuaguuuuuuguuuuuuuuuucaaaaccaucuuuacugucuguugccuacccacaagauucuuuucaguucucuucaaguucuuuucagugucccagaucuuuguuccuuaaucucuuucacccaaucacccugggccauucaaacacauuuggucauauccaguucccagcuauugauugacaaguuauaaauuucaaccuguaacccacugcacaucuauaccaacuauaauggcauagauaauguauaacuaguaauggcauagaaaaguauaacuuguaauauaaauagaguucauuuacugcaaggugcuacucaccaacaacagaaguaaauacauguuauaacauauucauuuagucaugacaacaacccuaaacuagguauaauuauucuuuccauaagauucacaaaggcuuggaaugugauucccuggucguauauagcuauaagacucugaagcugagacuaugucaauaucagugaaaguccauugcacaacaugcucacuacuacuugccagauuccuuaguucaacaugcucgaugcuuauuucguaauuuuccaacuuaaauaaugucugcgucuauuauucccacucuaugauguucuuauaaccagcagugcuacagaagcuucuaagugauauuuaauuccaucauccagcuucccccauggucucuuggucacuuagccuuacucuaugcgugaaaguaucucgaaucucugccucuuuggcacaguauauccauaacugccucgcuguuguccaguguuacuguccaauaugacccaugauccccguuacuguuuucuuuauaaauaaaguccuaguggauaagacagcugaauauuuacaauuaccuuuguuaucuccagagauuucaauuaauaugauuauuuuaaaaaggugacauucucacacgaaaaaaaaaaauaacuuuugccaaagaacucaaacuggacuuaaccaacggaagaacugucccggagcaagaaucacuaguucagaaguaacuuguccagacaacaagcagagacccacaaacucagauuuuuggcuuggggcuacaggcaaaggccaacucugaggaacuagagucauaacacaguacuaagaaugagagcccaggcagacacaagaugccagcucccugguccucugagcugcucauaugaauuuaucugcaugagcuaaggccaccuuuugcuaggcuucagacaaagguugggcacugcauccucauacaguguggaauggauauuuauuuaucuagcaucugucucuaaaaugucuuuccagacuucuacacuuuuccauuucuucauuaaacuucaaggaguuuuaaggcuaaagaugcugucugaacaauuauacaauaguuuuauaaauuccagaucacugugaccuuauguaugacuuuuaaagacacuaucaaauuuucuuuucagucuucaccugaaacuuuaauuuuaauauuuguuuauauuaaugcuccaggucaaauuauuguguuugauucugaggagaacugggagggcauuacucaaagguaagaccaacguuuuccaaaaaauuguuuaaauccaucucaaguagacuggcuaauucaaauccugaccccaauuuagaaacagauuaagcaucauaagccucaauuuucuauuaauaaaagguaaguagguacugguagggcucuuaaguuuuaagcaaaauugcuucuuuuccucuccuauaagacaaguaaugucuaacugcccugccugcuuccuucugucagacauucucagagcauccuauaaacuucacccuccuucugccccugccaggcuauaaccucacaugcccugauuuuuucucuaugauauuuaucaccuucuaccauauuuuuuacauuuugauuuuaucaucuuccucguucccauucuaauguaagucccacaaagaauacuacugauacguaaguacuugacuaauuaauaauuaagggcuacuaugucgacaauuauaacaugcuaucaauauauacuauaucacaauaauuaugcuauauguaaauauauacuacauauaaauaaaguagcacuuuguaaaaccaggaaucagagguacagcaggauuauccccagcuugcacacagcacaccagcuaauaugguaguuggacaggaaaaacccuucccugugucaaagcacaacccaagaucucaaguuaaagaucaaugcaagaauaagagaaaugacauuucacaagaucaaguuaauuuaagaaaaaggagacuggggugaacucauaacuaugugccccaaggcaguuuacagaggacacuguuucaguaaaauggagccaagcacaagaaauagaaaugauucaaacuaaauaugaccuaaagagacaacuacaggaaaaauacagaggaaaacugcaaagcaggguuugggugaaacaugcgaaucacugagguaaaauauauguuacaucacuuagaagaguaaauaaugggaaaauauaaauaugugguuuuauaucgcauacuaucagauuuucaacuuauauagcuauauacaugugauaagaauuaagugaagaacagaguaagcuggacuagaagauaaucauuagaacauaggagaguaugcccacugggagcugggagcuacaaacacgaagcucaggcgaggcuguggcugaugacggaccugaugcucaggggaggcuauggcugauggcggaccuggguaucuuugacagauagagguuguuggaaucacaaaaguagaggaauggacaaggcaugcuguaaguuuacaagucaaagaagaauuugacaagaagggguggggagugcaacgagaaauaagcaggagaagaguuuccugaaggaagggccuuggaaaacuaacaacggaaaacugaauccaguuaaacaagaaccaggaagaggucucacuacucauauucccauacguucaguaucugcguuagcgagcucuucccucuuucucaugggauaucuggccuuuguuuuacuccaucucuguaagugaucgauucugguuaccuccccaguaaaugcugcuuauucauuuccagucuucaagacccaauucaauuuuuuucuccguuuccaucugugcccuggagcugacccugugccacagcccuccacaccccaaccccacccaaagaaaauuggucuccaaggaguguugacacacccaagcucacaggugagaccaccaguaccggcccaauaacagguccaagugggaccugucuggggcccaguggacucaggaaccauagcacagcaggggacaggauccuucugguuucccucugugccugggagcugacccugugccacagcucucugcacuccaauccugcccagagaaaacuuguuccccaggagggugaacacaccuaagcucacaggcucacaggcggcaggauaagcuccaaccagagacagcaaggcaagcuaacaccagggauaaucagaugaagagaggcaagugcaagaacuuaagcaacagaaaccaaugcuacuugucaucaucagaacccaguucucucaccaaaauguuuucuccaacaucccaccauauuauuucacuuuuuauuuuuacaggauaacauuuuuguuaccgguagaaaacacuaccaaaaaaaacaaacaaaaacaaacaaacaaaaaacccacaaccaaucaaaaugcagaguuguagaauccagucccaauggauacaucuaaaaaacucucccauacucaaggccugggccacauuguagaagagugaacaaaaacauuguaagagcugaucagggccuuagcugugaaacuaugucuccugcuaauagcagaaguuauaccauaaguucuuaccaacacacccacccaaaugugagcugaauugauugaacgagugacagcaaugaccaagccaaagaggauaagggaaagcugcugaggcuacaguccuacacccagaacuauaggcaaguaaggaaaguggggaacuggagaggugcccuucccaggaagagcaaccaauugguuaucuagugucaaaugcucagcccugaaaaugugucuaaguagcauuguauggucuuaauacauauguauucaucucauuacaauuagugaaggaggaggcucugagauugaaggccaacaggaagagguaugugggaauguuuggagggaaagaugaaauguuguaauuauaucauaaucucaaaaacaaaauaagaauuaaaauggaaaaaaaaccaguucacagaccauggaccuuuuacucauaagacuucaaucucaguagauaccuacauggagagaaaggcuaaauguaaagaaaacacuguaucaguaucuucuuugaaguuauaguggaucuagaaaacauacauaauauguaaacaccaauauaacagggcagauauucuuuauuagcauaccauaggagcuagaacggcaagcauuguggcugaugaguuaguguccacacagugcaugguauggaagagcugggaagcugugcacauaggaagcagcagcagcacauuccuuauagcugguucagauagcaggcgaugaugccgcaauacaauuuucuacucacuuaaacagggcuuuucuuugaauuuuuccugaaauauuuacauaauacaaagguaccauguccccuugucagauguucccuugucagacagacauuaauaaaaaaaauaauucauaaauuacuacagaacuauccaaucagcuguuaaaugcuuccaucuuccuucuagcuuaguaucccccccacacacaaaagacuacaacaacaugguauccgguuguuauaaguuaacaauggggucacauggauucaauguaaauauauaucguuacagugaaauuucauuuuucugggucuaaggaugugucuuauauacuguggcauucccaauggcucuaacaaauaugguuaaagacaaaaaggguuauuuaugaaguaauaaaauuaugagagugguaaaauaaccuugaguuuuaauuacaaaauuaaggaagcaagcauucggugcugagcauaagagaguaaauugcuuagcccucaaccacacauuucuaucaucccucccaggaucagggaacacugcaaaagaggaagcagacagacugaaauauuggaaagacagggagaugacuuggacaggacauggcuuuuucuaggcaaucaaccgccacuaauuuuuaacaacuaugcauucauaaacauuuuaacaacugcacaagaauaagucaucaauagccaggcgaggacugggaagaggcugggggaacccucucacuuacugaauuguuucauaugaaaagagggagucauugccuuuugccacauguccacuggugacuaauggacaaucucaacccaauccaauggucacacagaugucucuguuuaaacuauaugggucacaucaaaagucauuaaucugggacagggauauguacgaaggagggggauugacaggaguaggaagagaaagaagguaaugagaaugcauuauaugcauauauaaaauugucaaagaacuaagguuagugauuuuuuuuuuuaaguuagggaagccagaaguuauguggcagauaggaaaaagguacauuuugaaauccauauacuuauaaaagcaaccccauuucauaugcauuucaaguugcaaaaggcaauugacuaaauuaaaaguuugacuuaaaucgucuaaagaaaaguauguauuugcuaaugguaaagauacuucaguaauuacaauaaagucugugucauaaagcaagggucuucgaacaauguccagugcuuacaugcacuuggcugcaauauucaguaauuuccaggaugaaccauagagguggugcuggcuuuaaucugcugaaugaauuaaaaaccugacacugaaacuaaacccagggaacaacauaacaaggccuggggcaaagaugguggaugcuaaguucuuaaucuaacuaguaugcuguuuacuaaauuaauaaaaauaaucaaaccagcugacacuuagcacucccacuuucugguugcuuuuucagucacgacauuaaaaccuacuuucuagcaugucuuuccucagaaccuuagacuuugccaagcaaugguugugguuaucaaugucuugcuguacuugccaagaacccuugguagcaaauucucuugaccucauaaucuaucuucuuaucugcuuccucuaagagcuugccuuaacuucuagccugucgggcagagaccgucuuaauuauucagaugaugucugacuucaguagccucaucuugaaaagcacucaauaagagcaaaugauggugauuggagucucucuaaaaagcaggcuuucgcuauuauugaaagccuauguauauuauaagaacaagcucugucuccugcacagcacacguaaaggcuaacagaccaccaucaggaggagaggaaaagguuaagacaguaaacccuccuacacaaauguuccucuaauauagaacucgcaugugucuaggagguacauuuaggcugaauaacuucaguguucuaugcaguuuuucuucagugucuauucccaugagucucucacaguagguaaaacauuugccaccaacauaaagaauugcugacugaagucauaacacuaggaaugaagcugauacugaacaaaugccuuuuuuagaagugauuaucauuuguagacaaauaguuaacauuuacucuuuacagaaagggaaacggaggcagcacacuccauccuuuugagcuuggacgacugggcucaguuuguccaucaaauggacugcuuucucacugggacacugccgcauugugacaggagucauuggcagaaaguauuaagugugucuagugcucagaacuauuugcuagcucaagccauaaggagccaacugauccaaaacagagacaguacuaaugguacagagcacucaggaguaaaccacaacacacccgcuaauaagcccugcauggauuugucucgggcucuuguucgucugaucugagguuacauuauucuucucagacaucauuaacaagauagagaaugccacuaagcugcccguaaaugauguuaauuaguggcaagauggugaguauucuauccauguggcuuuucauuuaucaaguggaucaaggcucgccaggcuuacaauuuacagguaaguauaaauggucgguuuaauuuuucuauucuauauuguaaaaagggcuacaaucacuuuaaauaguuaauuguaaguaggaaaucuaaacaucaaauuuugaaaauaaauaacaaaacaauuuauaauuuuauuaggaaaauucacaaaacaccugucauuuuagucucuugaaaauccaguuucucauuuaaaauaaaaauucaucucuaauaaugauaccaauuuuaugauacaaaauuuaacugcugaucuaaaagaugcaauuacuaauugauauguaaaauuggacaaaaauuggacauauuaauugcauauuuguuauauuuuuuucuuuuucuuuauucuuuucucauacaauacugccugauugcagccuccuucuccuuccaggcucccccacuacccuucucucugggacacaaugcuccucuguauauuuuaauacauuauaaaauguuugaaacagaguaagcuugguuuuccugaaacauuuaucucucuuuuuuuuuauggugaaagcauucaaaauaauuucaccuuuuucuaaaagcacacaguacggcuaacuaagggcccacguccuaaacacacacagcaaugcugaaugcccacugaucaaucugugcugaucauuuccucucgaucuauauucuucucuccauuuccauuggauuaggguuuguuuguuuuuuuuaagaucccacacaugagcaagauuaguagauaucagucuuacuguaccuggcuuaaaagugcaaucuaaaaaagaguaaugugacuuuucugaaggcccgauggugcugaagaaacuacacagaaucguauuuaugaacuaugaauguuuagaaauauaugcucucuuacacaucugauaauucccuuucuggcgguaauuuaaagggcuuaguaaucugcacagacgcuuacagagcucauguguaacauuagguuucaaagcagagucuuaacugagggagaugguggucacauuucgucccagcacucagaagguaccauugcuucaagaccaaccuggucagcacggaaaguuaugggucaaucagaaauaaacagugggacacuuugucaaagaaaaagagaggggagaaggagacaucaggguugugagacuagcuugcccuuugaaaucacaauaucaaugaaugaguugaugggauuuaucuuccguggaugucugaagaagcagccauuucuauauacugguagaugucuguauucugucaacaucaaaccaggaugcugauuaaauuaaaugaauauuuccuaccaacgcauauuuucuuuaguguccauccauuuacucacuaccuuaaaaaggaccacuauauuaaucaucucaucacuaacaaguucaagcaaaaaugaauuucuccaauaucaccaauaacuuccuaguauuaacuccaaauaguuuuuauugauuuugcugacaacagucuaucauucccuuccccaaaauauuuuaauuaguuuuuguuuuauuaacaagaauuuuauauuucuccuuacuuuugucucuaguaaguuacuaugcuaaguauaaauauuacaguaggaucuuaaugcaucaaaaauauaaguagacgaaagagaaaccauaaucgaaauauauuauacaagaaaaaaaauauagauagauagauagauagauagauagauagauagauagauaaaaaguguaaguucuacuaauuaaaaacuaaccagucuuucagacuagcagaagacaguauuuauugugggaaaaacauuaaaagcauuaccuaucauuauuucaauaauuacaauacagacaaaauggagaaacuauucagacaauaaguacaaaaacuuauaguacuaaguuuagaauauuauauaauaugcuuguccauguuaacuuuacgauuaaaaauaugcauauuugaguuucaguugauaauuggcuuccuguauuuuuuucuuacugcuuuugaaucauauauuuauuuugaaacauuuucacucuuucuauaugcauaugucauagauauuauauauaauguuaccacuuaaucaaggcaaaaaacaaaucugcauacacaugaaaaggaauaaacuucuacaccaccaaauucucacccagugacaugacuauacaucugagccugucuuggaggaaagugacauaugggucucgcaucgugacaugucgaaaauagaauuguagauuuagaaauaaguaagacugacaugugaccugauguaaggagcaguucucuccaaagaaaacggugcucuggaaagaaugcauuccaaagaccugcgaaggagggucaccaaagguagcacaagcaguaacaagggcgggcugaaggaaaaacaaguauggauuuggagaaucuugaugaucacccagauaaaguucagucuuuaugugacucugucagccugauggaacccagagucaccaguuacagccucugcgcaugcccgggagagaugaucaccacgaggcucgcugagguaggaagacacauccccucaaaugugggcagcacaguuccaggugcuggaauuugagggugagugaaaaugggaaauggaacugaguccaagaggucaucacucucugcuugcaacugcggcuguaauaaaggagcugccucgagcucgagcugacacaccuugaugcaugccaugauggacugugcccucaaacugugagccaacguaagcccuuucuaucuucaguugcuucugugacguauguuaucacagcaguggggaaaguagcuaauaaaagcccuuccccauguguguaacgauaccugcaauucugcacaccacugauauuaccauuucauaaucuccucugcucuugccuagacuuauugauaagcuacagugcccgugauaguuaggaugugagacuugucaacugguguugcuugaaucuugagagcuuguaucaaauuugacagauaaauauauaagaaagugugaagagacauuacuaaguguugggcagacauuaaaucauauuaaaauauaguuagcagugaaucugaggaggcacaaacauuucaaccuuuuucucauaaaucaaaucacacugccuaccugauuaaaacccuuuggcuuuaaaaaaaaaaucaguagauccugauagcucaagucugucacagcaucuggucagaaugaugaagcagaagaaauucaacggagaagggagauagggugaugaaacagugaaagggagaguggaagaagaagaagaaaguaucaacagguagagggggaauggaaggugaaaggaaacccacaucacuaggaccuucaagacuccacaggaugacuuccugacucuaugacuauaucugugugcgaggggguagaggucagcaucuuccucaaugcuuuuugagacuggagcucuaaugucacccuauuuuauucucugccuaugucccuaagccuuagccuauccagugagagaaaaauaaagccauggugugagcucuaggcccuuggggggcgggggagaauaaugcauccuggccccuuuaccucucucucuuucaugcucugcagccaugagaugagcaccuuacucuaccacacauucccaccauacccuagugccucaccacagacccgaauacaauagucaguccaccacauuagacaaaaaaacaaaaacaaaaacaaaacuuccuuaaaaaacaauucccucguauauguauauagucuccauaauggaaagcugcccaauacaccuuccuuuaaauuguagcuuuugcagagaggcuuucucuagcaauggcauagaugcaaucaugccauacugccuaucucauuauguacaguuagaucuuccagaccuaugaauagaacacguuuaaaaacugguuuaaagauaaggaaaauuguuuugaaauauucuuucucauaguugaucuaugaauacagaauauuguuaaugcuuuggauuggaccauuuguauccacaaaaugucuaacucuucuauguuuauggucacagucaaaacuaaaagaugucagcuucuuccaaaagcugagaacauuagggauccuuuagcugaggagcaaagauacuagugcucacugaaaauguugcuccuugucuuucccucuccuccacucuccuuuccucucugugcacaccacacaccacacacacacacacacacacacacacacacacacacacacacacacacacacaccacaccaacaccaccacacaaaacauacauacgacauacacacaaacauacacacacaugccacacacaaacauacacacauaccacacauccucaaacacacacauauacacagacauacagacauacacaccacaugaaacaugcacacacaacaaaaacauacauacacauaagcacccacaaacacuuacauauacauaaacacauacaaacacacagacauacacacagcauuuacacaaacacagccauucacacauacacacacacacacacacacacacacacacauauacaaggcauugaucauauagacucuugggaaggauuaacaccaauggaaagauaucuaaauagacauaaacacucuaaacaccucauuuuugugaacaucuuucucccugaguccucgucugguauucugcuuaucucccauaaaaggugugaaggagucaaugaaaacauuuaagguucugcuaaagcugcgaacaaagccuaaguucaagccacagcuucagaaaaugaugauggcuuuauguuguuggcaccuuaagggcuguaacugugagacgacagagacauucuuaugaaauauagcagaacugaggagaaggaagacagaagaucaaaaguuaagaguggcugagcaaaucauucauuaguuuaaaauacaguugcugacaccuuaccaaaagauagaaggcaacgggcacuuggaaaugauaagaacaucacaaugcugucuguagauuccuuccaccaucuuuauagagcuuuauuugaaaguggguggaacaggaaggaggaagaugagacagaaaggaucaggagagagcuagaacuccacgugguaacgaagaccauaucacugacacggacguuguaugaaaugaguccccauaccugacuacgcaugaaacggacacucaaaaauaaccuucugcgggacgcacagaauccuguggcagaaaaauuaccucaggaacuuauuaaaaacaauccacccccaggcacggauucagaagguggaagugagaaaggcuuccuaaaaccacugcuuuaaaaccacugcucccaaugagaggugagcggguaaugaggacaaaagguuucuuuucauaggaagcagugagaagucaagagagaugggaaagccagcgaaaacguggggaccauuuugauggcacauagaaaaauacacacaaaugacugacuagauaaagcauagauaaugaguuacuguuuguccccugugggggaggggagcucugugaggugcuuucagugauuggcuucauuuucagaauaaaccugcaaacucuuguuacgauugccguuuucagguuuaaaaaaaguaaaucugaagacgagggaaaucuuuauguaaagaacuuagguucaaacaccagccucuuugaacucaagggcuuguuuucuguucugaauguaacgccaagucauaaacacauuuuauuagagaagucaggaugauucuccgugugggggcucaggagccuguggcagcgacaucacgcuugacagcggagaugugggaguagcauuagcucuguaagagcgagcuuacagacacaaggccgcagggugcauccuuauauaagaaggccaaaaugcacugaguuccauagcaaaguaaggaccacaggcgcaggagcaacgugacacacaucuucugaaagcaggugguguccccuuccccgacacauacugcuuucugauucacucucucugcucacucuagaaccuuuuguuuccugccacacuauuaucuucuugacuccuugucuucugaguagauuaagaauuugauucguaucauuaauuagcugacaauaugaacuggaagcuagcaagcaaauggaacuguucugaaagcagaaaccagugguuugcgauccuaucaggcaucuacgguccuucucacagggguuacauuagacucucaaacaaacacagauguuacauuacaauucacagcaguagcaaacuacaguuaugaaguaacaacaaaaauaauuuuaugcuugggggucaccacaauauaaggaacuguauuaaagggucacaccauuaggaagguugggaacuacuuguguagacaaucaaaucuuuugagauucuaaaaaauacaugcagcagauguuauaguuguguagcuuggucuucauguggaacuccuuacagugggaucaggggcugucucugacucuguugucugcccuuaggauccuuucuucccacuggauugcuuugccuagccuuaauaggagaggauguggcuagucacaugacaacuuaguauggcagggcuggcugauauccaugggaagccugcccuuuuuugaagaggaggcagggacaggguggagaagagggaggggaaaaacagucuagauguaauauuaauuaauuuuuuaaaaaauauguaugguagaaagaagaacuccagaaaagcuagugacaauaacaguuaucuucuuuugguuugguuugguuuuaguuuuuugguguuccaagacaggguuuaucuauggagccuuggcuauccuggaacucauucugugaaccaggcuggccucgaacucaaagauccaccagccucugccuccugagugcugggauuaaagguguguaccaugacgaccaccaaacuaaaaagagcuacuuuuuuaagauccaagcgugagauugaaccacacacauagauacuuuuuuccauuuuucuauuacugguuucaauucuaucacagccaaucccaagucuucagcuguuauuugcugagugaauucccacauucuuuagucaaggauuaaauggucuuaugguaauauguguuagaagcaugagcaguuucaucaauuucucugggcugcuagucuacuauuccauugaaauuaauuuacucuucaaggugaaaaucauuucccuggacagagcaguaagugauucucacagugagcuugggcucaguguggauuuccucccgugucaggcgggaaaaugagaucuuuucauaauggcaagcuguccgacaccuucauuccaaaaccgcaugaagaaguccccaaugugcgccuugaaaucaaauugcaaauugggugugcuacagcaaaugaacaaagugauugugaaaaggagcuuaaaguggucgaaaauuaauauggccauuaccuaaaaggugcgguuaggaaaagguucaauuacuacuaaacuuucaagaaaauauuacaauuauaauaacugcagaaaauauugguuuuuuuuuucaggaacaucauaauagcugugggaaagcuuaaaaccaagucauagacaagaaagaauaaaacugucaauaaaaccuggcagcagacuauacaaguuaacuuugaaaaacucauaaaaauuaaaauacagaaauucaaaguauuuggagaaguucuacugcccuuggauaccuuaacagagauuccauauuuagagauaguuuaguauuacauguuuugaacaagcaagacugggcauagugccuccuuccuguagucccagcacauggaaggguaggguaggaagauugcugugaguuuuggucuagccuaggcugcagagugagaaagaacauauacacagggaugcaaugagauguauuaaauugcucaaauuagguagaaaaagcaggaugcugacuagcuaaaagcacuuuaaaaauagcacagaauggcagaaaauauuucauaauauaucuaggaguuugaacuuagcaauauaaauaaugagccauuuuuuuguucuuauaacaaucuauauguuauugagaauugaauaaaguauuucuaacauaagguucuuugaguuauauguaauuauauaagauaugacuagaccuaagauauugaugauuuuauacugugaagaagucaauguuauaauuuaacuuaguauuaaauuuuacuuucaaaacaaacuugugagcuauacguuauucaaaaaaauaaaacaacagauuagauucuacuccuaaguauauaucaaaaucagauaucaaacauacuuauuguaugccuauaacaaguucaauucaucaaauacguaugaagcaugugucuaugcuuaaaaacacacaugcagauuaauaauuccccuguguucaagcagcuuacaaagcaaaggcaaaacagaagacuuguguacuaaugauauaaagcagauuauagaauuuacauaggguguuuaaaaauaaagcacaauaauauuugaucuaagcauuagcacuaaauauagaaggaucaaaaaggaauuaugaagaaugguuuccacaagugagauggcauguaaaguaauuauacguagauaaagccacaugaacacagaagacaagcaugauucaguguugcgcuuuccugaaacauugcauuuacgcuauauauuacauuaauuauaccauauuauaggagaucagagggaacuguauacaguagcuaaaacugccagaccuuaaaaggcugguguuacauuuuugcacuaaggaucgggcauugaguuugaguagaaugcuugacccaagugcuccuuaugcauagccuuucaugaaaggugggagacagugggggaggagcaagcugagaaguucuugaaauaacugagguaggagguggagaaagucugaggccaggaagaugacaggauuaacgucaagcuggggacaagccaguguugaauauacuuaggaaagauggaaaucauccgauguuuaaucauaggcuucuaauacauuggccaaaauuuuuacaugcacuauucacccaaauugaaccucccucagcuuguguuuaugcuauuggcacuucgguagcugaauuacaggacauauuaacccucgcuagacuucagaccuuugucuugagcuaggaauuucuguguaugaaguguauaguucucauaggcaccauuccuacaggguacagaccuacuugugaccuaccuguuuuccguggcaaaauacuaagagugacccuagcacggaacguuugagauagcaauagagaaaucucucuacauauacaaaaauaaccauucaaaggucugaacacaagagaugguaaaacagcucuuuauaugguugguagaaggugaugaugauauuuucugauaaagaaauuaccuuuuggagcuaucaagucauucgcugcccauaaacuagcacagcaggcucggaaagccaaggccauauaauuuacaaucccauucucucugcauggcuacacuguucccuccacagaaagguggcucguguccugugcuccgaauaaagacagucucuacugaugacaucagcaggcucuucuccuuguggcaaauuccucacgugucuucauccagugacccuuagccaagagaccaccacaugaaagacacugugcuuggcgaaauuaauuagagacagaccaaaucuauguaggggugguucugauguuguccuguuccccaauuugguuuugaucugucaguaaagaagccaggggccaauugcugggcagaaugaauaggcaagacuuccaggucccuggaggaaaagagagaugaaagggagaagagacagaguucuccaggcuuuggaggagaaaaguugaccagccaugugagaacucaaaacacagccugcuccuacaugcaggcggucagagauguaacugagcaacucaaguuuaggacaggugugaggugugacgauaagaauauuuauaagggcacaauuuuccaggcgggagauaguagcacccagaaauuguaucagaaggcaaguugaaaaugagcaaccugugugugcaucuuuuacccauggauccagggaagcagggugggagcugguagcgagacccguucccagagcuuaggcaggguaguggaagcuacacacaacauagaccuccucaucacagagucuauuagaagcaacgugucaauguauaccacacaaaaggcaaagcgacagcccuugugaaaggugagaaccacgcggcagcucugaagagcacccguuuuucucaaauaccuuccuagaaauucuacagauaaaguucuuccuaaggugaaaggagggucagaaauugaucauucucauucuagguuuuuuuuucuuugcgugcacuauauaucuagugcauauauuucuuaaagauaccagccaggaaguauuaauauaggaccacagauugcagcuucuauguauuuuaauuccuagaaaaaucugcuaagaaaacucaaagcuggcugaauauauggcagcucugagucguacuucucaaacuuuuguuccagcauaaagauauaaaccguaguucgaaauuuucuccugaccaccaucuagguuuaccaccacuuaagacuuggcaucacuaucaaaaagcgcauuuaugccggagauuuacuacuaacccuguaagaagagcccuuuacuuacgugucagaaacauacaacaaaguagccacugaggucucucuauccuaaaacacaucagaacauguuugaacguaagccucauuccagaaacagaacauacacugcaugugcuuguauguguguguacagguaucuguguccauucauuugugugcagauacgccuaugugugugugugggggggggggugcaacugcacauggaaaugcucacacggaagccagaggucaaguuaugguguuacuccucaguagcuguacaucuuuggggggcaagaggagucucucgcugagaccugagguuugcuaagugacuuaaguagaugaccagugguccccagcucccugcagccuccaucuccccagccuugcgacuguaauauaccacugucccuggcuuuucguuaucuucacaaggguucugagaucugaacucggcucuucacauuuacacgucacaagcacuuuaccaacugagcucuacccgcaggaccagcaucugacuucuggacaaucuaauaaaauagcucacacuucagaaucuggcaugcaauugaagaguccgcaguagaagcguaagugaaauaagagaagugcuacacacuggcugaguaacacaacauugaccaugcuagcacaucccuggacaaacagagagcgcuggaugcgucuguaucuggaguuuccuucaggaaaaagaaagaaaagaaaacguuucuucaggcaacagucuuacccauuucuuuaaaggcuaauaagacaauaaugcuuuuucuauuuaaaucuaagagaaauaucuucccgauccaaucugucauaaucuuuauauuauaucauaucagaguuucuacagccugucauauucaccuuuaagaauuguguauauuguuuauauaaaugaagaauauaaaugaaaguggggcuuaggaaaauaaaugaaaacaauaggaaaaaauuuagaucauuuuauauucugucaaagacauaaacuucauaggcugguaacaaauaugaugauauuucuuuaaaauucauauccgagauuauauaauguucugauucaacuuggaaaauggucucauaggcauaguauaagagcauucagaacagauuaacuuuugaauuaaaaugcaagcaagguaaaauaaaauucuaacuugagcuggucuucaaauuaaauauaaaucccacaauauuaauaauaauagggaaagacuuuuuaauucauuuauaauaguaaaauuauucguauaaaauuaaacaucucugauucaaaaaacugaacguucuuacauaagagagcugauuuuuggcuuaaaauccugcacaagagugcccucuacuggaauaaaagaggaaaggaaacuugcaucgaacucagaaggguaacagcuaaaaauacucugcguuccagcuccaucgcuaauguguaaaauacacucaugaaugauaggaaacucagaacauguuuuccuuuuauuucauaauucccuaauuacuugugcaaugacgcauagcaccaaaaugaacaagcccaacauuuuggagcgucuaaaacuaaaucacauucagacugguggcucaucacauugcuagaaauauaaacaacaaacaagaauguuuuucuacauuuaaagcuuugauacaguacgaaaauaacuuugcaaguccaaacuggugucagaacauaauuugaauucucuuucauugucaagcaaaaccuuccugguaagaagaaaguuucuaccccuuccugauacacauacugauguaccaacccccagagacaguagagcacaggacucugggagguguccaggugaugagcgcauagcugucagggguggguuaaugcccacaagcaaagccagcugacagcuggcuuuuucccucuguccccagucauguggggaaacaaugugacucuaaagacggucacucccaaaccaggagguggucucuuagcagaugccugcuuugccugcagccuccaggaauaugagaaauguuugccuucaagcuacacaagguacaguaaauuguuuaagagucaaaacuagucuauucccuaguucuagaacuuaaacacaaaugauuaugcuagauaacugaagaaguaagcuacaagauguaugagauguaugagauuuguucagagagagagagagagggagagagagagagagagagagagagagagagagaaagaaagaaagaaagaaaacuuaaaauuguaugacguuacuaggaccuaaaguucuacucucauuuuagaccuaaauuagcuuguaaagguccuggcaggauuucugucacuagaucaacugugugccugguuagaauacuguauggggguucuuuaaagauauaaauaaauaaauaaauaaauaaauaaauaaauaaauaaaacagugcuuagaacaauuuuuuuuuccaaacggggucuggauaucuagccauggcuggccucaaguuuguuguacaucccaagauggcuugaauguacgauccuccugcuucaccauccuaaauccugguacuaacagaugcacaccaucauauccagcucccucaauggcuguuggccaaggggguaugguaugacaucucagugcuuaguuuguaaagccuuuccugguuacucuaagacaaagccauugaugagaaccacugucuauucugaggauaugaaacaacccaccaccuuuaccuuccaaaacaucaccuucaaggaacucccuggaagcuuauucuccugaccugccuuuguucucuggugauacggggaaugauacacgaaaugacucugguuucagagccaggaucugaaccaaggcauucugguugugcacuugugggaaaaaaaaaugaucaaaccucucugaggcuucccucucucaucuguaagguccaccuuggaggauaauuguguguuagguuuuaucauuauccauguaacuuuuauguccacugugguaagcauucuuugcaagauauacauggauugucacuucugcuucugcacacaccauuucuucaggcucugggccuuauccauaugugcaaagcacaccuuccccuuuuccaggacccacuuuagucuuaaccuacacccacagugagccuucagugaacgccuguagaucucugaucucucacuucuuaaaaguuccacuggccacaggguaaguuacuauaagaaauccuauaagaaauacagcugagaaaauaaaauaccaacucuuaguuuuaaaucaguggcucucaaucuuccuaacaccgugacccuuuaauacaauuccucauguugugguggccccacaacccauaaaauuauuuuguugcuacuucauaacuauaauuuugcugguguuaugaauuguagaguaaauuuuuuuucugagauagacguuugccacaggggucaugacccacauguggagaacaacugguuuaaaaccucacuacgguacaugcuguaucaaguccuaaauuuagaauuucauugguaggacugcucagugguuuaucucuuacagagaacaggguauagcaugcaccuaucaagcaucaacccauaauauauguauuugucuuauauguuacucuucucugcaaacagcaauugaagacuacuugagauuauaguuugaaacucuuugaagucaccuacagucuugcuuauuacaccuacauagcuauaauuuuaaacaugacaauagcuacuuauauuaggcagucaaaaagcacuuuauuuaccugguuguauagcaagggaaugauuuauaguaaaacucaagaaaaaacaaaaacacuucaacuaauggaaacaaacauuagauagacaggaugaauacaaauaagaugcaggccauacagaaggucaaugaaauuggauuacguuuucuaaaugcaaugaccaguuucuaucacauucauucucugaaaggccaguuccaaugaugucauuuaacugccccaaauccuuugugcuuuucucauuuccuaaggaauaaauaccagaagucuuagccugauauucagacuaccccacaccuaacuucauucaugcuucuaaguuuauuuugcauccuuuccccuugguggauucuauuacaaauaaauaggguuacuugauccuauguauacugucugcuguuuuaccuaauauagccuuugguauuucgguaugacaguuguuugaaagaauauuauaaugauuugucacucgaacaaggaguguagggauaccugggcuaaacuuuaaaagacuuaaguucaacaugugggcauuaauuucucccuugccaccaccacagugcaaucuccagguaagaaaagaaagcagccacccuuuccgaagugugcaccauccagccaccagccccugucaucacacccaaaaacauacaaguaucauuccaugcagaauucaggccccagggcacacagaauacagaguaaaagaaaaacaauuauagcuucugcuuuacauugccuccuuucucguaguucugaauuucuugauuccuagugcaguaacucucucauaguuuacauguguagcacuaggaguauguguguguauguauguguucugugugugucugugucuguaccaauuuauuaggaugcuuauuccaguuuguuuacaacuacauuuaacaaaagauucuucagaaaucagugauggacaaaauuagggcuuugugauuuagaaggagggagcuugaauuuaccaaucgguaaaaacguuuaaggauggguguuaaaguccaggcaucauaaauuaguuaugcagcacaacuccauuuaaaguucuaagcaaccuucuagaaguuguuaagguacaaucaguuuuacuuugcagacagcacaucucuguuuuagauguuuaaaaggaaauuguaugcugacuacuacaaacaucucgucaauggaggauuuucauuuuguaaaaccuauaagcuuuuuuggugugaugcauauacaauuauucacgcucuucgcuggaggaaggggaaugacguggcagcccagaaaagcaaauuggaacgacaacaaaaaaaguaggccugagagguaaguuuagccauugaacuagaucggcaggcacuucauggagaaucggugucacgccucacuugaaggaacuagaugaagugcguguucccaaaaugguucccaggugccacacuuagaugcuuuuuaaauuuucaaaauacuaugacauacuuaugagaaucugcacuauuauucacuggccaguaaaacaguagagccaguacugcucuaacaaauuaaguccuagaaguggguaaauaguuaauaucaaaauaucugaucccuuuaauaccucuccauacuauaaaucauuccuucauaggccaaagguauguuuauaacucauaauuuaaaacugauugauuacaaucuuucuugcuauuguugguaugaaaaauccaugcugaacaagaauauccagcuccuacuuuagauucugaggucauaagugagaaucgccggacaccuaauauuauggaaacacgugagcugagauaucccaccaugaugucacaaugacugaagaauugcacaugcgguuugacgcuaucuuuguuuuaagaaaggacuuggaagaauguggggaggacagacaagagaaauguuuccuucugcgggaguugagauaguuaugcucaguuauaugaaauauccucacguucaaagaaacugcaguuuccaaguugcaaaaugaacuguaauaguaugaauacuaucacaggcuauaaguauuuuuuuuuuaagaacugcacagcaagcaagugcucuaccacugagcuacacccucagucccuucccagcauuccuuucccuguauaaacagcagaacaagcaacacgaugaacagaaagacuaauagggacauugacauuugaucagcgcugaauccgaucaucuagucaaucaacagauccuaggccgcagggguaggcacugagcuggaaagacagaccagaugcagugucuuugucccgccccccuuacuuacuacacucuggcuuccauuuuucccaagcucuuccucugaaaucuugcucaaguuaucuaaguaguggucugagaucguauggcacagaucuucaaaggaauaguccuuuucuuggcagaguuuuauuucauccaggaguuuugauaguucuccagugacaguuucaccuacaagaaaacaaaguuguuuucagacgauacaagaaauacuacuacugaggugugauguuuaaucauguaagugagacugccguguugacagaggacaaaacacaacacguaaguggcuagaaacaucaggcagaagcaaggcacuaagcauaauuaauacgaccaugcuaacagacaaaggaggcuccaauuuuaacuguagcuauucuuugccaaaauagaaaucaguauugaaaguuuaauuacagacagugacuaguuucuguagcuuuauuuuuuuuuuacaguaauuuaacuuucuucuuuuguggcagcauggaacucgaacucagggcuucacacaugcaaccacuaacaaucaaucacuuggacuuauuuuuuuuuaauuggcauuuuauuucacugacagaaucuaaucauucauuaaccagccugaaauaauauugaaaacuuauguccuauuucaacaaacauaaauaccauuaacuucuuuaaacaaagaacuauacuauagguaaucagaauugugauauauaaggaaaaaggaaaaacagaaggaaaagaugauuuuuaucaugugccaaaacuuauaguaaauaagaauuuuucuugacaucuucagaaaaaguacuuugaacucagaauuuacucugaaaauuaauugcggcaauuacaauaaaauuuuaauuaagaugacaugaaaugagcauagauuuuagauuuauuucuaguuuuuucuuuuauacugaucuauguaucuuguuuuaaugauugcauaauaucuuuuuuauuauugacacuucccagcaacaaugccaggaaccuccaacauggaaaagaggaugcuggagccugcauguuuguagacaggaaucacagugaauguaccuugugccauaugcauucaucagccgaaaaaucacuaagauuuuaaugaaggaaaucauaaaauccucuggaaaaagugcaaagcuuccugaccucagucugaaaaaugcuuuuuuuuuuuuuuagauaccaaaagcccaggguaauaaaucaaaguugguaaaugaacuaaaucauaggagaagccuucugugggacaaggaaacaauccauaaaauaaaggcagcuuaucaagugaaagaaaauguuuacaaaucauagaucugauaaaggcucaauaucugaauauacauguguguguguguguguguguguguguguguguguguguguguauucaguaaccaaacaagaucaaauaaccuaaauuggcuaaauuggcaagugauauacuuuuauuuuucaaagaaagaaagaaagaaagaaagagagagagagagagagagagagagagagagagagagaaagaaagaaagaaagaaagaaagaaagaaagaaagaaagaaagaaaggaggaaggaaggaaagaaaagagagaaagagagagagaaagaaagaaagaaagaaagaaagaaagaaagaaagaaagaaagaaagaaagaaagaaagaggaaggaaggaagaaaggaaaggaagaggaaggaagaaagaaagauacauuaaaaugauaugcagcaucacuggccaucagggaacuaccaauuaaaaccacaaagaggucuuguuuuacaguuauuaucaaaaugauaaaagaaagcaaauguuggagaggccuggggugaagaauuuuguguauacuguugugggaacauacaggccacuguagaaaagcaugagagcucuucaguacagcaaccuacuucagucuaacacucucccagcugagcuauuucagcccccaguaaccgacuucuaaugucuaccucuaguaaauaaaaucgacaucuugaauagaaacauaugugucccauuuuaacugaauggguuaggauugcuacgauaugaggaaaaaauuaagaguccuuuguuggauggauggauggguggguggguggguggauggauggggaaaauacaaauggauaauagaccacuaugaacacuugugagaagggugccuaucuuuugaguaagcccugaugucacuggaagcugagcaagcugacgcugaaauaaacaaauacuggaugaucucacuaacaugagcgauauaagguuaacuuauaaaggcagacagggauugugguuagcagagucuacaguaggaaggaaaugauggagagagugauuaauggguucacaguuucagucaggagagaauggauuaacucaggaaauuucccaugacauuugauacuguuuucaccaacaaaaaguggggauugugcaaagugacacauuuguuaauuaguuuagauguaauaaucaacucacugugugugugccaagaccucacauuauaugcugcaaauauaaaaguauuugccaaauacaccucauaaagcuagagaaaauacauuucuacuccauauaaacuucauuacugggauugcuaacuaccuugcuuguugcccuaugucaguaacacaugcaaucagcgacacaugcaaucccuaggucagugacacauguaaucccuaugucagugccaugaacaaucccuaugucagugaugcauguaauuccugugucagugacaccuguaaucccuaggucagugacacauguaaucccuaggucagugacacauguaauucuaugucagugccaugaacaauccauaugucauuaccaugauaauuccaaacaaucagcagaaacucuauaaaugcugacuacggaaauauauaaaauaugaaguauaaaccacacacacauacacaaaaaaaaccuugauuggacauuucuauuggugccaacccuuccuaugcacuuugacaaauuugaccagacaugacuggcacuguuucagggguuuaaccaacuacgcacuuuuagucuuuugaggagacucggcaggagacgaaaggugugucucuugugcuguaucuuccugagcaugcucuuccaggacugcugcugaccuuccugcgccuuccaaguaaucuguggguagaauuaaaucugugaauaugccauugcauucaugggugcucaaaaucaagagcuaccacaaauaaaucccaaguuuuuaaagaaauaaaauaaucagaaacugaaagaaguccaaaaaauucauaagcugugagcuuaauaaaacauuuaaguagaaacaguguuuccuuagagauaaacaugucugucgaagacauaagcauccccuuaaucuuguuaaauauuuucuguuugacaauuuaaaguucccccaaaagaugcuccgaauagaugugaucuguaaaacugagaugcucgauuccaaugggugugaucaaccaccugggcaacaggagugaaugaaacggacagugguggugcaagcuuaaaagauaagcacaacacucacacuaaacuucauuuauauacagaaaaagucauuccugucacucuugaaggaauauccugcaugcaaccuaucuuucacuuuuuucuuguuuguuuguuuuuuuuuuuuuguuuuugauagaaccauaauaaauaacagcaugauucuaaaugcuugacauaaguaaagcuucuuaauccuuacaaagcuggcuuguucacuauuauuaucucaguuuguuugggucuguguguuuguuggagggggugcuguuaguuagauuugagauuugagacaggaccucaucauguagcccaggcugaccuugaacuugugaacuuccuggcuuagcauccugaguucugagcucacaggcaugcaccaccauucccagcucugucucaauuuuagagaugacaacucacaagaggagugugacaaacuugucccacuacuaagugguggaaccagauagagaggggacaucaaaacaugccgcuguugccuuaaucaaaggggaaacgacacugaaugcagugauaagugucaaugaacacucagccuggauggcacaggaagaacaggccaggacagaacguguuuaauaagacagcaggugcgccauuuaaaaguucagcacuuacauaagauggaagccuguauuuccacagaugccaaaauucugaagauucaacuacaauuguggauuuaaaaaaaaaaauguugacagcuaauuuggauuuuauggaagcagugcugguaaaauaucucuggucuaaggaaaauaucuguuauccacuaaaauauugagcccauguagggcuagguuauagccuccuucuaaaggggaaaaucagauugucucccacugggcuccuuugcuuguguucuuuauucagaaauaaucugcuccguaagaauccacauuguaacaucagccaguuaucaccuucagaauaauucagaccaaaggacaaauuuccaaggcaaauucuacuagggcaagaaagcaaccugcaaaauuguauccuaaaauauuugucaagcaugaagugacgauguagauugaaaagcaacuuuaugaaaacuugugaguugcaauuauggguaugauagacuggcuucacuucaauaccaaccuuuucauuuaauuuaaaaggcacagcaacuugacauccaagaaagaaaagaacauaagguauuuuccaaugugaugaaauauucaaagauguccuaaugugccccagugcaaacuggcacagauaaucaaccuuggccuuuaagagagcagacaguuugcuccuacugaauauuuuuaacacauugagccagcguaauaugucuaaaaauucuaaaauuacaucuugccccauuuuaguuagaaaguuccauuuuacuuucucugaaagauauacacaaacuucaagguuuuuuuuuaaaguucaguuaaaggucaaagucuagcgucaaaucaaagugcccugaagguagaagaaauauccacuaggcacaccacuuuuuagcuuucauucaacuugguucaauuaggauuaauaagacaaguuguaguuggauucccugauucauccggagguguucugaccucugauuagcuucuuuagugaccacaaaacuagaggggccuaaacucccugugaagguuuuagaaaucaguugggaaaaaggcacaauggccauuuugaucuauauacuuuauuugacgcuugcugacaucuacguuuccacagccccaucugguuuuaauucucacauuuucuuagaaaaugauguuguaaaaagagucccaacugacaaugaauaaaacuggcaugucccccccaccucuccacuacugcacuuguggccaaucuacaugcauaagaagaagcaaucagaauucguucagccaaucuacuguggcuguugucaauucgacauucauguacugucuaccacuuagcacagaguggagacugaguaagagcaaaaaccaucucccaaggcuucagugucucucgcuugugugccaggugaugauauaccacuuaauuacuucauggucauaggaaucagacaaaauuauagaaaaucucugaaaaaucuuaagguauuauucgaagaaaaaauaauaucuagucauugccaauucagauagccuauucacuucaagcuaucacaauccacauuuacuacaugaguuucuuaaaacauuuuuuuuaauuaucaagcaguaaauaaaaacuuuuccauacugagcaaacauugaacuaaaacauuuuaaugaauuuuuauguagcuuaaaauaugcuagaaaaaaugcaaaugauuaguuaauugaacauuaaguaccaaaucaaagccccaaauaaaaauuacagcuuccauuuaaucuuggcuguaaggcaaagucacccaucacucggugcuguuuaccuugcaagagcguugcaaucuggagagacuucugagacgggugcucuuuuagaaugucuaagacaguucuaccuaaacuguccuuuauguuggcaucaauuccuggaggagaaagaaaaacuagauguaccacuggagcguccucagaugauacugccgauauguaaccguucuaauuucaaacgcauauaggccaagcacugaaggugauuuaaaaacuaaguuacccacauaagauuuuaacaagagagaagacaggggccugaugucacuuaaaaacugaaaaauuccggauaaugaaucaacucuccuaaaguucucugaaacaaucauaaagguuguuuuucaggacccuugggucccuucuggguuguagcuaguaaacuaaauaaagagccuacuaucaaagugaaaaauauguuucacucaucaccugaaacccuaaugugcgauagccaggugaucuguauauucuguauaauacaauuuuaauuuuuuaauaaaugauaauuguauagaguguaauguaagaacgcucauagacuauuugaaauuaacaaauuugaaaagguaagaccauuucaagggucuaucuacugugccuacagauaucuccaucauuuguucauuucagacuaucuucaguugccggcuacaugggcuauuuaaacaaaccugcugaacuguguggcugaaacaccucugcucuuguucuaguuccaaaauuaugugcuguacuagagaacuuauuuuaaucuggggauuaguuuccaaaacucuaauacaacucgcaaacuuucuaaaugccugauugcaaacgaagccaauguauaguauuuaucccagauguuaguuaaccauaagauuauuaaauacuuguuuaagcuuaugugagaauguauaguauauauuuaauaauuuauauauuuaauugguuuucucaugccaucuaucuauucuauuacugggcugccugucaaaauuaauaguaugaaauuuuaacauaggguaagcaggguaacaacaugauaguauaccuauauuuuucauuuacagaucaaauuaaacacacuaaacuauagaacaugacuuaauccugcuguguacaguaauaauuuguacuccuacuuucgauucuuaaaaacuguccucaauuuugacuuuauuucauuacaaucaaaauaugcauauuauauaaauaagccuaccuuuguuuuuucuucaaaauauucccucuaaaauauuccuuuuaaaacugagccccgguagccaaugaacaacagcuauuuggcuuaugagugaucagaaggagaacauguccuaagaaaaagggacacaaaucucuguuggccauaggucacaauguaaaagaccaacaaaccacacagcugccauaacuccgcaggggcuggucccucgguuuuccuuuuccucuuggugguugcuuccagcucacuuaaauagaucaguuguaucaaggcccacuucuacaugguaugacuaccuaucucaaauuggagaaaagugucauuugugaagaaagccaccaucuucuuucaucuaacccuggaauagauagccaaaguaccuggcaggacaggcuccauggagaaccaugauagcuaccuguuucuaacagaacucgaaccacauccaccuucccaaacaaagccgcuucgugaagagcacuccccuuuucugucugaaaagaaaagagaaagaaaaggcauagcugcauuuggaauucccacagauuugcuagcauuuaggcacucaaacagcuuuucuacaaucuuggagcucugugucauagaagcugugugugugugugugugugugucugugugugugugugugugugugucugugugugugugucugugugugugugugugucugugugugugugugugugugugucugugugucugugucaggggugaggaaaaggguccaggagcaaagcccagagaccuguaucucuacuucugaauaguuauauuaaggaagugacucaccuucucuuugcuucaaucuugcucaaccaucaacuaagaguguuaacgccuauuacacagggcuuucaugaguaucuauuauacacguuauuaaacacguagagugaaaggaguuauaaacagagaacuaucgucuuggacccuugcauauucccauuacacucaagaggacaaauauguaaguaggcauuuaugaugaaugaaaucugaacagcuuaaaguggcauuugcuuuucucugcauccuccuaacccuccggcugacucacacacucugcuccaggcacacugaccucauucuuuaucaaugcuacugcuguucucugcauuucccuccacggaugucaaaggcccauuccuuuacaggcaggucaaaccccuagcccucucgaucuggauagcuuguuuucaauggucaacaugaaucauaaucacuaggggaacuuguuugaaaacacaauucuagccaugcacagugacacauuacuauaauccuagcauucaggaaacugaauaaaaggguuaccccaaguucaaaggcagccugagcuaccucuaugagcucacuauguuagugagcucaaggccaguuugagacacacaguaugacuugugaccuuaacuuauaaauaagggggugggagcaaugggacuggaaagaacaguggccacucuuccagauaccccaugugauuccuaguacuuucauggcagcuugcaacccuuguaaaucuaaucccagggcaucugacauccucuucuguccucagacacaacacacacauaguacacacacacacacacacacacacacacacacacacacacacacaagcaaaagacccguacacauaaaauaauaauuuuuuuaaaugaaggaaggaaaaaaagaagaaagucaggaauaggaagcaaucaaggaaggaaggaaggaaggaaggaugggagggagggagggaggggagggagggagggagggagggagggagggagggagggagggaggaggaaggagaaaggaagguacaagguacaagauaugacuguuauagggagggaagaauggaagaauagagggagggagggagggaggaggaaggagaaaggaagguacaagguacaagauaugacuguuauagggagggaagaauggaagaauagagggagggaggguggaaggaggaggcaaaagugaagaaucagccauuagguaucuggaccccauuuccaguuuuuacuucuguggccagaaaggagagacccaaagauuccaacuucugccauguccccaugaugccgagagucuaaagggucuuuaccuugaggaccuacuaacugccuuacacucggaaccuuagcuuaauguaaccucauuaaggaagcugcucauugcccugaaaucuacugcuuuuccacauauuucauacccauacauauuuucuuuccauaguaaauauaauaccacauuacaaucuugcuuccugaaucaaccauaagccauaugcucaguagaaagguaaacaauaucuuuuuuuuuaauuguaugcuuccuuaagaaaaaucgggaaagauuucaaagagaagggguuucuugagcuauacaaauauccuauuuugauuucucuguggaaucuaacaaacuccuaguagcuccucaaugcuuggugugaauaauguuaauccauccauucugucuuccuguagcauaaguaacuacuauugggauauuuaagaucucaauuugaaacaauaucacuauaauaacauuaaauguaaauguuucuuuaauuaauaaauauguacuuuaauaaacauuuaauuaaaacaaucuaaaauaagcauauugggaagaaggcuugaguaacacugaauaucaacaagaucuguacauaucuacaaggcagggugauucaaguucucugaauuauaauguggcugcauuauaggugaugauaaaaacggaaagaaaaagguuauaaauauacagcuauguacuggaggaaaaagaaacuguuucaacucuuuuaaaaaguauuucaguguggacagagacauuuuccuauuccuugagaggagauaaaaagcuuacacuuuaaucuguguguuauggcuuggguauuaaguguuucucaauggccaugugauaaagguuaggucaccucauggugaccuuuaagaagugagagagaccuaagaagaguaucuuugaaagauaguguaagaccuagcuucuuuuuuaaaagauugauuuauuuuaugugaguacacugucacugucaccagacacaccagaagagggcacuggaucccauuacagaugguugugagccaccaugugcuugcugggaauugagcucaggaccucuggaagagcagucagugcucuuaacugcugagccaucucuccagcucugggaccuagcuucuugcccucuuuuuucuuuauauauguauguauguauguauguauguauguauguauguauguacguacguacguacguauguauguauguauguauguacauuucuuguguguacacaagccggaagcagggugagugcugggaauccuuucuuaaccacuuucccaucuuauuuuuugagaaagguucucucacuaaacccuugcucacuguuucagauaaauuaacuaaaucagcaggucgacagaccccucggaucugccugcuuuugccugucagcacugaagugacagccgcauguagccaugacugguuuuuaaguaggugauacgcauccaaacucauauccucaugguuaaacaacaaacaccucauacuaugagcuauuaccccaaccauuucucuuuuuucuuuuuuuccaguuuuauuuuccuuaaacuaaaauggaaaguaaacuuuaugaacaugcuauacugauaaagugcacaauuuaugaaauaacuugaagacuauuauugauaaucuccuuacauuaaguaauauuauuuuauagaacuuaguuuucaucuauaugcauacuuuuagugggaagggagacagagaaaauacacucaacuucuauuuucugcuuaacuuuguuauuugaaauacuuguaauauaucuuuaggauuaauaauuuuaauuuaaacuuaaaguuuaguguguuucuuagauauugcuguggucuccuuuguaucuuucguuaaauuauuaaaacugauuuacuuuagagcucucaauauauucauuuaacacacaucuauugagcaccuaauaaauguuggucuaaugcuaguuacuagggguguagugaugaauaaaauacagacuuuggcaucaaacucuucacacguuaaugagaucguuggugcuuaaaguaauuuuacacuuuucucuagcugccucaugauuucuggaauuugagaauuuuuuuauuaaacuaauaaaauugauuuuaaaauauacaacucaguauugacaucuuuuuuaagucaucaaaauaauuuauaauaguuaaaugccucuuaaauauacaugaugccuucugaaacuaaaaguaauaugcacucaaccaguuuuuaaaaucuauuuggaacaucaaacaugauagaaguaggaaaaaaaucccuugugaaguccucuauaaaaggaaauuguaacaaguucccgauuagacagaaacucuuccauccucaauggagaauaugcagcauagcuguggcuucauagaaugaauucaguagugguucuucuguuucuauuuuguagaauaguuugaagaguauauuauccauucuaauauugaauaaaaucaacuuucaaccaaaaguuaucaaaaaggauacagaaggacacgucauauucaucaaagaaaaaugaacuaccaagaacucucaauucugaacaucuaugcuccaaauguaaagacauccacauucauaaaagaaacucuacuaaagcucaaagcacacauugcaccucacacaauaauaguaggagacuucaauaccccacucucaucaauggacagaucauggaaacuaacauaaguuauagaccaaauggauuuaacagaugucuauggaacauuucauccuaaaacaaaacaugagguguuucuugcagcaucucaugguacauucucuaaaauugaccauauaauuggucucaaaacaggacucaacagauacaagaagauugaaguaaucccaugcauucuaucagaucaccacagacuaaggcugaucuucaauagcaacaaaaacaguagaaaucccacauacauauagaagcuaaacaaugcccuacucaaugacaacuuggucaaggaagaaauaaagaaagacuuuuuagaauuaaaucuaaaugaagacacgacauacccaaacuuaugggacacaaugaaagcagugguaagaggaaaacucagcucugagugccuccaaaaagaaacuggagagagcauacacuaccugcuugacagcacaccugaaagaucuagaacaaaaggaagcaaacacacccaagaggaguacauggcaggaaauaaucaaacucagggcugaaaucaaccaaguagaaacuaaaagaacuauacaaauaaucaacaaaaccaggagcugguucuuugagaaagaucaacaagauagauaaacccuuagccaaacuaaccagaggguacagagacaguauccaaauuaacaaaaucagaaaugaaaaggaagauauaacaacagaaacugaggaaauuaaaaaaaaucaucagauccuacuacaaaagccuauacucaacacaacuggaaaaucuggacgaaauggauaauuuucuagacagauauuaaauaccaaaguuaaaccaaguuaagauaaaccaucuaaacagucccauagccccuaaagaaauagaagcagucacuaaaagucucccaaccaaauaaagcccaggaccagauggguuuagugcagaauucuaucagaccuucaaagaagacauaauaccaauacucuucaaaccauuucacaaaauagaaacauuucucucuuucuuaugaacuagucacuaugaggugagaaugauucaugcaggauucucacuauggugugcagccuuacuacggacauaaagacaacagauaaacaggcaagaucugagcccuuugcagccaugaacaauucuccuaagagcucauuauuucaacagaauacaacacaauguaaaacuggaucaaugguccaaauuuaaggcugaugcaauuaacuacuuuauuuuauaagcuaugauaaaaacuguuaagagaguuuucccaacaauacaagaaacuacauacuacaguaauaucacaaaucccguaguuuauacacgccaacuaugggcucuguccuuugaaaaugugaugaauuccaaaauaaguacacacuuucaccguaaguuauaaaaauuuaagaauuauuuacaccauuccuuggcauaugcccaaaggacugaccacccuacuccacaaauacuuggucagccauauucauugcuacuguaucuacaacagcuaggauagaaauaacuuacauguccuccaaauaacaauggguaaugaaagaauaauacauaaauauaauagaacucuauuuuacugaaaaaaaaaaugaaaccaugauggcuggagagauggcucagugguuaagagcacugacuacucuuccaaagguccugaguucaauucguagcaaccacaugguggcucacaaucaucuguaaugggaucuuacauagucuucugguguguuucugaagauagcuacaguguacucauauaaguaaaaauaaaaccaugaaaaauuuaaaaaaaugaaaccaugaaauuuucagauaaaugaugaaauauuauacugaguaagguaaucaagacccugaaaagcuaagguuggauguucucucuuaucugggaauccuaacucugaaacuuuagaggugagugcauagccuggaguaacuacagaaacaaagaaaguaaaaaggagccauggguggggaaaggaauucaagagaagggacaauaggagugggaugcuauaaaauagguaacggagaaguagcacauagaaaaggcauaugugcaagccagagcugggcuaacuggucuaccuccaaauuuaacauuuuaaccacaaccucccgaggccuccaaaggauaccaaauaaagacuagaucuugauuuuaggcagaaacagagaauguugauaagauaauaacauaguagugguugugaucagcaggaaaaaucuacacuuguuagaagaauuauaaaagucucacaacuguaagaacuaauaaccaguggauaaguagaaccuuaauggggaucaaggaagaaaauacuacuaaaaacaauauuuaauucaagaauaaaagugccuggcaccuugguuauuaccaugacacauauuaucucgggauaaaagaaaaguuccaaaggucagaacaucccagucuucacuagcaaagguaacaucuguaugagcuccagggcaggaacuuuuguguucuacagaugugucuaaccuuuuaacauugcaaaaugacauuaucaucuaugacauuuuaugccagaacuccacgaccaaauugcuaaaauagaaguuuuugccaggcuuggugacacacgccuuuaauuccaagcacuugggaagcagaugcaagcagauuucugaguucgaggccagccuggucuacaaagugaguuccaggacaggcagggcuauaaagagaaacccugucuugggaggaaaaaaaaaaagucuucuuuuuuuuuuuuuuaaagacucauaacauuuuuauaaaguuuaggauuuuguguugagcugcacuccuaccugcccuugccugcauucagguuauaauagaggcuggacauaugaaccucuuacuucaaguauguucaucuacacaguaccaacauuuucaggacuaccaucagauucuaaugugucuguagacacauuaagauuaagaauacauguggagaagagcuaaaauuuaaaagaugguuaaggcugggugaagauaggaaaauggaaauauagcaagcauucaaaugauucaaaaauaauauuccucccauucaaaaugggaauggacaccuccugcuuggggauuaucagcuuuugucuuugccuguccucucuucauucucccaaaggaagcauccuuucuccccauuaaaauuaacccuucauuuguguucuuuauugcucucugcuucuucuugaauuuugcucauuauguauauuuucacaauuucucuugcagcugcaaccucagucucuucauagaguccuuccacucuccaguagcauaugcaccuuuccacuacccaaaaccaaaccaaaacaaagaaacuuccugugaaguugcuacuacuucaaacuucuacccaagaucuuauuucucucgauucuacuuugucaaaguccucuuacuucuuccuggaaguuuuugucuccuuuuuguuauaaccuugacacauggcaggcaacgccuggcacucagugaacucacagagaacacaugaguguacgaagcugugcuguugguauuccucuuguaacuacuuuacagagugcuuuccauuaaauauucuucucucaguuucuuccuuucccuguauuuuuuucuuaugaaauucugugguaguagaugguugcucuacucuuccaauuuuuugacuauuccccuacacagugagccucgacuaagugguuaagagauuuuccuugaccuucaaauuaauuuacaagcaaaucucaaaacuguuuccuuuauaacaccaaauaaugaaacugugcccaccacaugaagaauuuuuacauuugcucugagggagauagaaaaacaauggagaguuaugaguagaaaaguggaaugaccugacuucauuuaauggcaccauugcuagcuacuauagugaaaccagacuauagagaaucuguuagugacugaacauuugugucucccccaaaacccagauguugauguuuaauccauacagugaguuauuugagcaaaaggcuuuuaaguaagugguuaaaucucuaguaaagugcuaaucugaugggaccagugucugcagugacagcagagaacuugcucuccauuuguuuguauucagaagaaaagucuccuaaaagaaaauauuaacaagacaggaggagguuguuaacccaaagcaagauugcugaaauccugauccuagacuuuauagccugugaaaaaaauuaauucuucuugcauaagcaaaucagacugugguauucugucaaagcaacuugaacaaggaaaggaaggaaaggggaaaacagaggaaggaagaagcaagagguggugagggucugagcugaugugauaaaaugggagguauuguuaaauagugacauucucaaccugaccuuggagccugugggaucugcucugagcgagaugaaugugaauguuccuggcauuuguugaaauaggggaaagaaggggcuuggcaagcuaagggagaaaugaauauaaaagcuaaauguugauuugggaaaccugaaaugugggagucuccuuauccaucuaauaauauauccaggaaauaauuauacauaccaacugagaguucagagugaaauccagguuuaaaaaaauaaaaguaaaagagagaaagaaacuuggugguuaucagauaaauaugucauuggaaggagagaagagguuaaaugagguuaacacagaaauaagaguggacauaaaggaagaauaucuaaaugcaaagccauggggcccugaugcauggggaucuggucaagaggauacaauugugggguccugauggauggggacauggucaagagaaggcgaucuggggaccugacggguggagaccaggacaagaggcaaacauggaaugaaaacgugagaaacucccuuccgcuccacucgagccccaggcuaccuugccagcagacucgcgugacacccgcaagggcccacacaggauuccccacgggauccuaagaccucuggugaguggaacacagccccugccccaauccaaucgcguggaaucugagacugcgggaaauagggaagcagacuacccgggccugaccuggggcacaagucccucccacuccacucaggcaccgggguaccuugccagcggagucaccugacacccgcaagggcccacacaggauuccccacgggauccuaagaccucuaucgaguggaacacaacuucugccaggaggccgguucaaacaccaaauaucuggguaccuucccugcaagaagagagcuugccugcagagaauacucugcccacugaaauuaaggagagagcuacccucccaggucugcuuauagaggcuaacagagucaccugaagaacaagcucuuaacagugacaacuauaacagcuagcuucagagauuaccagauggcgaaaggcaaacguaagaauccuacuaacagaaaucaagaccacucaccaucgucagaacgcagcacucccaccacaccuaguccugggcaccccaacacaaccgaaaaucuagacccagauuuaaaaacauuucucaugaugaugauagaggacaucaagaaggacuuucauaagucacuuaaagaauuacaggagagcacugcuaaagaguuacaggcccuuaaagaaaagcaggaaaacacaaucaaacagguagaaguccuuaaagaaaaacaggaaaacacauccuaacaggugaugaaaaugaacaaaaccauacuagaacuaaaaggggaaguagacacaauaaagaaaacccaaagcaaggcaacgcuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaagauccuaacucaaaauauccaggaaauccaggacacaaugagaagacugaaccuacggauaauaggaguggaugagaaugaagauuuucaacucaaagggccagcaaacaucuucaacaaaauuauugaagaaaacuucccaaaucuaaagaaagagaugcccaugaacauacaagaagccuacagaacuccaaauagacuggaccagaaaagaaauuccucucgacacauaauaaucagaacauuaaaugcacuaaauaaagauagaauacuaaaagcaguaagggaaaaaggucaaguaacauauaaaggcaagccuaucagaauuacaccagacuuuucaccagagacuaugaaagccagaagagccuggacagauguuauacagacacuaagaaaacacaaauuccaguccaggcuacuauacccagccaaacucucaauuaccauagagggagaaaccaaaguauuccacgacaaaacuaaauucacccauuaucucuccacgaauccagcccuucaaaggauaauaacagaaaaaaaccaauacaaggacgggaacaaugcccuagaaaaaacaagaagauaaucccucaacaaaacuaaaagaagacagccacaagaacagaaugccaacuuuaacaacaaaaauaacaggaagcaacaauuacuuuuccuuaauaucucuuaauaucaauggucucaacuccccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcuggaguagccaaccuaauaucuaauaagauugacuuccaacccaaagucaucaaaaaagacaaggaggggcacuucauacucaacaaaacuggaaaaccuggacgaaauggacaaauuucuggacagauaccagguaccaaaguugaaucaggaucaaguugaccaucuaaacagucccauauccccuaaagaaacagaagcaguuauuaauagucucccagccaaaaaaagcccaggaccagauggguuuagugcagaguucuaucagaccuucaaagaagaccuaauuccaguucuucacaaacuauuccacaaaauagaaauggaagguacucuacccaacucauucuaugaagccacaauuacucugauaccuaaaccacaaaaagacccaacaaagauagagaacuucagaccaauuucccuuaugaauaucgaugcaaaaauccucaauaaaguucuugcuaaccgaauccaacaacacaucaaaacaaucauccauccugaccaaguagguuucaucccagggaugcagggaugguuuaauauacggaaauccaucaauguaauccaguauauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaaccaauagccaacaucaaaguaaauggugagaagcuggaaccaaucccacuaaaaucagggacuagacaaggcuguccacucucgcccuaccuauucaacauuguacuuggaguccuagccagagcaauuagacaacaaaaggagaucaaggggauacaaauuggaaaggaagaagucaaaauaucacuuuuugcagaugauaugauaguauauauaagugacccuaaaaauuccaccagagaacuccuaagccugauaaacagcuucagugaaguagcuggauauaaaauuaacucacacaagucaauggccuuucuguauacaaaggauaaacaggcugagaaagaaauuagggaaacaacacccuucucaauagucacaaauaauauaaaauaccuuggcgugacucuaacuaaggaagugaaagaucuguaugauaagaacuucacgucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacgcaauucuucaacgaauuagaaaaagaaauuugcaaauucaucuggaauaacaaaaaaccgaggauagcaaaaacucuucucaaggauaaaagaaccucugguggaaucaccaugccugaacuaaagcuuuacuacagagcaauugugauaaaaacugcaugguacugguauagagacagacaaguagaccaauggaacagaauugaagacccagaaaugaacccacacaccuauggucacuugaucuucgacaaaggagcuaaaaccauccaguggaagaaagacagcauuuucaacaauuggugcuggcacaacuggcuguuaucauguagaagaaugugaaucgauccauacuuaucuccuuguacuaaggucaaaucuaaguggaucaaggaacuacacacaaaaccagagacacugaaacuuauagaggagaaaguggggaaaaaccuugaagauaugggcacaggggaaaaauuccugaacagaacagcaauggcuugugcuguaagaucgagaauugacaaaugggaccuaaugaaacuccaaaguuucugcaaggcaaaagauaccgucaauaagacaaaaagaccaccaacagauugggaaaggaucuuuaccuauccuaaaucagauaggggacuaauauccaacauauauaaaaaacucaagaagguggacuucagaaaaucaaauaaccccauuaaaaaauggggcucagaacugaacaaagaauucucaccugaggaauaccgaauggcagagaagcaccugaaaaauggucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucugaaaauuggacagaguacuaccggaggauccagcaauaccucuccugggcauauauccagaagaugccccaacugguaagaaggacacaugcuccacuauguucauagcagccuuauuuauaauagccagaagcuggaaagaacccaaaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacucaugaaacucaagaaaaaugaagacugaaguguggacacuaugccccuccuuagaagugggaacaaaacacccauggaaggaguuacagagacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguacccuggagcucuugacucuagcugcauauguaucaaaagauggccuagucggccaucacuggaaagagaggcccauuggacacgcaaacuuuauaugccccaguacaggggaacgccggggccaaaaagggggaguggguggguuggggaguggggguggguggguaugggggacuuuugguauagcauuggaaauguaaaugagcuaaauaccuaauaaaaaauggaaaaaaaaagaaaaaaaaagaaaauguaagaaacucugcugccaauucauccuaaaugccuucaacauaugaauuugcaggccauuugcauauuuuguguguaaacuacuaagagggcagcauugcuaagugacuuuguucccugugcugcuuauagcacuuuaagucuguggucaccuagacuuuugagaguuugucuuaugauacagucgcaugagaaccuacuaugucuuucuugcugccagcccccauuccggccuuccagauccucuauauugucagucaacaguucuuaaucacguguggccacaaugagucgauucugcauugcuaaauaauuauggucauuuguucccaucacaaacacacauuagaacuuguguuuucccacagaaguuacaucucagaugucauggaguauguagccuaauaauacuaaguuagguuaucuuauuuuaaaaggucaucacaaaacuaaauaaauauaaauggaaucagagaaaggggauggcaaccaaaaggaaucaugaggucacaagaagguuuuuguuuuguuucguuuuguuuuguuuuuuaaaaaaaggacgagauguguuacaauuucauuguguccuuauggggaugauacaguugaaaaggaaaaacagaguuguuuuuuguuaaguuauuaauaugaguacuguugagguuuggccuguugcuaugcacugcaaugcuaaauuacguaucccaaggucuaguugccucaaggaaaguaaaaucucauguaugccagcuguuguugugcaaaucuugcucuuuaauuuaaaacuauugaauacagaugccuacaccuguagcugggcagaagagagauaggaggggcuuccgcuccugggcuuggggucugaggcagagaccacaauggaaagaggaggagagaagaaggugcuaugggguggguggaucaugaguacaaggcuguccaguuggacuaggaguagcccaggcaaaacacagcaagugguauaucgggguuacugacagggauauagacaaacuagcauagaggguucauaucugcccagcucuagugcuuuaagucuuauuauaaauacaaagaaagguuucugucucuuuuauuugaaaauugaaugaucuaaggugggauagaaacacccacauaauauuuaccaugacagaguaauauaccccagcagucauagggagacaggacaaaauguacaagcugaagagcuaaucuuggucauaaagacaaacgguucauuuacaagacccagaaggaaagacgggucuaugcuauggcucugggguuaaaggugauugcggccaaaccugacagccugacuucaaucccuagaaccuacaugacagaggggagaaccaacuccucacaagguguucucugaccuccacauguuccauggugugcacauacauauaugaaauacuuuuuuuucucaaugaaauaaagguaaaauugaaacaagcaugcagagaaggaaguguugaaaucugaagaaguuuguaaaauuaucucgagagguuagagaguaacaaguuuagcucauggugauauauuucauuagauguacuuacaucguauccugccacugugaggugcuaaaaccaaaccauucucuagucagguuuacauuugagcugcucccuguuuggcaacuucuccuuuugauuaucaacuuugggcaauuuuuacugaaucuucauacaauguauaauuacauuaauguuaugcuaguaaaugaacuguuaagauuuaauaaaagaaauuuauaaggaagauguacaguuaaaggacuagcauaauacaagacuuuugcuuucuaguuaccaaaaaucaggauuaaaaaaauaaauagaaaagaaugauaguucuaauaaaauauugugaguucauuccugcuuucugaauagggcugacuugauuaagacuuuuuaagacuauuuauauauuuaacacuuauauuuauaaauaaauauaagacaagcuggacaccucuaauaugaaaauucaaaaucuaaaaagcuugagaauugacaugaugucaugaauagaaagaaauuucuacagcuuccucauggcagucaaaaugcauguacacuagaaacaguuugaaaucacuuucaggcuauacauguaaggcauagagagaauauaaauaaauuuuauauguggccuuugguccuacucccaaaauauuuccuuauuuaugugcaaacgguccaagauucaaaauccucugaagcacuucuaucccugauaauuucaaauaagaaaucauugacuuaacaugaaauuuagucaaacagaaacagcauuuuguuaauaauucaaacaggcaguaauuuagcauggcuuagaaaggaaaaacugcaaaaaacaaaauuuccagagagaauacuaaugcaguacuacauuucuaaggcacugggaaaauaguucgguagguaaggugguuuuuuucaaaagcaugaagaccugagaucagaucuuuaagauacccguggaagcuggguauggugagucccucucuagauguggaggugcagaagcaggucucugcaggggcuucuuggucagccagucugcugagacaacaggcuccagguucagaaagcaaugcuggggggagaacugaggaagaccugcaagcaucaacucugaccuauauacacauucacacacauguacgcucacaaagaaagaguauggaaaacaaacacauacaacccacauggaugaaguuuaacucugcaauuuucaacuguuuggcugcagcuauguagugaacuuucaacccucagaaucuguugaaguucacucuuagccagugagcaugcccacaaacauuaucugauauuaaaaacauuuuggaguggauccaaugggaaaaacugguuaauuuaaguaauaaaauuaaaauccuuauucaaaaaauaaaaagcaguaaguagggccuggagagauggcuccgugguuaaaacccuguugcuuuugcagaggaccuagguucaguuuccaacacccacucacgacccucuaaacuguaacuccaggggaucuagcauucuccucuggccuccauaggcacuggauacacaugguacacagacauacaugcaggcaaagcuccacaugcacaaaauuaaauucuuuuuuuuuuaagcaguaagucauccccucaaaauuugaggcagaauaucacucuauuacuuagacugaccuaaaacucacuaacuaugcugaccuugaacuugggauccuucuaucuuggccuccaaaguacuaagauuuccagugugaaccuccaccaacaaaacuacuauauaaaguggucugugugggaacagcugagaaacccauaacucaaucucuguacaauucuguacagguaauuuuauuaccccaguaauuccaucaugggacacuauuccuacaugggauuugcagauuauaugugaaacugggcucacuuauuucuuuuuuuaaacuucuuuuauaauuaauguucuccucuaguguacagguagugaccauuuucccaauuaaagaauuuaggugaccuuuguaauuugcucuggccaaccaaacauagcaggaucagcaaagugcuaggauuaagcauagcucucuaggggccuuggauauuuccuuucucuuuccuucuuagcaucauaauguugccauguuggcccaaacugaccaagcagaucuuuauugauaagaccuuuccuaucaccucucaugauguccacccauccucuaacagagacagguaucuaacuuacaacacaauauacauagggaaaaacacagacaccauauauuuggaugcagaaauauagaaauaaagccagaacugagauggaaacguccuuuguguugguuggcuuucauagugccaaaaggugcugugcaggcuccuagggaaaaguguccucuccagucucucuuagcuguggacccugccugcugcucuacugugguaauuugauuaagaauggcccccauagccuuguauaguugaaugcuugauccacaguagguggaaauguuugggaaggauuaagagguguggucuucuugcaagagauuguuacauuuuuucagagucuuuguggacauagugauuugucaccacacuguauagauggugaauuauauuggaaagagaccuagaacuuaaccaguaaaucuaaacggacauucugguuuuaucagcuaugucugagacaagacuuguagaccuaauuccuaauucccuucacuagaaauggauaguacuccaauccauaggacauuugggaccucuggauucuaaaugagucaguacgcuuagcguugaauauaauacugaaagcguuauugcagauauagacuaaauaugcacuaaauauauacuguaauaugcauugugaccauauacuaaaaguauuaacagcugagccuggagaaauggcucaggcauaaaaaaaaucacuugcuacuauagcagaggaccagcuuugguuccuggcacccauauggcuauucacaaguguguauaacuccaguuccggcagauccaauacccgacaccaggcauacacagacaacacagucagaacacucauauacauaaaauaacaauaauagaucuucaaagaacguauaggucauucacuaaguuucgccucgcucuguaagugugccaggcuggagguaaaacaccaggaaaagaaaacaauuacacacgguacugccuagaacuuccgucuacuaauaauccgcagaccucuaauuaucacacaguuauaacugaugcuuucaaucccccucacguucccaaaagcgcgcaggacagcagcaucgccuuuaaacgcacagcuuccagacucacuugacagcucacguccauccccgccuccagcagcaccuggaccacggccuugugaccguugcgggcugcgagguggagcggcgugugcuuccggguguuacagcucauuaaguuugggugugcgcugaugaucaucuucaccacccucagccgcccguacagugcugccaaguccagcgguguuucgaguuugcuguuccuaaucgugggguccgugaguuccucuaggagaaccgcaacuacuuccgaguguccguauugcgcugcacaguggagggcgguuucguucucguuguucuaguuaaggcgaagagacgaaagacagccuucagaaauuuaauuaggcaucaaacucuaaacacaauaauuuaaaaguuggcauguguguagaugcgaauuuaagcauaaccuauuuagugaggaacaucuaaguggauuuuauauuugauuaaaguacacaucaucacucauugcaucaaaaucaagucuuaguuuuaccacuccaauauaaaaaaaaaaaaaucagacuucccuguaucacauaaucuggcuuccaagaguaauggcuuagccacacaggucaguggcccugcugguccagaaggccagcauucccugcacugaacuuacuucuaugacauuuguuaauaaggaagauuaauagcaauuguaagacacuuugaaggacugacuuuguagacuagaguugagaugauaaauuccugaugaugacagacuuacagaaaaguuaccccgauuguuucaacuuauuuuaaauaaauagaaaccagggcuuuuugccacaaauacaaugaguaacaaaucugaaaacuucucuucuuugcagaaagacugaagacuccuaccccuaggauaaggugauagcauccuuuugaaaacacagguaagaaacaggccuagacccacaccuaggcaagucaccaagaauauagauuacugcauuugcagccuauaagaauaucuauugaaaaaaaaaaaaacaaugacauuuuccuagaacuuuaacaagauuuaaaaaaaaaauugaauucaguuacgaggcacaucaagccaucagacaauuuugacaauuggugugagcagaugggggucuugcuguauccagaggcggcagagucgguugggagaacugugagccagaagugcuaacugcacaagugaaagaaucucaauuaaggcuccagagggaaagaucagcugccauuagcacagccauccucacagugaaugcucaacaccagacagaguuccauuuuauguauucacucacgcagcccccauuauaagaugggggcuacccccaucacuaugcuuaccugcugggugaggcaaguaaggcacugaauaacugaacaguggguuuucgguuacgcagucaucccgugguguguaaggguagcaucaaguuagagcuugugcuuuaagccuugccguguuucccaaagccuguggaacgguagaaucaccucccacgagcagcuaagacucacuugacagcucacauucugccagugcucuagcaucaccuguagagcugcuuuggucccacugaagacagugaugggaagugacauguagcucagguuuugaaccaaguagcccagacccaaugucugaacuacuaccacauaggaccuuccaacauagcagugguaccuauuaaacacucaccaaacaacuacaauuuuuuuacaagcauuuccuuauuaacuuuuacagaaaucuuacauguuugguauuaacaucuuuacuucauggguagggaaguuaaaauaaaaauuaaaaaaaaaaagucacacuacaucuaagaagauaaggaccuuuugguaccugacaaaaccuaaagccuaaguucucgcugccuccaucugccacuacgcugacaaagaagcucugaaaguaucuucaagucuuccagagauuucacccaaagcucacugaacuaggaggagcugccucuuagauaugguagccccuacugaaacaaaaaggaaaaagacaauuuaaacucaagcacaucuuuaccuugcaggacaaacaagcaaacaaacaaaccccaaaaccaaaguaaaacaaacaaaaaaaagaaggccuguguuggaucaaaggaaaacacaaaccaguacauuaagcagcuagaagaaagauuugagaaccuaaagaagagccaaggggugagauggcgugcaugaggaagggcuucuuauuuugugugucuaguaucagugcaggacaaugggaaguuaaaaacaaacaagcaagcaagcccacucuuuaaagacaguggaugaaaguuggggucagacaggcaggagggaauccaccugaagauguuucuugcauuguuuguacaagaauuaaccuugugcuucauuuagauguuuaauuagauguuuuacuuucauuucugucccuguucauaaagaccgacuacauauagucucagacucccuacuuuguuaaauuugaauguucuccaagcuucaucagaagcccaggcuuauuacucuaacacauaaaaaaaaugacauaaaaauaugcucccuggccaguccaauuuccccuuggucuaaaaagggcuaaaucccauuuuucaaacuguaauaucucucugagaaagagaaaggccaauuaugaaguaaugagcccucaaagaucucucuacuuuuccacagcccuuagccuagagaauaggaggaaaauuguaaguccuucuaauaauaccaaauuagugcuguucaaaucucaggagaaauuaucuccaucauuaaagaccuacuuaggagacaauguucacagguuuuucauccgcaaucaacacaugcuugggcuuuuaucagcggagaccacacaacugcagugucuuuaaaaaggcaagauuacauauuugugucaggcucgauaacgguccaagaaagaaacauguaauuuuaaauggguagacuaugaagguguauugauuaacaaucgcuaguacaucuagagaaaacagucuuugaagguucugaauucuucauuuuuaaccaaauaaguagccucugacuacuacuacaccacuuacagacaauggauaacagaaggaaaacagcugacaagccccauuuaucaaaagacuugaguucaaauaccaaagacaacguccuuuggagacaaggauuuuugccccaguaguauauuaaagagaaaaauaaggccaggguaagggggggguaagauggauguacacagaacacacaaaacaugcaaagaacuaaaaauaaugccauucuuucuucauuguuuccacguaguaccagaguuuaccuuucuuguauuuauuucuuuguucaucguuugcgaccaacuucauauaugagcaauguacccaccuacccacacccacccuucccucccugcuuuccacuucucccuggcugccccucccuaccaaauccauuaccccauuuagcauucccuguguauuccuguguccauguccuuccauguuuucugccaugauccuccucugcaccgaggcuuuuguacagaaugggauggggaacgggauccaccuggaagccuuagcacagcccucauucacaacucacuagauuccugaauggucguuaucuuuauguaagaacgcuguccucucuaugaccacaaggugugguucauaugccaaaagauaucaggcaggguuuaaaaaaaaaauuaaaacacaagacugaccaaauucuuuucuaaaauggacucuguacuauuuuuuaucuggaaguuuuauaagcucgguaggaaaccugaguugauguuacagcauaaaaaaaacauguucugcuaacuggugauauuaacgcuuaucguauguaccaaccaguaauaucgaaauggacaaucucuguuccuuaugcucagcaaaggucugaaauguuaaauggaaacuuccagagcuacuuuguaaguuuugaaucaugggcuaaucugagcaugaggaggucuugagcuguuccacuccgugucucuccuggcgggaacacuuaaugaucaucucauguaucagauccaaggugcuacagcagagcuugccuuuacacaauccuuaugucacugaaugacccagaacacaaaagggaugccccaaacaaaaacgguggagugagacacagaaggacaaacagucccugacacuacgcagcaacacagcaaauguaugguuaaagcaguaaaugggauguuauuuuaaaaagaagucuggggcuggagcgauggcucagugaugaagggcacucagcucuucuggaguuucugaguucaauucccagcaaccacaugguggcuccuaaucaucuauccugggaucugaugcccucuucuggcaugcaggcauacaugcaugcaaaauacuguauacguaauaaauaaacaaaucuuuuuuaaaaaagaagucuguugacgauucauaaaccgugauauaaacauuggcacuuuucccaaguaacaaugaaggcauuuugaagugaaauugcuuacaaaugcuuuccccaaaaaaaucugaagagaugcaugggaauauuaggacagagguuucuaccugggguacuggacaccugaugaggggacaaccauauaugaagucaaagauccucuucagaaacaguggaacacugaccaaaaggcauaauuucaaugccaugcaugacuacguaauuggcuaaggaccuuuuuaaacauugauuccaugucuuaacagaugcauccaugucuuaacagaagaagauggacauauucuucuucucuaaggucauggcuucauccagacagcagccauaauaaucccuacuuuaccaggcugugauaggaaucaguaagauaauguugaugccguggcuugccugucacaggaaacuguaaguaacagggucuaggaaggcagcauuaguguguaagacccuguacucagaguucaagucucaguucgggucacccagaagcaugcgacccuaaccaauuuacuuagcuuaacugaacucuguuuuucagcuauaaaauaggaaagguaauuucacuuccaauuauuaaguaacaucgggaauuaaggaacacugugcagguggaaguacuuagaacaaugacugauuucccauagucaucauuaauguugauuuucauuccuccugcuacuguuuaaauacauaaaaguuucuaauuagauaaaaacauuucuguaccauuguggggagggggaggggagagcuaaaauucaaguuacugcuauaagaauaaagucugcacuucugacucucucagggguauuggucuaaaauggaaggacaaauuuaggaugaaaagucuugagauggcacuggaggacagcucaauugcuagcugcugagaugcuaugaugcuaagggcuaggugcuaagaugcuaagaugcuaaagguuagaugcuaagccccagccucucaacccacauuaaaaaacaaaaaacaaacaaacaaacaaacaaacaaaaaaccaggcaugaugguacaggcuuguauucuuagugccgagggagaucaucagccagcccgaaacucucaucagugagcucaguucccaaacaaagcaggcgguggcugaggacuaacagcugccucagguucugcaugcacauucauacaacuacaugugcacuagugcacgcgcgcgcacacacacacacacacacacacacacacuggucuauacauucucacgcacaugcaugcacaggcacagacagacaccacuaccaccaaagcagucuuaagaaguguucaacuuguugacaaccaaaccacagcacaugguaauggaaaugaaaaagagaauuucuacuuccagucuucuuaaaaggaauuuguucauaauuugauuaaucuucaauauuaccaaaaacaaguguuucacacaaauaccaagacaccauuuaagacuuucagcuuucaaauauaaauguacacuguauguuucuuauuuuagugucauuuaaaaaacaucuuguuuauguaaaucaacaaccuuuucuuuaaccuuggguuguuuuuuccacguuguuauuucagguuggcugugugccaugcugacaauuuuaagaauaaccaccagauggcucauccuguaaaugcuguaagaucugguaucucaggaacagaauaaaauucucacaaauuuccuuuuagcaugauaugaugauaaagauagccauuuaucugucacuuuuaaaaauacuugaaugcguccugauuuggaaaaaucuacauuucugcaacuauacaaacacaaaacuuuauugucauaaaaauuaaugagauacuuuucugacaaauaaaaugcucuuugcugauuggccuuuucaacauuucauuugggugaauuuuuuuuucuuuuacauuuguuguuuaaagcuaggguuucuuuuuauucuuauuuacucuuuauuucaggcaaaggucugugaaaucuauagcuauuugaacacugugguaauugcccuuuaauuagaaacucuugcccuucagugaucuauuuacauugguauuggacagcagccaacugcagcugauacuauggcuauaauucaauugccggacugcacgcugguuuucaaauauaguuuuacaaaaugggaacaguagggggcauucggagcucaaggugucuguuacacuguaucacgaggccauauuucccucucuaaaaaugcacucuugucuguucuagugcucagaacugaauuccuuucuaaauccguucacuguuuguaauacagauauuauguucuuguuaccauucugacucuagauagcuaacauuauaauucucuguggugcucggcucacucuacacaucucugucucacaugugcauguuuagaagaaaguuugagacuagagagacuagaaacugugcacaguguauuuuacaucuccccccacaaaaaaguguguuaacuaugaaaaugcuauauagauggaaaacaugcaaaugaucgcuauaaacuuuacuuuagcauucauaauuuuauuaaaggaacaauaauucucauacuaacauagauaucauuccaucuuuaaauauucaauagacuuaaaaugaauguucuauaaggcaggcaaaaauuuuacaauuacuuccuauaugugggauuuuuucuuuuuaacagaagaucuuuauaccaaaugugccugugcaugauaccaaaacccacagagccugugcaucauacccaaauccaaagaacugugcauauuucuccuuuaggaaauucagcaguagaaugauauuuuggcagaguaaagauaaaagcgaucaguuuuucaauguggcuuugccuuugcaaaacuugagaguaaaauacagcaugagcaagcauucggcgggugcaccuguucauugacucgggaaugggaagguccgugauggaugaggaucuucacaaucuccacgucuccuuuccaggcagccaggugaauggggaaguaacccuuguugucugcuacauugguggaugccucguacugcagcaguuugagaacuaugucccugaggaagaaguaaacgaaaggaaagaaacaacagaaaagaaaacaggcugaacaacacagacuuuauuagacagcuagggucguuuauuagagacuagcuggcauuuaaaacagucauuugaggcacuacaauuuaaaauugggauuaagaucauuuuacuuagaaaauacucaaagcccucccaagauacaugcaggcaugcacacacacacacacacacacacacacacacucauacacacaugcacaaaugguuguguauauacccagaucauuaacuaaccaauaaaauuacuuaauagaaugcauuugguacauauauacaauuucguuauagcaaucaaaaguuacaucaucaacuuguuauguuucaugauaacgcgugucugaaaguuaaccugaaguaaaagcugacgcuauaagcaaacucccugguuccagaaacuaaaguuaucaagugccaagguuaauuuagguguuuucuauaucaccucuagagagaacuaggcugaaggaauuaagauguauacaaaagagaaauuuagguacguggguaagggagcuaaugauuauaguacuagauuacuauuaaaagccagaauuugguagcuguacagcaacagcacauaacaugauugaauauacgauccauccugucuuccucuuucuccccggagcccaggaagugguccccagaaugaaauucaucuaagagagaauuuccaucucugcuauaauccccaguacagcucccaugcuacccgcagacuucuauauuuaaaccccaccagacuuccagaguggaaaccuucauugaauuaaccucaagaagggcuggauaauaauuauuacuaaauauuauacugagcuuccuauaaaauaauacaaaaaugugauucugaacaauagucacauuuucacuuggcugcacagagacacagauuuuaauaauccuuccaugaaacuccagacauacacauguguaaaggcaggcaaaaaaauacuucugaauauuacaauuauaaacuaaagucaauccuuaggguuaaaaaauuaccaauagaaagaaugaauauaagagaaagaucuaaauuuaauuuuuuucaugagguuaaacuaagacugguaaagaagaaaaacuaaguggccaacuaaaaauaaugagguuagaauccuaauaccucagaagaaacagauacaaugcaaaauaacaguaaaugguuaaauccacugccccaaauguagccuaucgaccagauacaguugcaacauacaugaaauugugauuaagagaaaaagaaaaacagagacuauguuauaaauaugcuuaugcauucucagaaacuuucaucuucuaauaagauuucugagaaaauaagacaugaauaauaucucuuucaagagcugguuguacuuuuguaagugugugugugugugugugugugugugugugugugcgugugugcgugugcacccaugagcguuagagugugcaugaggauauguggagugaucguggaggccagaauaaaucacagcccuggagcugcagcuacagguaguaguuaucagcggcccaaugugggugcuaggaacugaacucagguccucuggaagugcucuuagcugcaccuaugcuaagccaucucuccaguccuauaaauuauauccuaacaugucuuuuaaaaaguuauuauuuaacaagaucugaauuuagaaggcuggggguugacuuagcuaugccaacuaacuaccuaacuuuucauuucaauacuauuuucuuuuccuuucugggagaaaagaaaaaauacuagaaaaacaaaacagcgucuacugcugaugcacgguaagaaugcugaaugggagucacaaaagucacguaacaacuggcucugcacuauguaagcaugggaauuuguaucaaaccagaacaaaagcaggugaaagugaaauuugacauuuauccgggucacaugauuuuccucauugcugccacauaagagcuguccuagggucuucaauucugagauaaguaaauaaccacacugagauaagaagaauccagucaauaguuacaaauaaguaaaacccaguaagagugagaguugggcucuauguuccaaaucuguuguaguacuaacaaguguagagaaagaagcagccaaaugauccccuuacuuuucuuuucauuauaaaguaacccagccuuguauauuucaucacaguaauacaacacagacuaaaauaccuuucaagaggaaguuaaacaagauggggugaaaucuuuuauuuccuuuuacuuucaccaaaaauucagaauuuauucuuugacuugaauuuuguuauuuccuaauaauauugaugauaugcauucacuguuuauccagaaaauucaugacacauugaaaaaugauuauuuuuaaacagugacuuaguuuaaauauuuguauuguguauaguauuauaaccauuucauaacagaaucagaaagggauagucuauauaagguagaaggagaacaucacuaagcacuaucuuuugaaauguacuacauuaguuuauuuuagggggggcacacauguguggaaguuagcaggcacuuugucaaugacaguagguuuuucuccuuccaccacguggguacaucaggccaucagacuugaugaacaaagccuuuaccagcggagucaccuagcugucccaauuauucuagucacacuugugcauguguuuacuacauuucuuuguguuucuacuguccugagcgauuaaauccagggccugggaaacguaagcaaaugcuuuagcuauuaucccugaacauaguuacuuuuuucugagcaaaggcccugccgaauuuaaggguggucuucacucuugccucggccucccaagaaccugagagucacagaggcugcuugcucaaugcgugcaucuguacaucuaaagucucuuuuaauuuuuuucauguugaguucuauccccuuauuaggauuuauucacuagugaaccaucucaguucggauucgguuugaaaacacacuuuuuaaauauaaagcuugacuuuuaaucaaguaaauaccuggcaguucuacugaacuguaaacacaauagauacuaucauuaauaaucugucacuaaucugucuuauggugcaucuaguuguaucauaccuacuguuaauuaaauggucuuuuccauacaggcucauuaagaacaaauuaaauuguaagugcuuucuauaucuaaauuugaagaguaacagaauaccaacucaguauuauuacuuuuuauuuucauuuagguuaacuguaauacccuauucagggaaggcaaacgacuaaggauguuggcuguguuucauuccucggauuacacugcugauaucucugagacuaggaaguguuuuacaaauaaaguaacaaugguucguaucgagagcauuugauauugugguccaagguuaaggagugacucagccacuuagcagguacaaaaccugaauucaaugcuagcaaguucuaacuugauuucagccacuugaggacuguguauggugacauuguaagaaaaaauaaaaacaaacaaaaaacaaaaaaugaauguaccucagagucagguccaagacuguaaaugucaggccucauaagaguuuaccuuugucagaaaccaacacacacacacacacacacacacaucaaaaaaggugaucugaaauccuaauauaaaugugguagaugagugugcuaguuugaauaaguuuagcccugcauagaaucuguguuugaaugcuuggcccauaggaagugcuacuauuagaaggaauggucuucuuggaggagguguggccuucuuggaggagguguggucuucuuggaggagguguggccuuauuagagaagguguggccuuguuagaggaaguguaucacugaaggcagggcuuuugaggucuuaaauguucaaacuacaacuccuggaagccuucaaauuaagaugaagagcucugggcuccuccagcacugugucugccuacauacucccaugcuuccugccaugacgauaauggacuaaaacucugaaacccuaaccugggcccauuuaauuguuugucuuuauuaagcguugccuugaucauggugccccuuuacagcaauggcgacccuaacuaagacaugaggucacagaaaaaguaauuucauuaccagaggcaaaaccaaguaucaaauuaaaucaaaaguauuacaacuuaaauaauuuaauuauuuugcaugugauauauguaaauucagguaaaaauacaaauuuuaaaguauugguuuuuuccacucucauuuacauuuauguucugauaaauauggaaacauuucugauuaauauuaaauaucuuugaagaaguucagauuaaauucuaagcaaaucagaguacuugguugugccaacuucacuuuuuuucucuguuuucucaugaagauuccauguaacuucaucacaacugcguccauucuauccucuugcuugucaguaggucucaaaauagcagcuucaucugguugcagaacuaacuaaccaauaaaaguuucaaaccucauaagacgagacaccagacuucccagaggccaccugcuucuccuuaaagaaaaauaaagucucaggugugcugggcaugcccaggaggcugggggacauauggcccaugcucaccgaagcuucuuuaaaaaaaaauaaacucacacuuacaauuucuagauuggaggaggggagaacaauuaaaucaaagggguuucaagcuauuccaacaacucugggugucugauuauaaaaauuuuagagugcucccacuuuuauuuaagaagaaaaaaaacuaaggaaaaaaaaaaaacagaaaucaaaaccacaaacaacuuccuaucuggauucuagcuccaauuuaacauacaauuuagauuauagauacuagaguuuauaagauauuaagugcuaaaagagauaaaguggaaaguaucuuaacucuacacaugccauauuacacaccaugcauaucuccaaggaagaaagauaauuuguugauacuuuuauuuuuaaagaguauccaaguaguaugaaaacacauccaauagcauuugagaaauaagacuuaaggaaaguaaggagcaauuucguaauuagagaaagggaauaaaaugaaauauaaguaguuaaguuuaauaaaaaucuuauugugaacaguaaagaaaaaaauuuuuuaaaaaaaaaacauauccaggcaugugaucccagcccuuguaaaauggagacaggagaagagugagucucucaaggucagcuuauaagaaacaccacuucugaaaaagagggaggggaggggaggggaggggaggggagaggggaggggaggggagaggggaggggaggggaggggaggggagaggagaggggaggggaggggagaggggaggggaggggaggggaggggaggagaggggaggggaggggaggggaggggaggggaggagaggagaggagaggggaggagaggcagaaagaaggaagggagggagggaaacgaugagggaggggccuaacaagggaacugucaguggucaguguaaccgugggagcaaagaguuugccuagcauacauggagucuugauuuccaccccgggcauuuauuaacuaauuacuuacaaaacaaaauaagacaacagaacacaggaagaaagaaaagucaaccaggcgagaggaguggaagaagguagagaaggaugggagggaaaagucaugaagaggggggagaaggacaggcauugccauucagaagagaauuaagggauucauguuugaguguaaauggacgguaaucaucccugguacauuuuguccugcugaccaugauuuuucugucauuugaagguaauaacuuucuauucuguaauugcaaauggcccaggaaaacaccaauggaguacaauuucuguuguguccagccuggcugacuggcgaugaacuguucugugugaaauggugcaucccagggagaaaaugcuccuccgagccgauaaacaagggcuccggaaaacacaccaacacggaggaaacgguuucaaucuccagaguggaggcuuagggaugcucacccaguggaggugggggaaaauuacauggaaagccaaagauuaaaacacgggacccugcaacauccuuccuagcuccgugagucugcaaacucuagccuagaaaucgcguuuauaaaaacaaucuaggaaccacaacugcaacaagaauggacuaugcuuuuauauuaccugcuaagguuuacuagagaaaaauacaacaaacgaaugaccugugcaaauugacaauaguaaacaaaagaaguaucagcccguucuaucuuuaaugauauuuuucucuccuugaaguaacucuuuuuuuaaccuaaaacaguauuaguuagaauuccauggggaaaauacuaauugaugacaugggaagauaucucagaaauauauagcauuacauagaaaauccagggagggguuaaguacggaaggagguaacauggaaaacugauaaaagcauagaccugugggcuggagagauggcucagcaguuaagagcacugacuacucuuccaaagguccugaguucaaaucccagcaaccacgugguggcucacaaccaucuguaaugagaucacgugcccucuucuggugugucugaagacagaaaaaaaauguacucacauaaaauaaauaaauacuucuuuaaaggaaaaaaaaaagcauaggccuguaacaagaauggugagggucucaguacaacaccaccuuacaauacauguggcuaguucaucauuuauccaaaauggccugcuuuguccaucuaucuaauaaguggauuugaggaguauaaguggugccuaaguguauaagucuguaagcaauuuaaacauacaugcuuuauaaugcaaauuucagaacuauaguaucacaguacaaaaugaagaaaugaaugauacaaaacauauauaucagaacuguaauugaaagaccagugaagacuagcuagccaguuauuugauacacacugaacugaggccuaaaagcauuacuaauaacacauauuaaaaauaauuagcagguuagacacuuuuccuacuuuuuccaaagcauauccauggaaugauacugaagaguuuuacuagaaagugguugauaaacaaguucaucagauaggaugcuuagaaauaccuagcugaacccuauuuucuuuauacuaaugaugacaauuacuguuggguuccuuuaaauuaucuucacuuucaauguugagaauagaaacgaacaggcaugcuuucccaggccauuguguguaaaucaaaaauguucaguaaauagauuuucugaaaauuuagaaagucuacaaguccuaacuugcuuucaggcacuugagaagugacauuguaacaaaacaagaaacgaguguaacucagagugggccccgagacaguaaaugucaggcaggccucauagaauuuaccuucgccaggaaccugaacucuaaaugaaaaaggaucaucauuauugguagucugagcugauuuaaauuugccuuggaaucugaucaucccgauacaagaagaauucauaauaaguuucccuuuugaaggagaccugugaacugggcacagugauuugcaucagcaaucccaguuugccagaggcacggaaggggucaugagauugaggcaagguagggagguacaggcaagaacccaucuucagaaagaaaauagugacagacaagcaggcauacagauaugugcauucuauagaaaagcaacuuaauaauaaaaacauucugucaaaacaaaacacucuaagcuagaugggauaugauaauacaauauaaaagcaacagauaaaaacaaaugugauugaguaauccaaugcugagaauauaaacaaugggagaucaaauuuauaacauuuuaugaaauucagaugauucuuuuaauguccugaugagguuagauuuauauaaguuuugagagaaaaacuguaaggguaauaaauaaugcaaaaaaaauuuuuuuugaaguuagaguuuuauggccaccaaaguaaugaucaaguguaaguacggccucuguguuugaaauuuaaauaaauaucacgugggaagaaacaagugugugugugugugugugugugugugugugugugugugugugugugugaaugugugaguguguguguguguauguguguguguguguguguguauguguguguguguguguauguguguguguguguauguguguguguguguguaugugugaauguguguguguguguauguguguguguguaugugugaauguguguguguguguauguauucucauguagcucaggcugcccuugaacucacaaaguagccaaggaugaacuugaacuccuaauccagccugugcuucccaaaugcugggauacaagcaugaucugaagaccacaucccacucaaaacucuaaagugaaauaaaaagagccaagcccaggaacgcacuugcaccauuccugcaaaggaaaaacagaaagggagugggggagacagaaaagggcacaucucucuuaugguagcaaaagacagaacaucugugacaccaagaaaaugcaucacauguuagcgcuaaaccuuagcuuaccuagccaaaauacagacaggaagugcugguuguaauuauauguucucucaugccccacugcauaaacuagcauacuaauuaaaacguuaaucccauaagaucaaacagguuagagcugagaaaggugauucuauaugacagaaaacaucagguaaguacccauguccucuagugacaagauaguggcaagaguccccuccugugucgagcuggcauaggcaaaggucacgagaagguaagcagugguguuuuaugcuguucuuucccuaaaacuacacaggauuagcaugguuccugcuuccaucacuccugugcgauacuguuuacuccuccuuugaacugacacucugaucucacucaugcucaaugaugcuccuaccaagcugaauuuaucaguaccauucggugccuccucgcuaaauugccuacaaccagaaggcuggagagaugagaaaagaaucagcagaugauacaguuaaugucaucacauguaaccaaaucuguaaaacaucccguccggauaaguggcacuuacuuauguccauuuaaggcugcgugguguaaagcgguguaacccgaacugucugugcaauucacauuggggccucgccagaugcugcggacaaaacacaagcacagaguuaacagucacggagucacgcuuucggaagcaagaaccacaauagucacgcagcaggcugcguguggcauacaagcacugcaguucuguaugaaaugaauggcaucccucaucuauaccccaaagaauaacuucauuuauuugauguagagaaauuaaacagcaagugucagcaucuucagaaaauauauuacuggauauaugugcacugccaugcacugaguuugggcccaagauuucccucuaacucacuauuauugcuuaaguauuaacacucaaguacucgguacuaaggaccuguggcauuugccuccgcucuauugaugcacucacccugcccagaagagauuugugugcacuacgacacacguucacaugaugggaagacuuaaacucuucuugucuaucacugccaagaaagugcauauaaaaccaccagacgauccugacaguuaugcccuuaccacugacuuuacuauacaauauauucuggagcuaacauguaacuauguaaaggacucauuuuauacuugaucacugcaauuaaagaaauuacuuuuagccuuuggagacaauaaagcagugaaaggcacuugccuaagaucaagacagagugacuuuaucuaacguucaugcugauagugaaauuagaaaagauacuagcuaaugacaaauucauagucaugaauuauuuauaaugcauuaacucuaggucacacauuaagauaagcaaugaaaacacaaaaucaugaucgacaaucuuuccuuauaaagcacacucugacuggggaggcuggcucguggcuuuaauccuagcacucgagaggcugagguaggcagaucucugagauuuggagaccagcauggucuauacaggaguuccaggacagccagcacuacaucuaagguccugucucaaaaggagaaaagaaggucuaguauagacaauagauaugguacacacucauacacauaggaaaauacacacaugaauagauaugcauaagugaguacauacacauacauauauauauguauauauguauauauauacauauauauauacauguauguacauauuauauacauauauacauacauaaacacauacauacauacagagagauagauggaaagugagauuuaauaaaauauacccuaaauguaacuaaauaaaauaaauuuaauuaaaugauuaauuuuuauuaauuuaauuaauaaauuuaauugaauaaaaaacccuagauuacuaagcugcuuguacagcuaaguacagacuugccuagcauaugcaagguccuagguuuugacccucuauaaaacacacagaaacaggagagcgagcuaagaagccucaaugaucuucguaacagagaaagcagaccugauccaaaugagguugcaacacacguaaacaaaacacaguaggggccauuucauaaccauuaagggaacaacuugacaagaguacagaauaaucuuagguaguuuuuaaugcauagaacaacagaucuucauaauacauuaaauaaaaccuagcucaacugcaaaaaauauacauaccuaugucugaaaauagauuaaaacaucucccaguugaugaaauaaaaauaaaaucaguauaaaacuaaauaauauuaucaacuaacuugaccuaacuggaauuuauguaacccuuuauauuauaauaacagaauaauaaaaguuuuuuugcaaauaaacucagaauauuaucaaaacacaguaaauuauggaacauaaaacagucccauuuuauaugaaaguauucaaaucaagaaagauauauucucugacuagagugaaauuaaauuagaaaucuuucacacaaaaguaucuggaacccccuaguguuagcaaugaaguaacaucaaagucaaagaagaugauaaaaaggaaauugcaaaguaauuuaagcuuaaaacacaacacacuaagcuuuacuuacuaaacugacuuaaacuuuauauacuaaaccuauccauacacaacuaaagcauaccuaaagaacuugaguugcuaaaacacugauuuagacaagaagaaaggcccaaacugguaagcuuggcuucuauuuuuaagaaacagaaaaacagaacuagaguucugucauuaaagucucacacucaacucuuaaaaggccaugaguuucauucacagcacccguguaaucuaagucugucuccacagcugcccuguucugcccuuuaaugacacacauggcgcacgcacgcacaugcgggcgcgcacacacacacacacacacacacacacacacacacacguacacacacaucaguaaaagaaauuauaaaucauauaacacauuagcaaaaacaaaaaacaaauaagucauguaaaauaagcauaaaucuugaauacacauucuccaaagggaauguaaaauagacaacggguauaugauaaagcauacaauuucauuauuaaauuucaucaguaauaaauuucacuaaucaaaaacaguacgaaauaugaauacaagcauuaggaagacuauucucacucuuuucauagcuguuccuaaaaaaaacaacaacaacaacaaaagugcuuguaaggguuuggggaauagaaagugucuauauacuucuagcuagaauguaaaaugauauagucaccgugaaaaacacuguggagguuuuaaaauaaauuaaaaauagaacuucauauggcccagcaaucacacuucugagcauguaccaaaauauuaacaucauggcaauaaagauaaccacacuccugugugcacugggaacauuauccaccaagagcugagauagucaaacagccuaaaugccugucaaccaacagaugaccaaaccaaguguggcacacucauauaguuaacguagaggaagaaauauccugaacagaggaagaaagaccuugacgcuugcuacagcauaggaugagcacagagaacagcacccuaagugaaauagccagacacaggaagaucaaacaucuaacaugcagacauuaaaagagaaaugguuuguauugggagacaguuuggguccagcccaucauggugaagaaggcacaggaggagucuggagcuggggcagcaggaacuugcucacaucucaacagauuagaaaaugugaaugggaaugucaauguuugucuaauuuuuuuuuuccauuuuuaaccaggucaggacccuaccacgugggcugcugccaccacauccaaaugaaucuucccuccucagccaauucucccugaaaauacacucauagauacaccauaggucucucugugagaugacgcuaaaucuggucaggcuggcaacagagaauaaccaucacaguagguuugcuucggauuaugaggagacuuguaacaguccaagaaacuuggaauuaguucugcagucaauuugacacuucuggcauaacaaggucagcauuucaaggugacagcuucucuaauggguuuuggaaagugaccagaaaggaaacuguguugacaguuaauuuuauaauuuauuuauucauguguuuuuauguauaugagugcucugucugcaugcacucacuccugcaggccagaagagggaaucacaucccaauauagaugguugugagccaccaugcgguuguuggaaauugaacuuaggcccucuggaagaacagggaguaaucuuaacugcugagccaucucucuaguccuccuuuuuaaaagauucauuuguguauguauuuuuauguauaugagaacaguugacuuuaauaagaaaagaaugaaagaaauauccugaacuauuggguacauaacggcaaauugagaaagcugaaggaggagauucaaauucuuauagcuaagagaaaaucucugaaagaugauaaccauguggaaaggaguuagcuuggcacauggcugaggucccuaccaugaaugacaugcagguggugagauaccucucuuaguagggacuucaagggcugugaugccuuuggggaauaccugauuucagacaagcuaagaaccccguguuauucagaacauucucacaacggagggaaaacaaaugauaagauacuauaaauaaaccaauauuuuuuaaauuuuugaauguuauuaaaaucuuaaaaguauuuagugggaaagggcauugauauguguugcuaacauaaggcgcagguccuauauauuccauuuaccucuugcaucccacuuccauauugucaacaaaaauauuaauuguaaaagaaaccugaaauuuuucuaaugaaugucucuucuucuaaggagaauuaauauaggcaacauauuuuuacaaacaaggagauucagaauagaaauuuagcauaugugccaggaagcuaaauucagcugcaccuauugacagagccuguaggcacgcauccacauagccucagagcaucucuacacauuugaaugcuauaaauaauccaggcccaaaaccucaaacugaaaacuuaaaaaggaaaccuugauuuuggaaagcucaccccuugagucaacagcccauucauuccaacuuuuuaaaaauguagcccuccgauacuccgucauaauacgugccuuuagcagaugugcagaaaaggauugggaaucuuauuacauauguguguguuuuuaaaaccuagauucuuuaucuuauucuaauagagacuaaaauagcacuugcaaauauuuuaaggucuuccugccagcauucuuuacccaaaagucaaugcuuuccuauaaggagaucaaaacuuucccaaagacuccauucccuugguuguaguccauguaacaguguaaccagguuccuaugaaaugggcuuucuacugaacuuucagauagauggccaggacacgcaugaaaccauuucuuuggauuuuacauguugaagaggauaauccuuaaauguaauccugagguuuuggggccaauauauacauguguagccagugagauguaagaaauagcuaucccugcaaauugaucauugcuauugucuucacagaucuguggagaaaauccauucugaacaacuuaagagugucagcuuuuccuggugcuucucuggagcuggggaaauaggccacuagcagagagagcccuauacgcucucugacuauuucaagugauugauagccuaacguggacagagacuuucauauuauauaaugcagggcaguucaauguuauuauuggggccagagggaaagaaaaaucaaagguuacauugaugugauuuucuuccaacagccaauaggagacaugccgucacccucugugacagcauuuccagacaggauuaaccuaagggaguaagagccacccucaaaaugggcaacccagaaguagaaaucccaagggaaaggaggaugugcacaccuccuuacuucuucuugagcggugucucuaacacuauugcugccgauacauccuccacugcugucagacuccagcuucucgagcuuucugauguggacucaauacuaguaacucucuagcaaacuuccagaauuccaggauuagauugaaacuacugggucauucauuuucguggacugaaaagcuaucagauuguuugcuccuccagccuacagaaagccacucuugaacacuccagcccuuauaggauaagacaaucuaauaaauuccucuuuacaguauauauuauacagauguauuugauauuuacauacauuuuauaggcauuauuauuauuauuauuuucucuucuuauuugauuuuguuuuuguugaucaggucuuacuauguagcucugucuguacuggaacacaccauguggaccaggccagccucaaacucacauagauuugccugccucugccuccugaguacugggauuaaaggcgugugccacuaugaucugaucgguauaacacagcuucuuaaaugauggggcauaaccucguguggaagcacacaacugaacaaaggcagauggggaaaaugcaauguaagagguuucugaaugugcagcaaccaaaaauuaauucaaaaccaacacacucucaagccacucaugacaacaugugcucucacgccacacaugacaacacaugcccucauaccacacaugauaacucgugcccucauaccacacaugauaacacgugcucucacaccacacaccacacaugacaacacaugcccucacaccacauaugacaacacaugcccucacaucacacaggacaacacacgcucucaacacauaacaacauguacucucauaccacacaugacaacugguguucucaggccacacaugacaacguguguucucaggccacacaugacaacguguguucucaggccacacaugacagcaagugcugucugaaauacuuugguucagacucauggucugagaugcaguguuuuaacugaacauaugaaguuuucugcuauuauagaaacaggaugguuuaauuacagaaaacaaaaacuuaugaauuucccuacauucauuccucagcacagaagcacuggacuaguaaauaucugaacuguauuguguugaaaugucugauuuuuggaauuuagguagcuggcuaauuucauuuuaaaaauucauuaauucauuuucacuuggaacuaggagagaauuuccaaguauuucugaaauggcccuaaacguacucucauucugcacuaugcauuucugugagguggcaacaacacacugaugauuauaaaaucaaaauaucaaucgacuccaaaaacacugaagagguucauauuaugcaguaccaaauauugagccuaauuuuaauccuuuacauaaaauaaaaccacauccuucccauuaguaugaaauuugcuuuagaucuugauaaauaauaaaauuauauguagagauuacauauacauauauaugugaacaauuauauucagauaaauuuccuuacgaugugauaucaguaagugcguaauuuguacaccuauucuauauacuuugggucacauaaguauucucaggcauaaagaggaagcaaacagaagugacucaagaagcucuguggacagaauuagacugauacagcagacaugaaauuuuugccaaaagugacuuaaaauauuggauuuuuaaaaaauaaaauaucuauuugacugagucccaauuucuuaagguguuuuuauaucucuuuuuaagaagauaugauaacugcucuggcguacagucauauuuuagacuguaaacacaauuacacaaaagcuaacacuuuagggagcauaauggaaaaauuauauuaccaaacauuuuaaaugaauaauauguacauugacuuuuucauuguaaucgcauagcaaaguacauaauagguuggcugugagcagaaacggcucaaguagcaaucacaucauccaugcuuguucuucacuguauaaaauaagguuccacagagaacauuucagaaugugaacgucuguaaccaguccgagcauuagacagagcccucaugaaaaccacacuagacaugauaacgugcuuucaacuuugucacuggugguaaaaauauaaaacaaugcucccagcccacaccccccccccccccccgcccuccaaaguugacaggaugcuugaaaacaaacugacagacaggagagauuaaccuaccaugaucacacaccauggauucaauggcgauuguuccuucuacccuuguguuugcuaucuagauaguaagucagagguacugucaaacgcacaauaaugauguuucauacauccacauucuaauccucggagucgaugaagaugacaugucacacggcaaagaagaauuaaggccagugucagaauuaaacugcugaucaucugaauuuaaccaggcuuauccagaggcauccaacacaaucagagauguccuuaaauagaaaggaugacaggagacauagagccauagagacuacagcaagagagaccucacuggucacugggugguaaaaauaaaacacaaagcacccaggaaugugaccagccucuugaccugcaguucucaacauauggaucaccaccaccauaggguucacauaccagauauccugcauaucagauauuuacauuacgagucauaacuaggaaaauuacaguuaugcaguagcaaugaaauacuuuuauaggugugggggucaccacaacaugaggaagugucccaaagugucacagcauugggaugguugagaacgacuguuauagaaucugggaagggaaagaaaauauauuucccuagagccucucaaagauaacgcaacccuucugacucugugguuuuuagcccacugauaucuguuaaccucugugacuauaacacaauagacuggcaaggcuuaagccacuaaaugugauaauuuauuauuacaucagcaacaggaaacuaauagagguauauauaauaaccacccuaaaacacaagaugcucagacacaucuaaauauuuaggaaacugaggcagcaagaggaaaagaacaugaacaacacauggauugggagggggcauucugcauguuaugaagcaugugaaguacucacagaggcaucagucuuuaacuucuaucuuguaggaggcacagcagccucuacauaaauguaaugccagggcccacagcggcaaagucaccuucuacaggaggaccuaauugaggacugccuaagagaccaaggauugcugacacagacaaugccagccaaucaggaacugcugcuuagaagagaugcuuucuugggaccaaugggacacgggugagcguauuaaaggagcuugcagcagcuuucagaggugcuugcugugacauuucucaccugauuccacaccaccuuaccugcaacccccaaaggcagguagggcggggcaucagguagaucagggcacaggcagcacuauaauucugaguuuuugaaugaggaaguaaagcauaucuuuuccaggaucacaguguaguuagcacugacugccagauugaggaccaagcugccuguucccagagaccacuccggguucacugucuuaaaguaccuuucuauuauuuugaaauaauugagacuuucuaugcuuuagagccaacuguauuucuucugugagugccucauuuuuccauuguguuuucuaauauuuuauuacgcuucaggacuugaaggagcuauuuuauuauuauuuuuuuuuuuuacaaaaugaauaguuauugacuguuucuauguucuaacuauuuccaucagcucagcugaguucacccugucacuugccuuaccauagauauuuacggaaucaaaucuacauaguuucucaccuugacaccacaacaaaggaaagcauccuuuaaaaaaaaaaaauuuagauuguaaaauuaccucuuaaugacuacucuguagaaguuagcucuugcucagugugauuuaauggacuaacuuccuccuucuuuccuuacaucagucuuuaaaauaacuuuaaauuuucuugaacauacuuuuauacuuaauacuagugcauguuauaauccaauacauucuuuuuaaaauauuaacucuucacaagaaagcugcaaaugcaacuauaguuauuccacuuuaugaauuacauaaacaagguccagaaacaugaaaugacuuggucuggguugcauugccccacacuaagugaggcggggcuucaaagcaacaacagucuucuuccauugccuaaugucucacuacagugguucucauccuuccuaacgccacaacacuuuaucacaguuccucaaccauaaaauuauuucauugcuauuucacaacuauaauuuugcuucugauaagaauuguaauuuaaacaccugauaugcaggcuaucugauaugugacuguacugaaaauuuuugguuucuuugaaaaccacagacauaauaugggaaucuguguuaaucuuaggugugggauauggggcugcuucaaauuguccacagcagcugacuaugauuugccucaugcucuagcagggcugugauuuugccagcugcagauaguuugugugacauugggaauucugcggacuuuccaaaggguauauaaaugggaggaucuugagaggcagaguuguuguuguuguuguuguuguuguuguuguuguugugauuggagguuauuguuuguuggucaguugcuguugaucuguuuguuaaguagucaugugcaaaaaaagaaacaacaagaagaaauuagauaaucugauggugaagaugaaacuuaacccaaggaacucgauacucauaauaagcaggaaguagucucccuuuuucucuuuccuaucuagaguuaaggaguuaaagggguggaagaagagguuggagaaggguggaaaauuaaagaacccacaaaguagccaaagucuggcuacaugaggucccugugaaugggucuugaccccaaaggaguucucacucacaaguugcggaccacugcugcauuggguguguccauugguugcaugguuaauuggcuggcuggcugacuugcuagcugguuuauuccuucuucuugugguauuuggaaucaaggucuuaaggaugcuaagcaagugcucuaccacugagccauauucucaacauugccuggucauuuaaauugcaaggaacugacauuugguugguugguugcaagucugggggcugagcaguuaaaacauggggcuuaaguaugaagagcuaaaguucagauacccagaacccaaguagauagaggauggacuuggcaguauaucuguaauaucuguaauauccgcauccuuggacagcagagauggggccucccuaacgcaagccuaaggcacaggggugagcuuugaguuuaacugaggaacccuaccccaaggaauacgguguaagauugauacaggaugauucuuucaugaaccuugggcuccaucccacaccgcauauaugugagcauacacaugcaaaauaugcguauguauauaugcauaaguacacacaaggugaaaaauggagaagaaagauaaauaagaagcaaggacaucagcuaggagaguagagucaauuaugaaagagauacugagaacucagaaguguguuggugagggaaggcuugcauaugaaucuagacacacuacgagguagaaggguuacaucauuauucaauuuauaccacagaguaaagggaacaagccguauuucuacucucuacagccagaaagccacguaacaaucugaguaugucccagaggaguuucucuuggguuuucuggcuagaacaacuaccccccuuuccuuauaauacucauuccauugguuuuucuuauuuaacuguucuggcuugaauauauaaaguaagaaagggaugauucuguccuguuaaugaauggagugguacuccugauaguguuucagcagcagcucaucaauggcucuuagaacauuaagaacccccaguaaaggaugaaaaggcagauuagcgcaaggcauaaaagcauacauucaaacugcuaacauuaaaugcugauucuaccugccuuaccagacaacauuuuccuauacaaauaauuugcauuguccuaggaauuggccacuucaguuuuccuaaucuauguuacaacuguuuauauuuuuacaauaaucgcuauuuucuacacuuacaguucuacucuauuguaaugucugaugcucuauaucuguguuagcguaugugagucuauuuuacugaccuauucagagauuuggcuugcuuuauuuuuaccaaauauaugugaggcgugaucuuuauucauuugaguauuuacuucuuaauuuauuuucuauucuaaacugaaagguuucaaugagccaacuauuaugguuuuuuuucuuuccauaguucuuuuaguuuaauacuuaauucauuuuauucuuuauugucuauaaguaaaagaauuacaagcacugauauuuaugugauuuuuguccauaucacuuaggccuugacaagucauaauauuauuuccauuacuguauguaagucucaugacggggaugaagaaaugcuaaagagaaagauguuuuuugcacucuugcuauaguggacaauagagccuaagaaacuaaaauuucaguugaaaaaccacagcucucaucuuacagcaauuagaaacaguuuauucggaagugaccaaggccugagcacacagauuuggguuaccccaaauuccauauuccaacauggaaacuguuuuaagaauuuugcauaggcuuacaggauggagagugacgacucucugaugauuuaugaaaaucaagacaaguuuaaacugcacuggugggcaugagaugagggguuaccuacucuauaggcuuaaggugcugucugauggcauucuuagcuuuagauuggugggagcuagugcucccuuaagucaauauauucuaaaaagguuuuuaaucuauuguuaugagaugucaguuccaauacagaguggaagaaggaaagguuguucuggaagguuaaaacuagcuggagaugagacaauuagccucugaacaggcaagauuccagucucuccacaguacugaaacuccaaucaaucuccguggauacagauuccuuccagaaguuuuguguccaaagccguacgcugccucuucuccggaguuuuuguucugggugugaagagcagaucaggagcacagguaaacaaggaugugucagugaugggcaggaccacacagugacuaggacuaaagucaagcuuaucucuugugcucuauuuaaacuaaaucuucaugucuggacgcagaagaugaacuugaggagagucacugugacagucaucauuaaagguucacuggggaaaacuucuggacaagaggauaaagucucuggccuugaaggaaacuuaacauuucaguugagugcauuguuagccaaggaaccaacccugagaaggagggaucgauuuaauccaugcaaaugagauggguagaauaauugucucuuaaggauauaaugcacuucugauucacaaaguucccaccugcuaguacagucguuuucugacagugcaacagggucacagcugaggugugcccagcccacuuuucugaauuucuuagagaagcacuucuuuucuucuaacucugugccaagcucacuuucccucacacuuccuuucuuacuuggccaucucccugacauacagcuguuuuccccaugcagcuggcccccuugccagcauaacucaaaagagcaacauuguagcaucuuuuuucuuuucguuccccuucucauccucuucucuuccucuaagcaauggccaaagcauagaacuugaaggcuuuggauuugcucuucuuuuaaacucuaacaaaaauuaugcuuaagcuucuguuugagucuguucuuaaauuauuuuacuaaugagaaacuaauaacccccaauuuccccaagaaugaaaaaauaaauaaaaaaaggaaacaccuuugguucuggguuuugucaccagauaaaguuuaaaaaagaaauaaaaaaggaaaggaaauaaacaugacugcuccuagguaugguggaggaaaaaguuuauaauagauaaaagggagagcauacagaggcagggacauacgggagaauccagagcagacaugaccagacugagcugugccacgaguuggugggagguauccaaaauggcuggauuguauagggaagcucagcgggaggaagagcagcuggagaguucaggguagcaggugaggugugcuagccagaaggacccuguaacauaggaacuaugggaugcugggagaacaugguggucaaugcccacuuugauauguuaaauaggcaucucagccauuugucccggauuugaaacuuaacaccccaguaucaacugauuucuuuaucuguucuucuuuccaauguagccauauugggaguugggggguggggguagggugggauggggugggggaguccugcuuuuugcuaauacuuguuaauuugcauacugaggauggguggcagagcuauacugggaugagaacuaaacacuucccuggcuuugauccuaauagcucaggcaacacagggauuuuaaaaccacucaguggguuuucuuuucaaagaaaaucaaggagggaaagagagcagugucuaagcuguauuaacgaauguuuugauauucucuuuaguuaggcuaccccacaacuucugaaguugagacugaguagaaauguagggagagaaauaaagaaacagacuaaagggacaaauuguucuugguuagaaaguguggguuccaaaaaauguaugcaguuauuuuauauauauauauauauauauauauacauauauauauacauacacacauauauauacauauauauauguauguauauguauguauauauguauguauguauauguguguguauauauauauguauauauauauauauguauauauauauauauauguauauauaucuuauugcccagucccaagggaggcugaauugaggcagcaaauggaagaggagauugagagccacaggcuaaccaucaaucaguacagcagggggcaaacaagcaagggaagcaaauagcccgaggcuaccugcuggguuggcagcaucuaucagugggaaguuauugacaaaucugcuuccgagcagggacaaggagaaaggggucaguaucccugcccuaggcagucuguugaagaagauguccuuuuccccucuggaccuucuucccacagagaggcagggaggagggcaggggcaggaaugacaggagcgugcagggggagacagaggcaaggaggaugacauuuucaaacaggucugcaauauuuaaacuaaaauacuucaaguuacuuacuagaaaaccccaccucuaaaccaaucuucaguaaccucgacagcagcaacaucaucagcagcugccaaaaugagacuguguauacaauacaauacacacacacacacacacacacacacacacacacaccaaacuucuugugugagaucuguugcauggagucuccuuacagcauaccuuggcuccaacagguacuucugccaauaaauccuaacacuggggcugacacuugguaggauaucuucaugccugcaugcuccccucucuccuaggucuaagccacaccaggguccuauccccuguccccaguccaccugcaacagacuuaauucuuagcuuacugauagcugggugccucauccaacacuuccaacugguaaguugcuucccugaaucugaagaaggcgaccauugaaccuguggaaggggaauacugcauccaccucuccauaaaacagaggguggggcaguguucagugacaaaggcaucuccugcaggaggaccuaacugaagacugccugagagaccagggauugcuggcgcagauaacgccagccaauuggaaagugcuguuuagaagagauguuuucuugggaccaaugggguauggguggaggguauuaaaggaccuugcagcagcuucucaccugcucccagagucugugccauugaugccauaccaccucaucuucaagccccaagggcaaguaggguaggacagcaagcuauccugggcacuugcagcaggccugcucuaaccuccacagccagcccuaccauauucaaacugccaucaaaagguacauugggcuaacuguccccaucucccucacagcauggggacaucagaucaccuuccacccgaccucuuaggccucaccauggaugacuaaagggacccaggcucccuuggcccaaccacugucaucucugacagggagccuugcauagucauuaugauauuaggguggcccauauccuuccuacuggacacgaggaccacucacucaguccuggcagaguuuugggggacccaccucuccucauuucccuauugucagaguaggggaacagcauuaccaaccucaccagaccuaccauucaacugcauuuucaggggugcucuucuuacccauucuuuucuggugaaggcaaccugccccauccccuuauugggaagggaucuucuagccaaagugaggaccucuauuuccuuugacccuucccccaauucaccugaucccaagcuugccagcagccccuccuccucuucccucuccuccuccuugucuucuuguuccuucucuuccucuuucucuucuuccuccucuuccucuucuuccuccucauccuccuccuucuccucuuucuccuuccucuccuccgcuuccucuucuucuucuugccacccaacauacugguuccaacaccaauuuccuuuccuacucucccagguggacccucaaguuugggauacccaaaaccccucuguugccaaagaccauuccaauuguguccauccaauuacaggacccuacccaauccaucacucaaucccaguacccacucuggcucccgagucucagggaucuucagcuuaucaucucugaccuccuaagaaaaaucgacuucacuccauaucuuccuccccuuaugauccuuaaacuugcagcuaaaaaguccagugggagcuacugccugcguuaagagcucugauucaucaguucugcaaugguccuccuuuacccugucauaguuaaccuuuacggacuccuuuccaugauccccggagggcccucccauuucuuaguccuggaccucaaagaagccuuuuucucuauucccggcaucauccaguugccuucaccuggacuguccuaccccaugaguuccaaaacagcucacaccuaucuggucaggccaugaccucugaucuacucucuauccuccccgaaucuaaacuuauacaauaucuuaaacaacuugaugccccuggccccugggccuuugagauuccccauauggaacuggauacugcccuuccugacccaucucuuucugguuuugcuccuuuauuaaucauacccugcuuuaucaauuucuucucauaacaauucaaaaaaauuaaacuucuccucaguccaucccuacaaauuagccaaaaugacaccuuggcucuucuaaacuucuuguccagucaaggcuauauaguuacacuauaaaauccaacuguucacccuuugagucaccuacuugggacuaaccauugccccaacacacaaagucauuaccuuggauagaaaauaccuaauccagucccucacaaucucugcuaccaaagaggaaguuuuaacaaucuuaggaauagcuggcuucuuacaucccuggauccccucccaucugcccacagcuaauagaauugucuacagcuguucuccagaacaacaaucccaaaaucucuaaagaaaauaacugagcaacugaggcaaauagagcuguggcccuuggaggcccagacucaucucacccacugcagagcaugcuugauuacaacccacaucuccucuccuaaauaauacagaccugucauuucaucuccugcuucagacucuaaccuuggccuacuggcuccucaauguuacccaaccuggcugcuuuggagguuguugacugugcauucuuccugagacuagcucacaaaugccauuuaacaguuucucacauugcuuuaucaacuaaccuuaccucaccacucaccaacugccacagcucccuaccuuuuucauaucaccuucuugggcauagcaaauuaaccaaaaugacacauucuguaugggguguuaaauuccuuagauugcaacagaaccuuaacccuugaugccccaccucaagauccaguggccuaccaucugcaacaccuugauucuuuguaguucucaagccuacccucacccaccauucauuuggucaggggauugcacacuaguauuucucuccaagaaguauuucucuccaagaaauacauggagaagagccccuccugauucugauugugcccucaauaacugcccaacacaauaaauuggugguuaaaaucuugccccuucaggcuguuguaggaauaacugcagguguugcuaccuggagagugggacuagccacaacccugaccuuguauuaucaguuuucuuuccaguucaucccagaccuccaacagguggcccaaaccauacucacccuucaaggacaaauggaccucuuggcagcaaugauacucuaaaaccaacagggacuagaucuuaaaacugaggaagguggccuuugccucuuccuccaagaagaaugcuguuucuaugucaaccaauugggcaaaaaaaaaaaaaaaaaaaaugcaacaauucccaacagaccuccaaaaauggaagaaacaacuugaugcccccagccccugggccuuugagauccccauauggaacuggauacugcccuuccugauccaucuccuucugguuuuucuccuuuauuaaucauaauaucauaaucaauuucuucucauaacaauucaaaaacaaugacaaacucaucaauuuacucucuaugguucuccagugacaaauucaaaaaaaaaaucucuaaucgaacaaucaguuacuguuacaggacagccacagagcugguacucaugacaaccaaauguggccaguuagugaggaucacuagugucccaagaugucaauuccaccagacagcaagaagcagucuaaagaacaugaugcccccaucucugacucaccagccacacugaaacauuuccucaccuuuuauaauaaauaagagggaggaauuugaaagaccccaacccuaagacuuccuuugguaaccuaacaucagcacccacauuaugaucagccaccaagaugaaacacauuuccaccgucacuacaaguggcauguuuuaccugugcacauaugcuauaccccuuuaugaaaagccaaugccuucucucccacauucuuucuuuucgccuucuacccucacacaaugguagccucaguauacgcuccaccccccaguaaaccucuccugggagauuuguugcaugguaugagcucuuggcagcauacguuggcucugacucacacagaucacuuauaucuauugcuauaccccuucuauuuauacugccauauaucuauaucuaaaucaaaaauaguggugaggaaauacuguggguggacuaaaagagaaccagccacguacuuuuuccagggaacagccacauccauguuaagggcuccauaagcccuuaauugauugauuaauugauugauuacugagaacuuuguggccgaggaugguuggaaugaugcaaaucuagaauugaauuaucaugggcuaucauuggcagcuguaguggccagucacuguucaucucuguaucuuaccaaacauuuuugugacuaucagacaaaaucuuuuaggguauauuaacuuuaaagaccauuugcuuccaccaauuugaaacuaaaaaugccauccaaauagcaucuuggaccuaugcaagugaugucuccacuuugcugaaauacaacuaacagauguuuccaagaauguguuucuaaaaugaugacuugauuuaugacuuucuuguguucuaaaacuuuaaaaaauucaugaaaucauuuucacauugaagcaugguauuuagggguguccuaaguccaugcuaccaggccauggucauuuguauuuggcucuuauuuucuuugagauuagagcuggguuuuacauugacaauggcuccuugauauauggcaaaggugacaugaaaguacacagaaucaagaauauuuuuucauuaauugaucugaaucaauccugcaucuaucugaagaacugaacuucaaucucucucuuaagucacauaaaaaauacacuaacuggagacaagaaggaaaagaaugaaaggauguuggaccugguacccacagaaggcagaagagggcaucagaccgcuagaacuaguguuacagaugguuguaagccaucaugugggugauuggaauagaaccagguucucuggaagagcaggcagugcucuuaacugcugugucaucucuccagccccaacuugagcuuuuuuaucgguagaccuaucauauauauuuuuguauuucauuauucuuuuugugucuuuuccucugccuuaugaaacaaugaaucgaauuuauuuuaaauaauuguuuaacucuuaaaguuucucauacauuauuugaauuccuucucauuuauccuguaacuguuauucugaaucugcuuaucacuggaaaguggugccauccacuagauagaaccuuuauaacuaugaucucauugucuuaguuaggauuauauuguagugaagagacaccauaaacacaggaacucuuuuuuuaaaaaaaguauuuggucuuuauuugguaauuuuuaaauaguaccuuaauucuuuuagaaaaucaucuuacauaauauauugauacuuuacugaauauggagucauugcucuuuaaaaacagcuuuucuccauuaaaucacauacaauaaaaguaaacuucaugaauuuuaagugacugauuugaugacuuugacaaaucuauagagccauaaaguagacuacauuuaugucaggccaaaagucuuucaacagcuucguacacaguuaacccuugugaagcacccccuggccccucccccauugugaagcauccccuggcccccucccccauugugaagcauccccuggccccucccccauugugaagcacccccuggcccccucccccauugugaagcauccccuggccccucccccauugugaagcauccccuggccccucccccauugugaagcauccccuggcccccucccccauugugaagcauccccuggcccccucccccauugugaagcauccccuggcccccucccccauguuucuuuuacuuggaaggaugaguuuuagauucagauucauucuuuuuguauauguuaguaguuccuuuuuauuauuaagcuguauuugaugggcacauuuucuuauuuaccugcuguuaauggauauuugguuauuucucaugugcaauuguugugcaugggauuaccaugaacacugcaaacacaggaaugcuuauaaacucugacaaaaacauuuaacugggacuaccuuacaguuaagagguuuaguccauuaucaucaugcaggaagcauggagggacacaagcagacauggugccaaagagguagcugagaguucuacaucugaaucuucagggagcaggaagagaaugccacacuagguguguuugagcauccuuagacuagaaagcccucccccagugaugcaaacaaggacacaucuccuaagagugccacucccuaugggccugugaagggaccaugacuauucaaaccaccauacucauaguaaaccaaauuucuuuuuuucaacuaaacaaauuucccaugcuugaaacacaccaauaaucccauguuuuuauaaauauaauacugcuauuggugauuucauuuuaaaaauauguguaugaacuagguauaagaauauucucauccuaaacugaaagauccccaaguauguuaagugguucaauaaccagaaucaaccuuguauggaaacuaaaugugcuugacugcucuuuuugaaugaagauaauguuaauuuuaaguuuuaaauuuuuguuuuauuuacuuuugacaaagacagaagcagaaacuuuccaucaugugucacuauauucuaaaucagccacagauuuuuguuucaguacaacuuccccucaagacuaaaugacaagaaucuguaaaauaucaaacaacaaaaaaacuaacuaacuaaagcaagugaagcuuguggagagaaaucuauagucuacugaaaaagauguuaaaguggacuuuagcccacucaaaagaggaugucuucccaaagaaucccuuuuagaaauacaauaaaagcuacaccucuaccugcagucuaggaucugcacucuacaccacaggccacaguuuugccugucuccuggaggccugcugccccaugggaaaucaggcaaaauauccacaccccaauaccccaccuguugaggguacccaauacccucagcaagcagucugguccccacuguacuccaucuuccaguccacaccuugaccugcaaauccugcaugugcacugcacaacacugcuuguuucccuugagagcugcugccaccuaaaacaaccagaaaccugcugccaucagggaauaccaacuauaacuauaguuccaugggccagucaacaucugagacaaccagaaggcuaaaggucagcaaaagaacacaaccaacaacaaaaaacagccagggcaauaagacagcaucaaaacccaggucuucuacuacaucaaguccuggauauccuaacacaucugaagagcaagauaaugaccuuaaaucucaucuuauaaagaugauagaagccuuuaaagagaaaauaaguaaauaaauuccuuuaaaaguacagaaaaaucugggcgugguggugcacgccuuuaaucccagcacuuggcaggcagaggcaggcgaauuucuaaguuugaggccagccuggucuacaaagugaguuccaggacagccagagcuauacagagaaacccugucuugaaaauacaaacaaacaaacaaacaagcaaaacguaguacagaaaaauacaaucaaacagaugagggaaaugaauaaaacuguucaagaacuaaacauggaaauagaagcaauaaaacaacaaugaaggcaacccaggagauaaaaaucauaggaaagaacaggaacuacagaugcaagcaucaccaacaaaauacaagggacagaagagagaaucucagauguagaagacacaauagaagaaauugauucauuggucaaagaaaaugucaaauuuaaaauguuucuaacacagaacauccaggaaauuuuggacacuaugaaaagaccaaaccuaagaauaauauaggaauaauaauaagaauauaggaauagaaggagaggaugcucagcucaaaggcccagaaaauaucuucaacaaaauaauagaagaaaauuugccuaaccuaaaggaagagauggcuagaaauguacaagaagcuuacagaacacaaaauagauuagaaccacaaaagaaaacccucucaccacauaauaaucaaaacacuaaauguacagaacaaagaaggaauauuaaaaucugcaaggggaaaaggccaaguaacagauaaaugcugaccuaucagaauuacaccugacuucucaagagagacucuaaaagccagaagagccagagcagauauucuuacagacccuaagagaccacagguguuaggacagaaaacuauucccagaaaaacuuucaauuaccauagacggagaaaccaagauauuccaugacaaaaacaaaccaaaacaauaucuuuccacuaaaccagcccuacagaggauaauugaaggaaaauuccaacauaaggaggguaacuguaccaaagaaaacacaagaaauuaauaauuucacaccagcaaaaacaaaagaauagaaucucucuauguguaacugucugucucucucucucucuuucucucucucucucucuuucacacacacacacacaugacacagacacauacacuaacaccaccaacaucaaaauuacaggaacuaauaaccauuagucauuaauaucucucauuaucaauggacucaauugcccaauaaaaagacauagacuaacagaguauggaugcacaaacaggauccaaaauugaacugcacacaagaaacacacuucagcaacaaagauagauauuaccucagaguaaaaagcugaaaaggguuuuccaagcaagaaacaagauggaguagccuuugcaauaucuaauaaaacagauuuuucacuaaaaauuaauucaaccaguuucaaauuucaaaauuuuaaagauguugaaggacacuuuauauucaugagaucucgguucugaacaucuaugccccaaauguaagggcacccacauaauaaaacaaacaacaaaccccacacauuaauugcagccuuccugugucccaucuccuuaaaauuucucaugucuuacacaaaguuuuagauauucacaauagguauauaaagacuaucccaaguguuuuaucaauaacacgugauuuuagaaaucuacaagaauucucaggaauuauuauuuuuuauuccuaaaucucaaagauuaauauucuuuauaauuuuggaguuuacagcuuagggaauauauaaaaauaugggaacaaaugaacaaaaaacucuuagagcuuuuguuaugguuuguacaugcccggcccauggggaggcauuauuagaagcuguuggaauugguguggccuuguuggaggagguaugucacuguagacaugggcuuuaaaacccucauccuagcuaucuagaagccagcuagcagccuucagaugaagauguagaacucucagcuccuccugcaccaugccuggcuggauguggccauguuccuuccuugaugauaauggacuaaaccucuguaccuauaagcugaaccccaauuaaaugucaucuuuauaaaaguugacuggaucauggugucuguucaaagcaguaaaacucuaacuaagacagcuaucaugauaaauucuuuuuagaguguaauagagacacaaaagugaaaaccaaagacccagugaacccuacaagcuuagaagaggcuucauguccauccauuugccuaggaauuucauaaauucauucuuuuaauagcugaguaguacuccauuguguaaauguaccacauuuucuguauccauuccucuguugagggacaucugguucuuuccagcuucuggcuauuauaaauaaggcugcuaugaacauaguggagcauguguccuucuuaccaguuggaacaucuucuggauauaugcccaggagagguauugcuggauccuccaguagcacuauguccaauuuucugaggaacugccagacugauuuccagagugguuguacaagcuugcaaucccaccaacaauggaggagcguuccucuuucuccacauccucgccagcaucugcugucaccugaguuuuugaucuuagccauucugacuggugugagguggaaucucaggguugcuuugauuugcauuucccugaugauuaaggauggugaacauuuuuucaggugcuucucggccauucgguaacccaaucacaaaagaacucacaugauauguacucacugauaaguggauauuaacccagaaucuuagaauacccaagauacaagauacaaucugcaaaacacaugaaacucaagaacaaugaagaccaaaauguggacacuuugccccuucuuagaauuggguacaaaacacccauggaagggguuacagagacaaaguuuggagcugagaugaaaggauggaccaucuagagacugccauacucggggauggcauacccaucccauaaucagccuccaaaugcugacaccauugcauacacuagcaaaauuuugcugagaggacccagauauagcugucucuugugaagcuaugccagggccuagcaaacacagaaguggaagcucacagucagcuauuggauggaucacagggcccgcaauggaagagcuagagaaaguacccaaggagcuaaaggggucugcaacccuauagguggaacaacaauaugaacuaaccaguacuccccagagcucgugucuauagcugcauauguaucagaagauggccuaguuggccaucauuggaaaaagaggcccaucggucuuacaaacuuuauaugccucaguacaggagaacgccagggccaagaagugggagugggggagggaggggaguggggugggaggguaugaggggauuuuggggauagcauuggaaauguaaaugaagaaaagaccuaauuuaaaaaaaaaaaaacuguaguucauuuauuucaacuaugaacguaaacaucuauguguguguaacuauuuaaaugugaggaagcuagaagguuacuuuggaaauauauauuuuugugagugcuacaugggcuuauguaucuaguaauauuuucauguguauacuuuucugcaaguuuggaugugguuauuuauagcuacacgguaaguguaaauaguaauagucuaagaauguuuucuaaauguuuauuuuaauuuauauguaacuuaucugccuaccaccugugugccugcccgaggagggugucaaagccccuggcacuggaauuacagauggaugggagccacucugugggugcugggaaucaaaccugggucuucugcaagaauagcaaguguccuuaaccccugagcccucuccccagcaccccuuugaccuuuuaaggugaacuggcaacacaauaauuaaaaauguuguuugaucuuugacugaauaagcuuccaaacuauuuauccucauccuguaaauuaaacaaaaauaguauuuaaacaaaacaacaaaaagaaguggcuucauagcagggaaaugaucuuuuguauacaaaaaaagaaaaaaaaaucuucagguggagagaaguguaaggugguuaacaggcaauacaaucaaagggaagauugccaacaguagagucaugacuguuaaucccugcucaacagaauucaguaguuuaaugaagaagguagugaaguuuauuagagacaguuagagaaccagaacgcaacguaguucagagagagucugccaacaaguuaaaaagucucccaagauucuuaaauaguugacuaguacaaucaggcauguuuuagaacuuaaaucuaaucauguauguaaacuaagaaccuaacuuguuuguucaccacugccacaaagggcuuauucuuagauaaucauaguagcugggcuucaaucaauugaagaaagauaauuuuuaaaauauuuaacuaaaaaaacugaaauacccuaaaucuuauuacacguagaagauaagaauaaugaacaaaacuguuucugccaguagucuguuucaagccaauccaucaccaccaacaacaaaacugcuguacauuucuaaauggaugcucagauccuugccacgaaucgcaggaggaccacauuggacuuacagucuagaccaagcaagaagguucucccuucagagaacauucuccuauuucaaaacuuuaccuacucuucaggugugcuuuccaaguccucugauagauagccagugcauguuuacauuucucuccauccccaggcucauggaaaaaaaaaugccuuggucuaguggauauuuccaauugcugccgagcuacugguaguuggagguaauuguaauaggagucagugcuuuauuauucugccuagccucuguaauagcucaauaagcccuucuauuuccgauauuccuucaucucuagaauuuuguuuuacugcauccaacuagccagacuauccuaucucagacuauccuaucucacuuugguuuccuaucaauacaaacccuguuaugaagucgaguucucagauccauuugucucacaggucuuugcacaaauaaacucuauuaaaaagaaaaacguauaaacaaguuaaauuuaacacuauucuuuuuauauagguucuuuaaauuuuuacuugagcugagucugaguggaugguguguguguguguguguguguguguguguguguguguguguguguguguuaaaaggcacagguugguuccaggugccuuuuucuaucucuuucuaucuuauuuuuuugagacagggucucucacuaaaccuagggcucccugucuguuacacuggcuggccaacgaucuacuaucuccugucucucucucucucccucaugcuauggugauggacacacgccaguggccuuuacauggguacuggaaauccuaaauucugaugcuugcacaucaaacaguuuaccugguaaauaguccccccaaccccucuuacaggccuuuaaaagagcaucaaaguuauaacauaaaauccacugcaaucagguaugggcugugcauacccacaauccauaugaauauaugaaggagacuacaacagaaagauaauccguuuaagaccacccugggcuacuggacuauacuggcugcaaacauauauacaauauauacacaugcacacgcgcgugcgcgcacacacacacacacacacacacacacacauacacacacuguauaaaaaaaucaaaacuacggagaagggaaauuuccuuccaaagaagaaccacugccgcucuuaaaauguuaaucauuuucuaaagucucauuuauuaacgcaccuugauccccauugaccuacaauucaacacgacucagaguugcuagcaucgauuuuaaucauucccuuuguuauuuuccuugcagguuauuuugaggaaagcuguucguuauggaaaccuuuuugaauaguaaucagucuuucacaaaucuccaaguucuucuaucuagcuccccuaucaucccauugcugcuguuaauauuaugcagauuucguaaacaacggagccuguucacacgcaaacaaucuagguuccaccauggacaacaaugaagggguccacacacuuccccucuaagucuuucaugagcugcccauguuccuuuuaaaagcauagcaguaugugcuauuguuauguauuccaaagcagcuaugcauaaauggagauuccuuucaaauucuuuugacaugucacuggaguagcuccaggaaagagauuaacacuuuuggggaauucuguuguaucccuuuuaguaaccaagugggaauaggggauacaaagauugaaauaaaugcauuauucauuuuuaacaaggugguuuucccucuuguucuuccuuuuaauagcucuagaaauaauuucacuguuaaugccaaaucuuaaggauagugcuguauaaauuauuauuuuuuucuuauaaaaaaggcugggaagauuuuuuacucacuaucaguacauaaaauuggacaacugacaaucuucacacacaauaugcuuucaaugagcaugcucuuaugccuaaaagaggaaacaaagcauuucaggagugugcuuguaaaaggauuuuuuuuuaaaaccucagagcaaauuuuagaguaggaaaucaugacucuccaacagucaaauucaucacuggauauuuaaaggcaacauuuagagcaaguuaucugucauuaauauacagaaacaaaggagcuuuucuaaguuaaggcagcuaaagaacaauccuuaugugaagcauuuauauuucccuaauagucacuugaaaaggaugcuauuauucugcaaaggcaaauccauaggaaacaugguuucauguuuguaugaaaaauuauaaaugauaaucaauuaucaaagacauuccugccauucacauucaaauuuagguaauuauuaagauuauucaauaccaaaaauaaauuauuccuacguacuucuuucaucuccccaccuaauauccaacuguuaugugauacauccuacguuuuucuuacuccaccaaacauugagcuauaaaacaguaugaaccuacaaaguccaagugcaagauaacaguaugagccuacaaaguccaagugcaagauaaagggaauaagagugccaucuuucaguaggaaagccaacagacagacagacagacagacaaauacgggacucacauugcuguaauucaguuuuaauucuuuucauuuauuuauucacuuuacaucucaauaucagucccccucugcuuccaguuacacacacacacacacacacacacacacacacacacacacagauuccucccaucucccuuccucuucuccucugugaagggggcgcucccccuucaccauguaccaacauuccugggcacaucaagucacugcaggacuuagguacauccucuccaacugagaccagacaaggcagccagcccaguuaggggaauggguuccacagacagguaacauauucagggacagccccugcuccaguuguuggggaacccucaugaagaccaagcugcacaucugcuacauaugugcagggguccuaagggaacccaugcucacucuuugguuggugguucagucucugggagcucccaagugucuaaguuaauugacucuguaggucuuccuguugagucacuguccucuuugggucccucaguccuucccucaacucuuucauaagacucccugagcuccaucuaaugcuugcugguaggucucugcaucuguuuccaagagcugcuggguagagccucuuggaagauaauuaugcuaggcuccugucugcagguauaauggaguaucauuaauuacuguuagggacugguucuugcccaggggaugaaccucaauuugggccagucacugguuggcuauucauuucucugucucuguuccaauuuuguuccugcacaucuuguaggcaggacauauuuugggcugaagguuuuguggguggguugcuguccuuaucccuccuccauuggaaguccugucugucuagaggagguggccacuucaggcuccauagcucccacuacuagauuucucagcuauaguuacccccauagacucccugugcacccucugaccugugccagguuucuggcauguacuagagaugccccccaugcccacugccuauuucuguucucucuccccugcucuguuccccuucccauacccucucccauuuaguucccucccuccaucuaccucuaauaucuauuuuauuacucugucugagagauucaagcauccuccuuggaccauccuuaauccuuguuaucucguuucuuugggucuguugauuauaaccugguuaacuuguacuuacggcuaauauccacuuauaaguggauacauacccgguccuuuugggucuggguuaccucacucaagaugguauuuccuagauccauucauuuaccuacaaaguucaugauacccuuguuuuuaauaguugaguaguauuccauuguauaaaugaaucccauuuucuucauccuuucuucaguucagggacaucuggguuguuucuaguuucuggauuuacaaauaaagcuucuaugaacauaguugagcaaguguccuugugguauggugguacauauucuggguauaugccuagaagugguauaccugucuugaguuaaaauuauucccaauuuucugagaaacugccaaauugauuucacucagauauauuaaacucaaugagauaaauggcaaaguacagacccaacuauuuggauaaucucuuuugcacugaauaaaugucuuuguauuaaguaucaccuaucucaguguuuuguaaacaucuucucucucaccuucugcuuaguuuaauaaagaacugaaugaccuauaacuaaguagacgaggaaaggcagacuaucugggcagagauagaaacucugggaaggagucaaaggcaagagauuugcagccagacucagaggaagaagcaagugcugguacuuaggagguaaugagccacauuguagaacauagaacaguauaaacgggccaauuuaaguauaagagauaggugggaacaagccuaacuaaggccaaacuuaauagaaguucucugugccguuaacaugggcagcuggugggucagaaacaguccagcaguacccaacugccauuuaaagggggagaggggcaacccuauuaaagaauuaacucauaaugugcuucacaugauagauguccauucauuuagauauauacuaaccuucaagugcuuuuuuuuuuguucuugcuaacuguuuggggucugauuuugucuugcuguucuucuacaugugugcuccucgaauuucuacccaacuuugacuguuccgcaaagaccaaucacuccucuggacguuuuacuggagauuuuucuauacuuuuaacucagcauucucaaagccaaauuuacuccuaagccuuaaagaauccaccacuugucauguuucacuguagcuagaauucccuucucccaaauauguaaucucuaauuuucaacaugauaauaaguuuucuuuucuucucuuucaucagaccaagauacacuuaaacuaucaaaauucuaagagcaaaggucauauaaguugagauuuugucucuuguccuuccaugacacuaaugcagucaaggucauuagcacuuuuaaccaaaacuaauacaaaccaauggaagcucccaggguuuccacauuugaauucacaccauugguaacuucucauacuaauccuucaucccuuccaauuuuauaauacuuacuuaaauauguguauguguauaugugcagugacacacacauacauauauauauauauauacauauacauguguauauguauauacauacauauauguauauauauauauauauauauauauauauauauauggguguguguguguacacacacacauucauacacacacauacauaugcauacacuauggcaugaguauggaggucagaggacaauuugcagggaugggugcuccuuguacuauguggaucacggggauuaaacucaggguaucaggcuccacaguaagaacuuuauccgcugacacauuugacaagccccucaucuuuuauaaaguaaauuacauuuguauaugcuuauccuccuagagaagaaaaccagauaauuuuccaaacaugcuuuuuaaaacagaauaaucuugauagcaaagcauuacaagauuuuugcaagaaacuauuugugauaaauaaugcucuuaaaacaugaauacagagcaaaaauaucagugcaucaaaucccgugauauguauuuaaaggauaauaaaucauaacuauacuaagugucuuccaauaaugcaauguaauuugcuacacuaacuauaugaaagaaaaacaauaugaugaacucagcugauaaaugaaagauauucuauaaaauucaacaugaauuccuuauuaggaaaaagagaagauuucaacaaauuaucaauaaaauggaacugccucaggcugguagaugcuaaagcauuagggugucauuagaguagcgguccucuggagaagaagagaggagcuucaggagagauauuucuggaucuguguacuuaaaacgaauuaauccacuucaugggaauucauugaacaaagcaaagaaaacauacacacuuuccuccacacauaugucuauaaucaaucacuguauuuauuugugaaauuaugaaagcuuuccucuugagacagagaauuaaauggcguugccaaauaccaucacucucccaugacugacuacauacaugccccaagcaagaacaacaacaaauacaugagaacuucuccuuccccccaaaggaaaagagaacaacaauaaccacaaaacccaucuauggauaaauuagcacaauuaagggaaaaauacacagaaaucauuggauuucggguaaaaauuuuuuuucuuaaaaaucaaucauuucuauacaccaagaguuaacaaaaaaaaucuuucaaaaguaccaguuauaacaaaauuacagcauuuugauuacugaauuauugaacgaauuaaugaaaauauauaagcucuguaaaauacuaaaaauauuuuuguuuugaaaaauaggcacaggagcauggauuugauccucuauuacugcucaucaaauuaaaguagacguugggcuaacucuaugaauucauguuaggaugauucccagugcgugcaugcgcucaccugugcgcaugcacaaacauacauagacacacauagacacacacacacacacacacacacacacacacacagcgugaggcccugaguucagcaccagaauaaauucauuagcuaacuaaaguagacaauauaugaugggguauaccaugaaauaaaagaauugcacauugucauguuaauauacuaaaaauguauuuauaaauucauuguaauuccaaucaaaauagcaaccuguuuuucugauaauugaaaaaugagucuaaaauaaauaggggggggaaccaagacaguuuaaugaacugagaaugcuagaagcuaaguguaguacuuaggguauuggugcacagguaagcauauauaccaagggaagaaagagacacaccgcuauuuuuaaauuucacuggaaaacagaagagaaaugagcuucucauuaacagcucuuaauaucaauaagagaaagaaagaauauaugcauccucaaauauacacauacaucacagagcauaaauguucauuguuaauaaaaaauagauauaacauaaccaauaauuaacuauuuagaaguuaucauacagggaauaugauauauagaaaauauuucaaauucgacacgaaaaucaauaaucaugaggggaaagaugaacuuaaacgaauaaaaauuaguaacugcacuacucaggaaagacacauucagaaaguaaaaggacuaaucaaggguugggaagaaauauauagcuguuaaaaugucuaaaauuuagggcucccaauaccaagugauauauucucucuucccuuucucucucucucucucucucucucucucucucucucucucucucuguuucucuuuuuuguuguuuguuuguuuguuuguuuguucauuuguuuguuuuuugagacggaguuuuacuguccuggagcuagaacuguagaugaggugagucuugaaugcacagagauuggccuaccuuugccuccugaggacugggauuaaugagugugccacucucacccagaucugaacgauauuuucaauacagaccacuauaucaguaggaacagaaauuuuguauaaucacucuggggaaagagcuaaacaaauauauauguguguguguguguguguguguguguguguguguguguguguguguaauauaauauaucacuauagcuuuacuagguauaccuucaacagacauguauacagauauauauagagcgagagucaaucauuuauuaucccgacuuuucauuaauggccaucauacagagguaacuauuucuaaucuaccccaggaauccuugaauucaacuuuuaagagcugaauauguugauuuuguaucugaaaagauccuaaguggugauauuaugcaaaggacugaagagaguucucuuucauaacuaaucuauccacccacaucauuucugcccgaagauucauguccuaccugggguucuacuuaguauuuccaaauucagauacuuaaagauaaucauuauuuuauccugaguuuucuccaguaagacauaacugucuccuucaacuaucuacagauuuuauuuuauaucagcacauacauucaaauugcaugucugcuacucugauaauuaaugucaugagucagguugacuaggguagagguucucaaccugugggucacaaccccuuggggaaucaaacaaccuauucacaggaggugcauaucagguauccugcauaucagauauuuacauuaugauucauaccagaagcagcaaaauuauagccauaaaauagcaacgaaaccauuuuauggcugaggguuaccacaacaauuguauauuaaagggucacagcauucggaagggcaagaaccacuagacuauacagcacugugcucagacaucugguuaaaaacuccagauguuucugugaugggacuuucaugaugaaauugucaugucaggcagcagacuuccaugaaacaguaccuccuccaguguggcuaagccugcucuaggcaccugaaguucuugguagacuguugcccuaaaaagaagcaagagugucgccacaguauaccuucauagaguucugcucugagcucugucuccuuucauguuuuacagauuuuauuuuuuuugcuugccaagucucuauaauagugugagcuaaauucuuaaaauauaccauccuuucuccuccaccccacuuuccacccucucaguuauguaucuucagugaacuuugaacaauaguuaaguucuaagaauccauuauauauaccuguuuaucuccuggucuaaaacuacuuagguauguccauauaacuuuugaaacucuuccuaaaccacauacaaucuaaccagaaaauauaacuugaaaacuguauuuuucaccuaauucuaagaucauauaaucuuuuaaugcagccaaaacuugaaaaaaauccccauuaccacuguuuucacauuaacauuguucaagcuucaaugccuaacaaacaaauuaccauaccacaucucaccaacuuaauacuucuauaauuguuuugauggacauauacaauauaccuaauauuuucacaacugaauuauuuuuauuuacauuuuuuacacaauagauuuugauguuuucuccuaaucccucccagauccucuccaucucuacccaacaacauaucucucugucucucucucccucccucccucccucccuccaucccucccucuuccacccauuuccuacuaaauuuuguuuaaaauuuaguuucuuaccaagucuugucaaaaucuuuuaaaagccuucugauucaguauauauaagaacuuucuguuucauauuaauaaaauauuaguuuuaucacagauaagaugcauaguugagauuaagagaaauagcuaauaacaucaacuauauaggaagccuuauuucaaauggucuguaacucaagugauauaaauauaauucugcgagcauucucaggcauuggggggggggggaaggacacacugcuccagacgcucuuaaucucaagagcugguucuaaacaugggaguuuuauaacaggauaaacugcuuauucuucaaaccaguuuccaauuucccuuugaguaaaauggggacgauaaaacuaacaucacaggauugaugugaagauuaaaauacaugcaaaacacuugucacacugccuaguacacagcauagcugaugugacuuugaagcaggccguaagagcucagccggaguuagaucuauuccugaccuguccuguucuccuaagucagucuauaaagcuaacgcccaggguaaagguagagggaagagauggagggugaugucagugaauagcuaacaguugcuauaugaagcugcuacauaagugucugguuaaaggcuggagggguuuuugugaagacagcaaguagcuuagauauauacuuucauucagucucuuagcaaacugcagcuuuuggucaaaagggaacaaacacagugauguuugagauuuggcuaaacauuuaaauugcauuucaaacgguuggauuuggcaaaaucuaauauaauuuuugccaaguccuuaacuuuuucacuugcauguauucaaaggaaagccagcuuguagauuugaaucauucagauuagaaacucauuaaaauguauagagugcuuuauccaggcacaaaaacucggccccaaaucauuacaguuuaacacuggggagauaaaaacaaaaugccuuccuuacauaaaccacugcucucuacucuaaguugcugaggcucagaagaaaagauuaacucagaaaggccucaugaaagagaaaaauuuugaagagguaauuaaagugaaauagcccugaguacacaggaaauggaaaguccuccaagaauacagggaguugacauuacauaacagcugacaaggacuauaugcaaagucccagacacuugauuuugaguuaaauguauuuuuccaaaaugucuggaacaacuggauuuuucugggauagccagagacuaauccccaggggauauuuauucaacacuguauguccacacuggccaggcucucuaacaaauacugagaaacaaggcuaagacaggcaugacuugcccccuggaagcuuaucaucuauagggaaaacauuuuagagaagggagacugaagacacaucagaugagguggcacacaucugcaauccuagcacuuggggaguacaggguagaauagucagaaacucaaggucaaccuaggugacaugagacacagucucaaaaaaaaauaaaaccaaagccaccagauaucgcaaacuguaucaaagcugaaauugaucaaauauuaaaaggaguguucucauaguuuuucagggaguaccagaaugacgcuggugugccaccguggcccguuaugugugcgcuagaaauccgaccugggauuuuguacaugcguguagcucagcccacugagcugcauugucagacuagaaaaaaaacuuuuguuguuguuguuguuguuguuguuuguuuuguuuuguuuuuugagacaggguuucucuguguagcccugacuguccugcaacucacucuguagaccaggcuggccuugaacucagaaauccaccugccucugccucccaagugcugggguuaaaggugugcaccaccacugcccagcuagaaaacaucuuauuaucauagguuuuuaaguuauaaggugaggaugauuaauaaaauggaauccuggaaucauuuaaagaaagauuuuuaauucuuacugcccuuaagguuaauuacacccaguguuaucaagagaaaucuaacaggucugaucagagcaaggggccaggacuugguacaacuuucccagcuuauacuccauuauucuuuuagucaauguuuauggaauaccuacuacaauuacacaucacuaaaugcuaucaaggacauaagaaaccaaacaacaaaauaaagcccgccacuucccacuccaguccuaggauaagccugaaaacacucacccaaaacaagccguguuacacaagauggcacagaguuuacagcucugugaguggagagccuaauucugcugaggaagaucacagacucgccaggucugguaaaucccacacaaugagggugacuugccaagacuacaaaaggaagaagagcuucaccagaagaaagaaaguauacacagaacucuguacguucagaaaucuuaaguaugaagaguaaguuuacccuguuucggagacuucuuucucuuauccuucuucaaagcuaugauaugcauaggcaaaugguguuagaaaccuaaaacccaaaagcccuaaagcagucccuaugcagcucccguuauuaucaaagguucucucuuuuaacauuaugcuccuccaguggcuccuucagacauccuuacagucacaugugugaagcucuacuagagccugacaaauacagaggugaaugcuugcagccagccauuggacugagcacaaggucuccaauggaggagcuagagaaaggaaccaaagagcugaaggaguuugcagccccauaggaggaacagcaauuugaaccaaccagaacccccagagcucccaggguuuaaaccaccaaccaaagaguacacauggagggacccauggcuucagccacauacacagcagaggauggccuugucggaugucagugggagaagaggccguugguccugugaaggcucgaugugccaguguaggugaaugucaggucagggaaguggaaguggauggguuggugagcaggaaaagggggggugggauagggaguuuucagaagggaaaccaggaaaggggauaacaucugaaauguaaauaaagaaaauaccuaauaaaauaaaauaaagucgugugugugugugugugugugugugugugugcgcgcgcgcgcgcgugugcaugugcaugagugugugugcuguuguaauaaaguccuaugcaucaggaaguuauuuccuauaucccauuucauccuccucacccuaguuucccaguuggcuuaagacaguguggggcuuucuacauaacugauaugacuaaauauauaguacuuacuaaaguuguguguguguguguguguucuuucuguuaaaccuuugcauguugauuugcuuauauuuuauccuuuuuuaaaucccugguuaacucugucaccaauguuccaaaguuuuaaagauacuuuuuaaaaauuguucuuugggccaaugaaauggcuuggagguaaaggugccagcucugaaggucuaagugcaaucucuggggacccacaugggggaaccuacucaucaaaccuuccuuuuggaggagagagacagacagacagacagacagacagagaauauaucacacacagagacacacacauacaaaaacacacauacacaaacacacagaggcauacacacagagacuagcauacacagacacacacacacagagacucacacucacacauacacacagacacauacauagacucacacacacaugcacacacaaacacagaaacacacacacauauacagacucacacauagauauacacauguaaaugaauaauaccuaguauuauuauaaccaaauuuaacuaccuuacggucuuccuguagcaauauccccuggaagucugcuccuguucucaggggcacuggccuuuuaggcucuuccuugugccucucauccauaagacagcccaucuuuucuagauacugugccuuccugucucuuguuucauaccuccacuuugguagacacuaccccugcuacuuucccaagaaagguguguuagagauaauauuuuaaaauuuuacauaucuaugucaaucacgccuuacuguauuuugacaauauaaaaaaaaguuucaagguugaaaaugacucuuucagaacuauucagucacuagccuauuaucuucuacucuaaaaaaucuggcauugcucuuauucuacauuuuauacaugaaucuguaguguguguguguguacacuuuguaaguaugaguuaaaacuguauuuauuugacuauuuagaaagccagcauacuguaacucagccaaacaggacguucugaaacaugaaacccagugguccuugguugcuaaugucgaguuccccaguucagcuuagcagagcugagaauucuguuaggagcagguguggcggcaguccuaaaggcgccagggacuguagcuaagucguaugacuugcaccugacuuccucauauaagccacaaacaucuugagugcugcgcagguguaccaggauacaggugaauccaguuugauggagauaugccccugcugcccugauuagcugaagcugcgugccuggugagguggcguggccugcugugcguggaugggaacugagaguauaaaaggagugagaggcccaggguucgggggagauauauaaacaagggggagauauaaaaacaagggagauauaaaaacaggggagauauaaaaacaggggagauaaaaacaggggagauauaaacaggagagauauaaaaacaagggagauauauaaacaagggggagauauaaaaacaagggagauauaaacaggggagauauaaacaagggagauauaaacaggggagauauaaacaggggagauauaaacaggggagauauaaacaagggagauauaaacaagggagauauauggagaaagaagaaacaggacugaauaaaugugugcagaaggauccuguagcagcgucguucuugcuggcgaguugggcgcgcgcaacaaguggugccgaaacccgggacaagagacaccuucaggcacgagcgaagacccccugcuacagggaggauucagaacugcauaacggggaagaagggguuaauaaagguucccgugaaacagacuguugagaaggaucugguguggauucagaacucuucagcuggggaacaguacugaugaagagaaagaagaaagaugaagacugaauaaacugcuguuagaaggacugguggucgcaucguucuugcuggucgagagcgggcgcgacaauugguggcccguacggggaaccgacucccccaccgaguucagaacuuucagcagucagugguugcuggcaggguaaguucauggugagugaaacuugggaccccaggaguuugggaaggaccuuggauaaaauagagguaagcauuaaguugccaggaagcaggcacaagguaacaaaagguucaugguuuugggacaaguuaagguucccgguuuggggacaaguuaaggaacuaugauaaccucaguguagugaucaauagauccucgcuguguaguuaugcuuuuuuucucccauugacccuuuguggguaggucugauaguuuuggucuuguuuguucugauauauggacucuguuacuguuugaaucaagaggcagucaagacaggucagaaaauccuuauagagcaacaagaaaguaugucggaagagaagggcuuaaaaagaaaaaggaaaaagaaaggagacacaguguuaucagguggacagaaaggacaaaauaaaagagcugagguggaggaggaaggcgaauuagcuuuugugccgccucccuaugccuccucagcauccaccuguagguggaccuucuguccggagauuuggagaggaucaaccagauucaguguugacgugggcgagagggucuguuuguguguuuccacaggaccagacggaaccucuuugggugccggagagauuggugagacgcugcaagaaugaggcuccugauccaguugccccuguggaugugguggaugaucccacaagcacaaaggauggagccgagaugagagauccuuucgguauuccagaagccgauaccagcucgacaugacguuuaaauuuuuccaugccuuuuugaucccugaauuccccuuaaagagauagccccucuggcuaucuaucccuugcuucagagaagaugagcggggaugagagcccugggauguaugcuuguuauaguguguguguguguuguguguuuggcacaaguguuaggugcagaguguguggcccgcacuuucgccaugguagcguaggcuuuugcugcaguggaggcgggacaaucuccucagauucgguuugccgcucuaaaagaaauuaugcugcguuaugccguggggugcgaggcuaagcacugcacagaggauagcuugcuguuggcauccuguggaaggcacgucugauuacaugaagguucaguguccuaguucccuucccccaggaaaaacgacacgggagcuggccaagaccucucugggugaugagccuaagggaugguuuuguguagggccccuaugcuugcacacuggggaucagaccucuaccuucacccaugaggcuugcuugcagcaauuaagaucuggccauagguuaauuaacauccuggccuuuugaugcaccugccgcaagcaaaacacaaucuccccaggaguggcuuggcaugauugagagguagucagugauaagacucccugggcaugucaccaaccuaagacagggaucaaaccaaugcuguuugucacccaaggacggguaaggggcauggcugcggggggcuaucuacagacauucucucugccagaaaagaaaaaagggggagauguuaggagcagguguggcggcaguccuaaaggcgccagggacuguagcuaagucguaugacuugcaccugacuuccucauauaagccacaaacaucuugagugcugcgcagguguaccaggauacaggugaauccaguuugauggagauaugccccugcugcccugauuagcugaagcugcgugccuggugagguggcguggccugcugugcguggaugggaacugagaguauaaaaggagugagaggcccaggguucgggggagauauauaaacaagggggagauauaaaaacaagggagauauaaaaacaggggagauauaaaaacaggggagauaaaaacaggggagauauaaacaggagagauauaaaaacaagggagauauauaaacaagggggagauauaaaaacaagggagauauaaacaggggagauauaaacaagggagauauaaacaggggagauauaaacaggggagauauaaacaggggagauauaaacaagggagauauaaacaagggagauauauggagaaagaagaaacaggacugaauaaaugugugcagaaggauccuguagcagcgucguucuugcuggcgaguugggcgcgcgcaacagaauuccauaauuucugcuacaaaauggcuagugugucugugacaucuuguuagcauuccagacaaacagaacuagaaaggagaggcucauaagggaucuagcucuacuggaaaacaaaguuucuccucgcgaguaauuccuucagcggugccugcucacauuuuauagagcagcgcucugccacagaccauggaaaguuguuuaccuuccaaucuccaguacaaguuuuuccaaaaaguugaggaaacguagauauuauuagaaagugccaaaagagauaaacaaguguauguuacagaauuauacaauucccacuguauuuagacuuucaaaaaauugaaacacauguauccgggucgugguaauauuucuuuuauaacuuacuugauauuuucuuuccuuuaguuuucuccaucauuugucuccugucagguuuuuuuuuuuggggggguugguugguuuuugagacaggguuucucuguguaguagccccggcuguccuggaacucacucugcagaccaggcuagccucaaacucagagaucugccugccucugccucccaagugcugggauuaaaggugugcgccaccacugccuggcuccugucaccuucuuaaagccacaagaugagccucugacauugauuauccauuugauuuucuuaaaagcuagggauugaacccagggccuagcacugaguagguauaaacuacuaagcuauaaccccagauaaucuacuuuuccuguuugaaucucauugucuauuacuucuacuuccugguagcagauuuucuuauuuacuauugaguauuuucuuggacugcuuucuuucuuucucauuccuuuccacaacaacaaucuuacuuugcacauuaagucuuacuauuuccgaagaaauaucuuuuccuugagguauagaauaucaaaguuagaaaccuuguugcuaauaacauagaucaaagaaagaaguuaaaagcauugccaaugucuuaguuguuuuucuauugcuaucaagagaugccaugaccaagacaacguauuaaaauuuuuuuuaauugggaauuuguuuauaguuuaagagagugaguccaugaccaucaugguagggagcaugguggcaagcagucaugcaugauguuagagcaguagcuaagagcuuacauccuuauucacaaguuggaggcagagagagccugggcuuuccuaggaggguuugaaaccucaaagcccagacuccagugacacgcaacugaaucuuccccaaaacacucaucuaaggaccaacauugacacauaugagccuauuaggaguggguagggauucccacucaaaccaccauaaccuaugugcagauuucccuucaagucuucugauuccuaagcucuacuuuagagacugucauucaguucuucacagacucuucguucccauacugcacaaauggggagaugguuguuaccaaugccagaagagguuggagaaggcuaggcugacuccaugacaggcuucaaauuggcaguuaaggagacuaggccuaaaucucuguuuccaagaacuggacaaguccaggcaaguccagaccucagaagcugcccggccaccuggucagaggcaaggacaauaggucagcagcaguuuccagacuuccucagcuacuuccucagcaacaguuuccagaccuccccagcaaguuuccagcccaacaccccaguaauggaaggaccguagagaugaacccaacagauuaacauagaagucagcaacccagaauucccuaaugugcuuuaaauugagccugcgagcucacucagguaucucucuuuucugguaauaggagacccuagcgugugacugugcagaauaaaacacucuuugcauuacguacuuuuugagucuggacccuuacagcuugagguccagaacacagaauaaauuucaagcaaccccuguuuacaucucaugcaccucaccucacccacuuucuauccuauuuaaucccuuggguuuucaaggaguuuuccaacugugcucaaugacucagucugcuuaugguugugugcaccucaguggaugguuagaugugacauucucgcuguguguuaccuacaauuuuuuccaucugcuuuccauccugugcuauagaugguggcuagagacaccauccugguuucacugaaaaugcuguaccugacugcacugguuuugcuuauuuguuauuuuaggugaggucugguaaaggacacaaagacauuuagaaacagucaagucuccauggauaucaaaguuaaagguguccauacaugcagaaaaaaaauauaucacaagugaaccuccacccauauuagcagacuguauuggugcucaaacugcgcuaauuuagaacagcuauuucgcuguugguuauauuccuacuaauauaauauaguaucuaagacuauuguucuaaggucaagcucccugaacauaaauccugucuucaauaacuuaacuacccaaguagucuggacuguggagguuuguuauguauugcuauguauuguaaugauaaauucuguucccaagugucuaggccucugagugaauucucacaguuaccagcuuugguugugcaaaccuuguuccuuaauuuaaaacuauugguuaaauaaaaauguuggcccaucaagucucuauaggauuagguuuauccucucccauugagacuagacaaggcagcccucuguuacauaugugccuggggccacgggccagcccacaugugcucuuugguuaguggcuuagucucugggagcucccagggauccagguuaguugacacauguguucguccuaugggguugccauccccuucagcucuuucaauccuucuuuuaaaaaaauauuuuuuuaauuagguauuuuccucauuuacauuuucaaugcuaucccaaaagucccccauacccucccccccacuccccuacccacccauucccacuucaauccuucuuuuaacucuuccauagggucccuaaccucaguccuaugggagcaagggggaagaacacccucucagaggcgaaggagaggggagaagaggugaagaacucuggcagggggaacaggagggggcaacauguagaauguaaauaaguaaauaauaaguaaauaaauaaauagaaaaagaaaaaauggucacagacaauuacuagagggacuagaggauggguggauuuucaaguuacccgguugagugcgaaggaaaaacagguaagcaacaaggagagagaagaaggcaccaugagaggagauggacagugagagcaaagccaaggggaacagcaaguguuugggguacaccgcuggggaggcggccaggccggcaguuagaaagguagauuagggguuacccccaaaguaauugucaaaaccaaaugaaauagccauagucugagucucauuuauuuguaagcuaguuggggauaagcuucaauagguuguacuacacuggacacauugucaugauggcaaccucuuagucuauaaaugugcagcaguggcaaggauuagcugaacaaaggaccuggcguguaagaauaagcaucaagugcuaauauuaacuccaaauauuucaguuuucaaaaugguaguuucaaaaucucaauuacagucacaaacucacugaaucacauuaucagauagacacuauggcuaggcgaguuuuguuugugugugcguuuguguguguguguguguguguuucauuuuuuuaaaacuuuuuccaauuuuuauuagguauuuucuucauuuacauuucaaaugcuauccugaaaguccccuauaccuucccccaacccugcuucccuacccacccacucccacuucuuggcccugguguuccccugaacugggguauauaaaguuugcaauaccaaggggcuucucuucccaaugauggccaacuaggccaucuucugcuacauaugcagcuagagacaugagcucuggggguacugguuaguucauauuguaguuccaccuauaggguugcagaucccuuuagcuccuuggguacuuucucuagcuccucuauugggggcucugugauccauccaauaucugacugugagcaucuacuucuguguuugccaggcacuggcauagccucacaagagacagcuauaucaggguccuuucagcaaaaucuugcuggcguaugcaauagugucugcauuugguggaugauuaugggauggaucccaagguggggcagucucuggaugguccauccuuuugucucagcuccaaacuuugucucuguaacuccuuccauggguguuuuguuccaaauucuaagaagaggugaaguauccacacuuuggucuuccuuauucuugaguuucauguguuuugcaaauuguaucuuggguauucuaaguuccugggcuaauauccacuuaucugugagugcauaucgugugaguucuuuugugauugugugaccucacucaggaugaugcccuccagguccauccauuugaaggccaguuuuauagagaggaaaaugauguaauaaucaguucaccaauugccuaagaucacaaagacaaaaauauuuaacugagauucaauuccaaagaacguggcucaaguaucucuggugauaccacacacauauauacaaccuccuugcucuuuuuuaauauaccacuuagguuuuauuuaguacugcaaacaaauugaagaaacauuccaaaauagcacuauuaaaauuuggagaaaguuauacuccccuaucuagaagcagcauuacacacuuaacucauuuccacaguuaaaggaaagaaacgauggggcuggagcacugggaacaagagugugcuugaaaugacuggagauuuacaaauaaauagaagauacgaagaagauuuguccugauuugggagugugaccacugguaggcugcccauauuccaguggaugaccccauauccaauuguuuaagggcagcaauuggacucaguggguuauauuuuuaagaaagagagagagagagagagagagagagagagagagagagaaaggaaggaagagaagaagagaggaagagaggaagagaggaagagagaaagagagaagaaagagaggaagagaggaagagaggaagagaggaagagaggaagagaggaagagaggaagagaggaagagaggaagagaggaagagaggaagagaggaagagaggaagagagaaagagagaaagagagaaagagagaaaggaaggaaggaaggaaggaagaaagaaagaaagaaagaaagaaagaaagaaagaaagaaagaaagaaagaaagaaagaaagaaagaaagaaagaaagaaagaaagaaucgucagucuggggagaagaggaagaggaggacaugaaguuaggaggaggauacagagggaagggcagagguggauaauuggagggaaagaaugggggugaauacaaccaaaauacacacacacacacacacacacauauauauauacacauacauacauauacacauuguuuaaacguguaaaauguuucccauagguucauguguuugaauauuugguaaccaacaaaagccacugcuuuuguuggcugugauacuuucgggguagggccaaccuagagaaaaugggcuguugggagguaggccuucagggcacagagauuagucccauuucugcccaaauucuguuuccugguccacggcgacauuaacauacugcaucaccaauuccagccaccacagguggugccucaaccaccaugccugccccaucauggugaacuggaccuccucaaacugugagccaaaauaaauccucccuccauuuaaagacaaaaagcauacacgagcaaaagcucuuuuucucuucuagaaguaucaauaugucauucuuuauuuacauguguuuauauuuguguguguauaugguuacauguuugugugaguccacauguacaugggggguugguuacagauacauguguccauguacaggucagaggucaaccucagauggcauugcccaacugcuguauaacucguuuuaugagacaggauacgacacuggaaauuuucaauuacaucuguagcuuccauuaucuucccacuagcacuggccacuguacuccaagagcagcaguuuaccaacauuggacauccagaaucaaacagacguggguuuaccucucagaaagauccaccuucucguucuaaucuauaaguuucuuuacaauaaggauggaagaaggcuuuauuccuugaacccaaaugaauaccacaucuucaaaaaggaagaaacugaaauaaaaaagaaaagauaaacuaugcccuggguuuagaaaaacacuucucacaguauauacuuccauucccgaaaaugacaacugguguuggcauacaaaggacacuacccuuuaauguuccaugagcaaaccaggaccagaaacacacuuuuaaaugccuugccucugcuccauaaaaaaugggucugccagauauaacuacagacuguagguaauuauuaaagaucuuuuccagaacacaaaagcgauucauuacaucagaguucccugaggcaauauauagcccucucuaaaauuaugugggacuauaaaguaagagaggaagaauuuaauuugaucaugcucaguauauuaauagauagggccguagucaagccugaggacuaguuauauaacagacagcuacugguuguuucuaacuaccucauuuccuuuuuucauuaaucaacuuauuuauuuacuuuacaucccucccauucagagcuucuccucccucuucucccacucccucucucucauccuccccuggcccccauacuccugccuuucuccucagagaagcuggaaaccuauggauaucaaccugccuugguauaucaaguuguaguaggccuaggcacaucuucuucuauugaggcuaaacaaggcaguccagugagaaaauguaacuguugaauggucacccuuucucaguaggacaucggugucagucccucaaggcucagagaauauugcagaggagaggaaaggaggacacacaauuuacgaaucagauuacguaguggagugcucaggaaugcugcuuuccauccaucacauggcugcagcaucccugaacucacaguagcuuuauccacacaggaucuacacuagcuugggcccaucagcauccugccaugucuggaagaggggcucaugagacccaaguaguuaaugguaguuggagaaggaaagacauuuucuucagugauuuaaucacuguuaguucucccccaacacauaucccgaaagaaaccugucacucauguuccuguaagcaacuguaacaaaguuuacugaguuacaugcacaaaaagaaaguauugagaauuagcugaaaaacaguguggucagugggagauaacaguaauggaguguuagaaugaacaugacaaaauacauuauguacauacaugaaaauguuauaaaacauuuaaaccacuguuuuauguaauauauauauauauauauauauauauauauguauauaauauuaaaagcaaucaaauguuggcaagaauaugggagagaaggaaucuuuguacacugcuggugaacaugaaaaugaguacaaccacuauggaaaaaguaagauugaugaaauaaaaaacuaucagaagaauaucauacaaucuagcaaugcuacuuuuagucuuugcucaaaagauuaauucuaaaugcaaaugucaacuaagauaggucuacaagaacuucaaucacccauuuucccaaaagacacguaaugauucuaaucacugagaaacucuauacucgaagaaaaacaccaacauaacuuucagaaauuaaccacaguauauaagaccgaauucucuuuuuaauuauaucuugcaauguuaaagaagaaaaucgagggauuugcauugauggcuuaguuaguaaagcacuugcuuuucaaauaaugguuccaacauccauauaaagagcagggcguacugguguacacaacuguaauccaagugcugggaaggcaaagaguagaaaugccugagagucauugaccauccagucuagucuaagcggugaaaucuagguaaaugggauacccuguggcaaaaugguggguugaauuccugaugaugaugcucauaguagucuccagaccuccauacauacuugaacauacaugcauguguccaugugcacauguacguacacacacacaaacacaccggcaaaauaaaaucuaaaaccuagugauaaaaucagcuacuaacagaaaucuauaauuauccaaaaggacaucauuuuguacuauuuuaguagcuuaucaagcauauuaugaccagaaggcaacuacuagaauucuaggcuggaauccuacucaaaauggggccaaaauggcaucugaacaagauucuaggcagguccauucaucuaccauucuaagaugacccuucuccgggugauuccaaugugcagucugggauggggacugccaugaccacugaaucagcuccucaagauccauuccugugggacauacucuugagcucuucugacauccuucacaaagccuggcaacugguuaacugagaguuagaauaauccaacuggaagagaugauucauuuuauguaucuacuuggcuaaucuaugauacccagcuguugauagaacuccguguagauauuaguguaaguaguuuuuagaugugauuaacauuccaauaaacagaguuuuauuuagugaagcagauuagccuccuuaauguagaugagcuucacucucaauuagucaaaacccuugcaagcaaagaacgaaguucucagaaggccucuacuaugcaauccagaaauugucuugauuuuccagccuuguuacucuguacaggugacuucagacucaggaccgaagcaucaacccugaucugaauuuccaggcugccucuucugcccuucagauuuggcccuggugaccuucacaaucacauaaaccucuuucucucucucucucucucucucccucccucccucucucucccucccucccucccucccuccccccucucuuucucucucucucccuauccuucccucccuuccucccucuuucuccuccucuugauuuuuuccuccaaguaaccuuaauauagauacuauuauuuuaaaugcagaugaugggcuagauaucaugcaaaauuauucacacagaguuucagauucaguccuuagacaguugaaaaucaaguuguaagccacugugaccaaagacagcagaaaaacaaagaagcuucgguugacauuuuuagagagaacacauuacagucggagauaaacuaggugagucagggagagggagggggaacccaggcugggaguucacugagaaauagcauucaaagaagaggaagacaagagauguggcucugagccaggcagugguggcgcacgccuuuaaucccagcacuugggaggcagagacaggcggauuucugaguucgaggccagccuggucuacaaagugaguuccaggacagccagggaaacagagaaacccugucucgaaaaaccaaaaaaaaaaaaaaaagagagauguggcucugggguagaacaugcaaagcacuagguucaaacccuggcaccagcauugugugagggcugcuauggucaaaaauucauguccuugcucucugcuuagugauuucccccuuuguggagauuacauuuaagugggacgguaacaagacucagggcuuuugugucugacucucuccauuaaacauaagcuugcugaaauucagucauguuuuaacauuucuucguaguucauucuuccuuauugucacacagaauucuauuguagggggaaaaaaucucauuuuguuuauucagucaucacuugcagacauuuggauuguuuccaggguuagcuauaaugcuaguauaaacccuuuugagcaggcgccuucauuucacuuggguagauaccuaaguguggaauuacuguguuaucuaguaaccuuacauuuaaccuugugagaaaauauacaauaucuuucuuaaaacaguuucaaaccccauucuauagucuuaccagcuacaaaugucugaguuuguccacaucuuugccaauauguuacaguuccuuugaacagcugaguguguaugagguguguauguaguauguauuuggugacagcuuccuuggagccuuauuuugcaguucuccaaugaugagauggagcacauuuucuugugcuuaucaguuacuuauagaucuucuuuagcaaaauaucuauuaaaaucuuugucuauuuaaaaacauccgggggauggaaauuccgauuagugguacagcaccugacuagaaacaacaaggaugggguucuaggaccacaggagaaggaagaaaaagggaagagguagagaaacuggucuggaaaaacaacugcaaaacaaagugauuaaagcuuuaaccaucaguagaacuggggaguggcucaagagcuaacaugagacugugggccuucuccacucucccgccaagccaagcaucuccgccuucccugccccaguagaggacagcugguuuauggacuaaaaggacuuacagaguucuucaggaugagacaugcaaaaagcuaaaaucuaaggaaauaaauaaaagucuucagucugaaguaaaaauuacuuuaucaguucaucuaccagaacguucauaagucaaaacuuuugugggugucuuuuaacauagaaacucauauguuccaguuuuggggugauuuugguuuugugugugugugugugugugugugugugugugauuucuuuauuuugguuagugcagucuuucaguacgcucuuaagcauaaauguguuugcugcuuacggugacagcgaauagcauccuuuccuucuuuguggcuaacuaguauccucuuauucucuaucaguucguccaucaguggccaucggguugcuucauaucuuugauggcaagaauaaaacuuuuuuccacuuguucugcaaacacacagagucaacacugcuacuaauacagaaaagaguugccuuacccgagacuaucuaucuauccgugacagucuaugcaucaccugaucaccuuucacaacuaccaaaaauguccacuagauuauuauuucagucuuucaucagguggccuugaauuuggaggaaaugugccuuaaguuuaaaacaagcaacuuuaagcaaccuucucaaagauguuuuguacuaaaaagauguuucagaaguagagacucucagcauucaugagacagacacagcuucacuuagaaagaguccccaagccauggaucauaagugcaaagccagccuaucucacugaacucaggaaucagugacuugacaagccaaauaguucuagggaccugaggcugguuucuaggugagugccagguaucugagcucagguccguauccuuucaugacagguacuuuacuaauuaccaucuucucacccauauguaguugcacagacacaaaaauaacaaagauaugugacauuuauuuagaaagcuaucagaugcagaaccuuuuuaaucuucacuaaaauccugaauggcaagcagggaagacuauauuauccucaucuuaaauccaaggaagaccaugcaugauucauagugaauacuuacaccagcaaaauccuacaguaaucacgagacagaagaaggauuagagaacuuguaucugacuccugggugcuuauuucuuauguuaaaaaugcuaauaacuuacaaaugaauugaggaaauaugggaguaagucagaucaauucagaaguacccacccucuaaauuccuggcuguauaacuucaucccuguacuucucauuuccuccuacaaauacaaucuucuaagaagauaguucauccuugaccugauaaacaucggauagucaaaugaguaaguuuuuccuagcuaacacacacacacacacacucacacacaugcacauauacacauagcguauguacacacauacuacuacuacuaacauuuuuaaauccaaauguauauucuuagaaauguucaguaccaggagaaaugcuuuaagcuuuaacacuaccuccuaacacugcuacaggagaaugacaauaaacacuaggcauacuuuugcaguuaaugaagucauucauacuaagaugggagaaaaugcaguccauccaugauuuugcaucuauuaaaggggaaagauauuauccuuuucucacaacugucagucugugcugucagacuucgcauuuagcaauuagcuugaugccagcugucccuacaauuucauuccaaauuuaauaugacuuagaaaauauugcauuucagaauuucaagugauuugccaaagauaguaacaagaaagaauaucgcgucagaacuggcauugcccagccucucugcacagggggaacaugccagggucugugguggacuguaguuuauuggcaccccucaccaccauggauauuuuuguauggcuuccaauuaucauuugaauaacacugucuucccuucucucaguccauguggaaugguugggaucuucucacauacucaacagagccuggaaugaagauaaacuucuuucaacagcaucagagcuuucuaugucacaugacuauaacagacauuuauugcugccuggauuugaaaccuguuuccacaacuucaugccuaugugacuguugcagaaaguguauaaaagggaccaaguuccugugcuucauccagcuacucucugccugccaacucuccagggaggcuccuggguucccuucgcugacaugccagccccacacgacuguccaccccacagucagccgccacagcacccagccaccccauagaaacaaaacucuagaagcuuauaauuaacaagguagauuuauauaucaauaaauucucaauucacaagaugccaauacaauaauuucagaaccaauugauaaugauaaaagcugcccaccuagauuagacaaguuaucccaguuauucuauuccuuuaugauaucauaacuaccuguugcuauuuaaaaaccacacgggaucaggaucuuccugucuguccgccuccaucuugacuucuuccgccucuucugagucgcucucugucccugcaauucuuugcucugccucacuuuucccuguccaaucacaggccuccuguugcacuaguauuuuaauguaauuggacagggaaaauccugccacaacuaaccaguuuuaugaacuucaagccucagaauugaagccaggagaaucaagggcuggaucaguucauuuggaugucaacaggguccucggugguagcccauguccacauggucuauagcgguaauaugagacagggacauugacacagaucccugcugcugcauggccacagacacagagcuggcacucacaggcagccagcugggacaucaccaugggcucagguggcaggccaggccacucacaucaggcuguuccacucuacccucuucccuccaguuugccucucuucauaaugcucaaaacauuucgcuucucuuucucuccugucucuccaccacauacuugcacaucacaguggcuccugcuauaccacugacaagccucuggguggugacagaccucuggaugucuucuguaugguguggcaggaggugggccuauuuguauuuuauuuuauuuuauuuauuuguuuuuuuuuuuuuuuuaugaugggacaugcuguuucuauuucucuuuuccuggaugcuuucuauuugugucuaucagugcugccuuuguguccagcagcaucuuacauguuucuuuccuauuccucagcacauuuucuuggagucuuuguccuuuccauccuugguuauuuuucugaagagcagggaaaauguuguucuagugcacacuguuggcguaaguauuuguaguguagcacaaguaugugcugaauagaagacagaggugacaagaggaaguuugugaugaggaaaauucaaaagaaauuaaaugaauacaguuuuagaaaacagauuauuuccaaaguuugcuuugaauuuaguauuauuuaacccaaaagugaagcguauagauacaaucacucuaaguaauggaaggugauauaugauauaugauuuccuguuccagaguuaguuuaaaaauaacaagaagaaagacaggaagaauauggccucuaguucuuugaauacaagauaaaugaauacauaaauucuauucuguagacaaagaguuagauuauguaugaaacaaguggccauaauuuuuuauucuaaccuacucuccacugacaaaugucauaaacacacguuuuccucauuauguauuauuuuuuuagaaaggcauuuauuacuuagacaaaagucauaaagggaauaaugugccauuaaaggcaauuuuaagcgacagacuuggugauagaaagagagagagggagagggagggagaaggagagagagaaagcacuacugcagugagacagccuucacuugagguuuucuuucucucucugcaaaugucuccucugucacauugccagucauucauauaucugugccaacauucccuucaguaggacuaaggugaacacagaucuuacucuaucucagguugcaaacaccuauuuggaauuaaccacuucagguuucaggcagugguccucaaauuuaauguaugacguaguuauugagacuuagugaaaacacuccgucuaauccuacgaauugugaaugugggcuaaagacagcaaacugaucacguauccaauaacuguuucuaucaaauaguuguggaaagugcugauucugauauguuuaauauauuccugggauaaaauauugcaucuccaugauucagcuuucuucaauaucucaaacaucugucagagaguacauaucaggagggaauuuguuguggcuugaauguauucccaaaauuaauaugucaaugucucaucucuuagaaccacagcuggugacuguauuuggacauagugcuuggaaaaugguaaagacuuuaaaaugagaucauuaagguagacccuaauucaguauaagcaguauaacuagugcuucaauaggcagacaaaacacugacaagcacagagaaaaagcccuguaaggagacaggaagaacaaugaauccauaagucagcuugagagguccaagcacaaacuuuuuuuucuaaaacuuugaucuugauuaucuagaauuaugaaaaaauuccagauguuuaagccacccaguuuaugguauauuguugaauaagacugaaacuucuaguuguagaccgguguaguaggcuaugaaguagacaugcaagaguauacaucaccaugcagucuauaauucaguaaauauugcaauaguacauaagcaucccaaagucagccaaucacagagagauuugcaaguggguauucacugccacagcagagaaaaagagcuagcuuagauguccauagacagacagaugaagggagauagcaugcuacagauacauaucauuucuucaaucauuaauagaaaugaaaugauauuuacagaaaaaaacugaauggaacuagagaucauucaagagagauuaaacaaaauaagucaaacugaguauauaaacacacgccccaugcacacauguuuaauuuaagauucaaaaggacuaauaauagcuuauacguuuuauuuauuuauuuuuugggguuuucgagacaggguuucucuguauagcccuggcuguccuggaacucacuuuguagaccaggcuggucucgaacucugaaauccgccugccucugccucccgaguacugggauuaaaggcgugugccaccaugcccagcauaaguuuuauuuuauauucagcauuuauguguguauacaugugugugugugucugugugggugugggugucuguauguguguaugucuguguauauuuguaugugucgguaugugucuguguaugagugugugcauugugccugugugugugucucugugugcaugucugugugugagacagacugugugucucugugugugugcacaugucuaugugugugagagacuguguguuuguauguguaugucuguauaugugaguaugugcauugugucuguguguauguguguaugaauguguguguaugucuaugugugugugugugaacauauguauaggugauuaugugcauugugucuguguguguaucuaugucuguguauacaucugugugugagagagacuguaugucuauaucuauguguuuaugugucuguuugugcaugucugugugugugagagaggacuauauaagggguaggaaggcgaccaacaagagggggaaagagggacauggaacaggcaguggaaaaagggggucauguuuuaaaauauaacauauagggaaaugcuagagugaaacuuguagcuuuguacacagacuuuaaaaaguuaauaagggggugcaugccuuuaauuccagcacucaggaggcagaggcaaauggaucucuaugaguuugaggcuagccuggaaaucagagcugguuccaggacuuccagaacuauacauagagagacucuguuuaaaaauaaaacaaacaaacaaaaaaaccaaaaaugaaaacaaaacauuaauaaggaaacaucuaggcaaggauuagaacacacauaaaagcaagaaaaugacgggcaggucuagcagcaaacauucauaauggccauaacaaauggauaguaauaguggaaaucacagugggcuuuuaaaaauguuuuuccuacuucuuuauguguauugugagucuaugucacauauguggcgaugccuagaagaggguguccaagccccugaaucugaggucacaggugguugagagccaccugacaugagugcagggaaccaaaccugaguccuacagcaaacacucaaccacugaaaaucacuccagcacugggccuuuuauguggugcucaguaaugaguaauuguaucuaucagaaaaacagguuuuaugcaucaucagaucugugcuuaauuucccauaugccaaccuuuucccagagguuggccuccagcugcuaccugaaucugagcuuguauaucagcuucugaacccccauacgacaaugcuuuagcaacagggcugacaacagaucucagcaccucauuccuucacugguugugaaucuuaaaagcaugaauuaagaaauaucuaaggugcagcaaucccaucauaaaaugcccaacagauaauaagaaacacagcaugggaccauuuguuguucuggcugcuucauggaaauguguaacgaauucaucaugaguagaaauugguacauaaccuucaauggacagggacucuauucugauucccagaaguuuaaugaaaauugauagcauuuaaaaugcuauucuaaggacuggguagauggcucagugguuaagagcacugauugcucuuucagaaaaccaggguuauguucccagcacccauaugacagcuuauagccauuuguaacaccaaucccgggagaccugaugcccucuucuggucccugugggcacuguaaauacaugaugcaugaaugcaaauaaaaaacuuauacacaaaaacugaaauuuuaaaaauuaaaugcuguucuuuguuauuucuauuuagucuuccuauucucuugauuucuuaagucagucuugaguuuuagcaaggugucagauaaagauauuucuuuuuccuuucgaugucaccuaaaaacaaccuguucucuauuaaaauucuuuuuaaaaaauuaaaaauaaaagcuuaucugauaaacuguguucaacuaauaguauguuugucuuaaagcuuacuuaagagaauaagcuagaaagcagaaugauaacauagcauagauguugagaccugaaagaacucaagacccaauguguguucaaaugaagcugauauugacaagggucugcuaguacugauuauguagacuccuagguggaaaugcagcaaauagaaguugagguacagcucugagagguuaaauggguauuacucaucuuuaaguguucaguauaacucacuuuuuaaaaggaauaucuggaugagaagaaagaacaugaucugacuauacuguaggaaagucucaaaacuauauuuuaaaguuuaaaagaaaacuaugcaauucaauaugaauuaaauuccugaggauuuuuuuuuuuuuuacuucuuguagugaguuaagggggagagcaucgaaaccacuaccaagcuaauuaaaaggugacugaaggaguuauccagcucccuucauuguuaagaggccauucacugugggaacagccucccugacaugcagucacccagucucugcugaaauacaccguugucuuauacauguuuaucaugaacaugaugucuugauugcuuauaacuaaaccaaaaauaaccauauugcuuuguuaucaucugaucuuuuaguggugagagauaaaaccaauucucagcauagcccuauauucaccccacauaccuucaacuauuuggggguuccauucagcuccucacuuggaccgcuuugcugcuaucaaccaccacuguacugcuucuauguauuugguuuuaucuuuuuaaaaagauucugcacaugauaccaugaucugucuuuccagucuggaauauuucaagcagcacacuggcccccaugaacauucauguugucacgaauagcaguguucuguuucuuaagacugaauggggaauucacuaugcuuccgagggagagagagccaccagccauauaagaucucagguggaguggcaguggccacuuuucuauccgggccugggauagcagcugggagauuagaaaugcaacugagcuaaggggagauuuagggagcugagcaaggagaagguaaucgggcaacuaagcugaggaaagauuuuagagucguugagcuaggagugaagaugagggcacauuagccacaggaggcuuagaaaugccuggccauugagcuaaaaaguauauuaacaauaaaaauuaaaauaaaguaaaaagauugaaugguguuccuuugaguacauacaacaauguugucgauacaucuaccaucaugaaccuagacuguuucugcaguguggcaagagcuauuaucccugggccaucuugcuagccccaugcuuccuaugacuacuaaaugucaccuuuaaccaucugcuuucauucuucuggugucauacuuaguucuauguuuuuuugccccugacuucacugcuucucauucuagaucacagguggauaaugucagcugcauggauauaaugacgaccuuuucugguaaaugacuugcacuugacugccucuugcacuaaaaauauacaauucuauuuaauguuccuugagucuucauaaagcagauuccauuuugauauauuauuucuuuaagucuguaacaaaaaaaaaaaacuauuauuucccuaaauucuacauuucucaacuuaaguagcagagcuguguuuuaguuuuuuuaucaccaaccuuccauacauaucagcucccuaccaccacccccauacagggaaagauuuucuacagagcuagaacccuuacauugguuguguagacaggcaucugauacagcaaaaaacaccucagaaccaaaaacuaaagcccacucuguaaucugagacaagauauaaacugaccagcccaaguaaacucuaauccucccaucugcaaaucucuaaaaagaacaacagauucuccaggucccauagcuuuaaaacuucaacuaguucaagaaauacguaaauuucuuugucuucugaccaaaauggacauuaccaaaagaaagaguuuacgccgauguuucuaccuuuguuauuauugucaucagacuaugaaaaucuuaaguagaucauagaauccagaugagaaggacaaaauaucuguuccaacaccaccaggaguuaagugggaucagcaagauccagggacacaggaacccugccuaaccaguggcucagauuccuucugaucugugccaguucaccuugggcccaaacuccucagccagucccacaacacccagaugaagcuccacucccagguucucuaacauacccgggaucccaggaacuuggucacaccaggaucucaggguuccaaaggcagcuugacucccaggaacucuugacacacccaggaucuuaggaucacaggaucccagaaucacaggcucacagagauagcugaauucugaggaguucugacacacccaggauuacaggaaggacaauuagauauagcaagggcaguuaccacuagagauaaucagauggcaggaggcaagcauaagaacauaagcaacagaaaccaagguuacuuggcaucaucagaacgcaauucucccaacacagcaagucccagguacaccaucacacugaaaaagcaagauucagaucucaaaucacuuuucaugacgaugauagaggacuuuaagaaggacauaaauaacucccuuaaagaaauacaggagaacacagauaaacagcuagaagcccuuaaagaggaagcacaaaaaucucuugaagaaugacaggaaaacacaauuaaaaaggagaaggaaaugaacaaaaccauccaagaucuaaaacuggaaauagaaacaauaaagaaaagaaaucacaaaagcaaaaaaaaaaaaaaaaaaagaaagaaagaaagaaagaaagaaagaaagaaaaaagaaagaaagaaagaaaucacaaaagcagacaacccugaaguuagaaaaccuaggaaagagaucaggagucauagaugcaagcaucaccaacagaauacaagagauagaagagagaaucucagggacagaagacaccauagaaagcauugacacaacagucaaagaaaauguaaacugcaaaaaucuccuaacccaaaacauccaggaaauccaagacacaaugagaagaccaaaccuaaggauaauaggaauagaagagggcaaagauucacaacuuaaagggacaguaaacauauucaucagaauuaaagaagagaauuuuccuaaccuaaagaaagagaugcccgugaacauacaagaagccuacagaaauccaaauagauuggaccagaaaagaaauuccuccugucacauaauaaucaaaacaccaaaugcacuaaaccaagaaagaauauuaaaagcaguaagggaaaagggucaaauaacauaugaaggcagaacuaucagaauuacacuagucuucucaccagagacuaugaaagccagaagauccugggcagauuucauacagacccuaagagaacauaaaugccaucccaggcuacuauacccaacaaaacucucaauuaccauagauggagaaaccaagauauuccaugacaaaaacaaauuuacauaauaucuuuccacaaauccagcccuacaaaggauaauagauggaaaacaccaacacaaggagggaaacagcacccuagaaaaagcaauaaauaaucuucuuucaacaaaccccaaagaagauagccacacaagcauaauuccaccucuaauaacaaaaaauaacaggaaguaacaaucagcuuuccuuaauauuucuuaacauuaguggacucaauuccccaauaaaaagacauagucuaacagacuggauacauaaacaggacccaguuugcugcauauaagauacauaccucagugaaaaagagagacaguaccucagaguaaaacguuggaaaacaauuuuucaagcaaauggucccaagaaacaagcuggagcagccauucuaauaucaaauaaaaucaacucucaaccaaaaguuaucaaaaaggauaaggaagaacacuucauacuggucaaagaaaaaaaucuacuaagaugaacucucacuucugcacaucuauguuccaaauguaagggcacccacauucauaaaagaaacuuuacuaaaccucaaagcacacauugcacccuacacaauaacagugggaaacuucaacaccccacucucagcaauggacaaaucauggaaacagaaacuacacagagacacagugaaacuaacaaaagucaugaaccaaauggaucuaacaguuauuuauaggacauuucaucuuaaagcaaaagaauauaccuucuucucagcaccucaugauacuuccccaaacuugaccauauaauuggucacaaaacgggccucaacagauacaagaaaauuacaauaauuccauucacccuaucagauuaccauggacuaaggcuggucuuaaauuccaacaaaaccaauggaaagcacacauacacauagaaacugaacaauguucuacucaaugauaacuuggucaaggaagaaauaaauaaagaaauuaaagacuuuuuagaauuuaaugaaaaugaagacacaucauaccaaaacuuuugagacacaaugaaagcagugguaagaggaaaacucauaguucuaagugccuccaaaaagaaacuggaaagaacuuacacuaacagcuuggcagcacaccugaaagcucuagaacaaaaagaagcaaauacacccaagaggaguaaacuguaggaaauaaucaaacucagagcugaaaucaaccaaauagaaacaaaaagaacuauacaaaaaaaaucaacaaaaccaggagcugaugcuuugagaaaaucaacaagacagauaaauccuuagucagauuaaccagagggcacggagaaaguauccagauuaauaaaaucagaaaugaaaagggagacauaagaauggaaaccguggaaauucaaaauaucaucagauccuauuacaaaagcuuauauucaacaaaauuggaaaauuuggaugaaauggacaauuuucuagacauaugccaggugucaaagauaagacaggaucagauaaaccaucuaaacagucccauaaccccuaaagaaauagaaacagucauuaauagucucaaaaccaauaaauaaauaaauaaauaaauaaauaaauaaauaaauaaauaaagcaagcaagcaagccagccagccagcccaggaccagguggguuuaguggagaauucuaucagaccuuuaaagaauaccuaauaccaauacucuuuaaacuauuccacaaaauagaaacagaaggaacacuacccauuuuguucuaugaagccacaauuaagcuuauaccuaaaccacacaaagaccauacaaagaaagagaaauucagaccaaucucccuuaugaacauugaugcaaaaauacucgauaaaauuauugucaaccaaauccaagaacacaucaaaacaaucauucaccacgaucaaguaggcuucaucccagggaugcaggaaugguucaacaugcagaaauccaucaacauaauccacuacauaaacaaacucaaagaaggaaaccacauggucauuucauuagauucugaaaaagcauaugacaaaauucagcaucccuucauguuaaaagucuuggaaagaucaggaauucaaggcccauaccuaaacauaguaaaagcaauaaagcaaacaaguaaccaacaucaaacugaauggagaaaaucuugaagcaaucccacuaaaaucagggacuagacaaggcugcccacuuuccccuaucuauucaauauaguucuugaaguucuagcuagagcaauuagacaacaaaaggaggucaaagggauacaaauuggaaagguagaagucaaaauaccacuauuugcagauaauaugauaguacacuuaagugaacccaaauauuccacccuccuaaagcugauaaacaacuucaucaaaguggcuggguauaaaauuagcucaaacaaaucaguagccuuccucuacucaaaugauaaacaggcugaaaaagaaauuagggaaacaacagccgucgcaacagucaaaaauauuauuacauaccuuggugugacucuaaccaaacaaguagaagaucuguaugacaaaaacuucaagucucugaagaaagaaaucgaagaucucagauggaaagaucucccaagcucauggauuggcagaauuaauauaguaaaaauggucaucuggccaaaagcaauuuacagauucaaugcaauccccaacaaaauuccaagucaauucuucauagaguuagaaagagcaauuuggcccuuccgccccacccgagcaccaggguaccuugccggcggagucgcccgacaccugcaagggcccacacaggauuccccacgggauccuaagaccucuggugaguggaacacagcgucugccccaauccaaucgcgcggaaccugagacugcaguaaauagggaagcagacuacccgggccugaccuggggcacaagccccuuccgccccacucgagcacagggguaccuugccagcggagucacccaacaccugcaagggcccacacaggauuccccaggggauccuaagaccucuagugaguggaacacaacuucugccaggaggcagguucgaacaccagauaucuggguacccucccugcaagaagagagcuugccugcagagaauacucuacccacugaaacuaaggaaagagcuagccucccaggucugcuuauagaggcuaacagagucaccugaagaacaagcucuuaccagagacaacuauaacagcuagcuucagagauuaccagauggcaaaaggcaaacguaagaauccuacuaacagaaaucaagaccacucaccaucuucagaaugcagcacucccaccgcaccuaguccugggcaccccaacacaaccgaaaauauagacccagauuuaaaaacauuucucaugaugaugguagaggacaucaagaaggacuuucauaagucacuuaaagaauuacaggagagcacugcuaaagaguuacaggcccuuaaagaaaagcaggaaaacacaaccaaacagguagaaguccuuaaagaaaaacaggaaaacacauccaaacaggugauggaaaugaacaaaaccauacuagaacuaaaaagggaaguagacacaauaaagaaaacccaaagcgaggcaacgcuggagauagaaacccuaggaaacagaucuggaaccauagaugcgagcaucagcaacagaauacaagaaauggaagagagaaucucaggugcagaagauuccauagagaacaucgacacaacagucaaaaaaauacaaaaugcaaaaggauccuaacucaaaacauccagguaauccaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagccuacagaacuccaaauagacuggaccagaaaagaaauuccucccgacacaugauaaucagaacaacaaaugcacuaaauaaagauagaauauuaaaaguaguaagggagaaaggucaaguaacauauaaaggaaggccuaucagaauuauaccagacuuuucaccagagacgaugaaagccagaagagccuggacagauguuauacagacacuaagagaacacaaaugccagcccaggauacuauacccggccaaacucucaauuaccauagauggagaaaccaaaguauuccacgacaaaaccaaauucacacaauaucuuuccacgaauccagcccuucaaaggauaauaacagaaaagaagcaauacaaggacggaaaucacgcccuagaacaaccaagaaaguaaucauucaacaaaccaaaaagaagacagccacaagaacagaaugccaacucuaacaacaaaaauaaaagggagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuagagacacuuuaguaaagcucaaagcauacauugcaccucacacaauaauagugggagacuucaacacaccacuuucuucaaaggacagaucguggaaacagaaaccaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauuauuggucacaaaacaggccucaauagauacaaaaauauugaaauugucccauguauccuaucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcgcugagugccuccaagaagaaacgggagacagcacauacuagcagcuugacaacacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacaaucccauaucaccuaaagaaauagaagcaguuauuaauagucucccaaccaaaaaaagcccaggaccagauggguuuagugcagaguucuaucagaccuucaaagaagaucuaauuccaauucugcacaaacuauuucacaaaauagaaguagaagguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucaggcacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaggugaaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauuugucugggauaacaaaaaaccuaggauagcaaaaagucuucucaaggguaaaagaacuucuggcggaaucaccaugccagaccuaaagcuuuacuacagagcaauugugauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaaucgacaaaugggaccuaaugaaacuccaaaguuucugcaaggcaaaagacaccgucaauaagacaaaaagacaaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguauucacugauaaguggguauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagacagaguuuggagcugagaugaaaggauggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaauaacagaaaagaagcaauacaaggacggaaaucacgcccuagaacaaccaagaaaguaaucauucaacaaaccaaaaaagacagccacaagaacagaaugccaacucuaacaacaaaaauaaaaggaagcaacaauuacuuuuccuuaauaucucuuaauaucaauggucucaauuccccaagaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaaaaggaacucucaauucugaauaucuacgcaccaaaugcaagggcagccacauucauuaaagacgcuuuaguaaagcucaaagcacacauugcaccucacacaauaauagugggagacuucaacacaccacuuucuucaauggacagaucguggaaacagaaacuaaacagggacacagugaaacuaacagaagugaugaaacaaauggaccugacagauaucuacagaacauuuuauccuaaaacaaaaggauauaccuucuucucagcaccucacgggaccuucuccaaaauugaccauauaauuggucacaaaacaggccucaacaaauacaaaacuguugaacuugucccauguauccuaucagaccaccauggccuaagacugaucuucaauaacaacauaaauaauggaaagccaacauucacguugaaacugaauaacacucuucucaaugauaccuuggucaaggaaggaauaaagaaagaaauuaaagacuuuuuagaguuuaaugaaaaugaagccacaacauacccaaaccuaugggacacaaugaaagcauuucuaagagggaaacucauagcucugagugccuccaagaagaaacgggagagagcacauacuagcagcuugacaacacaucuaaaagcucuagaaaaaaaggaagcaaauucacccaagaggaguagauggcaggaaauaaucaaacucaggggugaaaucaaccaaguggaaacaagaagaaauauucaaagaauuaaccaaacgaggaguugguucuuugagaaaaucaacaagauagauaaacccuuagcuagacucacuagagggcacagggacaaaauccuaauuaacaaaaucagaaaugaaaagggagacauaacaacagauccugaagaaauccaaaacaccaucagauccuucuacaaaaggauauacucaacaaaacuggaaaaucuggacgaaauggacaaauuucuggacagauaccagguaccaaaguugaaucaggaucaaguugaccaucuaaacagucccauaucaccuaaagaaauagaagcaguuauuaauagucucccaaccaaaaaaagcccaggaccagacagguuuagugcagaguucuaucagaccuucaaaaaagaucuaauuccaguucugcacaaacuauuucacaaaauagaaauagaagguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccaggaaugcagggaugguuuaauauacgaaaauccaucaauguaauccauuauauaaacaaacucaaagacaaaaaccacaugaucaucucguuagaugcagaaaaaagcauuugacaagauccaauacccauucaugauaaaaguuuuggaaagaucaggaauucaaggcccauaccuaaacaugauaaaagcaauauacagcaaaccaguagccaacaucaaaguaaauggagagaagcuggaagcaauuccauuaaaaccagggacuagacaaggcugcccacuuucucccuaccuuuucaacauaguacuugaaguauuagccaaagcaauuugaaaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauaaacucaaacaagucaauggccuuucucuacacaaagaauaaacaggcugagaaagaaauuagggaaacaacacccuucucaauagucacaaauaauauaaaauaucuuggcgugacucuaacuaaggaaguguaagaucuauaugauaaaaacuucaaaucucugaagaaagaaauuaaagaagaucucagaagauggaaagaucucccaugcucauggauuggcaggaucaacauuguaaaaauggcuaucuugccgaaagcaaucuacagauucaaugcaauccccaucaaaauuccaacucaauucuucaacgaauuagaaggagcaauuugcaaauucaucuggaauaacaaaaaaccuaggauagcaaaagucuucucaaggauaaaagaaccucugauggaaucaccaugccugaccuaaagcuuuacuacagagcaauugugauaaaaacugcaugguacugguauagagacagaccaguagaccaauggaauagaauugaagacccagaaauaaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuauggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacccucaauaagacaaagagaccaccaacagauugggaaaggaucuuuaccuguccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauucuaccucacaccagucagaauggguaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccuggacauauauccagaagaugccccaacugguaagaaggacacaugcuccacuauguucauagcagcguuauuuauaauagccagaaacuggaaagaagccagaugccccucaacagaggaauggauacagaaaaugugguacaucuacacaauggaguacuacucagcuauuaaaaagaaugaauuuaugaaauuccuagccaaauggauggaccuggagggcaugauccugagugagguaacacauucacaacggaacucacacaauauguacucacugauaaauggauauuagccccaaaccuacgauacccaagauauaagauacaacuugcuaaacacaugaaacucaagaagaaugaagacugaaguguggacacuaugccccuccuuagaauugggaacaaaacacccauggaaggaguuacaaagacaaaguuuggagcugagaugaaaggauggaccauguagagacugccauauccagggauacaccccauaaucagcauccaaacgcugacaccauugcauauacuagcaagauuuuaucgaaaggacccagauguagcugucucuugugagacuaugccggggccuagcaaacacagaaguggaugcccacagucagcuaauggauggaucacagggcucccaauggaggagcuagagaaaguacccaaggagcuaaagggaucugcaacccuauagguggaacaacauuaugaacuaaccaguaccccugagcucuugacucuagcugcauauguaucaaaagauggccuagucggccaucacuggaaagagaggcccauuggacaugcaaacuuuauaugccccacuacaggggaacgccagggccaaaaagggggaguugggggguaggggagugggggugguuggguauggggaacuuuugguauagcauuggaaauguaaaugagcuaaauaccuaauaaaaauggggaaaaaaagaacagaauggcaacucuaacaacaaaaauaaaaggaagcaacaauuacuuuuccuuaauaucucuuaauaucaauggucucaauuccccaagaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauauuggauaaaaucgaauuccaacccaaaguuaucaaaaaagacaaggagggacacuucauacucaucaaagguaaaauccuccaaaaggaacucucaauucugaauaucuacgcaccaaaugcaagggcagccacauucauuaaagacgcuuuaguaaagcucaaagcacacauugcaccucacacaauaauagugggagacuuuaacacaccacuuucaucaauggacagaucguggaaacagaaacuaaacagggacacagugaaacuaacagaaguuaugaaacaaauggaccugacagguaucuacagaacauuucauccuaaaauaaaaggauauaccuucuucucagcaccucacgggaccuucuccaaaauugaccauauaauuggucacaaaacaggccucaacagauacaaaaauauugaaauugucccauguauccuaucagaccaccauggccuaagacugaucuucaauaacaacauaaauaauggaaagccaacauucacguggaaacugaacaacacucuucucaaugauaacuuggucaaggaaggaauaaagaaagaaauuaaagacuuuuuagaguuuaaugaaaaugaagccacaacauacccaaaccuaugggacacaaugaaagcauuucuaagagggaaacucauagcucugagugccuccaagaagaaacgggagagagcacauacuagcagcuugacaacacaucuaaaagcucuagaaaaaaaggaagcaaauucacccaagaggaguagauggcaggaaauaaucaaacucaggggugaaaucaaccaaguggaaacaagaagaacuauucaaagaauuaaccaaaugagguauugguucuuugagaaaaucaacaagauagauaaacccuuagcuagacucacuagagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauagaagcaguuauuaauagucucccagccaaaaaaaagcccaggaccagaccgguuuagugcagaguucuaucagaccuucaaagaagaucuaauuccaguucugcacaaacuauuucacaaaauagaaguagaagguacucuacccaacucauuuuaugaagccacuauuacucugauaccuaaaucacagaaagauccaacaaagauagagaacuucagaccaauuucucuuaugaauaucgaugcaaaaauccucaauauaauucucgcuaacugaauccaagaacacauuaaagcaaucauccauccuggccaaguagguuuuauuccagggaugcagggaugguuuaauauaugaaaauccaucaauguaauccauuauauaaacaaacucaaagacaaaacccacaugaucaucucgcuagaugcagaaaaagcauuugacaagauccaacacccauucaugauacaagucuuggaaagaucaggaauucaaggcccauaccuaaacaugauaaaagcaauauacagcaaaccaguagccaacaucaaaguaaauggagagaagcuggaaguaauuccauuaaaaccagggacuagacaaggcugcccacuuucucccuaccuuuucaacauaguacuugaaguauuagccaaagcaauuugacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauaaaaauaaacucaaacaagucaauggccuuucucuacacaaagaauaaacgggcugagaaagaaauuagggaaacaacacccuucucaaaagucacaaauaauauaaaauaucuuggcgugacucuaacuaaggaagugaaagaucuguaugauaaaaacuucaagucucugaagaaagaaauuaaagaagaucucagaagauggaaagaucucccaugcucauggauuggcaggauuaacauuguaaaaauggcuaucuugccaaaagcaaucuacagauucaaugcaauccccaucaaaauuccaacucaauucuucaacgaauuggaaggagcaauuugcaaauucaucuggaauaacaaaaaaccuaggauagcaaaaacucuucucaaggauaaaagaaccucugauggaaucaccaugccugaccuaaagcuuuacuacagagcaauugugguaaaaacugcaugguacugguauagagacagaccaguagacaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaauggaucaaagaacuucacauaaaaccagagacacugaaacuuauagaggagaaaguggggaaaagccuugaagauauaggcacaggggaaaaauuccugaacagaacagcaauggcuugugcuguaagaucgagaauugacaaaugggaccuaaugaaacuccaaaguuucugcaaggcaaaagacacccucaauaagacaaagagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaaugucuaagaucaaaaauucaggugacagcagaugcuggcgaggauguggagaaagaggaacacuccuccauuguuggugggauugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagccuuauuuauaauagccagaagcuggaaagaagccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaagaaugaagacugaaguguggacacuaugccccuccuuagaagugggaacaaaacacccuuggaaggaguuacagagacaaaguuuggagcugagaugaaaggauggaccauguagagacugccagauccagggauccaccccauauucagcauccaaacgcugacaccauugcauacacuagcaagauuuuaucgaaaggacccagauguagcugucucuugugagacuaugccagccuagcaaacacagaaguggaugcccacagucagcuaauggauggaucacagggcucccaauggaggagcuagagaaagaacccaaggagcuaaagggaucugcaacccuauagguggaucaacauuaugaacuaaccaguaccccggagcucuugacucuagcugcauauguaucaaaagauggccuaguuggccaucacuggaaagagaggcccauuggacacacaaacuuuauaugccccagaacaggggaaugccagggccaaaaagggggagugggcggguaggggaguggggguggguggguaugggggacuuuugguauagcauuggaaacguaaaugagcuaaauaccucauuaaaaauggggaaaaaaaaggaagaaagagcaaauugcaaauucauuuggaauaacacaaaagccagaauagagaaaacuauucucaacaauaaaagaaccucugguggaauuacuaccccuuggccucaagcuguauuacaaaggaaugguaauaaaaacugcaugguauuggaacagagacaggcagaggaucaauggaauagaauugaagacccagaaaugaacccacacaucuaugaucuuugacaaaggagcuaaaaucauccagugggaaaaagacagcauuuucaacaaauggugcugguucaacugacaaucaacauguagaagaaugcaaacugauccauucuuaucucccuguacaaaacucaagucuagguggaucaagaacuuccacauaaaaccagauacagugaaaguaauaagggagaaaguggggaagagccuugaacacaugggcacaggggucaaucugcaguuaugacaccccuuucaaguuaugacauuaucuuucagaagagucuugguacaaaaucagucauuuguuaacugucaaucaaagauagaggccaauaguguaagacaccauaggacacccaugacuaagacuaaaugacaaggguacaauaacucauuguggaggagacagucuccagguaacuggacuucacaaucaugccauccauggcagauacugagcuuuauguccaggauaucuaagagucucuugcuuaggucauuuaauaagaugguaguauuuuacuaucuacugcauuucuaggcguacuaaaaagauauuugcaagaaucaagcaaagcccaggaguccagaagugacaucuuuccccuccuggacagguccugccaccuucccuccgccugacagaggacaaccagaaaacaugcccuuuggacaguaccaucuucauucucuaaagccagcugccagcggacagccagcagguguggcaaagggaugacagaaaugccauugugccugccuuugcccucuggcaucuauaaaagaagacauucauucuuguuacaccccaccaaugugcaauaacugcuuccuacaucuucucaaugagcaauaacagggaagaaacagaagaucucaaucucccagaucuccucaccagaagagaaggcucuucccaguggguggggacucaaugggauugagaccuguagucaggagcuagaggagguagccuaagaggauugugaacugucuacugaaacucuaauguguggugguucgaauaugcuuggcccagggagugucacuauugagaaguguagccuuacuggaggaaguaugccacugugaggguggacuuugagacccucauccuagcugcccgaaagacagucuccccuggaugcggucagaucaagaugcagaacucucaagcuucuucuccagcaacauaucugccugggcacugccaugcuuccuggcaugaugauaauggacugaaccucugaaacuguaacuuagccccaauuaaauguugucccuuauaagacuugccuuggucaugaugucucuucacagcaauaaaaacccuaaguaaaacaccugaccaucccagaggaaaacucacucauaccagugccugagaaaggacgagaccaugguaacaaucacaagaacaagugcaguuagaggaugcugaacuccaucauccugcagucaugaugcuggggacuguucuuguguggauacaaagaccuguaggauggaaccauccuggaagcccacacugcugugugucuaucauacaccauccacacagagguagauggcaaguggguucuccgugggauauuccaaucaacaauaauuccaauugccagauuuccaguccaugggaacuuaugaccauugaauggagaagucuucugaggccugacaaaaucaugacuguaacucuuucacugugcauaacaccaaguuugaggaauucucuacuuccagccaaugaugucaguucugaucuaaucuuugccucugaccucccagaggguuggaagcuguugcaguguauagccuugguagugccaucagagaaauagcucauuuugaacccagucuugugaguuucuuccugucuguggcugaacaugauauugcugccauuccugguagcugagucaugcucuggguaccugaaaggaugaugaccaacaguccuauccaccuuguucucagcacacagcaguggucagacagugacuuuucacauucuuguugcaucuuauauucuugcuuaugcaugcucugcaguagacuaagacuucuucauaacaugguuugaagagauaaaagcugaagauugauuguacacaaguuuggguucaguaacugugcuggcuaguuaugucaacuugauacagucuagagucaucugagagaaggaaaccccaacugagaaaaagccaccaugagauugugcaauagguaagccuguggagcauuuccuagcuaaugauuaauuuucuuaguuauuguuuuaguuuuauugcugugaagagacaccaugaguacagcaacuucuauaauggaaaagguuuaauugggccuagauuacaauuucagagguuugguccauuaucgucauagcagaaagcauggcauuguacagguagacaugguccugaagaaggagcagagaguucuacaucuugauccacaggcaauaggaggaaggcuguagcuugggcauagaucucaaagccugcccucacagagacacucuuucuccuacagagccacaccuacuccaacaaggccacaccuccuaaucaugcuagucccuaugggccaagcauucaaacacaagagucuauggggggccauucacauugaagcaaccacagugauuaaugugggagggcccagcccacuguggguagggucauccauggggaggugguccuggacucuaaaagaaaucaggcugagcaagccaagggaagcaagcugguaaguagaacuccuucauggccucugcaucaggcuccugccuccaacuuccuacccugcaugaguuccuguccucacugcuuuugaagaugaacugauauacagaacuaugaguagaauaaacccuucccuucccaaacuguuuuugauuaugaugcuucaucacagaaauaauuuacccuuagacgguaaauuaaacacagccuuaugucaccuaacaaaggugacacauucuggaaaauaugaaaucagaugaucugauacuaaccuaaauggcuauggcauaccuaaugauguaacuuaugaggucauaauuauaccuacugaucauggcucccagguauauaacuauuccugaaaaucaagugagaaaguucauguucucuaugaaggaauucaaaccagaucacaugauaagacuucuaggacuaugagauuauuuucuauuauuauauuuaaagauuuauuuauuuuaugcaugugagcacacuguugcagucuucagacacaccagaagaaggcaugagguacaauuacagaagcugugagccaccaugugguugcugggauuugaacucaggaccucuggaagagcagucagugcucuuaaccacugagccaucuccagccuuccugcuauuauauuuaagugaauacuuaaacuuuuacauaaauaaauaacuauaaacaaauuacugaauacaaacucucagaaagaugauuuuacuuccucaauacagauaauaaucaaaugacgacaaaaucacaggaaaacagaauaaccuguaccaagaaaaccaaauguuugugugcucaguuaauauuauuauuucacuagcacaaccaauauuuccucucaggaggauuauaaauacuguuuacacuauaauauggauuuuuccugaggccuaagaaacucaugaaagaugucauuuccuuugaagaagaaaauaauagaaaauuuaauuuucuucuaucacguuaacaagacuaauacuauagagaguaaaauguuagcucuaacguaggagcacugcuagaccuugaugcuggauggaggucugucuccaagacuaaacgaagacucgucauuaacucguuaccaaacuucaauuuaaaucagagcuuaagagauuagauccacuuaacaaaauagaaauguuuuggaaaggcaaaaacaacucugaaaauuuucaacaaucaaaucacauuucaaaugcacuaggaugaguuauuaauaaaaguauccugaaaguuaccuuuccacccuuguaacguauucaacacaaaaauacuuguauugugauuaaccacccauaaaaaucagagcuaaacuuuuugaauacuuacugugucguagugucuacauucuuguuuuacaucuguacuuucauaacagguaccguuaggacacauaggaggccauauuaagaaccuaaaauguuccuuuagcuuugugagcuaccacuguuaacaacuuccacugcuauggauaaucagcgcacugaggcaagccacuucuggccugcagaccccauggcucugucuccuuuccucccuacucuuccuaacacuauccugggaaaaacacuaccuaagucuuuuuaucucaagguuugcuuuuggaggaaaugccaguguugaccauuacuaauagaagcuauuuauuaaauaaauacauaaacacauaaaugguaaauaaaguauaguaauguaagccccagaaccucauuuggccccuaaaucccacaaagaagagcuaagugugguggugugcacuuguaaccucaacacaaugagauagaaguagguugaucccugaggcuccugggccaaccagcauaaccuaauucaugagcuccaggucuaaaugucucaaacaagcaaaacggauagcuucuaagaaacagccucuagaguuggacucuggcuucuacauacacgugcacuccugcaggugaaugcacacauacuugcuugugagccacacacacagggugagggaggaggaagaagaaaggaagggcaagaaaucaagggagcaaguuggagaaggagggagggagggacagagggagagaaggaaggagggagaaagagacaauaaaaagugguacuaguugcagaugguaaugacaacuuuaauucccaacacuagaaaggcagagucaggcugaugugaauuugaggccaccuuggccucuauagagcauguuccaagacagccggaacuacccagagaagcccugucuuaagagggaaaaaaaguaaacaaugcucagcagaauaucuggacuucuguaucacuuucuggucaccaaagaucccaguucuaaugauaaccauaagugauaauucaacaugguauauguauacuagcugaaagucauacauguggcagaccauauauguuacagaaaacuaaaauauauauaagcuuauaguuuagcuaauucuuugaagaaacaucauaacuguaccaauuuuguaguaauuuuaaguaguccaugguuuuuuacacuuaucauuuauuuacugagcagucugcaugggcauacacaugguauauagggauaaacaugccaaggcacacgaguggaggucagaggacaacucgaaggaauuggucuucugcuuccaucaggagggucccgagacucaaauucucacugugggcuuaccagcaaaugucucuauccacugagccaucucacagguccacccacugcagauuuuacaaaugagaauggcaagcuggggugagcugcucucaucugaguacaugcucuacaaaugagggaaaacugugcaucaauaaagagagccuuaacugccugcaccuaaaaaaagaaaaaauagacuggacugaaaucaagauucuauugaaaaauugagcuacaaagaagaguagaugcggaggcccgcggcuuagccaucggcacucugauagaguaagagguggagaugcaauaccccaucccauguggugggugggucugcaugaggacuccgaaugcugagauucuacacuacccuccaggcuggucaaaucugcuccuuccaauuucauaaaaaaaaguuaucuccaguugccuagagaccuugcaaaagacaaugaaagccacagccgccaccaccacccacuaccaccacuacccucccuuguugccuuuagacuaauaacuagagccagaacccacuuauaaaaacuccacuuguaaaauguaacccugcuguaggaagaaacaacacacacacacacacacacacacacacacacacacacacacacacacacacacacagugcccagacugcaugugccaaaaccugcucugaggaugugucacugaggaauaaggaauggaugcuagcuauagccuauaggagacaguuuuaguuuguaggacucucuuguaugucagaaauuagauucuaacaaggacaucuucgguagguccuaaacaacgaugagaugucagcggaacagacagaauuccaaaacagcagccguaaaauaugccacuuaacacuagaaggcaagucuauuauaucugcaguacaucagaguagcaaccagagagccuugaaucugaggcacugcuuaauaaaucauuagucauuuuguuuauagauccaagaaagcgacuagagcuguuauaacaacaacaacaacacccauaaacucagcaggcuaaaaucaaaauguacugugugguaguucuagaugugauuacccaaaauucaaagaauuagcagugucuuuuucuucugacaguaagaaccuugugguuuuaaagaccaacaguguccacuaaucuggucccuugggggcucccagagauugaaccacugaucaaaguguauacauguguagcuuuaaauuuuucaaaccuuauuuuuaaugaugguucuuaaauguuuuaaucucccuccaagcccaucacccaccauauguuguggggggaaaaaagaauacaguggaaguggaccuguuuagaaagguucuuugaagccacucccgucuguguugucuggaaauuggcaguucaguucacagguuaacagaggcagcucaauccacuggcaaacacuucauggauacaccagcaguccaguucgguagaguuuggauagcaaacaugauucagcagcaguggcacaaccuagcugagacagccaggccucaaucuuggcacgagucagcaggagggauccagagggaugccuggaaagguucucagcugugccucuucucggggaauccaagaucaaccagcauugcacagcuagcucuguaagcaagccaagcucugcuucuaacacugucuguuaaguuguguuuauacccuccacacaucacaucuccuccacaggucuugccucagcacgugagucugucucagguuaccucacucugccaaucagucagaguccaagaaagcaggaagaaacuuuagcacugcaccagcucaauuacgcaauguaagguggaccaauacaugugugugcuuagcaaaggauccuucaucaugcguccuuucaagugcuugcuuuagcagaacauccuuucaccugugccugcuuuagcugaacguuccuucauguauuugccagagcaaaacaccauccaaccgacuuuccaaagaacccuuaaguuuucaugucauauaugggcuggaccuagacccccugcacauacauagcagaaguacaguucagucuuccugugauggcccaaaaauuagagugggggcugucccugaaucuguugccugccucccuguggauccuguuccccuaacuguacucccuugucuggccucagugggagaggauguaucuaguccugcagugacuugauggguugguacccagggggacuucccccuucucaaaggugaaagguagaggggauggaggaaaggucugugugaaggagggcuggaaggagaggaggguuauguaaacugaauaaauaaauuaaugggagcaggauauaaagugaauaaauaaauuaauuaaugaggacaaaaggaaucuuguauuugucuccugccaguauggaguuccuuggcuuggagauauaucauucuagucccuacuuuuauuuucacuuauuuucccuguauguguccaaauuucuaaacuuaacgggggaacuauuacuuguauuugcaaguauuauguuucuaaguucaggaauugacagauaccucaacauacaaauguugaggaacuauaagucaaacuccaacagccaaugaagcccuuaugucaccaagaagaccuagaacuggagagacaauuaacugaaaggaagaaaacaaguugaauccuuuuaagaagaagacaaacuuuucgcaaaaagaaaaaaaaaaaaaaacuccaaggaacugugugacauuuuaccaccauaauucaacaguuaucuaagagggaaagcccagccccuucugggacuaguguauauggaaucuaaacgucacuaauaucagaacacccaaaauagaguucuggucuaccagugaguggaaacaucuggaggacagaaaacaaauggccuaaauacagguuagaguuggaccaauagaucccaauuccaaccaucuaguacugucucuggacccuaagagcacaacuggaauacauacuaucaccagcuccaacccgaacauugauuuuuuucaaccugaaaaaggaaucacuguguuagaaagagcaaacaaauccccuaacauuaauaccuucuucuguugucccagaugauaaaacagaaggaacauuuuagccaggaagaauaggcaugcacauaccaccaucacagaaugguuccugaacaaaaaaacacacuaucucaaagcuaaaucagugugauauauugguucaagguaaaacuaccaucauacuacagguccaugcugaggugaacaaccucagugguauuaaaaucacaguccacagacuaauggugaaucauaaacugcuuuuuaucauuccacaucaagguaaggauugaaagggagaauggacauuugaaaauuuacagcaaucugaugauauucuagccauaaugaaggguagacuuuuauaucaugcagaaggaaaacucaugacaaaaggaaaacaaacuaaaagaacaggguucuuucacauacuauugaauacaugguucuaaaggacagcgggacaaauaaagucugccacuaggcaaaaauucucuaaaaggagagaaguuguuggauggaaggaugcauaucaguuacacuauucccacaggauuggacacaaugucugaaaaugugguaugaaagauccugaaggaauggagcuucuacagcaaaccaugcaaauagagaagguaacccaucuaaagaauuucaaccaacuaaaugcuugaucaugucaaugaccauacgauuaacuugugacuugaauagucauaguggcaaggcuagaagcuguaaugauggaacaaaaccaaaucauggcucucucaccaaagcuuauacagugcuugauaauguuaaaugugugaauaaugaccaacagugacuuuucaaugcagugacuuuuuuccucaaagaagccaacuacacacuugaugaguuaauugcauuagacuccuccuuugaauggcacagcaauccguugucacugggccugauacuauuuaacuaugaacuuaaaucucuucaucuauuagguuuacacauauuggcauggaaccuacauaguccucuuaggauguaucugucuauuguaaugaaucuggccuaaggcucagauuuagaacagugagauugacaguccaugcccuaaacaagaacauagguuaaacaaugaccauugucagguauaaaaggacccaggacaaaugacuaacuguggugccuguuagcauagcaaagcacaugguggccucuaggcucucucagcaaguaucuguuagaguccaugcuggcauccuggcuccucucagcucuucucugcccagcccuuauccuaaaagucuccagccuauuggccucacuuccgccagcuucucauuccuacaacccugccaucucucccauguguucucauggcucugucuacccucuugguucccaucuauccucuuuacuuucuugguucucucugucagcccucucuucucuucucuucucuucucuucucuucucuucucuucucuuucuucucuucucuucucuucucuucucuucucucucucucucucucucucucucucucucucuuucucucucucucuccaucucucuccucucaugcccugauucagcugacugcuuucucucucuucucugaacucuuccagaugccucuggauggacucucccucauaccuacaguacaaaccuucucccuguaggaauggccauguccucauuuuguucauuuggugcuugaaacccaggaaagccauguaugagcucccuucaaugggacucagccucuccuaaccaaagcaagcugcuggucuggcucugcuaugguuauguaugguuauuucuuucuucuggcuucugauacccaccacauuugacuucaacuucuacagcucacuuuuucagcugcuuugucccuuuagcuggucucucuuugcccacuggaucuacuggccaugcuuucuaggcuuauauguugugaccccauucccucucagcuuccuccuggaaguccuguagcuucucuauacccuucuggaccuauacaacaacccuuuccucaccucugccucagagcucacugcucucucuuccuugugcccucauggacauaugcaauacuggaguccucccucugucagagucccugcuugcaacccuugugacaacacccugcuuugacccucgugacaacaccauucgccucugucucucagcucucucauggagcuaacaacaacccucauuccagcagaguucauuuugggacccuuuucuccuuuccuccugagacucaguuuccuccuccaacucagagauuucauuaaagcugcacugucucacugcaaacggcuuggucucaguacagcucaagagccaaaaacuggcacacucgauuuuuaaauucuuucauaggauaaaaccuuccaccaguccacaaacaaauuauuccaaaaaucucuuauaccuaaacuuucccugcucucuauuuccaaaagucucuuaucucaaagauuuuucuauuuuuuuccacucuuaaaaaucuuuuaucucuauaauuucacugcacucuucugucaagaaauccuuuaagacuauuguguaaacucuucaucuuagguuuuuaauucauucaguaugguuuuaauaucuggaaaaucuguaauaaaauuuagccuuaaauuuguaacaaaaggcuuagaguuuaaaauucuauacauuggugaucuuaaucugcuacagcacacuguauguauaccucuaguucaacucuuguuuagaaaaaacaauuauaauucuuaauaauagcaaccauguggcuugucuccauccuggcugaugaccucugcaggauagaagcuaccaugugggcaacagccaucuuuacuaaggauaaaaaaagagcacaugcaagauaacuacuuuauuaagguggcauaaaccaaagaaugcaacaaucauaaaacuuaguccuacugagcccugugcuuaucacuguauaaggagguaauagcagaucuccaagauauuuuagguuaaaauggauuugguaugguaguuuuaaauaacaacauuuauuuaaugaauaagguuuauaaaccacuaagguuauaaacaucugcucagauuaacaaaagcuaauuuagauuaacauuuuaacuacucacuguucaacaccaggcuucuaaaaauucucagauaaggaccaacauauauaaauaaagucuguuugauaaguaagguuuauacauuccuaaggucuacucgggugaacaguaacugacuagaauauauaugucuugccucuuugucuuugguaauuuuguuaugcuuuggcuguuuggauaaauugaguuauacaaaaaccuuugacacuacaaggcucaggaaagugacguuucccgucugugaacuguauuuaugguuuguuuugaugcugaagaucuucaauuaaaucuucaacucaaaaauuuucacacucuaacuuaucagggauaaagcuguaauaucuuaaucuuauaaaagcugcuaacuuguuguaaacuguuaaagauaauuaaaacaugcaaguuaguggucaaucguuuucuaaaugauuaaauucuuuaguaugcucagaacuaggcucacagucacaguaauuauaauucuacuuagccuccucuauagguuuucaaggcuaagccuaaagcaaguaauuaaaacuaaguaagauuuguuuaaaaccagcuaugcuuaauaggcggcccucaaaaccuuucagagaucuguugaauauggcauugaaaauguuuacugacaaagcuucccaucauagacagaugugccagcuuuuagcagugagucuaaggucuccacauaagacagcaggacacagaugacaccaccuggacugugguaacgccaaccacuauacgaagaaugcucuaugccucgccugccuccagggcccugcccaaacuguggacacugugggauguauuguucuucucagucuugccaagggaggucaguuuauuaaguuccuccgccacaggcaaaucucucagaccuucagccacacacucugugcccuguuugcucucuccguucucuccucucucuuuccucuucauuucuugcucucgcccugcccugcauuccuccuguggcacaguccagucuaccggcauguucaguguucuacagucuccccugcucugggcagguccaggugccucugacugaacuuucccucgaaucuacaauaaaaaccuuauccucagccauaccuaggaacagauacguccucacuuccuugaacuaucacgugacacuccauaccacaaacaugggugggaaaauucagugguuuucagagaacugcagaacgugucaccugaacccuuucauauauuugucuuuccugaugugguaaaaccgaagaacuucugugucuuauucuugcaguguggggcucuaugggugcugauauccuugacucacugaggggaauacuuucauguggaauauacaacaacaauuacugaaccuauagugaccacugcugcccugccaacagaucgaaaggaauuuaaaaaaaacaaaaaaaaacaaaaaaaaaaaaaacaggaaauaaaaaaaaaaguuacuuuccaauagcuaaucaacacugauugaaucuaggagcuaaagaugaugcuauauaaauuaugcagaaaagagcauauguggacuuggggguggggguuacugggacaagcauaucuuaauuuuuuuucccuccgugauaauaguaaaaagaaagagaaguaucccuaaugacagcauaagaaugaagaccucagccgggugugguggugcacgccuuuaaucccagcaccucggaggcagaggcaggcggauuucugaguuugaggccagccuggucuacaaagugaguuccaggacagccaggacuacacagaaaaacccugucucaagaaaaaaaaaaaaaaaaaaaaaaaaggaaagaaugaagaccucacuuggacucugaaauaaacauuuaucaccguauggucaggggaaucaaggaugguuauuaaagauggaaccguaaaugucaaguugugcccucaagaucaguugaagcaauaaaauauuuaguuucuuccuauacuuuucacauuuuaaauaguuuggauaguugguugcaggucacaaauuugagccaauuacuuucauaucacugugauaaaauaucugacagaaaggacuugagaugagauuuauuuuagcucccaguucacaagaaucaauccgucuugguaggaaaggcauaguagcuagcagcuguucaugacaaaagggcaaagaaauaaauugaaucaaccacgacaaggguuuucaaauuuaaauauaaaaguccuugugucucaaauugucgugaauugggguuaaggacagaggcggaaaguaaauccucgagcucgguggaaaggaccuaacagcuuauuuguucauaaacagcaauagccaaguaaguggcgaaaugggauggcacucguucacacacacacacacacacacacacacacacuuucuauggcuugauuuccauaguuaucuggggccgcuggcauggucuguggccgagguggacagagcuaaggcacaacaaauacagcugcugcggcggccuuggguugugauggcaaauaacuacagcaccaaaaaaaaaaaaguauauuugugcauuuuguguuuguguacaugccugggcaggaaguuguggcaggaagauugcucuguauuugaagccacccuuguauacagaguaagacccuguuuaacauaauaaagaauauauauugguuuacuucaaaacuacuacuccauuauguuuuaagaaauggaaugacuagauugcagaacugcagguuuuugguuguuuucacaauuuguaauucuuuuguuuacuaaaaauaaaugcucuuaacuuaaaaaaaaaaaaaaaaaagccucuggggccaugugucccuuacuccuugguacuugcuaauccucacuauucaguaaaacugauugacugucucuagacucggaggcacuguuggaccaaagacaugggaaccacaguucaaauguagguuucuuuaagauuuccacauaauguaacaauccgguacaggugggacaucugaaagagcuugauucucaccagcaaugcucagcuuugcaacgaucuugcuacaggccucagcccaguuaauuucacuuccuugucuguaagauguggaaaaggauuauguucgcaaagugcuucaauauuggcuagaacccaacuguugcuuacuaacuagcaguuucuuucuucauaaguaguaucaauuaguuuauucauguucaaauaauuacuugcaguuaaaaaauuauuuaggaaagucucaagguccuuauaagcuuaucuggaaauaaauuagaggccuaaauaaauggauuaaaacauggacucggauguggcgugccuuagcugggguuucuauugcuaugaugaaucaccaugaccaaaagcaacccugggacuaaugcaguuuauuccaucuuacagcuccaggucacagucuacaagggagggagucagggaagugauucagugcagaaacugcugaagaggccaugagaaaauccugcuuacuggcuugcucagcaugcuuucauuuuguuucuguuuuguuuuuuauugagaaaaauuauuuuucauacaauauauucugauaacauuuucccccaccccaaugccuccaagacccuccccacuucuccacccgcuacaaacccuuucucuuucuuuuuuuauuuuuauauucagauuuuauuguagagcacaugauuaauaauaguugucaaacaauaauuaaaaauuaauuuacagucauggcuauagacaauauagaggaguuaucaauggcuucaaagaagauaaacccuacacuaaacuauaucauuuauguggccauauaaugaugucuuggaaauacccuuucucuuccuuuaaagagaaacaacaacaacaacaacaaaggaacacacauauagaaaaaagaaaacagggcuggcgagauagcucagagguugaaagcacugacugcagcaaaagaaagccaggagaguagaagugaguauaccaagccaugacaaacagcuuaagcgauacuccucaauguucucgucaaaacuggauauucaguauauaaaguguaaggucugauaugcuguccucuacacauaagcuacugaacacuucaaauacagcuagcauaaauucaagugugcuucacuucucuagaaugaauccaacuucccagugggaagucacucugcacaugcgagauuaauggagauucuuuaauaagagcucacaauuuuacuagcuuacaugcaccuugggcuuauacaacuuacuggugcugucggccucucauuguauuuugaacaauuuaaauagagacagaaaauuuaaguguggccacuuacacagaugggagguuuacacagcaaaaauauuaucagaauuacaguaguuucucccccaccccucuuuuacugaaaauagaucuuuuuccucacauuauuuuauccuaguuguaguuccccuucccuccacuccugucagcuccuccccaccuuucuccccucuggaucuacccccuuucugucucucauuagaaaacaaacaggcuucuaagggauaauaaaauaauaaaacaaaacacaucagaauaagaccaaaccgaaggaaaaagagccggagaggaggcauaauaaacagagacccacucauucucacacucaggaaucccauagcaacacuaaacuagaaauuguaauagauaugcaagggaucugaaggauuaaaaagagggaagaaaaaaaguacauaaguaaaauuaaauuaaguuaaaaauaauaagauuuuuuuaaggaaaagcccugacauuaacauuauaagacaaggaaaccccaaagaugcuguugaguucauuuccuauuggccaucaguaguuggacauacagccuacuauuaagaaucguuuguuucccuaguaagacucccuuggagaaaacuuaauuuucauucacacgugguucucaauuggagguuacuucuggguuagggguggggacaugugucuauuucuccuuucagcucuggaaccccaucuggugcagaccugugcaggccuuaugcaugcugccuuuguguccuaugggucuaaaucuuguuaauuuagagggccuuguuuccuaagaguccuccauccccucuggcccuuacacucuuuccaucuccucuucuaaggggagggacuugaugaugacauccaucuuugaugauaucaaaucaguuauaguugguuacucccacaagcuuuaugccaccauugcccuagcauaucuuacaaguaagaaccauugccaauccaaagguuugcagcuggcguaguguuuauuucucuucuuuggcacugugcagaguauccucuaguaacaaagacacuagaacauaagggugaagacacuauguaggaaccagcucaauuuuucuaugucuaaugaguuguguaggaguugccuucagcaaacaggccuugcugucaauuugugaagaacaaccuuuagucuuggcaacauuucaaaucgacauaucccagucccaguacugaaagccuccuuuggugacaaaagauggccaguuggggcccuuccuccccauuauuuggcaauuucauuuagauccucuucguguguguguguguguguguguguguguguguguguguguacauauacguccaugcaaacagucaugcacacauguucauauuaauaaucguaaccucauuguagaacacaaauguucaucagauacugugagauaaacuuaagaaaaugaacugcaggagcucagggcuuuggugaaccucacaguaaugacagagaaaucuaugucucuuucagagcuucccaucuugcaaucagauccaagaggcccuugucccaccauuguauaauauaagauauaucaauguagucugggcucucagcgugucauuucucaugcuugacaugaggcugagaauagaaaggagacuggguaucugagagauccuguccuggaaauggcuauucuggugagugauucguguaagccagaggguucagucauccuacacagcuucuggggcugagaugaucacaguggcacuuggcuucccaaaaccccaaaggaaucccaaggaacaaauaucugggauccgagaagggcagguggagaugugagcucacugaggcaggcaugagaggaggaaagcaacugacuggggcaauggcuaaacugauggauugcugcuuaaagagauccagacuccaguguccauaauuccauucuuuuuagcagcuuaagaacugccagaaauugcaaacaaccuaaauaucccucaacaaaugaauggauuuaaaaaaaaaaagugugauacacuuacacaauguuguauuacucagaauuauuugucuaguucuuguuaaauucaguguuguucuugucaaauguguuucaaggguucaccuuguccaccuggcaggaguaugcuuuuucugauugauaagaccacagaggacuucgugacagauggggcgguuuagaguaguugugaucuuaugcugcuccaaugugcugccccuuggaggcacauucuuucauauggaaauggacucaacggccaguuguaagucagucuccuucuguuaugagaacaaagccuaauugcaauccaaucauggugagcaaacaccagcagaaaccuuaaacuccaauuguggaacacaauuuuuauuccuacaguaucuaauacucaugauuagaagacuacauaugcuacuguuguacacauacugcacauacuacauacugcucugguuauacuggagguagcuccuuuaucuaaaaucuacucugugugacuuaauacuuccuaaacaaguugauuaacaaaucuuuuauagagucaauuuuauuacuucaacucuacaucagcaggaguaaauauagugaaauaguauuuuguauauauuggauuaacuuauuuauuuuaaauuuaacucagcuuauuucuuuuaauuuccucgauuguagguucuagcaauuauaagaguauauguaguuuacacaguauuucaacuagcauugaaauaucaacuaucuacuuuggacggcacccacacagaguccucauuccuaguaccaaaaguucuucucuucaucucauugauuacaaagaaugaaaagguccacagcuacaccacuccuaggcauauacccagaagauauucuaacauuuaauaaggacacaugcuccacuauguccauagcagccuuauuuauaaucgccaggagcuggaaagaacccagaugucccucaacagaggaauggauacagaaaaugugguacauuuacacaauagaguacuacucaacaacuaaaaacaaugaauacaugaaauucuuaggcaaauggauacaucuggaggacaucauccugagugagguaacccaaucacaaaagaacacacaugguaugaacucacugauaaguggauauuagcucagaagcucagaauacccaagauacaauucacagaccacaugaaacucaagaagaaggaagaccaaagugugaauacuuuaguccuucuaagaagagggaacaaaauacccaugggaggagauacagagacaaacgcuauccagagacugccccaccaagggauccaucccauauagucaccaaacccagacacuauugucaaugucaacaagugcuugcugacaggagccugauauagcugucuccugagaggcucugcuagugccugacaaauacagaggucgaagcuuucagccaaccauuggacugagcacagggucuccaauggaggagcuagagaaaguacccaaggagcuaaagggguuuccagccccauaggaagaacaauauaaaccaguacccccauagcucccagggacuaaaacacuaaccaaagaguacacauggaggaaccauggcuucaucugcauauguagcagaggauggccuuguuggacaucaaugggaggagaggcccuugguccugagaaggcucgauucuccaguguaggggaaugccaggacagggaagcaggaacggguggauugguggagguggggaggaauaggugguuuucagaggggaaaugaggaaaggggguaacauuugaaauguaauaaagagaauaucuaauaaaaaagagaaaauaaagaaagaaagagagagagagagaaaagaggggaggggagacuacccccccuccccuacccacccauucccauuuuuuuuuuuuuuuuuuuuuuuuggcccuggcguuccccuguacuggggcauauaaaguuugucuguccaaugggcuucucuuuccagugauggccgacuaggccaucuuuugauacauaugcagcuagagauaagagcuccgggguacugguuaguucauaauguugcaccuacaggguugcagaucaagaaaacucuuaacuguaaccuacacucaagccuuuagaguuuuaaauucauacuacauaccugaccuaagaacuucaagccgaggaacuaaaauaaacauugauuccaagugugcuauacuuaccaauuuauugucucucaguucugagcccaccuuucuuuguccugcuuuggauauugaaacaggagccuguaaacauuucuacuuugccuuuuagcuuuuaauauaauaagccuuugccaaaaaagaacugugcagggaaagacgcucaggccacugagaaaaaaguuaaguguuuuuuauaagucugguuuuacuuaucuaauauaauaaagcacaacagauuuccuucugaaagccuaacagaaaauuaauacauagaauuuucguuuaauauguauucuauucuuacaaugauagaacuucaagccaagguuaauuucagacacugaaguaucccgauacauuuauauuugaauggauuuguguucacuucuacuuuaagccaauggaucuaucuguagauuaaucuacaaggauagcucuuaaaguuguuuagaagagacugauuccauuugauuuauccuaagguuggcuguucauauaucauauuucacauuccaaguaucuuccuuuguuuucugaaucauaaagguuuauggcauuuuggauacacuaagaaugaaaaccacacagagaaaccgggcuugucaguuuguauauauaaucucuucccaguuucauuuuaauuugcuccauaauagaacugugaaacacaaacccuaacucaacucauauucuaacagguaacuuugugaugaucaauucuaugccaaggugacuggaccaugaguugccuaaauuuuuggucaaauguuauucugugaagauguuuuauuuuguuuuuugagcaaggcucucauuauguaacccagguuggcuucugacucaugauccuucugccucagcuucacagauuuggggauuacuggcacacauagcacucccaauuuacuuagauguguugaagguuaaugugaauggugagagacaaaacagauugcucucccugcuauaggaagagaccuacccaaucuguagauggucaaagagagcaaaaggacuuaucuuccucaaguaagggagaacucccccaugacuggcucccuuugaacuagaacaucaguuuuuccugccuuuacaguagaacuaaaaugucagcuuuucccugaucucugucucuugaccuucagacuagaccuaugucaucaacucuccagaguccaaagcuuccaaaugauggaaccugaugguccuguaacugccugucaaauuccuuauuucauuuaaaaaaaaaucauacauacauacacacacacacacaagaaagcagguugagcaucaaauaagagaggugaaguauuagaggucacagagagagagacacagagagacagagacauggagagauggagcaagagacagagagacagagagacagagagacagagagaggcuucucuguuucucuucagggcccuaacauacugaaagagauauuaaugccugccaaacauucacuuuuacacacauucuagaacuucccuuuucuucucucauuucaaacaauaaagcaugugguuauuauccucuucuccugaccccguuccuccaucccauugccuucuggaaacaucuguagcccuucucuguaaauauuuggccagaauauggauuguuaucuucuugaaagcacaggccugcaguccaggccacaucugcuuagcuaggggaggacagaagccugaccuaggcuuguccaaucugaagccacaaauguaaguaggguuucugguuuuggguuuguuuguucuuucagccugaaaacugaguaaacuaaagcuccuaucuuugaacaaauguguuaaauaaucaggccuaaucaauagagcagaugcagcaaaauagaguuggagacuaaaaaaauguccuccugaaacucaaugucuucacaccagucacugcuaaagcuucacccuggcucauuacauuugucaauaaauucccuuuuaguuuaaacuggucugaguugugacuggcuagucccaaccagaggaaaaauauaaaucccuacuguucaucauaugaauucauacaauuaaaaucaaaauaaugaaacucaccacaaacaucauauauaaccuauuuuccauaaacuaguauuguccaaaaauuagauguauacucuguauuuacccuaaaaauaucacuaccauugaagcuacuuaagaugcaaagauuaucuaaaaguguuguuucuuuacuugugauagagaagcuauugaauuaguaaagcaggauauuuugaaaauucauaaugagcuccauguucucugagaaacgcugagucccaucaaaauacauaaaaccauaauauucuaaguaacacuacuauaaucauucagucuuuaaguaaaaaucauauauauuuauagacugguuuaaucaaucaaauaucuuuuccacaacuguuuuuagagggcugagguagucugguucgcauuggacucacuauguaacccaggacccugacuuugagcuuaagauccuccuacaucuuccucaugaccacugagauagugugcuauaaugcccugccaguagauuagaacucgugugguguguguguguguguguguguguguguguguguguguguguguuuguguguguaugaucaaauaugguaacuugcacaugcuaggcaaauacccuaccacaacuucucuuuauuuuuaaguaaccauuuuccuauuccauuaacuaaaggcugaaauuaccuucuuacacaucacaaaaaaacuaucauagaaaaaauauuuaauuauaaacuacuuauguaaacaaaaaugauuuuuuaaauuggccuucaauuuucucuucaugaaggucaguuaucugaagaaauaagaaagaugguggcuuggauaauuaaaauuuagaacugaaaacauaaucaucaguacucaaauucaaugaaauucaaagucucuaacaaucuauuuuuuaaaagucauggccaauaguuuuaaugucuaauuuccccaaccuugcucuucuuacaaauuuuccugaauauguccaaugcaugaacaaaaauaaaagacaaaacaagaaaguaacacaucuauacacugccaaagaccaggcucagcucggagaggggucccugagaaagggguaaugaaagaccucuguggggauaccccaccugagucacgagauagcguguacccaaagaaucacgagagcccaucuugaugcaaacacacgagguaguuuaaugacagaaguccaagccaacacauaucucacgcagaagacauaggugccaaccaugaggcucagaagcuagggguuuauauaggaaaagaauggggguaggggaagaauuggugcaguuacacacaagugaguaguuuaaacaucagcaaacuguacguguagaucaagguaacagcagagcaucugguuaacauuuaacccaggucagaagggugggagauaggaaggcacagggccaguccggacauucuuguaugucuucccuaucuuuauggcuaguugguuccuaggaugacuuuacagccuuuguucuuugucuuaggcccaaaagccuuccuaacuugcaagccgcaugagucauggaccuugaauuuuaauuuucuuucaguaucucgaaaaugcaaaagaacuggaagucaauccuggguacaagcugacagccuuuuguucugcuggagacaacucuccagagaucuccagacaguucaccaaaauagcucagcucucucagaccaaagcccagucuuuuauuuauauaccaauucaaucauccaccaagguucccuuuugauuaccccaugaaucaacauuuuaugaccuuagcaccuugaaucuuagaaaagacagcaaauacacuuuguuuugacauagcuugaauacaaagaucugccugccuuuguaagcacagacaauaagcuagcuggguggaaucuugcccugcaaccaccacuccucaaaucucuuuaucuccuuaauauguuucugacaagcuggcuuauagugcagcuaccucuguucuuucaggucugugaagccccucauauaauuaauauuacauucuuauauuuugcauaguugagaaauccugucuauauauuuuugaacucggguuuucagcauucuuucccacagccuuaaggacaauccuaaaggucacaguguuuaucauuuugcuaaggacagaaaugcacucuugccuccuggacucaugcugcuucuaauuagcauggagucucuaaucuuggcagggagaacauucuuagauaaccucggugggggugggaggguaguauuucccaaaauguaaaguaaauuauguacauuauuacacaaagaaacguuaugccuuagcaaccaucaacacuuggggagguccaugcccugcugagagaacugugucauguugaccccucugcaguagccaugcaggacuugacuuaugcuucaaaauaagccuaguuaaaaaaaaaaaagacauggagguuucuacccucucaggagccuauauuuagauaacucuuacuuaugacucauuguaauuucacuaauuaaaaagaaggauaaucaacagacuuauaauugggugauuaaacaauguagcaggaaguacaucaaguaacaaaacuuguaauaaaaaucucagguucugacaucaugcuuacauacuaaugagaaagguuaaguucucaauuauuucacuuuuacaaagcuuuaugaaauguuagggcuuccguaauuucuaacagcaucaugagaaauauguauguauauucaaguucaauucaaagaaccaauugucucaaauucuuauacaagcaaaaaaaaaaaaaaaucccuuauccuucuaucauguucccaauccuaucuccauuaagacaauccacacaguaacuaguaagccacaaaaaugucagagggaguacuauaaaauacaaaaauaauacacugacuguaucauaugacauuuagaauuauuuguccauaaaauucucacccaguaaccucguguuauaaucauaagucacugacauuuuguguuauagaacauccaccuaaacuauaaaauguucagggguuuuuaagagccuguuaagggaagcauuucaaucaaagugucugccaaaauaaaauuaggauuaauacaaguagcaauuaauaaaaguugacaaauagauaugcuaacauggaagggagaacgcucagguggucucagccuuaaagaauuacaucacaccaaucaguugucuaacaccaaguggucagcccuaaaaacaugcauacaaguaacauacagacugagaaaaugguauuuauuuaucuauuuauucauucauucauucauucauucauucauucagaaaaacaugcacaaagaaauaaauacauagacauauacaucaccaccacuaccaacagcaacaacacagaaaagagaucaugaauuugaaguggggguuacaugugaggguuuggagggaagaaagaaagucacaagcuauauuauaaucucagaaacuaaaguaaaucuuuuugaaaagguuugcaaagaucugaaauugagucuuaaauacuuuagugcaucaggagauuaacacaguaaggaaagaaaacauggauguguuucauaaccaacgaaaagagaggacaagcacuauuagauuuuuauacaaaagaggaagguauuaugcaucuauguauaaacaacacacauacauaaguucucucucucucuuucucucucucucucacacacacacacacucaagcucacacacauauagagacucuccaccgaugaauguaaauuggaaagaaugcuugccucagguucagggaacuagagaacuaguuaugaugguuacucuuaauuaucaucuuaauggaauuuagaauuaaguaaaaaauacaaccuuuugauguguuugugagagaguuucuagaauaaguugcagacaagugcaaaaauauaccuuagugaagacugcaccauucuguggcuuguguuccuguacugagugaaaggagagagcaagccaagcgcccaaauuuaucacucuauacuuccugccuauggauauacaaugugacuagcugccaugagccaucaucaccaccauaaccuucccaccaugauggacugugagccaaaauaaacccauccuuccuuaaguugcuuuuuuuagguguuugaucacagcaguguggaaaguaaccgaaucgcugguaaauuaggcuaagaacacucaugucuuucauuguauacuauuugccacuuuuggaagguuugauguauacacaucccauuaaaauauguaauaaaaaaaggaaaagauaaauagcaccaaacauguaugaaaauaacucaaagaaguuacauaaagcaaaauacaaaauauacugaauauuuaaaggauaagguauauguaggaauauggaaagucuugauacauaguugguuuguggaaugggccuuaaauaaugacaaaguagaaccagacacauaaaagaaaucauuccacaauauaguaugccucagcaaaagacucaaaguugagacaagacccgggcaucuuuaggaaagcacauguacaguggucauucuucucaaagugcuuaacaacucauuguacaguugagagcuucaacaauacaaauuuaucaucucaagauuucucgugaagagucugggguuggucagcccuauuuuuucuuggggucuuaccaggcguaucaauaucuuccagaaagcaugugucccucuuucuuccagaacuauugcaaauucauauccuugcaaugguaugaauuuagcaugaauucaggguaaacccauuacaauacugacaccccccacaauuugcugguuguugaccaggagcuacacuuaucuccuagaugccauuuguaacucuugacaaguggacccugagacagggcccccuccuucuauccugagaauucuuucugcuuuaaaagaaagacccgggucuauccagauaaaggcacuugcuuggugaucuaaucacagacauaaugacucagcauauucgcaagucaugcccacgcugaaggggugaggauucacacaggaugugcacuccaaggggagagacucuugggaguuauaauaauccugacuagcauggaugguaauaaaagaugaaaacaaaaauucuccaaagcuaugucaaaauucgauuuauuuuucaucuuaugugcccaaagaugaugccaccuguacaguguauaugcauaauuaacaguuucaccugaagaccuucccacauuucgaaacugccuauucuuugacuauggucaccauuaucaucaaaugccugguucacucugucagcgcauaccucaagcucacugcuuucauucacuaugaaccuuucccaccuaugcuaucucuuagcuuucuuaucuaugaaugcuaaauuaguagugaauuugugaagacuccaccacaucuauggugguuugaauaaaaaaaaaaaagcccucauacgcuuauaaggaguagaacuguuaggaggaauaacuuucuuggaguugguggggacuuuguggaagaagaacaucacugagaauucucagcuccuucuccaaugccaugucagcaugcaugccaccaugcuuccugaguuagcaauaguaaauuauaagccagccccaaauaaauguuuuccuuuauaagaguugccuuggucacggucucuucacagccauaaaauccuaagaugccauccaacaaaugagcaguuuggaacuuuaugucuuucuacuggucuucauuuuucaggccuugaguuaauucacucuuuuuuuuaagcauuuuuaaguauucuaugcuuacguagcccucaucuuuaacuagccaagaugaaaggauaguaaacagcuuagcuuugguuuaauuaaaaugucauuccuaucaccauauggaagaaaaguacacacauaauuaauauuccuucgaugcaaauauaaugauuuaagagcacaagucugaaggauuagaaauaccugcuccuccuuuugucugacaauuuacauuuuacucauagacaaaauuaaaagaccuugcuuauuuugucuacugacuagggaaacaaauguuauccugaaauucaaagaaauacauuacugugaaaagcaaaucaauauacaaagcuguuagucucucaggacacugugguagagaagguugcagaacuucaggcagcuguuauauugcuauacugacuuaacaguaccuguguucuccagcuuuaaacagaacaguaguauggcuucuucuuagaaaagggaaguaggugguccuugaguuaaagugaguauggugguugaauacgaauggcccccaugggcucauauauuugaaugcuuagucauuggggaauggcacuaaaaaggauuaggagguguggccuuggaggaaguguaucacuggguugggcaaaagcccaguguauaucugucucucugucucucucuccuccccuccccuccccuccccuccccuccccuccccuccccuccccuucucucucucucucucucucucuccagaucaaaauguagcucucagcugcuguuccagcaccugccugcaugcucucugccaugaugacaauggacaaaaccucugaaacuauaaguaagcacauaauuaugugcuuucguucauaagagauaccuugguuaugguaucuuuucccaacaauagaacaaugacuaagacaauagaucauacagcaauacgcccaacagcauaaauugaaaacguccuaaguuaaaaaauauacuuaaaaugucuaaccuaauaaacacaauauuuagccuacugcuccuuuauguaugacugcuuugcauaauacuugcauguaaguguaguagguaugugccugguucccacagaggccauaaggagguaucagaucccccuaaaauuggaguuacagaugggugguuaugggugcuggguaaccaaccuauguccucugaaaaagcugcaaaugcucuuaaccacuaaaccagcucuccagcccuuagucuacuucuuaaaaauggguaguacauuuauauaaacuuggauaaaauuaucuuauacuaacauuauauuauaacaaagugugaaauaucacauguaauuuacuaaaacuuuacccaaaacauaaaacagccuuguaccaguauaccuucauaccauuauaaaguuaaaaguuuguaagucacaccauuauaagucagaaacugucuguauggcuuaaugguagugaugauuuaaaaagcagacauuguuagcaaaauuauaauuuuaacaguuuucaacugauaaaugauggcuuucaauuugcaauggucagaguguccaucucuuauaagaguuucgauguucuuugauagcagcuuuguaccacaguaguuaagucuucagauaccacuugaauucccuaugaagugugaaucaaguguuguauagauuagcugacauugauggagaacagaaggcaggaaauaaaucagacauaacucuguccucaaggugucuauaagugaaaaagaaaguccuggggacauaauuaauccaacguuccuuucccuucccuucaaaggcagacucuuagcauaauccccauuacaacuucuaguguccacacccuucugugaucuggugcccuugaauguaggcaggaccugcgccuuguuucucaugaaaagaacauagcaguguggcaugauauacaugcuguaugucaugggucugaggugauauuacauacauuuauuggaguuguuggagaaucuccucuacuggcuuggaggaaccaacagccaugguaaaggagugucauguguucaggaacugcaggggcuuucuaauuaccaaaguuaggccccacacaagaaagugaaagucucaguccuacaauuauaagaaacuaaauuuugcccaaaagcaaaguggguuugcaagcaucuccuaacccagggaagcuuuagcugacaaauccaugcaagcagccugagugaagcuuugaggggcaaugguagagagaguucaaacgggcuaugcuagaauuuuggcccacaaaaauguaguaacaugagaacagaugcguacugcuaagucacuaagcuuaaaguacuauugugagaugguuagcuuuaauuguaaacuugauacaaacuagaaacaccaggaagagaguuuaaugagagauucucuacauugagcugcccaaugagcaugucugugaaggacugcauaacugauguaaggaagacaguccaccaugggcagcaccauucucuaggcagggaguccuggccuguguaagagugaagaaauaaagcuaagcagaugcaaguaaagagguaagcacguauauucucucucccucucccucucucucucccucucccucucucucucccucucucccucucucccucucucccucucucccucucuugccuguuuaugggauauaaccaguuguuugaagguccugccuuaauuuccccacaguaaugaacaagaaccuugaauuauaagcugaaacaaacccuaaguuauuuuuucucauuuuuuuuuauuauagccacagaaaagauacuaggacauacugcuacagaguaagagaucaugaauacacuuuccuaauacuccccaagcugcuaucaaaucauggccaugcuaacaaauucaaauauccuaagcaucauaucaucaaaggugauaugucacucucgucuacacacuggggaaauccagaauugaucagacacacacaagcuuugguaagacugaggagcccgucugcagacgaucuugccuuaaaugggaagcacggaugccuaguuaacagaucaaaaacuaaagaucagcauaacucucaccuuuuacaaucucagaaagcaaaggacauggauugccuggcuaaaggcucagacugaguggcaggggacagaagacauggcaaguaaaacgugaaaggucaggagcaucacaaagguugauggaguagacaagcugaaggcgaagggaaaagcgccauucuuacuuguccaaagauaguaaaaguacaaaaacuacagggaaaauacaacccuuuuguuuccuauuuuaaaaacucaucuucucaacuaagaauuagccuguaugaggaagaacaaccccacucgucaccuaaaggcuccuaccgucaucucuccagaagucccaucuccacagacucauuaaagcacaaauauuuucacaaauggaauggaaaugacguuugauacauuuuuauuaggcucauaaauauagguagguuuuuuauaauuuaacaaaggaaagaaaaaauaacucaguuuucaauauacuuauuuaugguuaacuuuugaaacuguaagauaguaaucuguuauaaaaaaaaaaacaagaguaaaaucuaugucuagaauaauucgguuuucuccuuuguuaaaggaaauuuacaacaucauuucauuuugcuuuucuauagaaggagaguaaaaucaauaacguauuuccaaauaggcagcuuuuaaccuguuuggggacaggcuaaaauuaccuuugacugcacacuuaagggagaguuguuuuaauuucuuuuaauuauauagaauguuaggcuuuuugcaaaucauuaccuguugagauguacuuuccuugacaauuugggaagauaaaacauucaugguuaacugagaaaauuacucccaaaacauuacuaagugcauaagcacauuuccaaaaccacaggaaauaaaaucaaaacaaaugccaagaauaugcauuugcuuaaagcuugagcacaugcauagagacaaaugugcaaagcagagcuugccagcacccccacagcgccuccagguaugucucucugaaugccccauuugugaacaucuaggucagcccuauggcugacaaaacaaugcccuaaauagggcaugaaaauaaaugaaauguacuuuaauguaagacaauauaucuuucagagcagggcagcaccacauaaaacaguguuucuaaaccagcacauaggaacuggaaacaaagaguauaagagguauuuauagggauuuuuuaaaauaagcaaguauauaaaauaacuaaacagaguaaaugaaggguaaucuacagaucucuucugcuucagucaggggcaagacucacguauucauauuuuaccugcuguuugcagcuacaaguacugucuacugagucaggcucauaaacacaaauaacaguacaaagcaagaucaagugacacuaagaauacaccuuuggaaagacuaauccacaacagagguuguuacaucaaacuggcugggagaaagacacugacaugcacaaaaucauccuuccgaauagcucagauucuacuacuaacaaucuaauuaccuuguaagagaaagcaccuccucagacaauagcacaaagcaaggaacaagaagaacaggagaucuacagucguaguucucaaccugugaguccaaaucacuuuguggguccaaagacucuuucacaaagguauccugcauaucauauauuacauuauuauucguaacauuagcaaaauuauaguugagaagcaagaaaauacguuugugguugggggucgccagaacaugaggaacuguauuaaaaggucacggcauuaggaagcuugagagccacugggcuagagugugguacaaaaaaaacaaagagaagagaacuucagcugugaugaggaaaggcaucauagaagagaagugugugaguuagacuuuaugcgacuguguggaaaagugacgagugucauagguuuuguuucaaacaaaaggaaaaaaaaaaaagcacacacuuucaaaaugaccaugaaagaaccgugugugcuagacuucaaauccugagaugucuaagacuaacuacuuuuucaaggaucuccccgguaguagcaaauaucugauauguugucaaugcucaaaagaaauauuaaaggcaguaaauaaaaugaauggcucaauuggcauagcaaagaaaaaagauguaagcaucaagauucacagagaccaugaaaaucaaaauugagaccuuuuacuuuacuugauuguaacagagguaucugacuugggggaagaguaaaauauaacuggguauauauuuagggagaauaucuaaaagcaaaauauauagcuaauuguaguaggagacaaugaagauaaucagaacauuacaagaggcuagaucaaauauaacaugggacugcaaaauaaaaauaaauaaaauaaaaaaugagacuagaaagaaaaaagauauucucauagagauuacacagaucaaaucaauaggacaaucagucauccauucagcaaacagcuuuuaaguaugcacuacugaucuaccaaacacugcuaggagaugcaaacggggaaaaaauaaauagagcauagcccuuuaacucaaagaacugacagucucaggguugugucucugggaaaccauuaaagaugcaaucagucaagacagcaagaugccagaccucaccaaguccugaguccaagacaccagaagugcagagcaacaaccaaagaagaguaagauggggaagaugguggguagaaaacaggguauggagaacuuuaaaaaaauaacccuauuaaaaaaugggguauauuuuugguugugagccuagccuuuaacggcugagccaucucuccagccuggcgugguggcgcacgccuuuaauccuagcauucgggaggcagaggcaggcgaauuucugaguucgaggccagccugucuacaaagugaguuccaggacagccagggcuguacagagaaacccugucucaaaaaaccaaaaaaaaaaaaaaaaaaaaaaaaaguaaaugggguauagagcuaaacaaaaaauucucaacuaaggaauacugaauggcugaguagcaccugaaaaaauguucaacauccuuaaucaucagggaaaugcaaaucaaaacaacccugagaguccaccucacaccagucagaauggcuaagaucaaaaauucaggugacagcagaugcuggagaggaugugaagaaagaggacaguccuccauuguuggugggauugcaagcugguacaaccacucuggaaaucagucuggugguuccucagaaaauuggacauaguacuaccggaagauccagaaauaccuccccugggcauauacccagaagauguuccaacuuguaauaaggacacaugcuccacuauguucauagcagccuuauuuauaauagccagaagcuggaaggaacccagaugucccucaacagaggaauggauacagaaaaugugguacauuuacacaauggaguacuacucagcuauuaaaaacaaugaauuuaugaaauucuuaggcaaauggauguaccuagaggacaucauccugagugagguaacccgaucacaaaagaacucacaugauaugcacucacugauaaguggauauuagcccagaaacuuagaauacccaaguuacaauuugcaaaauacaugaaacucaagaagaaggaagaccaaaguguggauacuucguuccuucuuagaauggggaacaaaauaccaauggaaggauuuacagagaaaaagcucggagcugagacagaagaaaggaccauccagaaacugccccacccggggauccaucccauccauauacaaccaccaaaccuugacacuauugcauaugccagaaagauuuugcugacaggacccugacagagcucucucuugugagucuaugccagugccuggcaaauacagaaguggaugcucacagucaucuauuggauggaacacauggcaccuaaagaaggagcuagagaaaguaaccaaggagcuaaaggggucagcaacccucuaggaggaucaacaauaugaacuaaccaguaccccacagaacuguaucucuaguugcauauguagcagagcauagccuagucggccaucagugggaggagaggcccugauccaguacuggggaaugccaggaccaggaagcaggauuggguggguuggggaguagggcauggguggggggcaggguauaggggacuuucaggauaacauuugaaaaauaaaugaagaaaauaucuaauaaaaaaugaaaaauaaauacuugcuguagcauaauauccagguccaucagauaauugcacauuagagaacaggagaauaaaacagaacuuagcacaugcuaucugggaaauauccagacagaagauugaaaauguagaaaaguguagaagguaaacaaauggggguagaaaaagcauccaaaauaaaaaaucagaccaagauagaagaaagcagaaagacaggcaaucauccagacagagagaaccacagaccaucaauagcauguuuuccagcaaagaaugaauaacauuaauauaucaguaagcugaugaguuugugcccagccuggacuauucuaaaugugauucugucucaaaaaaaaaaaaaaaaagguaagagauaaugacaaauauuuuaaagaucaaaaccuuguauuguacaaauuauuaguaauuaaaaggaauaaaaggaaagcuauccuauuuguagcauuuuuuuuacaagauaccuuuguuuggaaauuagaagagaaugugaaggcaaaagacagcauuuaugccaacuauuuacuuugccaaaauuaguaucauucuaauuuagcaacaaagugauauauucucagauuguggguuccuugaaaaacuucuuccagaugguuacacaucccuggagugacagcacccagcacagcccugcacauacugggaauucaauuaaacacugcugaccaucugagaauucagagccuggaguagcugacucaauauaaacauauggcuuaguucccaccagaggaaaaaugaagucacaguguuccccuccccaacaguguuuccuuggaaaugcaggagaagacagaaguaagccaugauaagaccauguaacaaaagacuagggaauggacaaauugcagaauccaaacuuucucuaacauaaaaaaaaacagaauuguccaacugagaaucaacaguauaaguacaucuuuguucauuuaauucauucagaucaccauccaccaagcauugagcuucagaauacugaaggucaggcagucauacucuaaaacucugcaaaggaucagggaauuggaggacuaaaaugauguaaugugaaguuaaguaacauuaacccucuaaagcaaagagagggugagaccacugagugaguuuuaaaccacuugagaaccacagacaguauuuacagauaggaaaggaccugaacaagcuuaaaacauuuuauaaucacauacuaagugcauauauauauauauguauauguauauaguguauauguauauauauauacacauaugcaugugcauauauacauauauguguauauauguauguguguauguauauauguguauaugugugugaauauauguguguauauguauacauguauacaugcauauauguauauacauacauauauacacacauauguauacacacacacacacacauagaauagacucaauuuccagaaagacuccaauacucaccuuuucccaagcaugaggagcaaauccccagugcuugguuagcugaauuuggagccuugugguaagaaaccaggaauggcuucuuagaggagccauuauuucagacagaacuuagaagcauacaauuguguccaacuaagauacuaaaggagaauauuucuagcaaagcagaauaagaugcacacagacaggaaucagggucagcaucugaagaacagugaguuguucaaauaaauuaagaacaaauuacaaaauaaagagaaacugaaaguauacucaaggagagaacgcugagucaagaggcugcaguacccagcuaggcaauucacucgauaauuaacaguaacaaaagacagguaagcaaguaaaaaaaaaaaaaaaaaaaagaguuuggauuagcaagagaaacucaucccugccuaucccuugcacccucugauccagagccuggaaaauauggcucacacgccaauuccagcccgccaucuguuuuuguuaacaaaagacuacuggaucacagccaugcccacucacucaugggcuggcauguccauucaaccuguaaaaacaagcacagcacagcucaugaaaucuaaaccauuagccuucuaucccuaacagacaaaacugccaacgcuucucuaaccagagucccaacccuuuuaguaguuuuuuuuuuaacuaaauauuaaacguauuauauguacguuucuauuuucaaggcugucaucugaacucauauuauguaucuugauuuucucccauuugucccuuauucuccuuucuuccccauguccucaaugguugacuuguuuucuucucugguugcuuuugucgauguugaaacgcuuuccgauuuauucaauguucucuuaaaacauguaacuuauagaugaguucuuuucauagcauguguucccguuuuaagguuacaauaucuucccuacuacucuaagaagaucaaaaggcuuucgaggagugaagugacagauugcccagauuaccacauggacucgggggaugggaucuagcuugaucuaaagguucccgaacuucccacaaugcuccauuuugucugcuucauauguuacuccuaacuuccaugagcuccccagggcgguucuccagagggcuggcuucgcaucugcauuccccccacagguaccucagccuucuuucuacagacucaguuacuguucuuccuuucaccuuccuucuuccaaaaaauuugauaagcucucucaucagcugucccaacaucuuugugucuguaauguuaguaucuuuuaacuucucauuucagugagaucuggggaaaugguauaagacaagucuacucuauguaacauauccaaguuuuuucauuuaacuuggacacagugaguuucaagcaacaaacacaauggcagagcagauauauaccuaauaauuggaaauacaaaggggaaacucaacauaauggauagggcuagaaacauagacagaaaguugcuaauacagagauaguuucuacaacuaucaaaggaacuaauaaaauauucaaggugacauaaccagugauauacucuuuggaaaucccuacaguagauaaagaaaccuaucaaaauccaaacaagaacaaugauaaaauauaaguguaguguaugucgguuacuaucaagucacaaaaucaaaggugguaacaucuuaaagacuagaccagcuagccaugguggcacaugucuguaggcucaacacuuuggaggcugaggcagaaggauccugaguuugaggacaguugggccgcaugucaagcucuagagaaggcuaagccauggugugagacaucgucuuaggcaggugucacaucagagaugguuacuaacauaacauggaggugagaaacacaggaaaggagaacguggagggagaauuccaucuggugacauuuaagacagcuguuucaacaggauacaaauucaaaugguaagagaaugcagaaaaacaguaugcacugacucuucuucguuucucaagugaccaaauuacacagcggagaagcugaagguaaaaacugcaagauaagaagaaaguaggauuuggacaacaccuuaaggucaaggaaaaaauuaggggucucccuugggaguucccagggacuggaccaccaaccaaaguguauacauggagggacucauggcuccgugcacauauguggcagagaauggccuuguuggccaucaguggaaggagcagccuuuggaccugacgguguuugauguuccaguguaggggaaugccagggcaggaaaaugggagugacuggguggguggggaaagcacccuuacagaggcaggggaagggggaugggauggggguuccaaaggggagaccuggaaaggggaaaacauuugaaauguaaauaaagaaaauaucugauuaaaaauguucuuuaaaaaaguagggggucucuuuugguuuggugcuugcuuaaggaaaaaaauuaauaaaacaaaccuugagcaggaacacagaaggaaauaugagaaaaauaaagaaauaaacaggaaaguuaaagguaauuaaugaagacuuggaggcgaaagaaagguuuuuaaagaagcauuggugcggggaccugccugagaugggcaaggcauuuauaguauggugcagaggucaaggaaaaagaacgaaaaguggggauguggggagcuguggaaaauuccaaagaguccaaauguccucaagcucugcuagguaagaaauuggguuagcucugagaguaacuacagcaaaaauggaguuuauggagaguggaaaagggcuaggaacagcugcucggguagcuguaaucgggacuuuaugggagguuuacuuauuuauuggauauuuaccuaagccauagcagcagcaggaagagucccaaugcagcuacccugaauuugugggggagauucaacuguuaacaaaacacgcuuuuggaggucacugaauuuccauucccaccaauggggacucgcacacuagagaguugcuuggcggauaugaagcagaugauggugggugacgggagauaaaauaucacaauauaaacaaaacuuaagcuuuauuaacuuaguagauuuccuuucuuauuuuacuuuuacaaauaaaaaacagugccugaaauuaugcacuuccuucgcgugcacaaggcauagguauaguucucagcuuuggaaauauaaaaaucauauguaaaauuauauaaaaauuaaucucccaauuaaugguucaagagcucugucaacauuuauuccucacuucuuuccgauugacuccuaauucugacauugagaccuucaaagcucuccccaaugugugcccaacaacauuaacugcaaucuccuuucuccaaacacuauucuucuacugagacuuuaaauaguugcauucugugcauaggaguucauauuugcaagcacauaaguugcugcuucuuaagaguuuaucucugccaaccaguuuucacaauuaggucacuuuuaaauccgcauucauuuugggauucauaugaaaagauguaacauguauagggcuaccuagaauuaugauauggcuacuuaaaaugauugcccacuuauuguuucuguugauguuuuuguuguuguugccuuuaauacaaggucucaauacauaucccaggcugaccccaaacuccugaaccucuuaccucauccuccugaguacagggauuacagacacgcaucauugcacagaauuuuacucuuguccuuggccacuucauucauauuccucuaauggcaguuuugccuccaggggacacuuggcaaugucuacacauaaguuuguugguuuuuguuuggggguugcuuucuuucuuacuuacuuuguuuguuuguuuguuuguuugggggggucuuaauuuuuauuuauuuauuuuguuuuuguuuucuggcuuugcuuuagguuuguuguuacugcaguaucaccuggcacugcucugggaugcuaugaucccacaauccaauagauagccccaaccauacacagcaauuaauuaucucauccgcacuuagcagaaucaagguugagaaauucugcucaaaaaccauuaaacuucaauugugccuauagauagcucaacgaucacgaggaaucugucuuggcuugagcucacucucuucugcacuguuauccuuuguguucucaggcccuuugucuaccugaccuuuaguaucuugccuuuuucucagcaaugcuaugguagguaaauugaucuucagcuccuuaguuccuuccugacacuugccacauacagcacuugcucuguguggucccagacucccugggcuuguguggugucacagaaggaggagagacuuuucugccucauuugccagacauaccuuuucagagucugguugucaaaccacccuaauccagucuuaauuaccuauugagcccaacacccugagguuaccauauagcuuaacacuguacaucaaagcacccuuaaagggucuauuccugucuuccuuugcagcuccagcauuccgucuuucuucagucaccuaaggggcuauugcuuucucuagacuaguagcuacagguuuuacacuuuauuauauauaugcucacuaaaggaauaaaugaaccuauagccugcagucaaaaagaguauagcuuuagaaugacuaaauucuagaucuuucucacaguuacaaaacuaucaaauacugugccaagcauagugaguggggggggggggggaagacauuguucccaauucuuuuuuuaauuagguauuuucuuauuuuacauuucaacugcuaucccaaaagucccccauauccucccccucccccacucuccuaucuaccuacucccacuucuuggcccuggugucccccuguacugagacauauaaagucugcaagaccaaggggccucucuucccaaugauggcugacuaggccaucuucugcuacauaugcagcuagagacacgagcucuggggguacugguuagcucauauuguuguuccaccuauaggguugcagaucccuuuagcuccuuggguacuuucucuagcuccuucauugagggcucuauguuccauccaauagauaacuaugagcauccacuucuauauuugccaggaacuggcauagccucacaagagacagcuaugucaggguccugucagcaaaaccccacuauguucauagcagccuuauuuauaauagccagaagcuggaaagaacccagaugcaccucaacagaggaauggauacagaaaaugugguacauuuacacaauggaguacuacucagcuauuaaaaacaaugaauuuaugaaauuccuaggcaaacggauggaccuggagggcaucauccugagugagguaacccaaucacaaaagaacucacaugauauguacucaaugauaaguggauauuagcccagaaacuucaaauacccaagauacaaguugcaaaacacaugaaacucaagaagaaggaagaccaaaguguggauacuuaauuccuucuuagaauggggaacaaaauaccuauggaaggaguuacugagacaaaguucagaucagagccugaaggaacaaccauccagaaacugccccacccggggauccaucccauauacaaccaccaaacccaacucuuaaauagcuaacaguaaaugauuugugguuauacugauuacuacucuauagcuuuaaaaagauucugaugcauggaccuggagagaucacgcauacauagguuaagagaacuugcugcucucccagagaauccaaauuagguucccagcaccuauguuauacaguucaaaagcacauauaacuccagcuccaggggagccaagaccuuggccucuggccucccugggcagcugcauacauaaccacagauggguauagaugcucauacauaaaaauaaaagaucuuuuuaaaaaucaaaaacugaaaaaaucccuccucaaaacauaaguaaccagucuccaaacacaugaauggcugaguucaugagcucaaguaacgauuagacaagauuuaggggugggacauauuaagcaaggucaucaugcgaauuaaagcuucaauguucuacuacaucuccuugcuuugcuuccccuuuaaauguucuucucccuuugcaugcugauuacauagcaucuguaaugacuucaucagagugguagguagagcuccacaacacaaucuaugcugaaaggcuucccuucacagcuugcaccgaaugaaacgucuaacggaccuagccccugggguguacaagccaaggcugauacuaggaucaaaugcauuuugcccacucuccagaagcuuauaucaguauccaccuaaccagccagcgcuugagauguauggcuauuaaaaugguuauauagcuuggaagaauguccucucaaaaggacauguaguaaaggcuuaguugccagucuguggugcuauugugggcugauggcaccuuuaagaagcagggauuagaggaggaaauuaggggugaggaaauccccuugaggagaauauuaagaucugauacaaacuggcugacuaaaaucucauaaucuccuauaaugucuucucuuuugcuagauuuuucucucagucccucuacuucauaaaaaccuuuguccacuuuuucauuaauucaaaggcauuaagaacuuaccaccucccucaaaaucucuccucgacaucuuuagaccccacagugaaaagaagacaugaugauuccaaguuugccuuuacccuaauauaaugaguguccucucccaccugcaucuccaaucauguucaucagugacagagauguaauuuuuuucaauaauuuauguuuuuaauucacuuuacaucccaaucauauuucccuuuuucucuuuuccuuccagucccacccuuacaaaucgcuccucaagucucagaggaaagaaauugaggaagaucucagaaaauacaaagauucccaugcucauggaucgcaggacuaacaugguaaaaauggccaucuuaccaaaagcaaucuacagauucagugcaauucccaucaaaaucccaacacaauucuuuacagaccuugaaggagcagcucuucaucuggaaaaacaacuucauauggaaaaacaaaagacccaggauagcuaaaauaauccuguacaagaacuuccagagguaucaccaucccugaccucacgcuguacuacagagcaauagugauaaaaacugcaugguauugauauagaaagagacagguugaucaaugaaauagaauacaagagagcuauagauuucgagucaagcgauccuggauuuuaaauccaacacugcugcuugguuaucaagcuccuugaggucuuguguccugaaagcuaacauauccacagcagugaagacaacaccuaguacucuaugaagcuauauucaauuguucucucuagugacauugcuaaacaaagcuauguucucagucaauaauuagucucauaggauauaguccaaaucacacgucacugguguaugccauauuccauacuuucucacucuguuuauucaacaagcaauucuaugacuauccuacaugauuuaugcauaaaaggacaguacagaauuuuggccgauaaaaaagccaacaugucagacacaaagaaacucaugcucuauugagacagcaagcacauaaacaaauaaauuacgacacacuguucaacgugcuaaaaauagaugcgugcauacaaagugccacagacacaggucaagcaaagcuuuccagaggugaugaagccagaggagucugucaggaugaaugagcuucacugaguauauaacagcaagauggcugcuccaggggaacaacacggggaagcucagaauuccugcugaaaguugucagguacaggaaucaauccguuauuugcagaaagacacuacaaagaaauugauggggaaacagagguggguauuagaaugauccaagucacaaacagccacaaauaauucgccagaaaguuuggacuugacucaacagaggguaacuaauacguuuauaagucaacaagcaagaugcuucagagccaugccuaccaaagccacagggucugcaaaauaggggcucaaagugaaugaauguacauggaaagugagagguucaagcaagcccuaggguuucccgcuuagacaaaugguccacuguaguucccuaacccgaaggcgucacacgaguagcagggcuuucauuuugagcaaggguucucagccaauggguccucuuuggggucgcauagcagauauccugcguauuagauauuuacauugugauucauagcaguagcaaaaguacaguuaugaaguagcaauaaaaauaguuuuauggugggggcaggucaugacaacacaaggagcuguauuaaagggucacagcguuaggaagcuugagacccauugcuuuagcaggagacauugcaaagaacacagcaagaauuuauucacagcacaggaaaaggaaugcauuggaggcagaaauuuaggauggaaguuuuuuuaagaauaacuguuuuuaaaaucaauaaaaaauguuuuucaaaagaaauauaauuccauaagauguggugcaagauuguaaacuccagcacucuagaaacagaggcagggagguaugaccugccugggcuauguagugagaccucgcuuaauaauaacaagagguaauuaaaaaaaaaaaaaagaaggaaauaaaaucuuuuuagacucuucccccgccaacuucagauuaaaaauuacaaauuaaaaacuuuaaauuaugggugggggagcacccucauagaagcaggaggaggagggugggauaggggguuugcagaggagaaaccaggaagggggaaaacauuugaaauauaaauaaauaaaauaaccaauaaaaaaaacuuuaaauuaguaucuaccauauauacauuaaauuuaauguaaaaggagagaaauaucaaugcacuuaauggaggauaucacuuauugccaugguugaucugguucuuaaauugucuaccagcuaauaauauaaggaaguuucuacaucuauaaaaucagcauguuuucaaaauaguguuuucguggcaaauaaauaaauaaccaaaaaccaggcaguuucauuuucuuacagaaacuguaugcuuuccugaguaaacauuaaaaccgaacagaauccaaagucaucagaggaguucagaauuucuaaaaucccaaggcagcagcucaccgagagaauccacugcagaccucacugugagggacucuaugucaaugucacaccaacauuuuaaauaacaucacgcgucccuccaguuaauaaauuauuucaaaaccaggucacaauugacagacacauuaucuugggcagacgggagaaaggagagaagcaggggaaauuuccgucucucuccugaagcguauccaccaacugucaggccuggaagacagccaaaaucaguauauuauuuggaaaaauaagggggaguggagagacuugaaaugugagcaaaauguguuguggaagauuguaaaauauugagaauucuuucaaaauccacauuuaugaguaauauuucaaaugcagguuaaaagcacaaaaggagcucuuauagccaauagggggagcucucugaauccccacagauaagcuguccccuucuguaagcugugaccaucuacccaggggaaagguccuuaaacucuucuaagccagauaaucugacuauguggcuaucuaggcucacuacuugagccacaugaauuaaauugagaaacccaaagccaaagcagaucgcugucucagaaccuuccuccuccuuacucacacggcauuaucugcauuccuuccacagggaaaagaugacacagccaagccgugugaagugagaacaacuacaguauuaaagagucauuacaaaugggaccucauaaaauugcaaagcuucuguaaggcaaaggauacugucaauaggacaaaaaggccaccaacagauuggcaaaagaucuuuaccaacccuacaucugauagaugacuaauauccaauauauacaaagaacucaagaaguuagaccccagagaaccaaauaauccuauuuuaaagugggguacagagcuaaacaaagaauucucaacugaggaauacugaaaggcugagaagcaacuaaagaaauguucaacaucuuuacucaucagagaacugcaaaucaaaacaacccugagauuccaucucacaccagucagaauggcuaagaucaaaaacucaggugacagcagaugcuggugaggauguggagaaagaggaacacuccuccauugcuggugggauugcaagcugguacaaccacucuggaaaucaguuuggugguuccucagaaaauaggacauaguacuaccugaggacccaacuauaccacucuuaggcauauacccagaagaugcuccaacuuguaauaaggacacaugcuucacuauguucauagaagccuauuuauaauagccagaagcuggaaagaacccagaugucccucaacagaggaauggauauagaaaaugugguacauuugcacaauagaguucuacucagcuauuaaaaacgaugaacucaugaaguucuuaggcaaauggauggaacuagaaaauaucauccugagugaggucauccaaucgcaaaaggacacacaugguaugcacucacugauaaguggauauuagcccagaaguuugggauacccaagauacaauucagagaccacaugaaggucaagaagaaggaagaccacaguguggauacuucaccauuucuuagaagggagaucaaaacacccugggaggagauacagagacaaaguauggagcagaaacugaaggaaaggccauccagugacugucccaccuggggauccaucccauauacaguuaccaaagccagacacuauuguggauuccaacaaguguuugcugacaggagccugauauagcuguucccugagagagucugccagugccugacaaauacagaaguagaugcucacagccaaccauuggacugagcacagggucuccaauggaggagcuagagaaaguacccaaggagguuuguagccccauagaaggaacaacaauaugaaucaaccaguaaccccagagcucccagggacuaaaccaucaacuaaagaguacacauggagggauucaaggcuucaucugcauauggagcagaggacagccuugugggacaucgaugagaggagagguccuuggccugagaaggcuggauaccccaguguaggggaaagccaggacagggaagugagagugggugggcuaaugagcaaggagaaggaggaugggauagggccguuuucggaggggaaaugaggaaaggggauaaaauuugaaauauaaauaaagaaaauaucaagaaagaaagaaagagagggagggagggagggagggagggagggagggagggagggagggagggaaggaaggaaggaaggaaggaaggaaggaaggaaggaaggaaggaaggaaggaaggaagggggagagagagagagagagagagagagagagagagagagagagagagagagagagagaaagaaagaaagaaagaaagaaagaaagaaagaaagaaagaaagaaagaaagaaagaaagagugagucacuagagagaggagaaaucagggaaacuggaaaguuaacuguuccacaaagcaaagguaaguaucucggacugugugugugaauauauucaaacuuaaaagugcagguugauauucuguacucaguuugcgacccauagucaacaaagaauccaaaauaaguuucccaaugggauguucauuuauccaaaacacaaauaugauuaaugaaaccaucuaaacuacguucauagucaaugacuaggagaagcaaaagggguagacaggaaccucccuaaugaucauagcgcugcuguaauaacacucucccuugggacaacaugcccgauugugccaacccguauccugacuuuuaaaaaaauguauauacaugguacaugaguauugugccuaccugcaugggagccagaaggaggugcagaaacccugggauuggaguuauggacagugugagcauucauguggguacugggcauuaaaccuaagaccucaggggagcaaccaguacucgaaaccacugagccaucuugucgggcccuauauucuggcucccuuuuuuaaaaaaaaaaauguauaucagaguugagcaggagguauaaagugaaggagugugugugugugugucugugugugugugucugugugugucugugugugugugucucugugugugugugucugugugugugucugugugugugugugugucucugugugucuguguguguguguguguguguguauacacauacauacaugcauacauacauacauacauauuuuuuacaauaaucagaagaaaaugccaucaguuugagggggcauggaaggaauuagaggggggcuugagaggggaaaggaggaagaaaagaagggggaaguaauguauuacaauguauuuuuuuuuagaaguccaucagacacggaucccuucuuuccuccagagaaauggucauaauauggauuagauugcugagcagauaacuaugcaucaauucccaaguucaaaaaucuagauuguugaaggguaccggggaaaagauaauauacauggucaacaugacucuuuguucuaaaugaaguuccacuggcuacaaaguuuacggaccauuucugagccugcgaaggaguuggauuauuuaguaacuacuugccacacaaggguaaggaccugagcucaaucccaagccccacauaaacagucaggcgcagcaucaggcacacaucuauaagcccagcauugggaaagcagguaccaggaggaucccaggggccuuuuggccagccagucuagccaacuggaaagcugguucagugagagacccugccucaaaaaauaacaggaagaagaagauggggacuuaucaaagaagaaagcugaugucaaccucugcuucuccaugaauauacacacagaccccucgugugugcacauacauaaacacacauacagauucauuuucuccuacacacacacagacacacacacaccacguuucuguagauuuccaaggaccucaugaaaacagaagauguaauuauuaauguaaugcuagugaagggucagauuucauuauaggaauuaauaauaagaaccuaauaacauaaagaaagaauaagaaccaucuuaucuuuggaugccuacauauuacccugucuguuagacuacacucuaaaugcaagccuguuucguuccuguccucaguacuacaccugaaagucuccacaaugcuuguuuucccagaccuagagcaggcgaucaccaacugauaauacugucugcucuuuacuuuuuucuuaaauucggcaugaagagcagagcagucuuucaaaauacagaauauaacugcaauaaacugcaucugcagugcccccaacuguuuuuucccacuuuuuacaaauaaugguauuuuucagcuacaucaaauguuuacuaaagagcuuccuagaaguuccuuugcggagauuuguuucuaagaauuauagauucuuagaaauaauuuaaagccugagaaauccccguaugaauugcuguccuggaucauauggagcaaugaucauuuuuauaaggcuugugcagauuuaccauuuuuaaaacacauuuuaucgauuuccugacauaacauuaaugugacguuuuaaaagucagagugggaauaucauauaacaggaaccgacuugcugaaauccucuuaucguauucugcaaacucaaccucuuuguaaaugacagcacuaucucaaugcuuucaugagucuuuuucaguauuaucaucaacuugcugaaagucuuaagcaugcauuucacugacaauuaugauugaaaccuucagcuaaacauauaaauguuuagcugaagagugugugcgugugugugugugugcgugugugcguguguguguauucucaaucuguaggccacuccguggccauaauaaaauauauuuuaaaaguuaaaaaaaggggcuagugagauggcucagugguuaagagcgccgaccgcucuucugaaggucccaaguucaaaucccagcaaccacauggugguucacaaccauccguaacgaaaucugaugcccucuucugaagugucugaagacagcuacaguguacuuacauuaaauaaauaaaucuuuaaaaaaaaaaaaaaagaaugcuugcaaaaaaaaaaaaaaguuaaaaaaaaaaagcauagcacuggcuggcuuguuaaauuaucguucuccgucuuuuaaaauguaaaaagaaaagucuagagaagcuacaucguauucaaacuucggucacaaucuacauauuaccuaaacaucucaacuguccagagccugauguaauccauccauccaugucguuaucauuaucauccauaacaagagcauuuugucacuuucuuuuucuaguucuuuccccccuuuuuuuucuuucccuauauuucucuuuuuuuuuuuucaggaucaauauagucccuaacauuauuaacaaguauggaagagaaaugcuagcauucgcaacagagacaaaaaaacaaaggugccaugacccacaaucacaugguguccaaaccacgauuagaaaacaccuauagcggagacagcccaguguggaaaagcagagcuuaaguaagaaagcaucccuuauggagggcuggacugacaggagaggccccucagaaaagaauacucuaugguauugacugagggggaccauccuggucuagguauuagaauucaaguuguguaagauagcauucacacacaaagaugaagucugaacccaugcagguugaaauggguauuccccuguagcuguggaucaacguagaaaguuggagccugaaacgcacagagauguaucuauggagaaaagcagccuaacacugggagucuucgucuaaagggguaagaauagguucauuauagaaggacaagggauagcaguggagaaggcugccuauacagaagguguucuaucaaguaaguguauauacaaagaaaauaacaucuuagaaagacaagggaaguuacaaacgcaagaagggaaagccuaguauuacgcuuguuuguggaauggggcuagaacuaagaauccacacuuauaaggugugggcuuauagagauggcucagcaguuaaaucacuugccacacaagggaaagcugagaguuuguauccccagaacccauauaaaugcuaggugggugugaaggcuugcuuguccuucuugucucagaagguggaaacaggggaucccagaaucaagcuggcuggugaucagcaagcucuggaucugauuaauagacccugccucaaaagaauaagguggagagugauggaggcagaguaccaacauggaccucgccacacacacacacacacaccagcacacacacgcaugucccauacaugugucaacaccuaaaugcaugugcucacaccacacacaaacacaugaaaagaaggaaagaggcuucaggguuuucaguaacuacagacaaauauggcacacuucuguguacagguauacagaauuuuucacuccuggcugagagcaacuagaagaggugacauugcuaaagucaugcaaugaauauacccagugccaaaauuugagcucugauuaucaucuuccaacagaagguauauaucacuggaaggaaugguaauugcaggacugaagaguucugggccauuuuagaaagccaaaagcaaggcacugagacuggucccaugcaggcaucuuaaaagggcugcuacuaagucuaaagcgaucuauacgucaaaauaaugacagucuaugucgcagugagggcuguggugcauuauaacagaaaaacccauguguuccauugaauacaauuuuuuuuaaaguuugauaaggaaagagguauuuaauauauacauaguuuaaaaguucaaucucacaagaucaggaggaaagcgaguaaccacuuaaacaggaguuugucagccuccaucacuaacacgugacuaaaauucaucaucagcacagugaaugggaucacaucccccaacagugagcaaugaagggaacacagcagccccgaaggacuucccaaaagaucccgagccuuguucuaaucaugagaaaacaucaaaucaaccacaaacugauaaaacuacauaaaauaagugguccuuaggcucuuuuuuuaaaaaugucaacaugaauuagugacauggcccagcauguaccugugaccaagacugagggccugccuuagaccccugaguaaaaauguccucugaccuacacacgcacgcacgcacgcacgcacgcacgcacgcacgcacgcgaauaugcacacaugcauacauaacuuauacugguacaaugcaaaauuccuagaguuucccacucaaauaaguaugugauauuuaucauuggauuuauaauuaugaaugcuuguugacuuauucuuuauacagucauggauauacaucaauaaaaguauuuccccuuccgaugugccaggcacuccgcuguucgaaauaaguucuccuugucgacuauucuccuuauccacugcagguguguuccaaaacagaaaucuuagauggucccaaaugugccuaggguaaaaccuaacauaaaugaaguaaaaugauagacguuauaagaguuacuuaaaauugauuaacuguuuauuccugaauauuuucagaucaaagcgggccacagauaccugaguuaauucuguaacucaauaagauuuguuaucaugcuauccuacaaacacagagaccaaagcacaaagaagcuaaauaacuuaacuaggccuagagcuuacauugaaaaucagaacucagggcuggagagauggcucagggguuaagagcacugacugcuccuccagagguccugauuucaaaucccaacaacuacaugguggcucacaaccaucuguaauaagaucugaugcccucuucugggguaucugaagacagcuacagcaagcagggccagagagagagcaggagaguuggcucagcaguuaagagcauugacugcuucuccagagguccugaguucaaaucccagcaaccacgggguagcucacaaucaucuguaaugagaucagaugcccucuucuggugugucuaaaaacagcuacaguguucuuacauauaauaaauaaauaaauauuuuuuaaaaaaucaaaacucaagauuuuuuuccauucccucccacccccaaccucugcuuaguucucuuauuagugaauauaugaguguuacagucugaaucuaaaauguuccuccugagagaauguuuugaaugcuuuccccaaagcuaguggcucuguuuuggcaggcuguggaauguuuagaaggugaggcccagcugauggaaacagguuacuggagccugcucccugaucagccaccaggugaacagugccugucucaucuccugaugccaccagccacucuaccaugccuuucccuccugacagggcaccagaguccccugcucauacauucccugcucucaguucuuucugcuauguauuuguuacagcaauacagaaguaguuaauacgaggauauauuccuuaagagggcaaaaacgaaauacaaaaagauuugccgauacgggauaaaacuuaacgguaguccuggcuucagguagcagcaaccagagaacgcucaagagucacacaguucagcaaauggcccacaggaggggaugagaagguccuaaggaugcucugccuggugcuuuauuuuacuagacugucaaaucuaugggccugaaaaagauagaccaugcaaugaaggccugcaagcacugucucugccuuccuugugugaacaaggaaagaugaaaagcaagcaccaccuucguggagacagagaauaguagacaaaauugaagccauuuuugaagauguucgauaagauugaaaacccaagaaauuuguggagaagggaggagcuugggaacagugugccucccuaagggaucacuuauaggcagcuaaugguugccaagggggggggguauuuuccuuuaaugguguagacacuggcaaguugcccaugcuccuguaagaaacccuaauuaaacucacugguguacacacacacacacacacacaccuuaaugcaaagagugaaauuuuaaauggauaacugcacuauuuaaaaauaaaaugguucacaaagaaauuuuuuuaaacaucuuaauuuauuuaacauucauuuuacuguuuauguuuauguuuaucaagaaaauaaauaaauaaagcaaacuauuacucuuacugugaaacugucaacaaagaaagcaaaacugagaacucuguuagaaugucguugaggcgcuguauaauuuuacaggaaaaguacuauuuauauacuaaaguauauugcuauuuuuauucuuuaacccaggauagacauugauccuuauauaacuaagaagcaaaacagcaacgaggacgaccuuuggggucagaaaugcccggauaugaaucucagaucuguuacuuacuaaguauaacuuugggcaaguuaugcaacuuuccugcuuuuucaucccauagaggaagaugagguuggcaaugaccuugugaggcuguugugagaaucagcugcacagcacauaacacaguguaccugaaacacacaauaggagcgguuccacuucuaaaaguaaggugcaguugauggaaacaguggcuugcgaagacauucauagcauuacuuaccgaaagcaaguaagauaaaacucacccaggacucgggcuauauaaaaauggcgaaauaauaguauacgugucaguucagagguucccgacuuuagugcacauauguaaucaucuggggaaaucuguuaaguucauauuuccagguaugacacauaaaaauucuaugggucuagaguaagaucagaaaauacauacuuaacaaccauguguugucuggauacaggaagucucugaagacucuauauuaggcagcaauaaaaauuauaauuauggucacaucucuaguggaagucuccugcuaugaggcuacacagagggucaaaaaccuagaaaccacaccuauagccagaaccccugcuccagcagaggauccccugcugaaacagaguaugcccucugagucagaacuuuagcccccaacucacguagagacuuucuacucaaccagccacauggccagaagacaaaagaggaaacagaaaccaaaaacaaaaugaucauccaacaagaacaaacacagaaaucgcacauagaccuaugaccaccccaaacccaaauguuuacacgucaguguaagaccacaaucaacaauaacagcaaaggccauaugucaccaccaaaauccaguuauccuacuacagcaaacccugacuauucugacacaacugaaguaaaaacaaaacaaaacaaaaaccuuaaaacuaacauuaugaagaggauggagguccuuaaaaaggaaaauaaaucccuuaaagaaaaaggaaaccaccaaagaaauaaaauagaagaccagaggaaauuccuuccuucaagacaaccaagaaagaaaacauuugaagcaaacuaauaaaacuguucaagaucugaaaauggaaguaaaagcaauaaagaaaacauaaagugaggaaauucuggaaauugaaaaucaugguaaaugaacaggaacuauagacgcaaacauuaccaagagaauauagauagacgagagacucucagacaccgaagaaacaauacaagauauagauacauaaaaaaaaaaaguguuauaucuaaaacauuccagacacuaaauauccaaaaaucuggggcacuaugaaaagaccaaaccuaagaauaauaggaauagaggaaggagaagaauaucagaucaagccgggcagugguggcagcacuugggaggcagaggcagguagauuucugaguucaaggccagccuggucuacagcgugaauuccaggacagccagcacuacacagagaaacucugucucgaaaaacaaaacaacaauaaaaacaagaacaacaacaaaaaaaagaauaucaggucaaaaucccagaaaguauuuuuagcaaaauaauaaaagaaaauuuuccuaaccuaaaaaagaaccuauaaaggugcaagaagcuuacagaacaccaaauagauuagaccaauaagucccaucaccaccuaauaaucaaacacuaaacaaacagaaaaaagaaagaauauuaaaauuuguaaugggaaaaggucaauuaacauauaaaggcagaccuauuaguauuauaccuaccaucucaauagagacuccaaaagacaaagagccugggcagauguccuauagaaucuaagaaaccacagaugcuggcccagaaugucagcaaauacccagcaaaccuuuuaaucaccauagauggagaaaacaagauauaccaugauaaagucaaauuuaaacaauaucuauccacaaaguacagaaaguacaaaaaaaaaaaaaaaaaaaaaaaacucuaucucaagaaaguuaacuaaacaugaaaacacagucaauaaucucacagcagcaaaaccaaaagaagggaaagacacacacacacacacacaaucaucaacaacaacaacaaaaacaaaauaacagaaauuaacacucauuggucaacaauaucucucaauaucauuggacucaacuccccaauauaaaggcacacacuaauagaauggaugugaaaacaggagccauccuacugcugaauacaagaaauacaccucaacaucaaaauagauguuaccuccaaguaaaggguuggcaaaagauuuucuaagcaaauggaccuaagaagcaagcugguauaauucuaauaacuaacaaaauagacuacaaaacaaauuaaucaaaagagacaggacaggacauuucauagacaucaaaggaaaaauccaccaacaugaucuuucaagucucaacaucuaugccccaaaugcagaggcauuuacaagucagauuuguaaaggaaacauuacuaaaguuuaaaucacacguugacccucacauauugauagugggagacuucaacaccccacucucaccaauggacaggucauccagacaaaaacuauacagauaaacauuggaauaaacagacauuaugaaccaaguggacuuaacagauaucagcagaacauuucacccaaacacaaaagaagacauuuucuucauugcaccucauagagauuucucuaaaacugaccauagaaucagucacaaagaaagucugaacagauacgaaaaaauuaaaauaaccgccgauuccuaucagaccaccaugggucaaggcugaauuucaacaacauaaacaagaggaagucuacacacucauggaagcugaacaacucucuacugacggaaaacugggucaaaacaguaauaaaggaagauauuauaggcuuucuagaaucaaggaaaaugaauacacaacauucccaaacuuaugggacacaaugaaaguagugcuaagaggaaaguucagagcacuaaaugccuaaacagagaucuuguacuagcaacuuaacagcacaccugaaaguucuagaacuaaaagaagcagacacacccaagagaaguagauggcaggaaauaauccaacugaaaguagaaauaaaauagaaacaaagagaauauaaaauauuaaugaaacaaagaguugguucuuugagauaaucaauaagauagacaaaccuuuaucaaaacuaacuaaaauacagagacauaauguccaaguuaacaaaaauugaaugggggacauaccaacagucaccuagaaaauucaaagaaucauuaggucauacuuuaaaaaccuguacuccacaaaauuggaaaaucuaaaagaaaugaauaauuuucucaauagauaccaccuaauaaaguuaaaucaaaaucaggugaacaauuuaaaaggacuguacuggcuguuuuugugugucaacuugacacagacuggaguuaucacagacaaaagagcuucaguuggggaagugccccccugagaucuagcugcaaggcauuaucucaauuagugaucaagggggaaaggccccuuguaggugggacaaucucugggcugguagucuugguucuauaagagagcaggcugaacaagucaggggaagcaagccaguaagaaacaucccuccauggccucugaaucagcuccuguuuccugaccugcuugaguuccaguccugacuuccuuggugauaaacagcaguauagaaguguaagcugaauaaacccuuuccuccccaacuugcuucuuggucaugauguuuugugcaggaauagaaacccugacuaagacaaggaccuaugaccucuaagaaauuuaagcagucauuaaaagucucccaaacaaacaaacaaacaaacagcccagggccaggugguuuuagcacaguuuagccacaagguucuagcagaccuucaaagaagagcaaacaccaauacuccucaaauuacuucacaaaauagaaacagaaggaacauugccaaauuuacuuuaugaggcuacagucacccugauacccaaaccacaaaaagauucaacauagaaagaauuucagaccaauuucauuuaugaacaaugauauaaaaauaucaauaaaauacucaaaaccugaauccaagaauacaucaaaaacaucaucuaccaugaucaaguaggcuucaucccaaagaugcaggaugguucaacauauggaaaaaaucaguuaauguaauccaccauauaaacaaacugaaaggaaaagaacacaugaucaucaaauuagauacugaaaaagccuuugacaaaaauccaacacccuuucauaauacaagugcuggagagaucagggcuacaagggacaguccuaaacauaauaaaggcaguuuucaggaagcuauagccaaaaucaaacuaaacagagagaaacuaaaagcaauuacacuaaauucagaaacaagacaagguuguccacucuccugguaucuauucaaugcagaacuugauuuucuacuagaagcaauaaaacaacuggaagagaucaaggggauacagauugaaaaggaagacaucaaaguaucacagaugauacaauaguauauauaagcaaccccaaaaacacuaccagggaacucagaaagauucaagaaugagggagaacugagaggcauuuggggagcaacauggaacccuagugcaguagaaacucucuagaaucuucaagagugacucuauugaagacuucucguauuggggaauacagagucuaaacugguccucuucuauaaccagacaagacucccaacaguggaacuaaaacaccaaccuagccacaaaaccuucaaccuacaauucuuccugccucuaagauguucucggguaaugguagacuacaacuuaugagaguggucaaccagugacugguccaauuugaggcccaugccucaagagggagcccacacuuaauaccaccuggauggccaagaaccagagacuggacagccccaggacccaggauagaacuaaacauacugagggaaaaaauucaaugaaauaauuacuuacuaaagauauucugauauacucauagaucagugccuagccuaauugucaucagagagguguuauucaguaacugaugggaacugaugcaaaaacccagucaaacacuaggugggaccacagacaucagugggauaaucauacaccccguauggcucugagcuggguccucuggauauauguuaugguucuauggcaguguucuuguggggcuguaacaguggggcugucucugacucauuugccucaugaguugccucauacagccuugauaugaugauuguaacuuuuuaaugccauguuugguugaucuccugggaggccugcucuuuucugaagggaaagaguggaagaguggaucuggggucgggugaggagccugggaagaguggagaaaggggaaacuguggucaggaugcaauguaugagagaagaauaaaagaaaaaaaucaugauuguaaagacuacacaaucacacuggaaacacaucauacacuauugaacgaaaaauccagaauccaaaguugaaugguuuaucagauaaguacauagaacaugcuagaggaaagauucuuagcaaaaagaucacgaguaacuucuaagcuuuacucaaaguuuucaagcagucgugcuauuuauaaguggauaacuggacacauuacauaagaaaaucaaaaagagaauacauauccauagccuucaagauaaguucaaacuccuuauggaaacaccagaaauccuucaauuucuagacugacuucuuguccauuaaaccagacuguuuacauuucugaaccacauucuacauuuccacagacuguuacuagaugauauauugcuccuucugccuaaaauaucugucuccuaaucuugucaguccaguaaacuucuauucauccuacaagauugaagcagcaccucccgucucagguucccugcacacuccucccaugcagaauuagaaauguuuuaauuuuuuaaaucuuucuuugugccaguguucaggaggugcuaugugguacuugcgcaguagcuuauaccucaguguauucugacucuauaaaacuauuccaucuacuagcaccgggacuuggaagagauuacccacuucaaguuuagaauccacaaaaccccuuaucaauaccuguugagauuaguggucuguucuauaaaucccugacugaguuggucagucagauaguauguguuugguugaaaagaguaauucuggucuauguacaucccaauacauagcagucaaaaacauguuuuaaguucuaagcaacaguuuagcugucauuuuuaaguuuuuacauuuuuccucugauagcaucugucaugguuugaauaugcuuggcccaaggaguagcacuauuuggagguguggucuuuuuggaguauuguguggcuuggaguaggugugucacugugggugugggcuuaaagacccuacuccuagcuaccuggaagucagucuuccacuagcagccuucagauaaagaugcagaacucucagcuccuccugcaucaugccugccuagauguggccauguucccgccuugaugauaauguacugaaccucugaaccuauuagccagccccaauuaaauguuguccuuauuggaguugccuuggucauggugucuguucacagcaguaaaacccuaacuaagacagugucuucaauaucuuccaaucuucagaaugccagacuacccccaacaaauuaacaaugcagaacucugcugacauuuuaccagaacaaagacuauccuuacauaaucugcccugcucccccaaaacacauagcucuuuacacacaggucuccacacuagcauccauaugaaacagacaauccuguaaguaaauacagccauuuucuguguuuugaaacacuaaauaguauaguuaauauuuaauauugauaugugacauagguauuucaaauguagauuuaguaagaagagggacagagcaugaacccuaagugguuaagaguaauuuaguaaaaaagcggcacagaguaaauaaggaugaaagagaggaagggagaaaguggggggaaguuagcaacaccaaaaacugcuaacuggaaucccaggcaaaaacuucaaauguacaacacuguuuauacaguccuauacaugaugcuuauggagucacauggauauugaaaucaacuugcaacaugaaauaucuucaaguaaaaauaagucuaccuaaaacaucuugauuggaaucucaaaccacacuagauauuaacacuguucccugauucuacugcauagucuugccaccuguaacuauauaacaaauacauauagcuagggaauaacuucuggaagccaacaacaguacacuagaugcuuauaucugaauauucaugcaaucaaaguuuuagggguguacguagcucagugauaaagugcauuucuagcauguccuauagcugagccccaauaccacacacacacacaugcacacacacaugcacgcgcacacacacacacacacacacacauacacacacucacauacacacacaugcgcacacacacacacacacacauacacacacauacacucacacacacacaguucuagggaauuaacuaaaguuuuuaugagccucuucaccaccagccaugucuccaauaaaucucuuuggagagauuuccacuucugucuuguaagaauaaugacuucuuuauuuaacuccucuuauaaaccaagcaaagcccauuccauucacucugccacaaagcugcacagcacagcuaugcuauuucugccuaagguuuuguugucucuuccaguggaaauaauaaaagggguuuucuuccuaaaagcuuuaccaaucaaucuccauucgguaucacuuaacugucagcuccccggggcaguuuagggugaagguaaagaugaggaaagcacagggcacuggcucacucauagguuaaaggggauauuaacaccaagauggacaggacagcaaagcugcccaaagaacacuccagacuccucuaauuuugguggccgggaggucagguaggguuucaagacaggguuccuggcgguccuggaacuuacucuauauaccagguuggcuuugaacucacagagaacugccugccuccgccuccccaugauuaaaggcgugcaccaccacugccuggcuaaacagcuaauuuaaagguccaauacuuguucuuaaucuauuuuccacaacacagcccagcauuacugcucacaagaucagcuucccgaauucccuuucucuuguaacuaaacacuuacaagauucccucuccaaucuguaacuaaacaguucuucauaaagggaugccaggccgagaacucuaggccgacgcagacuacuggcuugcucuccauggcuuuguucagcuugcuuucuuauacaacccacaaccaccugcccaggaguggcaccgcccacaguguguuugugcuggucccuuccacacacugaugaaccaaggaaaugcaccgcagacaugcucacaggugauucuaauuuaccucaacuugacaaaaguccaaccaguugccuucugccucccuuuagggaagggacaguuggaacaaaaacuacagcugaagugaauccacaguaauuagcaaaguguagaaaccauuucauguucuggaagauaugggaauaaggaaacauacaggaaauguggagugagaaagacaaauaccaagcagggucugaggcugccuguuuaggcccaaagccaucaaccacgacuugaucuguccacucugaucaaauagcgaccagugugagcagacugccucugguccgguaagcagcaggaauuagccauuuuaaagauaaagcuacucucucacagacuccacacaccuacagcaugaguaagucaguguuccauuuuauagcuagauacaugaaggcacuaccacuuaauaagaaagcagugcucauaagaaacagguucggagacuaacacucuuccggcacuguaguagggcaaacuggaaaacacaaaauguauccuucaaccaaacuuuuuuuuuucauucucccucagagaaucuauuucaaaguuucacuuaacuucacaaaaaagaaaagaaaaaagaaaaagaaaaagaaaaagaaaaagaaaaagaaaaaagaaaaaauugacuuguuauccuacugaaguauaaaaaggaagaaaacuuggcucuaggaagagcuccuagagaugaauuacacaggagagucauuaggucucaguggcauggugccucugccugccuaugguaccugaaugaccuguucaucacaaacauaaggaagaacacuaugcagguaagccugccuuuucaaacguaagcuauucuuucacaccaacauaugagaaaucaaaguaucauacuuuagcugacuaaacaauugugcaauauguuuaaacuggaaaccaaauucacuaaaauguaauaaauauuuucuaggucuauacauugaaauuauauauuuuucuaccccuucauuuacauuauggucugcuuuaaugccuaaaauguguaggcucuuagaaagacuuuucccaaauuaucucaucugcaaaauaaaccguuucagaauaccacugaacuaaucaaauuguguccugucaccuaagaaguaagacugcuaaagucagucgacaccguguugagcauuguucgguucuucuugauuucagggcagaguugcucccaaccucccaugcugggucaaaaaaaaaaaaaaaacaaacaaaccccacugaguugcacaugcacuagaaacugugcaaugcaaaacuagccagagcggagggauauagguaaauggcagaacacuugucuagcauguaagacacccugguuuuaaucccugucaucacaagaaaacgaaacagaaagacgagacgacuagcaggcacuagguuagccgugcuagcuucccaccaccagagcaucccaucauuuuaaagaggaagugaaaagcccugcuucauagaggucaaugccaaagcuccccacacaccaggcuuacacccaugaugcagcuggcacuguucacucgggcagacaccgcucacugagcacaauggugcaaucacugcucccaacaucauuacuaucuaaaauagacagcccacuugcaacgugauuauuuuuauggauauaacaucuucaggagguuuaacugcucuauuuaugauguaccccacuuuguaaaugcaguggcucugaaugaaaguaucuucuaucggauccccaauagucuggcugcccagauaguuguggaaauuacagggauuucuuuuucuauuuccuucuaccuaccaccaaaaacuuuaugaguugaauccuaaacuugagaaacuuauaagguaacugguugauaugucuuuggugaccagaaaacuguuucucccucucacuugcuauuaauuuacuuuuucccauggggaccuuaagaaguggcucauuuauguucaacaguaauuuaugaaaaguacuacacauaacacucaacucuuuggagaacuggggcgggagaggaguaagaagaacaucuagaguauaguuaaggauucugcugguuguagguucuucuucaagagggaugaugucacucgcccuggguugcucccuagcuuuccaguaccaguaccaggaaugaucuccuucuuauuaaguggaucuuaaguccaauuagggaacaguugguuaccgcccagguaugugugccacuacugcacccuuagggucaguauugugguucacaggugucacagcucaguagaauuguugguugcuccccucccuuggaagguugcaugguaucuucugguauuaugaaagcuaguuugcaggaaggaagcauucauuugggucaguucaagcucaggggccucuggcuccuguacuucaagugcauggugucuccagcaguagggacuuacucuccaccucugggggggggggggggcggcaaccguagccuauauauuuugagagucucuuggacaacacugaccaacaacucaaaagauggcuucucuguuguugaagguuuuauaaggugaucucuacucuuagaaagagcauugucagcccaaaugagaaaaaaaauuaaacuauguuauguauauuuauguauauagacuuacauguauuauacagacucaccaacaugucugcccaaacaugagcucaauaauagacacgucaaaguacaagggaaaaggccuuagcccuacacauaaaacuauagucaacuaaaaagugcugaaagugggagaaacugucuucucuagggaagggcacacuacugcacagguuauauuuaggaauguauauaugcaugcauacgucaacaauuaaugaaaaagaggcuaugaaguuagaaaacaucaaggaacaccagggccaagaagugggaguggguggguaggggagucgggggugggggaaggguaugggggacuuuugggauaguauuugaaauguaaaugaagaaaauaccuaauuuaaaaaaaagaaagaaaacaucaaggaggguuuggggcaagugugagguagggagaaaaucaagauguucuuauagucucaaaagaaauagaaaaccaaauaaaucuaaaguauuagcaacucuguauugcuuuauuaaaauacaaauaauucuuaauuaaugucaguggaaaauuaaaaugcauuauaaaugugaauuacuuuugcuuagaauaaaagaguguagcagaaauacauuuuaaagguuuugcagcuguuuaacgaaccaugaaaguuuuaggauaugaaauuuuauguauaucagcuggauuaauaaaggggcucaaccugagaccucuggugagugcagauuucucuaaaaugaaaggggaugaugagagagggaaagagaagcauuuccagagaaaaagcuaaauuugaagaggagaguguaaaacuucacuagcaucaucuuaugaucuggcaguguaaaccaauagauggauuuagaccaucagaguucucuguuguuuuuaacaauaccaagugugggaacuaaaaaggggagugugggggaaagagggggagggaagauagcccgagucuggccagaguuccaccuaugcucugggcagguggacacaggagggcugccagacacuuuccacucagcccugggugggcaucuaagccacugaccacacucgacggagggggggauggaaaaggggcagcccccgaccaggggccccagggugacacccuguagccccaggguuaugggagagagggcagagggagagagguucccacaaaggcaagaguaagagcagcaggccuuggugaacagagauagucuaugguuuuagagcuuuauuguagaaaggcaggggggaagagaaaagguggaaacagagagagagagagagagagagaccagucauggccaagaggagagaagggggaaagggagagagagaagaaaggcuaaagaguaagagggagagagaguaagagagggagaggacagaggagaggagaggagaggagaggagaggagaggagaggagaggagaggagaggagaggggaggggaggggaggggaggggaggggaggggaggggaggggaggggaggggaggggaggaagagagugaggaguaagagagugagaaggggccaaacagccccucuuauggugugcuguuaucuuuacuguugcuagguaccuggggaggaguuuagccugaaggucagaagcuugggacauugucuacaugacuaaaagccaugcuucugugggggcuguggggggcuguaacuucaacaggagccagaguuccaggaaacaugagagaacuccuuucaucccauguaggugaauuaucaccaccugggucccgggguucagaccucagcucgacuggagaccagacugucuguauauagcccauugccccacagccaagcauuugauucuuccuaauuucuauuuucuccuaccuucccuguugaggaucauuuucaagcuaaaggaaauaacagauaaagagauauaauaaaguugugaacagagacugaucauaagagacacuaggcugcuuuuaaaaggagcaagugugggcuauugauacagcuaaguggaggcuugccaccaagccucaagaucugaguucaauucccccacaccagugguucucaaccuuccuaauguugcaacccuuuaauacacuucuacgugucuuggugauucccaaccaaaaauuauuuuuguugcuacuuuccaaacuguaacuuugcuacuguuaugaaucacaguguaaauaucuaguaugcaggauaucugauguguggcuccugugaagggucauuugacacaacuaaagggguugagacccauagguugagaccauuagacucacaggguagaaggaaagauggaacucccucaaguuguccucugagccccauaugcacacgcccauauacauauaugcacacuagauaaauauaauuuaaacuuuuuaaaagaaauaaguguuagauauccagacccagaagauuuagauucaaguagaaggaauugucaucaaacuaggaaucgagaaagucucacugccagaaacaagcaaaguauacugacucuguuggaauuuauagucauacaucuaaagggauaacucaaagaaaugccacaaauagacuacggcaugaauuuagaaaggcaauaaauaaaauacuucacaauacuauuacuaguauaauggacauaaacagcugaccagucuaaugcaaguagcuccaaugcaagaagaaauaccaagcguaaacuaccaccauaaacugcauacacugaauuuuuacgguguguugguuuccaguuaaaaaguuuauccacagaugacaaagaaugggaaguuaacaugcugauaagcagacucaggaaucaaaaaaaaaaaaaaaagacaugcacagguuacaaauagagggcaaaacaagaugaaauguaguaagaauaacuugaguuuaagcaacacuuucacaaguaccagaugugggaauuacggcaucacagauuguuaaaagaaaaguuacuuggaaguuuucauugauaauaugaaccaaugccaauuucuuggcuuagaaaagcuuagccuauagcaaagucuuagagcaauaauacacuggccaucauugaauuggcucauauuuuaauagaugcaacacugucucauuacauaauccaugaaagcacaauuaaaaauuaaauaaaaaagagcccacguucccgucacucaaagauaaauauuaucuccauuuuugugucccacagccagacauauuguuguacauuguaagucuuugcaguuacuuuucuuaugaaaguacaaucaagcuaugaaugcucuuuuauaaucaguugguuuuuuuaugcaucaguauaucaacucccaugccauucuacacugagugacaccuaauacagacuauucauuucuuaugguuuuugccauauuucaauggggcauuuugaaauuuaagaacauucaaaggacugaaaagggugauuuuaagaaaaacaugaaauuuugagcuuuaacacauaagccuuauagucacagugaaaggcaacaguaguucucccaugaaaaagaguggauuuauaagaaaacaccacaguuagaugcaugccccugcagaacuaucuuggcagaugaauucagcaacuuuuggguugacccauacagccaagucauuaccaauugugagaguuacagcaaaguggauuucaggucaauaaauauagaauguuuuacgaucacagauaugaaaaaguaaauagaauagaugucaggugcagagcagcaugccuguaaucuagcacucaggaggcugaggcaggaggaugcugaguucaagaucggccucagggagauaacaagauccggccacaaaaauaggggugugugugcccuggguuuaguuacugagacugugggugaugcuugagauaacucacaauguuaauaaugcuugagauaauuugcagaagaaauuccuccaccauguaagaacuuggacuaaaggccccuuucuauuugaggacuccaauuccagugaaaaaugugguguggcaauuuccucccaguuuuuuuuuuuuuuuuuuuuuuuuuuuuuucaggcaacgcuuuacuucaugcccuuucccccgcucuggcucacucgucccaugaugagaaggacucagccacccacaauaauguuauuaauggguauauggaucaguuucacgaagaagccaaugaaucccaugauagcaaauccuauagcuguagccauggcaaucuucuggaauucuuuucugucggguuuggugcaucuuuuaaccagccgaauugaguccuuuacaaacugccggcugggcucuacaaacugcauuaccugauccauguuuguuggauggcggauugagagcguagagacacguagcucaggagagacuuccucccaguuuaaauaaguccuuaagaaaucaagucuccuauagcaaccuauagaaagaccagcagucucaacuaacguuguucagagacugaaccaccaaccaggcagcacagaccagcugauaugaggcccccaauacauacacagcagaggacugccaggucuugacucagugagauaagauguaccuaaccauaaagaaacuugaggcuccagggaguagggaggucugguggaguggaguagagggcuagggggagcuggaacauccucuuggaaaaggggguggggggaaguaugggauguggaacagucagaggauggaccgggagggggauaaagacuggacugaaaaaaaaaaaaaaaggauugaagaauuuaaaaaauaaaauuaaauaaauaaaucaagucucacggugucuccugugcuuuagaaucaugugaggacccuaacuguaacaaugaacaccuauguagucaauauucuucauuuauuacuuuuuaugucauuuaauccucacaaaaaccauaggaauagaauucuacuucuaccucacaauaguucacagugaguauggcuuuuggaaguaauugaagggcauucuuaugcccacuagaaacuguaaugacacacaggacacacaggcaaaccuccucgugacauagccacagcuggugucauacaucacaagugaacagaaaguaccgucugcaaaacuuucaucaaaucaggucucaagcaagcaggcaaggaauauuuuuuuuuucuuggaaaaaugacuuuaaguguaauuauuauuuacaacuaagaaaacauucagacuguacugccugauuugaccauacaccuuaaacuuugaagacaaaauauauucuugacuaugacuaaagauucaguaaagcaaauuuuaaucucuggauuucaaauccuuggcauuacuaauuaagugaccuuggacgcucuagucuuucaucugugaaaugaguguuggccuccggaugagacaugcaagcaucuaccccagagucugacgccauuaguauacuacacauguaaugaagcaaguagaagagacugacuaaccuacuccacaguucacuccaaaauauuacaauuauuuccaagugccacuauguuugcuggagaagagcacaccucccuuccauuacccuguaaguuucugauggcaagcauuaacaaaauaaggugauaaccacauaaaaugugucuacuuagaaauauuuuauucaauuuuauucaauuuccuaaacacaugaaacucaagaaaaaugaagacugaaguguggacacuaugccccuccuuagaagugggaacaaaacacccuuggaaggaguuacagauacaaaguuuggagcugagaugaaaggauggaccauguagagacugccauauccagggauccaccccauaaucagcauccaaacgcugacaccauugcauacacuagcaagauuuuaucgaaaggacccagauguagcugucucuugugagacuaugcuggggccuagcaaacacagaaguggaugcucacagucaccuaauggauggaucacagggcucccaauggaggagcuagagaaaguacccaaggagcuaaagggaucugcaacccuauagguggaacaacauuaugaacuaaccaguaccccagagcucuugacucuagcugcauauguaucaaaagauggccuagucggccaucacuggaaagagaggcccauuggacacgcaaaauuuauaugccccaguacaggggaacgccagggccaaaaagggggaguggguggguaggggaguggggguggguggguaugggggacuuuugguauagcauuggaaauguaaaugaacuaaauaccuaauaaaaaauuuaaaaaaaaaagaaauauuuuauucaaaagaucaccugaacaccauuccaguaacuauuuucuuccaagacauguuauagugguuaagucagugugagauaaguaaaugcaagccugaaagguacuggugaucucugugauuuuugcagcaguugacucaaacugcccucgugaauacaucguuuuccauguaggcuccuguagaacuaccagggccauucaacacagccaguaauaaagaaacucauugcagaagaacacuguggcccaugcuuucauggcuuaaauauuuacuaacauuaaauacuugaugucuuuuuucuucuucuucuucuuuugguuuuuugagacaggauuucucuguauagccccgacuggccuugaacucagauccgccugccucugccucccaagugcugggauuaaaggcaugugccaccuuaacccuaaaacuugucaacuacuucuguuucaaagauaaaacaacugagaaaggccuauccaaaaaaaauaucauuugucucaauucgugucagugauauuaacuaaaccucucauugcuaaugaauucucuauuuuccaaaaugauuaauuuuuaaucuuugaggaacuuguuuuagcauacauccauuaucauuuuuauaaucauugauucuguugcaaauacaacuaguucacuucuaacuaaaaauuguaacuaaacuuuucuauaaucuacagguaaauaccaaaacugaugucuaaaauacauauauuaucuaguuguguuugaaaauggaagacagcacgcggaagaguuauguuuucuaagacccacugggggcagagcuucuauacauaaccacuguucugcaaugaaauauuauuccaauagugucacugucaccaaguauauguaauaguacauggcucuuuaaaucuugcccuuuuucagguauguucauuucacuguaauauaaccuuuuucuuccccccuagaggcaguauuauaauuaauugcaccaucugaucacaaccuaugagaaccuguguccaugccacaauauuuucaugcauaaguuuguaucaaacacauaaggacaucagcacaaaaggucagagcagccguucucaaccccagggcuugcaaucucuuugagggucaaaagacccuuucauagggaucaccuaagacuaccaggaaacacagauauuuaccuugcaauucauaacaguagcaaaaugacaguuauaaaguagcaacaaaaauaauuuugugguugggagucaccacaacaugaggaacuguauuaaagggucacagccuugcacuaguugaguggauaaagaugcuugcuugcucucaaaccugagaacuugaguaccacuuccugaaucugcaugauagagggagaaaacaggcucucacaaguugcccucugcuuucugaaugggguagauggcaugcacagcgugcacacacacgcacacacacacacacaccaaguaaguguaauuauuuuuauuuuuuauaaaaaguaauacaaaauauuuuuaagcaagaaaaccacuccagcuuuuaauuuuuuuuacaaguaucauuaaguugccauuaagagauguuuuaagauagaguuauguaugaugauagaugccuccaaaaauacacaagacacacugaacaaucacgacuugagaacuaaagagcuuuccuugaauuucauugagugcucuucaggcuuccugccuccuaagagauuucauuuguucaauucaacuuuuaauaguuucucaaacaugcagacaaacccugcucucucuagcucucucuaguauggugaauaaagacuuugacuuuuuuuaaugucaccuuagaaagaaccuuugagaacuaauauucgucucaccugcaacauguuaacauuaaaaggccucugcuguauuuauuccacacacgcuuucccaagccggauguuucccucagcugugucugggaaacugaaaguaaacuaaagcugcccaaccugccucaucaaguuuuacacacuccugauugacaucucagaagguucccuggcuuuguuuuugugggaucguuacccacugcugaugcuuucugcccaagaaggaagcagcaauccagggagucgguggcuuucgcaggauaacugcaagcauccaacaagcuucucauuuaaauagccaaauaguagggggugggcuuucacagcugcaaacacaaacaguaccaggcaugccgauuuccuucuagcaacaccaguacauguacaaguucugcaccacgguuuagagaaaaguagcugauugacgcauugauggaaaagcuauuuuaaaauuacuccaagagucuaaagcaucggucuaacugggaggcucuugccuccucuucacacacacggucuguuuuccugucuaauuuaagaaugaaucgcugacaccuccaggugcaauauacccugaggagagaacguacccaucacaaugcuaacgaggggugugcauaccaccaccaccaccccgagcccgcagugagugccaguucuuaccuuagcagauuagacaggggcagagguccggauccaccacccaggaucccuccuuuccugccagauaggaguuucuccaccagagccacauugccaguacgagcagcuuccagcagcuccugguccuuccccauagucucucaccgaguccgcuacagaguccuuucccugcuccagguccacuccccaaaagccagggcccuccccgccccacccuauaaggaugcccgggcuuauucccugcagccccgcgcagggagcagcacgccguccuccuucucuccgcgcagcuucuaca

SEQ ID NO: 12171 - RNA, 21813 nt, Mus musculus
ucaauaaaccauuuauuugcaaauaaauaacaucaaugccauuucuaaauaaacauuuaagaacuaauaacacacaagguacuuuauuguaaaucgggacugaagcugcccaggcugccgcacccaccgccuccuauucaaaugcugucacgugggaggaguguucuuguucuugucucugaagcuuuaacgcaacauuaauacaaagcuauccuucgcuuccucuaccuuacaguuuuauguuuucuauacuuagacgugacccuucaaucaaagggaagaggccuauuaugaaccaggagauuaaucuacauggauagacgagucaucuuagaaugaguucacuuuauccauguucugauucagucuuucugaaugggcugguuucuaaaccuagccuaaguacaggccugaaacauaggcaaccaccaggaaccacggagcugaggcaaaaaggcgcuucuaccagccucaggcuuuucaaccugggacaaacugcaacacuugugccacaccccuaugacaaaaagcugaaaaugcuggaaaauaaggcguguguuuucacuuacauaccaccagaugcaauucaugccuuuaaaacugugugugugugugugugugugugugugugugugugugugugugugugugugcgcacgcgcgcgugugugugcgugcaugcgugcauccauuugaagaucagggaacaacuuuguggaacugguucacucuuccuggggguuccaaggaucaaaugugugucaguggguguacacagcaggugccuuuacuggcugagucuucucugcagcccacaacucacacauuuuagauuacuacaguuucagaauuucaauaacuuaaauauacaauccuucacauagucuuuaacucuuuacaugaaagacacuaaauaaauuaaauguucuuauuauuaacaaaaaaaacagaaaucaaguacuucuguagcccuugaugaggaagguccaccaucaucugcaggagauggaaaggacuucucacauacacuuccaaaguccuuccaagcggagauuauuuaaaauauaaggaaaauauaaacagccaaugcaaauuacuuaaaacacaaauauaaaauaaacaagugaaauuucccuaaaaaggaagaaaauauucaccauauuuacucuccaggauaaauuauaagugaauuuuauguggacuaagacaguuuucuggcuuuaauguauaaaaauaauacccauguugucuaauuugggggucauauaguuagaaauauaaaauucuauuuuugugagcaggucagcuaguugaaguaaguuagcacaaucauuuggauuggcugucugcacacugggcagggcuuguuucuuuuuuuuagcuucuuugcacacgugaaacaugacaugagguguccagucuugccgugaacaaugcagccauuuuuaggccgccccuggcagaucacacaugguucgauggcauucagggagaagcuagauuccacacucucgucuuuguccugcguuuccuccuucaacucuuucacgcuuucuuggcugcuauaaacaaugcugcuggaagucgaugguugggaauagucgucacucuccugggacaggggcgucuguucggccuucuccucgcuguccuccucagcacauggcucuuuagcaucauucucugucagcuuuuugccaucaggcacauccaagccuucuucugccugagcugaguuuuccaguuuggcuuuuucagagauuuccacuuuaucuuuccccuuaucgucuggaagccaguucucacgaaggguccagcaucuuuugcagugugauggaaggggaggauucauuucauugcaugagguacacuuccaauaguccuucaauaaaaaagacaguaacucuucagucaguguucauagcaaggcuaauaacuucaauguggcuaagguaaaaguauaccauguagcuuaauuuucagcauuucauauuuuacauaaauaggcaaagaacaugaggaauauaucuaauacuauauaccagaaauuagcuaauagaguagacucuagguacuuuccccuacacacacacacacacacaaaaggugaccuauaugaaauagugacaggcuagagauggcucagguucugagcacacacgugguggcucacaacuaccuauaguccuaauucugaucucaacauuguguuuuauuucuuugaagaaucuauauacuuacagcuaaggaaaucucaggaucuccuucaaaagagucuguaucgcuuucuccugucugauagacugugacccgauagaccuaguaagacaaauucauuagcaucaauucaacccuucaaccaagaagccagaauucucaguaagucuuaaaacaaacagcuugagccauuaacuguggacgaagaguucugaaagaaaguuaaaugcaguucaaggcaagcaggaaacgcaggauaggaaaaccuuuacucgcaauggcaagaguuguuagauacuuaaaaccaaacaaaacacucaagaagacauuuuauaaauuuagaguuauuagacagaaaacaacuagaaauguagaguugcucccgagaaagagauacucggguccuauuggacacuguucguugcaugcuuuacauuggugaaaaacaaaucaguacugagaagggaggggcagaaguaggggcucacaccuuucaucccagcaaucaggaggcagaggcaagaggauucccaugaguuugaggccaggcuggucuagauagccaguucagggucagccagggauacacggugguacccugucucaaaaacaaauacacacacacacauacauacauaaaugggaagaccaaauggagaacuuugugguccagccauuaugagaauguucauccaucauuagcagagcagugguggcgcacaccuuuaauuccaggacuugggaagcaaaggcaggcagaucugaggccagccuggucuacaaagcaaguuccaggacagcuagggccauacagaaaaaccaagucucgccgggcgugguggcgaaggccuuuaaucccagcacuugggaggcagaggcagguggauuucugaguucgaggccagccuggucuacaaagugaguuccaggacagccacggcuacacagagaaacccugucucgaaaaaccaaaaaaaaaaaacaaaaacaaaaacaaaaacaaaaaaaaaaaaaccaagucucaaaaagcaaaacaaacaaaacaaaaacaccccaucaacucaaaaaaaguuuaaaaacauuguucaaacucuccucuaaguuuuuuauuuaguaaugugagacuauaauaaaucaagcaaagggcuggagagaugacucagagguuaagagcacugucuguucuuccaaagguccugaguucaauucccagcaaccacaugguggcuaguaaccauaucuagugcccucuucuggccugcagacauacaugcaggcagaaugcuguauacauaacaaauaaaucuaaauaaauaaaucaagcaaagaaacuauaaaauuucaccucaaauccacaaagcaauauucuaucuugaacaaaugaaaaagcaagacuuuccagagacucugaauagauggccucuucaucuuacuaaaaggcugacagacacagaaacccaccucaucauccucaucugagagcucgugcccuucgucacucaggcuguaaucuuccgaguccagagacucaacuucaaauuccacgcuaaacugaucagaaacugaauccugauccaggcaaucaccagaaugcucacuuacgccaucgucaagauccuauggaggaagaaugcagcgaauguaaaugcauugccucugggccucauuuagagcucccggguucaucccgagccacuauuuccuucucagccccagaccacauagacuggguucaagguuacuaccuuacucaaaaguccuaccucaugaaggaaaagucagagccccuuagccccgagguuacacucagaaugacugcauuaacauuuucaaauguccagcuaaacacacccuccacccuauucaauacccaugcuccagccacaucuuguuuccuaaaucaauccacacacuaacuuuuucucaguaagauaaucugaguuucuaagccccacucaucuuucuuugguuaagguucccacaauaccauaaaaagaucuuccacaaugaccuuuccuacgugugugauuauaugcacaccuacuauuaucugaagcaccacugugaguuuauccuauuaaacacaggaagacgaaggccucccugacucacaggcuagugugacggagugcuagugacgacacacaaacaccaagcuggcaucuggguuuuccgaugcagccuuaguuggccuggggccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucaugugacacuauauuggcuauuaccucagagagcucugcugucccugcuuccugagugcugagauuaaaagauucaacuucaggccaggcaugugguguaugccuuuaauccuagcauucauucaggaggcagagacuggaagaucucuguagguucaaaaccagccuggucuauacagugaguuccaggacagccaagagucagaacuaaauaagagacccugucucacaaaaaugcaaacaagagauucaacuucaaaucauacacuaaguucauccgcaaaucaacuuacuuacaacugauaaaaauacacugcucuagaauucaggacacaggcauucucaauuugcuaccaagaugcugcuuaacugcagacacaucauuucucuuccagaaaauacagucagcuugacauaaaaguagucuuuuuuuuuuaagauuaauuuauuauuauaucuaaguauacuguugcugucuucagacacaccagaagagggcaccagaucccauuauagaugguugugagccaccaugugguugcugggaguugaacucaggaccucuggaagagcagucagggcucuuaaccgcugagcuuucaaguucuagccugucuuauuaaauguaauaauuaguuguaggauccuuuaacaaauuauuugaaacacuaucaggcauaguguucccuguaaauaaaggguaaaacuacugagacuaauguucucauaaguaaguuaaaacaaagcaaaacacaguuguauuaaaagcauuuucacuuaaguuuaaaaaguaacaaauuuuuaauauggaagauuuuuagaagagcauauauauauauauauauauauauauauauauauauauauauauauauauucuguuuugacagcaggucagguucuauucuaagaaacuagauaggcagagauccgcagagagguuggcucacugacuguuggguguuggggauguaauuaacugguagaacacuugcccagugcgcacagagcccuggauuuaaucugcagcacucaaaacuagggcagagaugugguagucaacccacuuuccuggcacccacacaguggcuccaaccaucccuaaccccaguuccaggggacuccacacccuccuguggccucaaagcacugcaugcaugugguguacauucuggcagacaagacacuuccauauuaaaaaguaagauaauuucuuaaacccaagcacuaccugaugcgagggcgucucuguggacucgcugcugcugcugcuacugcugcugcugccgccgcugcacaucucccucagcucacacagacccaggcucggaucaaaggacagggaccugcggcgcuuccggugccgcuccccagguagcucaucuguguucucuucuauagauuaaaggacaugggguuaaaacucccuguacugggacugauuugagauugaaauaucuucagcaccuauuugcaacaaaauuuaauuucaauuauauuaaacagagaagugaaccauuaauguuucaaaagucagcaguguuucauuggaucuguucagcuacacauaagcucuacuucuaagcuugcaaccuucuuuguggacguuaccuccacaaguuacucauuuaauccuccuagugcuuuuacugauucaacaguacacgauuuccccaucaacaguaagcuuuaagaauaaggcugggcuggugaaacagcucagugguuaagagcagcagagcacucauacauuaaauaaauaaaguuaaaaaaaaaaagaaaaaagaaaaagacuaugcaaaggucaaccugaucuauauagaagcccugucccaaaacaaagaacaacuucaucuccuuuuauuagaagucuaggguagcagcucuuaacuuuccuaacacugugacucuuuuuuuuugguuuuucgaaacaggguuucucuguauaccccuggcuguccuggaacucacucuguagaccaggcuggccucgaacucagaaauccgccugccucugccucccaagugcuggauuaaagaugagagccaccaucgcccggcacugugacucuuuaauacaguuccucauaguggugaucccaagcauaaaacuauucucauugcuacuucauagccauaguuuugcuaaugugaugaaucauaaugcaaccaugugguuuucaguggucuuaggucucagaccucugucaaagggucauuugacccaaaauggaaacaccaagcaacuguuuaguaugucacauaaugucccuauguaccugucucacuaauggaucuccuucuagaugagguagacagucuagaaauuaaaucagaagaugaagguuucucuucugguggcgcuugcaaaggauccuaaguacauaaaagaaaguaaaauauugcaaaauaaacauuaaacauuggcuguuccacacccuguuuuauguaacccucccaauuuucaagaacuaugugucaugaagcuagagcgguggcucagagaagaagaccaugugcuguucuugcugggguguguuugguuuccaucacucaugucuggggcagcucacauccaccuguaacucagcuccaggugagcaucaccucuuucuuuuggcuggaggacauacacacacccacacuuacagacaggauauuuuaaagagaaaaguguguuagaguaagaacuuuaugcaaguauuaccuucagaucacucccaccuucaggcugacgucugcucucacucagcgaugugccagagucugaagauuguaagagaaaguaaaaaguggaucaaaacaaagaaaucaagaauucaacauauaccagucuaacacaugcccaauacaaaaucuaaccuuuuaacaacuauuaaccauuuguaucaagagucauuugcaugcuggagauauaaauucaacaggaauuaugaagcaaaauaagcaaauuuuaagauauacuagcaggggaaacaaaaauguuuaguagacgugggggaggggcucugaagagcuaucaggacagauucuggaaucgccuacgcugaaguuagcauaggacagacacuccagacugaaggauuaguaugugagaaaucaugaacacgcaaacaguuccugugacugacaccaacauaauaaacuccucuguacucaaacaguaaagugcagggucgcugugcacagagccaugcguguucagcugagucacauacaagguuauucuucucaacaguuauucaagcaguucuauaaucuugccugaggccaucuugcaacuucucacuauuaaaggguuuuaguucaagaaauaaagcuaauuuccuagcucacagaacuauucuccccagagagcaaucauaaaacuccuaaauaagaagcaacaaaccuccagguggugguggcacacgccuuuaaccucagcacuuggaaggcaaaggcagaggcaggccaauuucugaguucgaggccagcauggucuacaaagugaguuccaggacagccagggcuacacagagaaacccugucucaaaaaaacaaaaaaagaacaacaacaacaaaaaaagcaacaaaccacucugacaaaauagaauuuaaaaaacaacaaacccaccaccacucccaacugggcacggugauuuacacuacagcaaucaucuccagcaggccagccugggcaacucagugagacugucaagccauagugauucaguggaggaggccucaguuagcauguaggagguccacacgggaaggcaaacagagcacagaaacaagcaaacaguauuugaaauacaaagacaacuguguguguauguguguguguguauacucuguguguauguguauauguguguguguauagacacacacacauauacacauacauacauauauacauguaguuaaaguauuuaaguggugguuugaauaugcuuggcccaggguguggccuggcuagaggaggugugaccugguuggaagaggugugucucugugggcgugggcucuaaggcucccuugcucaggccccgcccaauguggaagaaaccugccucuuacuugccuuccaccuuuggauaaggguauagaacucucagcuccuccagcaccacaucugccugcaugcugccaugcuuacugccuugaggauaauggacuaauccucugaaguauuaagucaagccccaacuaaauguuuuucuuaauaacaggaguugccuuggucauguugucucuucacagcaaugcaaacccuaacuaagacaaucaacuugagaaaaauuaagacauaaaaacugguuaagacuagaugucuguaaggaaaaggaagugaucccaagagucuaacuagaugaagaaugugugguaccacucaccaagagaggugagggaggugaacgauuuagcuuggaaaaaauaaugaauuuaaaagaguuauguagauagacagguguaguuuguacuuaguuucacagaccaagcucucaaaacauccaaguuccagaacuggaauggacaaaauuacucaaaaaucacaauccauacccuagacuaccgccuaaagcacauccaucaaccgugagaccacagcugggcacugccgagcuccucaaacacugggugaccgcagugaacuguccuguauuauggcauaauacaaacuuuaaagggaauacauagauaggcuaugcuaccugggaacucugucuugggcuguguauaguuauaaaacagauguaauaaaguaacgggagugacaggcucaccuaggauuuucaaaauuacuuuuaacuaaacugaaacacagcaucaagagaaaucgucaguaaucugucaaaguuuauuaagugagugacuacuagagaaaauguaaaauacuaucagauuccauaacuguauagcaugacauaaagagccuuagcaggucccaguaaccucagcaucaugaggcagaagccgaaaaccacaggucucaguuaccaaacuaauuacuuuguucuuuuuuuagggaggauccuggugccauuuacaacacacuguacacacaacacagugacuucugaauauagaagggaauagugggaucgcaagagaaugguugauucagucuagaaaccaagcaagcuucugaacacaguagcuauguucaaggguaacgguaaggauuacgggguuucagagcccacagcuacuaguauucaaauacaacuaauaggagacauggcgguauguaagucuagaaggcagaggcagguggauggaucucugggaguuaaaggucugccugaucuacauaaugaguucuagcccaaccauagcuaauagugagagccugucuuuaaaaagagaaacucuuucuuuaaaaaaaaaaaaaaaaauagccgggcaugguggcgcaugccuuuaaucccagcucuugggaggcagaggcaggcagacuucugaguucgaggcaagccuggucuaaacagugaguuccaggacagccagggcuauacagagaaacccugucucaaaaaaccauaauaauaauaauaaaacacuauccacauguacacacuuauagaaugaaaaucaagugccuuuacuagguucucaaaaagguugcaucccaaaaauaaccaauucucucaguaaguagcucaacaucagaguugaugcuugugaagcacacacaaggaccugugcucaagucacuaaaaaagaacugccaaggagagcuaaaaugaugcuuaccuaaaaaugcuaaguguccacucaagaaacaagagcaagaauacaaaggggggcaagagaagagaagagaugaaaccccacucuuucacgguccuaccuagguauuauauuacuuccugaaacaucucaacgcauucugagguuugaucacgcuucuacuaagcagcuuuuaacauuaccuguccuucagaagaaacccugauaacccagggucgugacagagauuaacaagacauccaauuugacuucccaaugcacaucauggcauaaggaugcucuuaaacacgaauaaauguacuuucuuuuacuuuuaaggagaaucauggggcuggauuacucuuaguuccuagauaccacagcucaaaacucccuaacuccagcucuagggaagcugacacuccuggccucuaagaucaguugcacucaugugcacauauucacauaaagggacgcacacauaauuaaaacuugcuuuuugccuuuuugagacagggucucuuuauguaaacuuggcuggacaaguccauccgcccauuugcugagauuaaaugucuguguaaccacaccaggcaguauaauuauuuuuuccaaagaggggcuggagagaugacucuggugcuuaagagcacuugaaggucuuccagagguggcaauagucuaauuccaguccuaggagauucaaugcuccuccucugaccuugcugggcacugcacacgcguggugcacauguauacaugcauacagcaggacagaaaaaacacccauacaaauaaagugaaaugaaagaagucacuuuaauuuuuuaagagagaaugagaugagucaaagccuggcuggggcagcuaacuaguacaguacuuucuaaacgcaagggugugugagccuaaguucaacucucagcagugcugaauaaaugaacaaacgucagcuacuuggggagcaggaagccuggguuccaaaugagccuggauaauuuauggggaucuggucucaaaacaacaaaaaaguagaggcugggaacacagcuucaugguuaagagcccuggcuacucuaccagaaguucuggcuucaauucccagcccacacagcagucguuaacugucuguaacaaguucuaggagaccugaugggcucuucuguccuccaaaggcacugcacacagaugguacacagacagacaugcaggcaaaacacuaauacacccaaaaauaauuauuaaaaaaaaauugguaggcaaugaaagaguuaaaaauaauaaagagagccagaagcaaacacaaaugaaagcagcacacagugauauuuugccuuuuuagagugcuaaggguuaaagccagaacugcacucuaugaagaaguauacauccaagucuuuaaaacaugaaguauacaucuguacuggcuaguuuugugucaacuugacacagcuggaguuaucacagagaaaggagcuucaguugaggaaaugccuccaugagauacaacuguaaggcauuuucucaauauagugaucaagagggaaaggccccuuguggguggugccaucccugggcugguagucuuaguucuuuaagagagcaggcugagcaagccaggggaagcaagucaguaaagaacaucccuccauggccucugcaucagcuccugcuuucugacuugcuugaguuccaguccugcauccuuugguggucaacagcaguauggaaguguaagccgaauaaacccuuuccuucccaauuugcuucuuggucaugauguuugugcaggaauagaaacccugacuaagacaacauccaagucuuuaaaacaugauuaggggacugguaagauguuucaggaggucaaagugccugccacacacgccuacagaucugagcuggauaccagaacccauguaaaaaguagaccaauuccgccaagcuguuuuuugacuuccagguauacaccauguaucuaucccacccuacacagacauacagauacauacacaacaaaaagcuacucaaagguuugugguuuuuuuuuuuuuuuuaaggcucaaggguccguagcuacauaguuuaagguuagacuaggauacauaagaucuuacaugaaaaagaacuguuauuaaguuauacuauguuuauaauauucaaaauuaccuaccuugcugacuuacagccacuaaauuucuguagaucauugcauauauuuuccuuguaagaaaagaaaaaaaaaaaaaaaacaacaugugaguagagagccuacagcugagagaugucagauccauuuacacacccacagacuaacgacucgaccugucucaaaagaggucaagccugguaaccugcauucaauccccaguacccacaugguggaaggacaagcugacuccugacugccacacacucacaguggcauaugcacauacacacacacacaaucaaaacuaagauuccagaguucagguucccacacaauaugcuacgacuacuguuaaucgcaguagggccucaaaaaaugacacccaauguuagcauuuuguauccauggucaguuccucucugacagaggugagaaacagugaccgcccagcugguacuucuuuaagauguuuuuuauguuuaccugcauguaugucugugugagggcaccagauccuauagaacuggcaguaccaacaguuguaagcugccaugggggcgcugggaauugaaccuggguccucuuaaccacugagcaucucuccagccccaugcacagccgcucgcuguucuuauaacccaccacgcacaaggcuuaccugugcuccuucacagagaaacucgggacuccaaacacaucuccuaggagaucauuugaacaauacacaaugugcugcugcuucucgucauauaaccucuuagucauaauauacuggccaauauaaaauauaaucugaaacacaaauaugguuucuaaguacuaaggaaaucacauagaauauauacauuauacauucagcaauaccacacuuaacugaacaaguuacacuuuacacuaacagccacacccauaaucauguacaagaccaaacaguuguauuguagaagcuucuuuuaaauacuuccacacugaugaaaauagaaguaacuguuucuccacauuacuuaaauguauuuucuguuuuucuuuuuuucuuauaaauuuuaauuuuucccagaaacuuagauacuaacauaugauacuaggaaagaaaaaagagguuuaaaaaaaaggggggggggggacacuggagagauggcccagugguuaagaacacugauugcucuuccaaagguugugaguucaaaucccagcaaccacaugguggcucuguaaugagaucugaugcccucuucuggggugucugaagauaacuacaguguacuuacauguaauaaauaaauaaaucuuaaaaaaaaauugaauaaaaaaaaagaguaagguaaaauacagcaauguauuagaauagugacaugucacaaacguauacuucuacagcucugaggucaucacagaggaagacaggacaucaugaguaacaucucccaauggaauauucucaguuauuaauauagucuucaccaaacaguccagggcccgaaccaucacuauuauuauauuccaugugcuccauuauggcagcuuaagcaacauacuuugucauuccaaaacgagcccaucaacaauguaacucuagacagcauuuuacagugcacagguuugucaguacagucucaccauccugacaccccagggaacuguuauuccuguaugaaaacaaggucacgagugucguucaguagguaaaaugugcucccuugaucugacacccaguaccacaggggggaaaauaaaaacauaaacagagaugagaaacuaacccaggacaugacaccuaucccagcguacugucuaccacacuagcucacuacauucucaaguguccuagaauaaagaucuuguaacugaaaacugguaucagacacuauaaacaaucuguaagucccacccccacagauccauuugacugugggucuaauaauauuccuggcauccauccugaauguagaaauguuuuuccuugucacuauuccuuaaagaauacaguauaacaacuacacacauuguguauuacagauacucuagggauaacuuaaugucuaagaggugauguccauacagagacaguuucacgguuuaaguaagagacuuggcaggcaguguccugaagccaacuccccgcagagagcaggaggacagcugaccuacugcacacagcuuagcauaagcacuaaaucuuuuugauggccuucaucgauuuucucauaucuaccuacuacuaaauccauacuuguuuaucauuugucuaaccuuuauaaaggucaauccaaaguuaaugaccuuaaaaacaucacuuaacacuuaaagagacuuuaacuagcuaaguaggagccaaucaaucugaaaggcaauuuuuacaugucuauagaucacaaaguauugacagucagugggacagaaaggacacuuggguuccuccaacaaaguguucuuugagacguuuccaaauguguagcugagaagaagccccuaaccugccacaagaacuugaguguuuuaaguaaacaagccuuaaccuaagugagccagagaaacacuuauaucucagccaugcaaaacuucugucuacaacugaccaaccucuagcugaaaacaauacuuuacuaauaaacguuaaggcagagaauacaacauugugucuaugaaucagcccacugagcaucccaacaguuguauaaguucuuuuuucuuuuucuuucuuuuuccuuucuuucuuuuuuucuuuuucuucuuuuuuuuuuuuuuuuuuuuuuuugagacaggguuucucuguguagcccuggcugcucuggaacucacucuguagaccaggcuggccuugaacucagaaaucggccugccucugccuccccagugcugggaucaaaggcgugcgccaccacugcccagcaguuguacaaguucuaagcugggauccagggaugcccaagaaguccuuggauaaaauugagggaauccgcugggcagugguggcacacgccuucaaucucagacuugggagguggagacaggcagauuucugaguucaaggccagccuggucugcagagugaguuccagggcagccagggccacacagagaaacccugucucagaaagagaaaaagagaaaagagaacucaggaggcagaggcagguggaucucucuugagucugaggccagcuggucuacauagugaguuccaggacagucaggacuacauaguaaaacuuugucucaggggcuagugauggcucugguuaagaguacugauugcucuucugaaggucuuggguucaaaucccagcaaccacaugguagcucgcaaccaucuguaaugagaucugaugcccucuucuggagugucugaagacagguacaguguacucacauauaauaaauaaauacaucuuuuuaaaaaaaagaccuugucucaaagaaaggaaaggaggaagaaauucauguaaauuagaauuuuuagcuucaaauuacaguucaaaugaucacaaaacuuaauguccuugcucauuacaaaaucuguauggccaaucucacucaaacuugaaaaaccaccacagaugccuguauguaaccaugaagccaucggcucuccaccccucaguucugcucaccucuuucauaguguaagugucguuuugcgcuccaacggacuuuaacaacuucaaaagcaaugguuuuggucuaaccuguaaaagaaaagaaaaagagcugauguuacaccaugaacauacucuacagcacaagcccuuuauguauggccagaaagaagcccaauacaggcagcaaacgccgugcuuauaacaauuuguuaccgagcugcacuucagaaaguuggguuuuacacuaaguacaagugcacaccacuaagcguuaggacagaaaaugcuuugggaaaagcuacuaugaaauuaucaugaagucaucaaauccuggugucaugucaaauaaucaaacucaauuuguucugaucaaaacgguaucaagaugcuggagagauggcugagagauuaaaagcacuugcugcuuugcaggggacccaauucuagauuccuagggccaccaaaaggcagcuaccaacauccuaggcaauccaacauccacuguagucucugcaggcaggagcuacaaauacacacacacacacacacacacacacaggggagugugugagugagcacugacuccuuccuacagcuccaucaucugcuugccaccacacaaccuagcugagauccagucucuuacuauacuguacaaauccgucagucuacugaaagggagcuuauagaauguaggagaauagacuauaucuuagggcaaaaccuaucaccaaucuaucauauaccacauuccugacugcuaaagaaaccaaagucacaagguaaugaacaauucaaagaguacaaucacagcccucagcuacaacucauuguuuucuuuauaugugguuuaugcaucauuuauuuaucacuuaaaauacaugcaaaggcuagauauucucucucucucucucucucucucucucucucucacacacacacacacacacacacacacacacacacacacacucacuaaugacaaaugaucuuuaaagagcaugccaguaauaucagaagagccagaaaguguuuuuucuaugucuagccaacuuaaaagcaaaaguacuacauaaacuauaagaguaaauauauaacauuaagcuuuauuuauaaaaacaaguagccagcuacaauuugacucuaauccagcuuucccaguagugagacaauaguugauggggcugaggcuuagagguuaagaccacuuguugcucuuauagagacccugaauuuaguucucagaaccuauaugauagaucaaaacuaucuaacucugguuccaagggauccgacacccucuucugguuucuauagccaccagacauccacaugguacacauauacacaugcaggcaaaacauuccuauauauaaaauaagaaaugaauccuuaaaaagauaaaaacuggacaacugucaccuaccuaacaaggugucacccacaaagcagcuagugagcccagccuggcagccugacaacggauaccaaggaacaccaugauaaaugucccugagcuugcucuagccacgucagucugauaucaaaguauguuaccaucggccacagauacucuaaagacacuccugcacgucagcuuugaugaucaaggcuccuguucacucguguucuauagcuaguggaugcccagcacggagagccugcuggcuuucugucuguuccaugcauaugcauguuuugccugcauguacuuccaugcaccacuugugucccugguccccagggauaccacaacagugcuggaccccuggaauuggaguuccagauggcuaggagccaccauguggguacugagaguggaagccagguccucugaagagcagucgugcucccuccuggcugcuuggccggcugucucugucaggacaguuauuuuguauggcucuauuguugcaauggcugcagaucucacugugccaggccucugucuacauggcuagaauguggccucauggcagaguacugaggacaaauaggacuaaccacuaccuuuaaaggcauuuaguuuauuuuuaaaauacuauuaagugcuucaaggacaguaaguacacugagcugacuaagcugagagaguguuuagaaacugggaaggaaggcauguaacaugacuaugcucucuguaucugcaaacucagcuguuuuaguuugagauaaccacacagaccaccacuucuguggauuuuuuugguaauuugaagacuuuuauuauuauuuuauguauacugguauuucaccugauguauuuaagugcaccgugugcaaacaguguccuuggaggccaaaagaggccaucagauccucugcaacuagaguuacaagagggcugagccaccuuauccauucuggggauccaaccuggguccucuguaacaacagcaaaugcacuuaacugcugagcccucucuccagcaccacucuuuucuuuuucuuuuuuuaaagacuacuuuuagcacaauuuuaaaaugcacuuuucaguuauuuauuccagaagagcacacaaacugguuauccaauaccaaaaggucagcccugaaaacauacauacacaaauggcauuauucagacugagcaggcuguaucugggaacguagcauguacugggcauguaacaauuaaugaaaaaagucaugaaagagagaagggguauacuggaggcuuuggaagaaggaaaaggaaaggagaaaugguauaauuucaaaaauaaagaaaaaaguuuuaaagacucuguuauuuauguauucuguguaugagugcucugucugcguguacaccugcacaccagaagagggagggcaucagacaguugugagccaccauguaguugcugggaguugaacucagaaccucuggaagagcagucagugcucuuaaccucugagccaucucuccagccuauagaaaucaguuuuuuaaaaaaggguauuaagaccuuauuuucagauuaaguaauucacucuuacaagauuugaaaaagacuuuuuguuucuuuguuuuuucuagacaggguuucucuguguagccuuggcuguccuggaacucacuuuguagaccaggcuggccucgaacucagagaucugccugccucugccucccaagugcugggauuaaaggcaugcgccaccacgcccagcugaaaaagacuuacuaaugcuuaauuuucuuauguaacucauauagaagucaugcuagccuucuccuuaguguaucaauuuuaacauacguacugccaaagcaagaaguucuacauuuuugcauauuaaauuaacucaaaucaaaacucuacaauggaaagccaguuucuuaucaaagcuuacaagauaaaguuaauuuuaaaaacuacuauaaaaacacaacacuguaaucucacacuuaacaaagagaguucugaauaaagaucuacccggaaaagguuuuuaaaaugcuauaugaaaauacuuuaaauaugugcauaaucuugaaauggaagaauuccuccaaagcauuacaagaaaauucaaaaauuaucaaaauaaacaaauuugauaccuucaauggggcagacaucagauuauaguccuuguaaaaaaaaauuucuuagguuaacuauacuugaaaauuaugcaagcuacuaaaauaugcaaaaaaaaaaaaugggggaggaaaggaagagcgagaguaaauagagagagacauuggcaaacccagaacaaacaggcuguuuaacuggagaucugggacaugcccacugaaacaauacauuuuacuccacagagcaguaaccguaggaacugacuuaacuugcauacauguauucuccacaaauauguaugaaauuacaucagaaagggaaaacgagggcuggcaauauucgugcuggcaggaucgaagacggccaugaccucugcugagcagagugagcagucugcaaucaaaugugguuaccaggacguaggauucuaguucccuaucuuccucacccuuacuuuacucaaacacaugggcaacuuuuacaucccccaguagucgugagccugagacugucgcucagcucaguaguacaguacuugcauacacacacauucuaaaggcugagguucaaucgcauuaucaaauccuaugcagcuauuaaaaguaauuuuguaacuuacugacaagcuguagaacaccuuuauaugcuaauauaaaguagaaaacuuaaagagauacagagcaaagacuggaacuuuauauauuuuaugcauuccucucauaacuaaaauccucacaaaaagcacggaugcuucuaugacuuucgguuuaccauuuagaacagugauagaacaucaugucacaaccagcagcacccacacacugugcacuucuaaagccugcgucaggggaagggcuguggaaauauaggucgcagugaccacucucuaaugcaauugcaaucgagaaaguuaagaguuuguagguaaauacuuaaaacgacugugcgauaauccagguuucaauuuuguuuccucgauuaccugguaaaacaagcuauauuuacacacucgaggcagaaauaccaaccagagucucuuguuccgaagcuggaaucugugaggugcuugcagcacccucgguagacacagacauguugguauugcacauuggccuacaaguagaaaaaaaacaacaacacacacgauaaaaacuugaaauuauaaaacaucuacgaaaagggacaaauagauacaugcauuuacgaaggagacagaaaacgucuuucggcaauagcucucaaaugcaaaacgacgucggcgagcugucccuuaccuggaggcccgcaggagaagcgcggugauccgagagggucccccagggguguccggucggucucccgcucgcccagcagacggcugcggaaacggggcagcguuuaaauaaccccagcuggagacaugucaggacuuagcuccuccgacagccgacgccggacgugucccaacuugaccagccccacaggaagagcugagucaacucggcccagcccagucccacccgucccggaagccgcaucccggcgaguccgggaccaggcaccugucaccuccuggaccccagcaacgagcccagcgcgaccccggagcgggccccccgcgcgcggggccugcugggagacccccgcucuucccuccucccccucccuccguccccucccgcgcaugcgccgugcuaaccgcgccaucucccaccccaccccccacucccacccacacgcacacccccggccgcagaaugacaucagggcccagcgcgggcaaacggucgcccagccucgugccccgcgaccccacgagccggcccggguuacgaguaggccccggagggcgcggaaaagagggaaugaucgggacucuccgccgcccacggagcggguaccugcuacuucccgcgcaucuuccgacccuucacggggagcgcggaggccccgcggccggggccugagcgaccauggucgcuccagagcucgagcgacgagaaggcggcggcuccucaccggccgcuccuaggcuacgcuggccccggaggccccguuaacaaagc

SEQ ID NO: 12172 - RNA, 21813 nt, Mus musculus
gcuuuguuaacggggccuccggggccagcguagccuaggagcggccggugaggagccgccgccuucucgucgcucgagcucuggagcgaccauggucgcucaggccccggccgcggggccuccgcgcuccccgugaagggucggaagaugcgcgggaaguagcagguacccgcuccgugggcggcggagagucccgaucauucccucuuuuccgcgcccuccggggccuacucguaacccgggccggcucguggggucgcggggcacgaggcugggcgaccguuugcccgcgcugggcccugaugucauucugcggccgggggugugcgugugggugggagugggggguggggugggagauggcgcgguuagcacggcgcaugcgcgggaggggacggagggagggggaggagggaagagcgggggucucccagcaggccccgcgcgcggggggcccgcuccggggucgcgcugggcucguugcugggguccaggaggugacaggugccuggucccggacucgccgggaugcggcuuccgggacgggugggacugggcugggccgaguugacucagcucuuccuguggggcuggucaaguugggacacguccggcgucggcugucggaggagcuaaguccugacaugucuccagcugggguuauuuaaacgcugccccguuuccgcagccgucugcugggcgagcgggagaccgaccggacaccccugggggacccucucggaucaccgcgcuucuccugcgggccuccagguaagggacagcucgccgacgucguuuugcauuugagagcuauugccgaaagacguuuucugucuccuucguaaaugcauguaucuauuugucccuuuucguagauguuuuauaauuucaaguuuuuaucguguguguuguuguuuuuuuucuacuuguaggccaaugugcaauaccaacaugucugugucuaccgagggugcugcaagcaccucacagauuccagcuucggaacaagagacucugguugguauuucugccucgaguguguaaauauagcuuguuuuaccagguaaucgaggaaacaaaauugaaaccuggauuaucgcacagucguuuuaaguauuuaccuacaaacucuuaacuuucucgauugcaauugcauuagagaguggucacugcgaccuauauuuccacagcccuuccccugacgcaggcuuuagaagugcacagugugugggugcugcugguugugacaugauguucuaucacuguucuaaaugguaaaccgaaagucauagaagcauccgugcuuuuugugaggauuuuaguuaugagaggaaugcauaaaauauauaaaguuccagucuuugcucuguaucucuuuaaguuuucuacuuuauauuagcauauaaagguguucuacagcuugucaguaaguuacaaaauuacuuuuaauagcugcauaggauuugauaaugcgauugaaccucagccuuuagaauguguguguaugcaaguacuguacuacugagcugagcgacagucucaggcucacgacuacugggggauguaaaaguugcccauguguuugaguaaaguaagggugaggaagauagggaacuagaauccuacguccugguaaccacauuugauugcagacugcucacucugcucagcagaggucauggccgucuucgauccugccagcacgaauauugccagcccucguuuucccuuucugauguaauuucauacauauuuguggagaauacauguaugcaaguuaagucaguuccuacgguuacugcucuguggaguaaaauguauuguuucagugggcaugucccagaucuccaguuaaacagccuguuuguucuggguuugccaaugucucucucuauuuacucucgcucuuccuuuccucccccauuuuuuuuuuuugcauauuuuaguagcuugcauaauuuucaaguauaguuaaccuaagaaauuuuuuuuuacaaggacuauaaucugaugucugccccauugaagguaucaaauuuguuuauuuugauaauuuuugaauuuucuuguaaugcuuuggaggaauucuuccauuucaagauuaugcacauauuuaaaguauuuucauauagcauuuuaaaaaccuuuuccggguagaucuuuauucagaacucucuuuguuaagugugagauuacaguguuguguuuuuauaguaguuuuuaaaauuaacuuuaucuuguaagcuuugauaagaaacuggcuuuccauuguagaguuuugauuugaguuaauuuaauaugcaaaaauguagaacuucuugcuuuggcaguacguauguuaaaauugauacacuaaggagaaggcuagcaugacuucuauaugaguuacauaagaaaauuaagcauuaguaagucuuuuucagcugggcgugguggcgcaugccuuuaaucccagcacuugggaggcagaggcaggcagaucucugaguucgaggccagccuggucuacaaagugaguuccaggacagccaaggcuacacagagaaacccugucuagaaaaaacaaagaaacaaaaagucuuuuucaaaucuuguaagagugaauuacuuaaucugaaaauaaggucuuaauacccuuuuuuaaaaaacugauuucuauaggcuggagagauggcucagagguuaagagcacugacugcucuuccagagguucugaguucaacucccagcaacuacaugguggcucacaacugucugaugcccucccucuucuggugugcagguguacacgcagacagagcacucauacacagaauacauaaauaacagagucuuuaaaacuuuuuucuuuauuuuugaaauuauaccauuucuccuuuccuuuuccuucuuccaaagccuccaguauaccccuucucucuuucaugacuuuuuucauuaauuguuacaugcccaguacaugcuacguucccagauacagccugcucagucugaauaaugccauuuguguauguauguuuucagggcugaccuuuugguauuggauaaccaguuugugugcucuucuggaauaaauaacugaaaagugcauuuuaaaauugugcuaaaaguagucuuuaaaaaaagaaaaagaaaagaguggugcuggagagagggcucagcaguuaagugcauuugcuguuguuacagaggacccagguuggauccccagaauggauaagguggcucagcccucuuguaacucuaguugcagaggaucugauggccucuuuuggccuccaaggacacuguuugcacacggugcacuuaaauacaucaggugaaauaccaguauacauaaaauaauaauaaaagucuucaaauuaccaaaaaaauccacagaagugguggucugugugguuaucucaaacuaaaacagcugaguuugcagauacagagagcauagucauguuacaugccuuccuucccaguuucuaaacacucucucagcuuagucagcucaguguacuuacuguccuugaagcacuuaauaguauuuuaaaaauaaacuaaaugccuuuaaagguagugguuaguccuauuuguccucaguacucugccaugaggccacauucuagccauguagacagaggccuggcacagugagaucugcagccauugcaacaauagagccauacaaaauaacuguccugacagagacagccggccaagcagccaggagggagcacgacugcucuucagaggaccuggcuuccacucucaguacccacaugguggcuccuagccaucuggaacuccaauuccagggguccagcacuguugugguaucccuggggaccagggacacaaguggugcauggaaguacaugcaggcaaaacaugcauaugcauggaacagacagaaagccagcaggcucuccgugcugggcauccacuagcuauagaacacgagugaacaggagccuugaucaucaaagcugacgugcaggagugucuuuagaguaucuguggccgaugguaacauacuuugauaucagacugacguggcuagagcaagcucagggacauuuaucaugguguuccuugguauccguugucaggcugccaggcugggcucacuagcugcuuugugggugacaccuuguuagguaggugacaguuguccaguuuuuaucuuuuuaaggauucauuucuuauuuuauauauaggaauguuuugccugcauguguauauguguaccauguggaugucugguggcuauagaaaccagaagagggugucggaucccuuggaaccagaguuagauaguuuugaucuaucauauagguucugagaacuaaauucagggucucuauaagagcaacaaguggucuuaaccucuaagccucagccccaucaacuauugucucacuacugggaaagcuggauuagagucaaauuguagcuggcuacuuguuuuuauaaauaaagcuuaauguuauauauuuacucuuauaguuuauguaguacuuuugcuuuuaaguuggcuagacauagaaaaaacacuuucuggcucuucugauauuacuggcaugcucuuuaaagaucauuugucauuagugagugugugugugugugugugugugugugugugugugugugugagagagagagagagagagagagagagagagagaauaucuagccuuugcauguauuuuaagugauaaauaaaugaugcauaaaccacauauaaagaaaacaaugaguuguagcugagggcugugauuguacucuuugaauuguucauuaccuugugacuuugguuucuuuagcagucaggaaugugguauaugauagauuggugauagguuuugcccuaagauauagucuauucuccuacauucuauaagcucccuuucaguagacugacggauuuguacaguauaguaagagacuggaucucagcuagguugugugguggcaagcagaugauggagcuguaggaaggagucagugcucacucacacacuccccuguguguguguguguguguguguguguauuuguagcuccugccugcagagacuacaguggauguuggauugccuaggauguugguagcugccuuuugguggcccuaggaaucuagaauuggguccccugcaaagcagcaagugcuuuuaaucucucagccaucucuccagcaucuugauaccguuuugaucagaacaaauugaguuugauuauuugacaugacaccaggauuugaugacuucaugauaauuucauaguagcuuuucccaaagcauuuucuguccuaacgcuuaguggugugcacuuguacuuaguguaaaacccaacuuucugaagugcagcucgguaacaaauuguuauaagcacggcguuugcugccuguauugggcuucuuucuggccauacauaaagggcuugugcuguagaguauguucaugguguaacaucagcucuuuuucuuuucuuuuacagguuagaccaaaaccauugcuuuugaaguuguuaaaguccguuggagcgcaaaacgacacuuacacuaugaaagaggugagcagaacugagggguggagagccgauggcuucaugguuacauacaggcaucuguggugguuuuucaaguuugagugagauuggccauacagauuuuguaaugagcaaggacauuaaguuuugugaucauuugaacuguaauuugaagcuaaaaauucuaauuuacaugaauuucuuccuccuuuccuuucuuugagacaaggucuuuuuuuuaaaaagauguauuuauuuauuauaugugaguacacuguaccugucuucagacacuccagaagagggcaucagaucucauuacagaugguugcgagcuaccaugugguugcugggauuugaacccaagaccuucagaagagcaaucaguacucuuaaccagagccaucacuagccccugagacaaaguuuuacuauguaguccugacuguccuggaacucacuauguagaccagcuggccucagacucaagagagauccaccugccucugccuccugaguucucuuuucucuuuuucucuuucugagacaggguuucucuguguggcccuggcugcccuggaacucacucugcagaccaggcuggccuugaacucagaaaucugccugucuccaccucccaagucugagauugaaggcgugugccaccacugcccagcggauucccucaauuuuauccaaggacuucuugggcaucccuggaucccagcuuagaacuuguacaacugcugggcagugguggcgcacgccuuugaucccagcacuggggaggcagaggcaggccgauuucugaguucaaggccagccuggucuacagagugaguuccagagcagccagggcuacacagagaaacccugucucaaaaaaaaaaaaaaaaaaaaaaaagaagaaaaagaaaaaaagaaagaaaggaaaaagaaagaaaaagaaaaaagaacuuauacaacuguugggaugcucagugggcugauucauagacacaauguuguauucucugccuuaacguuuauuaguaaaguauuguuuucagcuagagguuggucaguuguagacagaaguuuugcauggcugagauauaaguguuucucuggcucacuuagguuaaggcuuguuuacuuaaaacacucaaguucuuguggcagguuaggggcuucuucucagcuacacauuuggaaacgucucaaagaacacuuuguuggaggaacccaaguguccuuucugucccacugacugucaauacuuugugaucuauagacauguaaaaauugccuuucagauugauuggcuccuacuuagcuaguuaaagucucuuuaaguguuaagugauguuuuuaaggucauuaacuuuggauugaccuuuauaaagguuagacaaaugauaaacaaguauggauuuaguaguagguagauaugagaaaaucgaugaaggccaucaaaaagauuuagugcuuaugcuaagcugugugcaguaggucagcuguccuccugcucucugcggggaguuggcuucaggacacugccugccaagucucuuacuuaaaccgugaaacugucucuguauggacaucaccucuuagacauuaaguuaucccuagaguaucuguaauacacaauguguguaguuguuauacuguauucuuuaaggaauagugacaaggaaaaacauuucuacauucaggauggaugccaggaauauuauuagacccacagucaaauggaucugugggggugggacuuacagauuguuuauagugucugauaccaguuuucaguuacaagaucuuuauucuaggacacuugagaauguagugagcuagugugguagacaguacgcugggauaggugucauguccuggguuaguuucucaucucuguuuauguuuuuauuuuccccccugugguacugggugucagaucaagggagcacauuuuaccuacugaacgacacucgugaccuuguuuucauacaggaauaacaguucccuggggugucaggauggugagacuguacugacaaaccugugcacuguaaaaugcugucuagaguuacauuguugaugggcucguuuuggaaugacaaaguauguugcuuaagcugccauaauggagcacauggaauauaauaauagugaugguucgggcccuggacuguuuggugaagacuauauuaauaacugagaauauuccauugggagauguuacucaugauguccugucuuccucugugaugaccucagagcuguagaaguauacguuugugacaugucacuauucuaauacauugcuguauuuuaccuuacucuuuuuuuuuauucaauuuuuuuuuaagauuuauuuauuuauuacauguaaguacacuguaguuaucuucagacaccccagaagagggcaucagaucucauuacagagccaccaugugguugcugggauuugaacucacaaccuuuggaagagcaaucaguguucuuaaccacugggccaucucuccaguguccccccccccccuuuuuuuuaaaccucuuuuuucuuuccuaguaucauauguuaguaucuaaguuucugggaaaaauuaaaauuuauaagaaaaaaagaaaaacagaaaauacauuuaaguaauguggagaaacaguuacuucuauuuucaucaguguggaaguauuuaaaagaagcuucuacaauacaacuguuuggucuuguacaugauuauggguguggcuguuaguguaaaguguaacuuguucaguuaagugugguauugcugaauguauaauguauauauucuaugugauuuccuuaguacuuagaaaccauauuuguguuucagauuauauuuuauauuggccaguauauuaugacuaagagguuauaugacgagaagcagcagcacauuguguauuguucaaaugaucuccuaggagauguguuuggagucccgaguuucucugugaaggagcacagguaagccuugugcgugguggguuauaagaacagcgagcggcugugcauggggcuggagagaugcucagugguuaagaggacccagguucaauucccagcgcccccauggcagcuuacaacuguugguacugccaguucuauaggaucuggugcccucacacagacauacaugcagguaaacauaaaaaacaucuuaaagaaguaccagcugggcggucacuguuucucaccucugucagagaggaacugaccauggauacaaaaugcuaacauugggugucauuuuuugaggcccuacugcgauuaacaguagucguagcauauugugugggaaccugaacucuggaaucuuaguuuugauuguguguguguguaugugcauaugccacugugaguguguggcagucaggagucagcuuguccuuccaccauguggguacuggggauugaaugcagguuaccaggcuugaccucuuuugagacaggucgagucguuagucuguggguguguaaauggaucugacaucucucagcuguaggcucucuacucacauguuguuuuuuuuuuuuuuuucuuuucuuacaaggaaaauauaugcaaugaucuacagaaauuuaguggcuguaagucagcaagguagguaauuuugaauauuauaaacauaguauaacuuaauaacaguucuuuuucauguaagaucuuauguauccuagucuaaccuuaaacuauguagcuacggacccuugagccuuaaaaaaaaaaaaaaaaccacaaaccuuugaguagcuuuuuguuguguauguaucuguaugucuguguagggugggauagauacaugguguauaccuggaagucaaaaaacagcuuggcggaauuggucuacuuuuuacauggguucugguauccagcucagaucuguaggcguguguggcaggcacuuugaccuccugaaacaucuuaccaguccccuaaucauguuuuaaagacuuggauguugucuuagucaggguuucuauuccugcacaaacaucaugaccaagaagcaaauugggaaggaaaggguuuauucggcuuacacuuccauacugcuguugaccaccaaaggaugcaggacuggaacucaagcaagucagaaagcaggagcugaugcagaggccauggagggauguucuuuacugacuugcuuccccuggcuugcucagccugcucucuuaaagaacuaagacuaccagcccagggauggcaccacccacaaggggccuuucccucuugaucacuauauugagaaaaugccuuacaguuguaucucauggaggcauuuccucaacugaagcuccuuucucugugauaacuccagcugugucaaguugacacaaaacuagccaguacagauguauacuucauguuuuaaagacuuggauguauacuucuucauagagugcaguucuggcuuuaacccuuagcacucuaaaaaggcaaaauaucacugugugcugcuuucauuuguguuugcuucuggcucucuuuauuauuuuuaacucuuucauugccuaccaauuuuuuuuuaauaauuauuuuuggguguauuaguguuuugccugcaugucugucuguguaccaucugugugcagugccuuuggaggacagaagagcccaucaggucuccuagaacuuguuacagacaguuaacgacugcugugugggcugggaauugaagccagaacuucugguagaguagccagggcucuuaaccaugaagcuguguucccagccucuacuuuuuuguuguuuugagaccagauccccauaaauuauccaggcucauuuggaacccaggcuuccugcuccccaaguagcugacguuuguucauuuauucagcacugcugagaguugaacuuaggcucacacacccuugcguuuagaaaguacuguacuaguuagcugccccagccaggcuuugacucaucucauucucucuuaaaaaauuaaagugacuucuuucauuucacuuuauuuguauggguguuuuuucuguccugcuguaugcauguauacaugugcaccacgcgugugcagugcccagcaaggucagaggaggagcauugaaucuccuaggacuggaauuagacuauugccaccucuggaagaccuucaagugcucuuaagcaccagagucaucucuccagccccucuuuggaaaaaauaauuauacugccuggugugguuacacagacauuuaaucucagcaaaugggcggauggacuuguccagccaaguuuacauaaagagacccugucucaaaaaggcaaaaagcaaguuuuaauuaugugugcgucccuuuaugugaauaugugcacaugagugcaacugaucuuagaggccaggagugucagcuucccuagagcuggaguuagggaguuuugagcugugguaucuaggaacuaagaguaauccagccccaugauucuccuuaaaaguaaaagaaaguacauuuauucguguuuaagagcauccuuaugccaugaugugcauugggaagucaaauuggaugucuuguuaaucucugucacgacccuggguuaucaggguuucuucugaaggacagguaauguuaaaagcugcuuaguagaagcgugaucaaaccucagaaugcguugagauguuucaggaaguaauauaauaccuagguaggaccgugaaagagugggguuucaucucuucucuucucuugccccccuuuguauucuugcucuuguuucuugaguggacacuuagcauuuuuagguaagcaucauuuuagcucuccuuggcaguucuuuuuuagugacuugagcacagguccuugugugugcuucacaagcaucaacucugauguugagcuacuuacugagagaauugguuauuuuugggaugcaaccuuuuugagaaccuaguaaaggcacuugauuuucauucuauaaguguguacauguggauaguguuuuauuauuauuauuaugguuuuuugagacaggguuucucuguauagcccuggcuguccuggaacucacuguuuagaccaggcuugccucgaacucagaagucugccugccucugccucccaagagcugggauuaaaggcaugcgccaccaugcccggcuauuuuuuuuuuuuuuuuuaaagaaagaguuucucuuuuuaaagacaggcucucacuauuagcuaugguugggcuagaacucauuauguagaucaggcagaccuuuaacucccagagauccauccaccugccucugccuucuagacuuacauaccgccaugucuccuauuaguuguauuugaauacuaguagcugugggcucugaaaccccguaauccuuaccguuacccuugaacauagcuacuguguucagaagcuugcuugguuucuagacugaaucaaccauucucuugcgaucccacuauucccuucuauauucagaagucacuguguuguguguacaguguguuguaaauggcaccaggauccucccuaaaaaaagaacaaaguaauuaguuugguaacugagaccugugguuuucggcuucugccucaugaugcugagguuacugggaccugcuaaggcucuuuaugucaugcuauacaguuauggaaucugauaguauuuuacauuuucucuaguagucacucacuuaauaaacuuugacagauuacugacgauuucucuugaugcuguguuucaguuuaguuaaaaguaauuuugaaaauccuaggugagccugucacucccguuacuuuauuacaucuguuuuauaacuauacacagcccaagacagaguucccagguagcauagccuaucuauguauucccuuuaaaguuuguauuaugccauaauacaggacaguucacugcggucacccaguguuugaggagcucggcagugcccagcuguggucucacgguugauggaugugcuuuaggcgguagucuaggguauggauugugauuuuugaguaauuuuguccauuccaguucuggaacuuggauguuuugagagcuuggucugugaaacuaaguacaaacuacaccugucuaucuacauaacucuuuuaaauucauuauuuuuuccaagcuaaaucguucaccucccucaccucucuuggugagugguaccacacauucuucaucuaguuagacucuugggaucacuuccuuuuccuuacagacaucuagucuuaaccaguuuuuaugucuuaauuuuucucaaguugauugucuuaguuaggguuugcauugcugugaagagacaacaugaccaaggcaacuccuguuauuaagaaaaacauuuaguuggggcuugacuuaauacuucagaggauuaguccauuauccucaaggcaguaagcauggcagcaugcaggcagauguggugcuggaggagcugagaguucuauacccuuauccaaagguggaaggcaaguaagaggcagguuucuuccacauugggcggggccugagcaagggagccuuagagcccacgcccacagagacacaccucuuccaaccaggucacaccuccucuagccaggccacacccugggccaagcauauucaaaccaccacuuaaauacuuuaacuacauguauauauguauguauguguauaugugugugugucuauacacacacacauauacacauacacacagaguauacacacacacacauacacacacaguugucuuuguauuucaaauacuguuugcuuguuucugugcucuguuugccuucccguguggaccuccuacaugcuaacugaggccuccuccacugaaucacuauggcuugacagucucacugaguugcccaggcuggccugcuggagaugauugcuguaguguaaaucaccgugcccaguugggaguggugguggguuuguuguuuuuuaaauucuauuuugucagagugguuuguugcuuuuuuuguuguuguuguucuuuuuuuguuuuuuugagacaggguuucucuguguagcccuggcuguccuggaacucacuuuguagaccaugcuggccucgaacucagaaauuggccugccucugccuuugccuuccaagugcugagguuaaaggcgugugccaccaccaccuggagguuuguugcuucuuauuuaggaguuuuaugauugcucucuggggagaauaguucugugagcuaggaaauuagcuuuauuucuugaacuaaaacccuuuaauagugagaaguugcaagauggccucaggcaagauuauagaacugcuugaauaacuguugagaagaauaaccuuguaugugacucagcugaacacgcauggcucugugcacagcgacccugcacuuuacuguuugaguacagaggaguuuauuauguuggugucagucacaggaacuguuugcguguucaugauuucucacauacuaauccuucagucuggagugucuguccuaugcuaacuucagcguaggcgauuccagaaucuguccugauagcucuucagagccccucccccacgucuacuaaacauuuuuguuuccccugcuaguauaucuuaaaauuugcuuauuuugcuucauaauuccuguugaauuuauaucuccagcaugcaaaugacucuugauacaaaugguuaauaguuguuaaaagguuagauuuuguauugggcauguguuagacugguauauguugaauucuugauuucuuuguuuugauccacuuuuuacuuucucuuacaaucuucagacucuggcacaucgcugagugagagcagacgucagccugaaggugggagugaucugaagguaauacuugcauaaaguucuuacucuaacacacuuuucucuuuaaaauauccugucuguaaguguggguguguguauguccuccagccaaaagaaagaggugaugcucaccuggagcugaguuacagguggaugugagcugccccagacaugagugauggaaaccaaacacaccccagcaagaacagcacauggucuucuucucugagccaccgcucuagcuucaugacacauaguucuugaaaauugggaggguuacauaaaacaggguguggaacagccaauguuuaauguuuauuuugcaauauuuuacuuucuuuuauguacuuaggauccuuugcaagcgccaccagaagagaaaccuucaucuucugauuuaauuucuagacugucuaccucaucuagaaggagauccauuagugagacagguacauagggacauuaugugacauacuaaacaguugcuugguguuuccauuuugggucaaaugacccuuugacagaggucugagaccuaagaccacugaaaaccacaugguugcauuaugauucaucacauuagcaaaacuauggcuaugaaguagcaaugagaauaguuuuaugcuugggaucaccacuaugaggaacuguauuaaagagucacagugccgggcgaugguggcucucaucuuuaauccagcacuugggaggcagaggcaggcggauuucugaguucgaggccagccuggucuacagagugaguuccaggacagccagggguauacagagaaacccuguuucgaaaaaccaaaaaaaaagagucacaguguuaggaaaguuaagagcugcuacccuagacuucuaauaaaaggagaugaaguuguucuuuguuuugggacagggcuucuauauagaucagguugaccuuugcauagucuuuuucuuuuuucuuuuuuuuuuuaacuuuauuuauuuaauguaugagugcucugcugcucuuaaccacugagcuguuucaccagcccagccuuauucuuaaagcuuacuguugauggggaaaucguguacuguugaaucaguaaaagcacuaggaggauuaaaugaguaacuuguggagguaacguccacaaagaagguugcaagcuuagaaguagagcuuauguguagcugaacagauccaaugaaacacugcugacuuuugaaacauuaaugguucacuucucuguuuaauauaauugaaauuaaauuuuguugcaaauaggugcugaagauauuucaaucucaaaucagucccaguacagggaguuuuaaccccauguccuuuaaucuauagaagagaacacagaugagcuaccuggggagcggcaccggaagcgccgcaggucccuguccuuugauccgagccugggucugugugagcugagggagaugugcagcggcggcagcagcagcaguagcagcagcagcagcgaguccacagagacgcccucgcaucagguagugcuuggguuuaagaaauuaucuuacuuuuuaauauggaagugucuugucugccagaauguacaccacaugcaugcagugcuuugaggccacaggaggguguggaguccccuggaacugggguuagggaugguuggagccacugugugggugccaggaaaguggguugacuaccacaucucugcccuaguuuugagugcugcagauuaaauccagggcucugugcgcacugggcaaguguucuaccaguuaauuacauccccaacacccaacagucagugagccaaccucucugcggaucucugccuaucuaguuucuuagaauagaaccugaccugcugucaaaacagaauauauauauauauauauauauauauauauauauauauauauauauauaugcucuucuaaaaaucuuccauauuaaaaauuuguuacuuuuuaaacuuaagugaaaaugcuuuuaauacaacuguguuuugcuuuguuuuaacuuacuuaugagaacauuagucucaguaguuuuacccuuuauuuacagggaacacuaugccugauaguguuucaaauaauuuguuaaaggauccuacaacuaauuauuacauuuaauaagacaggcuagaacuugaaagcucagcgguuaagagcccugacugcucuuccagagguccugaguucaacucccagcaaccacaugguggcucacaaccaucuauaaugggaucuggugcccucuucuggugugucugaagacagcaacaguauacuuagauauaauaauaaauuaaucuuaaaaaaaaaagacuacuuuuaugucaagcugacuguauuuucuggaagagaaaugaugugucugcaguuaagcagcaucuugguagcaaauugagaaugccuguguccugaauucuagagcaguguauuuuuaucaguuguaaguaaguugauuugcggaugaacuuaguguaugauuugaaguugaaucucuuguuugcauuuuugugagacagggucucuuauuuaguucugacucuuggcuguccuggaacucacuguauagaccaggcugguuuugaaccuacagagaucuuccagucucugccuccugaaugaaugcuaggauuaaaggcauacaccacaugccuggccugaaguugaaucuuuuaaucucagcacucaggaagcagggacagcagagcucucugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugagguaauagccaauauagugucacaugaggccccaggccaacuaaggcugcaucggaaaacccagaugccagcuugguguuugugugucgucacuagcacuccgucacacuagccugugagucagggaggccuucgucuuccuguguuuaauaggauaaacucacaguggugcuucagauaauaguaggugugcauauaaucacacacguaggaaaggucauuguggaagaucuuuuuaugguauugugggaaccuuaaccaaagaaagaugaguggggcuuagaaacucagauuaucuuacugagaaaaaguuaguguguggauugauuuaggaaacaagauguggcuggagcauggguauugaauaggguggaggguguguuuagcuggacauuugaaaauguuaaugcagucauucugaguguaaccucggggcuaaggggcucugacuuuuccuucaugagguaggacuuuugaguaagguaguaaccuugaacccagucuauguggucuggggcugagaaggaaauaguggcucgggaugaacccgggagcucuaaaugaggcccagaggcaaugcauuuacauucgcugcauucuuccuccauaggaucuugacgauggcguaagugagcauucuggugauugccuggaucaggauucaguuucugaucaguuuagcguggaauuugaaguugagucucuggacucggaagauuacagccugagugacgaagggcacgagcucucagaugaggaugaugagguggguuucugugucugucagccuuuuaguaagaugaagaggccaucuauucagagucucuggaaagucuugcuuuuucauuuguucaagauagaauauugcuuuguggauuugaggugaaauuuuauaguuucuuugcuugauuuauuuauuuagauuuauuuguuauguauacagcauucugccugcauguaugucugcaggccagaagagggcacuagauaugguuacuagccaccaugugguugcugggaauugaacucaggaccuuuggaagaacagacagugcucuuaaccucugagucaucucuccagcccuuugcuugauuuauuauagucucacauuacuaaauaaaaaacuuagaggagaguuugaacaauguuuuuaaacuuuuuuugaguugaugggguguuuuuguuuuguuuguuuugcuuuuugagacuugguuuuuuuuuuuuuguuuuuguuuuuguuuuuguuuuuuuuuuuugguuuuucgagacaggguuucucuguguagccguggcuguccuggaacucacuuuguagaccaggcuggccucgaacucagaaauccaccugccucugccucccaagugcugggauuaaaggccuucgccaccacgcccggcgagacuugguuuuucuguauggcccuagcuguccuggaacuugcuuuguagaccaggcuggccucagaucugccugccuuugcuucccaaguccuggaauuaaaggugugcgccaccacugcucugcuaaugauggaugaacauucucauaauggcuggaccacaaaguucuccauuuggucuucccauuuauguauguauguguguguguguauuuguuuuugagacaggguaccaccguguaucccuggcugacccugaacuggcuaucuagaccagccuggccucaaacucaugggaauccucuugccucugccuccugauugcugggaugaaaggugugagccccuacuucugccccucccuucucaguacugauuuguuuuucaccaauguaaagcaugcaacgaacaguguccaauaggacccgaguaucucuuucucgggagcaacucuacauuucuaguuguuuucugucuaauaacucuaaauuuauaaaaugucuucuugaguguuuuguuugguuuuaaguaucuaacaacucuugccauugcgaguaaagguuuuccuauccugcguuuccugcuugccuugaacugcauuuaacuuucuuucagaacucuucguccacaguuaauggcucaagcuguuuguuuuaagacuuacugagaauucuggcuucuugguugaaggguugaauugaugcuaaugaauuugucuuacuaggucuaucgggucacagucuaucagacaggagaaagcgauacagacucuuuugaaggagauccugagauuuccuuagcuguaaguauauagauucuucaaagaaauaaaacacaauguugagaucagaauuaggacuauagguaguugugagccaccacgugugugcucagaaccugagccaucucuagccugucacuauuucauauaggucaccuuuuguguguguguguguguguaggggaaaguaccuagagucuacucuauuagcuaauuucugguauauaguauuagauauauuccucauguucuuugccuauuuauguaaaauaugaaaugcugaaaauuaagcuacaugguauacuuuuaccuuagccacauugaaguuauuagccuugcuaugaacacugacugaagaguuacugucuuuuuuauugaaggacuauuggaaguguaccucaugcaaugaaaugaauccuccccuuccaucacacugcaaaagaugcuggacccuucgugagaacuggcuuccagacgauaaggggaaagauaaaguggaaaucucugaaaaagccaaacuggaaaacucagcucaggcagaagaaggcuuggaugugccugauggcaaaaagcugacagagaaugaugcuaaagagccaugugcugaggaggacagcgaggagaaggccgaacagacgccccugucccaggagagugacgacuauucccaaccaucgacuuccagcagcauuguuuauagcagccaagaaagcgugaaagaguugaaggaggaaacgcaggacaaagacgagaguguggaaucuagcuucucccugaaugccaucgaaccaugugugaucugccaggggcggccuaaaaauggcugcauuguucacggcaagacuggacaccucaugucauguuucacgugugcaaagaagcuaaaaaaaagaaacaagcccugcccagugugcagacagccaauccaaaugauugugcuaacuuacuucaacuagcugaccugcucacaaaaauagaauuuuauauuucuaacuauaugacccccaaauuagacaacauggguauuauuuuuauacauuaaagccagaaaacugucuuaguccacauaaaauucacuuauaauuuauccuggagaguaaauauggugaauauuuucuuccuuuuuagggaaauuucacuuguuuauuuuauauuuguguuuuaaguaauuugcauuggcuguuuauauuuuccuuauauuuuaaauaaucuccgcuuggaaggacuuuggaaguguaugugagaaguccuuuccaucuccugcagaugaugguggaccuuccucaucaagggcuacagaaguacuugauuucuguuuuuuuuguuaauaauaagaacauuuaauuuauuuagugucuuucauguaaagaguuaaagacuaugugaaggauuguauauuuaaguuauugaaauucugaaacuguaguaaucuaaaaugugugaguugugggcugcagagaagacucagccaguaaaggcaccugcuguguacacccacugacacacauuugauccuuggaacccccaggaagagugaaccaguuccacaaaguuguucccugaucuucaaauggaugcacgcaugcacgcacacacacgcgcgcgugcgcacacacacacacacacacacacacacacacacacacacacacacacacacaguuuuaaaggcaugaauugcaucuggugguauguaagugaaaacacacgccuuauuuuccagcauuuucagcuuuuugucauagggguguggcacaaguguugcaguuugucccagguugaaaagccugaggcugguagaagcgccuuuuugccucagcuccgugguuccuggugguugccuauguuucaggccuguacuuaggcuagguuuagaaaccagcccauucagaaagacugaaucagaacauggauaaagugaacucauucuaagaugacucgucuauccauguagauuaaucuccugguucauaauaggccucuucccuuugauugaagggucacgucuaaguauagaaaacauaaaacuguaagguagaggaagcgaaggauagcuuuguauuaauguugcguuaaagcuucagagacaagaacaagaacacuccucccacgugacagcauuugaauaggaggcggugggugcggcagccugggcagcuucagucccgauuuacaauaaaguaccuuguguguuauuaguucuuaaauguuuauuuagaaauggcauugauguuauuuauuugcaaauaaaugguuuauuga

SEQ ID NO: 12173 - RNA, 115662 nt, Mus musculus
ucugaaaacuugcagcacgggcaaaacuugggcuccgggugcagagcgcagaggccagcagcuugucccucugcaucugugcagugccgccgccugaccccgccacccgaggaggcgcggugccacccacugcucuguuccuugcuagagcugagcugggcgcccuaccggauccuggcagaaacuuccacucucuccucgguuucugaccgcacuagucagucucuaucucugucccguucugucucuuugucucugucucucucugaguuucugucucugucccucuucucugugucucucucuggcucucugcgucucugucucuccuucccgccccccucccucucucucccucuggggugggggagaggaggcggaauucuuuccccgccuaacauuucaagggacacaauucacuccaagucucuucccucuccaagccgcugccgagcgucccaguacccgcaacucccgagccuuugcggagagagcaacccucuccgccuccaacucuucccucuccuucgcuucccgccuccucucccuaccuccaccucuaccuccgccacccacugcccgcagcgccuccuccuuuccuccuccuccucuccuccuccucucuuccuccuccccucucucuuuuuggcagccgcuggacguccgguguugaugguggcagcggcggcagccuaagcagcagcaguaguccccggcgcacucgccagcucgccugcucucgccgcucuugcccucuccagcucucuacaucccgucucccgaaaggugcugggcggauucggggcggcggaggccgagcggcugcagcggcgguaccgguagaggcagugguagcggcggcgggaggcaggaugagcgcacgcggugagggcgccgggcagccguccacaucagcccagggacaaccugccgccccggugccacagaagcgaggacgcggccgacccaggaagcagcagcaagucaguacgccgacgcggaggggccacucagcccacccgcgacgccucugcccccggggccccgcgacacgccgggcgaccggagcgcgggagcgcagcggcuacggcagcgcaagcuagcccgccugccacccggguguagguggggcgggagaccgaguuccccuggagagugcgcggcgcagucucuccggguacccgcgcuccccggcuccaagagcuggggucccgcggcgagccguagccacccgguggagguggggucgcgcgaaucguggacagggacuuucgcuauugugcgcagccccggagcggcgcggcguggcucggggggggggcaucgagccucgggggucccaaagaauaaaagcgucgcuuugucagccgcuuuggcgacuggggggacuggggaguucaggaggggcaggacugcgaguccgaagcucuuagacccgcggcuuucuccggcuucucggggccgccuucccguaggaggcugaugcgccgcggccgcccccucggugcccuccccacacuccauggcccaaggcucgcgcccucccgacaaagaacgcgugcggagccgacugcccgccuggugcuccucccgaggauauuuaaaugccugccgagcugcuacagccgccggggcuggcggggaaaggaucccggaggaucccaggcccccgcgggcccgggaaacgcgcuucgcccagggagcucuggaaggaaagugcacgguagccagggucgcuuccccgccaggagucgggucccucuuuggcuccucgaucccgcuccucugagcagcccaaguuuuagcuuccucuugggcgaguggcugggggcugggaagggacggucgaggggcacccaggaccccgcggaauggaggguuuugucugcggaugcaaccaauuaagagugcaagccggcuguugcagaguugugcgcagcgcccagggccgggggcgggcgggcgggcgggcaggggguugggacguucgcagcaauuuccaagccuaaggacgcgucuauugagaacaguaaaacucccuucccggccuuuaaaaaaaaccaaaaacuucccauuuuuucuuuugcuuuaaaucgcuucccucgggccaauaggcggauuagaaaauaguccuaaauugcccccguagagcuaggugggaaaucgaagaaaguuuguugguguguuuuagaaaaacaaggaguguaccuuuugggaaaucaucaaaggaaacaaacuaaucuagaggccgccgagauuucccgcucugcccuuagcgacacuuuacagugcuuugggaucccguuuuacaccucccaggaagucuccgcucuacccccuugcuucccaccagccacccagguuuucugaauccuacuaaucgcaccccucccccaaaggcuaaaggaaaacgcauugagauccggaggcggcugggaguuuuuaccuuugagugaaggccgaguucacaaagaaaaauguguuuccgauguguuugcucuaagugcccacuggcgcugguguccaauggaaguuucuaagcaccccccuccgcucucccccucccccgcucucuagcuugcgaacuuccacggagaacgcuccggaguuguaauuagucucguuuaagcacccaaucugaaugaaacgagaguagaugauucaccggagagacguucagcguccgcggcaaaucuaucgcuuuuucuuaauugccugaguauuggcuacuuagccuagcacccaauaaagucaaacguuaauauaccuggugaccucguggcuguuucaauuucucuuucccagauacuuggauuuuucuccccacuaccccguuuuucuuuccaguccacccccccccucccgcccaaaagucucuuuaaaaaaagguuugaggacaacauguuuauuuuuguaaaaagauauuuaaauuucgacugaagaucaugccugucucuccaaaaggaaguggagaauugaagcaauuaucuagauaauucaagcaaaaccuuccaccucagauuuaccauaauuauuuggaaauuuuaggggguguggaauuauucugagcugaagaguuuggauaaucgcuccaauauuucacucagacuguguggguugaauccuaaaccaccuggaacacaggcacauagaggugacugcagcccaugcuuucucucucucucucucucucucucucucucucucucucucucuccuaucuuuccaucuauuuaugacaauuuuuguuguuuagaaauacguagcaguagucauauaaaauguuuauuauguagauucuacuuuguaccuuuaaaaacaugugcuuuucuagacugugcagcuugacccggggcuugccauccuuuugauuuugaaauauaauccaguuuucacauguagaguagcuuccuccuuaaacacugguguucaaacuacggcucuguguccccuuuugucaaggcuguaccaccauccuucucgaaugacuuccagcagguuggugaagcaguccaggcagagagcacagccagagucagggugaaguucuuucagccgcucuagccacaacagcuuuucucuccucuuuacaaucaggagccaaccugugagcccucuccuaagagacccagaggaagacccaaaggcagcaaaaacaagagccccucuaaagcagcccagaaggugagaauucucaugucaaguucuuccaauguuaucaaugacuuccauguaaaguuuccauucuaaaucuacaauaugaggauuggucucagcuggguaacccaagacauuuuuuuuuuccuguauuuguuagaugggucuuaaccuuuuucccucccucuugugcugaggcuuagcuuaaaagcuucuugacgcuacaguguuuuagacaaacaaaaagccaucaaacaguguaaaccugaagaggugggggaggauggggggagggagggcugggugggacaggggcagaaaugauauuguuaauauuuacuuccauggugagcuaguugagaauaaaucaaagcuggagauuuugacagguggugauauuccugcaauuuccucuggggaaaacauaauugagauuaauuuauucagugccuauuuacaugaugacucaaagccacgcccccuauuaauguuaaguacuugccaaauagaugcuaauuaaaaagaaauccaauuacggguuacugaaaagaguuucaugaauuuuacagccuuaaauguggugauaaguauacuauuugggucagaucugcauaguaguaucauaauuucccccaaacuguugugcucucagacaauuuuaaguauuaaaaacaaagacuugcuuuauuuaauauuuuuuuguggugguggugguggugguggaauguaauagaaaccaguuaagugugacaaucauuuaaaaaaaauaaacaaaaaaccagacuuuagauuacaccuuuaaaaucauuucauguuggucgugugugguagcaaaaagaggaauuaccuaauaguaaaugccuauuaagagaaaugaugaagacuauaugucacuuuuuggccuuuauuaaaaaaaagagagagaauaauuugcaucuuauuaaguaugcauuguaauagaaaguaacgguucaguauuagaaauaaaucccuacaaaccuucucaauggauugaaaucuauaucauuuguguaaaaagagucugugcucaucuuuggggaauuaaacuccuguguguauuuuccuguguugagguggguagcacuaaccacauucuauggggugcuucccagugguccauuccugucauagacaccagugauguagaaaagucguuuaggauguaauuaucacuucuggcuguuuuauuuuaacagggucggacugaguugaaagagcagauuucuuuaacauuugaauuaauugccuuuuagaguugagaucaguagugaauguuuaaccaauuaucccccaguugucucuaaauaaccuuguuauuuaaguaauaauacauaaucugauauuccuaauaugaaugguuucccuuucuucuauuuacaaaugaacuaaaauaggacuuuuuugaaacccaaaagauucuguguuauguuucugugacacuuaguuaccuguguccucaggggcaguacaggugggucuugguugguaucaaucaguagauauuuaaaauaugauguaaucacucugaaaaugccucaucacaauauaaguuaaggcaucuuuaaaacucaccacaaauacaugaucugaaaguuaauauaagaaugaagguagauuauccucuugaugucccuguauaacacuuucccuugaaugaauaggucggaguggucucauccuggccucuucacuuuaaaagguuuaguguggacaaaaggaaugguaagacuugugccugguuuaacauauaaggaaacaaaacaaaacagagaaagcguauccguuuccaagcuuguuugguuuucagugucuuuagccagaaguaucuacagcuggccccacuaggcugccccucuuccuguaauuccucuuguccauacacauacuuggguaauugcuagaacacaaaucccccuccccucauagaagaccuuucucugaaauccuucuaucuuccaggcagcauacuucuguuacaaauguuaacaauguuaaaauguaagauuguaacaguuuacacauguaacaguuuacaaauguaaaauaaauguuacaaaugugaauaaguccauuagccuaggagguacguguuauuuuucuucagcucuauaaaucacacuucauuuggagaagaugagacugaggacauugauaagccaucucuggaauggauaacuuugagguguuucacuuccagauguuuuuauuggagauucuccuauggcuuuauacacacgacuaccaacuguguccugcauucuaacagggcagggugcagaaugaccuuuuagaaagaguuaugcaguucaaaacauacaagaugaaaauacauuaccagacuaagcugaauacaugggagaaagccuucuauuugauuaaugaagugaguauuuuucugaacucugggaaucaucacacacacacacacacacacacacacacacacagacacacagacacacagacauauauacacagacauacacacauagacacacacagagcuaguaaguacuugagagaaacaaaccuucaaauaaggagagauguaguguacgcuggaguccuaauggaugcuguuuaaauguucuugcacuuuuggaaccuuuuuuaaaauuaaauuuaugcuuggaccaagcaucuggccuugggcauuugaaaacaaaauugcucauuagaaaauuaccaucgagagacuugaugauacaugcagaaugcugcaagaccagguggaugaacaguuagcaaauuagcuguccuuuaaaguucaauaggguugauuuuugugugacacauacaagaaacaaauuugagaaaaggcaauuuguugugcuuagaauguauggaggagaugauaauuauucuuccaucaaaauuaauuccauggcugacccuuguauguccaugcuagucauuccugggaacucuuccacuuuggauguacccuuaauaaaaaggaauuagaaguugacgucuucugaacuaaaugguuugccugagauugugggugugucuccuagccuuuugcauucugguuuccccuugugguggggcuuuacuggagaugcuucguauuuucaccuccuucauguuguguuuagaauuuuguccuuccuuuuuaaucaggagagaaugcuggagcguugacacuaaaaucucuacuucaggccacagaucaaacuaagcuucaagcuucaaagccgguaaaauuugagcccuucugaggguguugaauguuaaaagauuucaggcaugaggaaacccuaguucauaaucucagagguuugcuuggcacucccucguccccacccccuuugacuugaagugcaauggccagacuuaagaacgaagcauagaaugcaaguugcaucugggcaaagucuguacacuuugaauuacacacucagaauaaacauuuaauuccaucuucagacaucauggaaccaagcccugaggcuagcuggguacucuguagacugaguccacagcauucaaauuccuggaggugaugguuuuauuguuuuucccacuauuacuaauaucaaugacaguuuaagaauagauaaggaagguggggcuuacucaccauuucauaucuacugcagaggcuagcugcugaaugaggacaggaguuucuuuuucuuuuuuuuaaaaauuuauucauuuaguguauaugaguacaccauugcucucuucagacacacuagaagagggcaucagaccccauugcagaugguugugagccaccaugugguugcugggaauugaacucaggacccucuggaagaguagucagugcucuuaaccacugagccaucucuccagccuggaaaggagugucuuuagagcauugaaguccauggaagagagggacugaaggcagucuuugcugauucauccaagaugaccccggggaugaccauaaggcuccagcccauaguuucuacagcacuagugugacuucaugugaucgcuguguguuuuaauaagcagguaaguucuugugugagacucggggucccagcagagcacacuucucgaaggcagguagcaugacggaguaugcagccauugccucugcccucuuaauacucggcguugacuuacuucaacaguaaacucaguuuuuaaagcuucacuuugccagggaagaaaaagccuuaaugcagcuauaaguucuacaugacaccgccaucaaaccauccuuggaaugugauacaaaucggggagauucggauauaucaggguuauuuuauccaguuacuugaugccagggagacccacacuccuauuucucuggaaacuaccagcccucuuaccucuuuccuccagagccguccccccaccccaccccaccccccauuacuuuagcugaccuauaucuuuggcccaucucucucucugggucuaaacagaucacuuugcagaggagacugaaggcuccacacugggacucuauugccuuucagcucuuuguuaagaaaagacggagugaacauuuuaugccguuuuaagucauucaaaccugcuuugucuugugagcggacucuuuuuugccauuuccagaguucaccuuggaaccauggagcuuacaugggguggaaacuaaacucggaaccccgggugcuaaaguucuuacccgaguaccugugcucgguuaacccggagagaagggugaacagagaaccagcaauauuuuaaaucugguuuauguuuacuuguauaguuucacacacugaacaauuuugaauggcauauucugccauuuauuucuuuguuuaucuuuuagugccccaagugaaaucagagaccuugcacacgcuaggagagcacuugaccacuggacuauacccccagcuuuccuguaaaccuuuauuuaugucauugcuauuuuaucugguggcaaaagagguagggagucaguuuagaguagggaagucuccagcuuuggaggagagaacucuuccuacaauuucagcuuugguuuuuaaguuacuguguauguauguggaagcagauaagcgaaauaauagcaggagaacucgugcaaugcaugaugggaauuguaucuuuucaagacuuaaaauggucguacuuaaccuugggaaaccacagaacuggguuaucaaaaugcugaaaugagauuuuacccaauguuuagcccaaauguuugguccaguuggauucaaugcuaguguagauugguucacgcuuauuauuauuaagaagcugaaagcguuuaccuuuuagguuuuguauuauuacagagaaccugaaagaguucaccuuucuagguuucgauuagauguccuuauguuuuauacacucaagccugguuaaaucuuuuuuuaauaaaaaugaaaugcagauaucagaagacaagacaagccucuuucacaugcagccguguuugcuuguuuguuuuaacuucucuuucuguguucaaacacuuacuaguuugaaauagggauuccuggcucguagguaacauacacuagaacagaaacauacaaugagacaauuuagaaugguaaaaauugaauagcuaucuaaaugucuaagcuugaccugaaguuagacuuguauuagacucuuguuucccagccucugcucucauucauuucuuaauaggaauauaagaauauugaaaauacuuuguugugacuacucauuuauccuagggugcuuucuuucuccucuuuaagauguucuuuccuagucuuuuucccuuucuaaaauuccuucucacacccuugccucuggccauuucguuuuguauaugagaccaucucugugaagaaaagacauuuuuggacuuuccaucagguugagucaaguucuacucccuguagaaguccgccacaucauugaaugucccgugaagugggacucuggggagggaauggcugcccuacuugaguagaaguguucuuggagacccacagacuuggcagggacucgcuggaagggcaguguuuaaaaguacaagugguauauuacauuugaguuccuguucaauacugcagucuugcugggccccucauaaauagauuggucauuuaaagugugaagaucacuguggucuucacaaaugauaaaccugauucaaaaugguaaacugccacaugcccucaaaccccucugaaggucaucuuuccauuucuggggauugcccuguguuuauacaguaccaaccacagcguugaugucucucaucuuccuuaacuacucaacagacugaaauaaacgugugagaaaauccaaguguggcugccuccaagacaugaagacagagaaacgugugucuuuugccacuaaugcucagagacccugggccccaaaauaacccauaaggucuggggauugucauaauccaaauguuuccuugugugucaaauguaaaggcuauaagagauggcuuuaaaguuuuaccaagcuccugagguuugaugggaguagggaacccaccccacccccacacaguguuucuugcuuucccauccuuuucccucccccaccucucccaccucuuuccucccuucaucucucuuuuucuuccuuucacaaacaggcaguaaauacugccuccaauauaucggcaccaaccuucaucaccauuccccaaaucaagggagauguucacaagguaaauguucuguuuuaauuuuuuuaaauaaggaaauaaaccacaggcuuggaguaccagcaccucuuaaagaaagaguuacaucucccauuuagugucaucucaggcuuccauggacuuguuucuaaacacuuaaaauuuaggauacaauucugaacuaugcgcuuucccaaggcauaagggauauaauauaaugaaggcagccaaggaagaaggcaccuugagguauggggaauguggaugccagugucauggugcugguaagucugaaguuuuuguuuucuccaaggcagaaagccuacucuggcucucuuucccucuauaacagcagaaaaacacuuagaacuagucaugucucacuuauccauguguguggaguacagaaacaaaaaucuaucccagagaaagcaagguaaauaaucgccuuuacagaguuguauauguuggugcuuuaaaccaaguaacccucaggguuuugcuugccuucugugaaagagagagccccagugagugugccccagugagugugccccagugagcguuaaagacacguacaaaagccugcucaaggcacgauuuucccaguaucugaauguuauccuggagcuacucagguuuacaaacuaaaccccagcuuguuuugcagccuuuguggauugggucaggauguuuccguaaugugggcuuuaaagaacaagcgagccucccagcucgggccacacagcagcagccagcguguucuuucuagaugccaucucagagaggguuucaguuuacaugggacaccagccuuucagaccaggggaacgcacuuacuuuuaacaagucagaaugauaaccgucaucuugugcccuuuccuuaaugguaugaaauuuauuucucaaugggcuuuuuguaaauggcauagugguuuaaaacuuaucuuauuugccaggcuccccccacacuccccucuuugagagaucuguuuucucagacuguaaaauguaggaagaucuuuuuuuaaaaaacaccccccccccccaaaccccauccuuuucuucaguagauuucagauacaaccaggucacaucgcaguccuuaggauguaagaauuaaacagaaauaccugauaaagcccugcuaccuucgagguuaauaacagcuuucccuccacucgggggaccaccccaguuggaaugagaaaggcuuccuguguuucauguuccuguaauucauuccuggguaaacuguggacucuaagcugcuuccaaagaugagcucacaugacgcucucucccaggggacucugcgccuuuacaacucacuguacacagccaggcauuucuguaguaaaguuuccuucuagaggagacaaagucgaguauacuggaauaguuuuguguugaaucaacugccugugggauuggaccagcuugaaggaaaucuuugccucaagccuucuauccuguuacauaugaaaagacauuuuugagcaucuuguguggggugggcacuuucagguagcuugauguccccaucaaagcuaaguuuaccucuacuuuacugaggaaauccaauuaaggcuuccaggaacagguuaugaagcuaugaugucagagaaaggucuuggaccuaagcuuuauaaaacgagauaccuucaaccaugcagcggacaauuugaaaaggguuugugguuuucuggcuguccccagccuucacuuaccuuaaaauccaugcugucaugacuaaaaggugaggcagugcucgaacuuugaccauaaagaaauccuugguugaccgugaucaaagccagaagcaauuggcagacccaaaucuuacaguuagcuaaagauccuaaaagcuacugaaauuucuguuagaaaugagauaagucuauuuauauuuauaugaguacacuguuguucucuucagacacacuagaagagggcaucggaucccauuauagaugguuaugagccacccugugguugcugggaauugaacucaggaccucugaaagagcagacaauacucuugaccacugagcccucucuccagcucugguuacagaucccucucaaguacugguaagaagguagcagcagucuugggagucaaacagcugaguucgaaucucugguccaucacucauuagcguuauguaugaccuaacucaucuaggauuuaauugcucaucugcaaagugaaaugaugaugucccuguuagaaggcugcuauaaggauuaaaguaacaugugugccuaacuuaaaccagaguacuuuaaaugcuuaauuaaaucagagaugacauuauagucauaaaaagcucaugcuaauuaugaaccuggguuaaucuauggcuggauaccuaagccagcuaccuaucuucagauucauucucucucucucucucucucucucucucuccaucuaucuuuauuuguuaacuugaagggggaagguuagugucacuguaucaagauccacuagcuuuucaugcagguaacaaaacuaaauugcaaaacaaguuguccugauucagucuaccuccacuuuugcauugaggggucuuggauuuuuuuuuuuuuucuauacagcaguauguucuuagcuuuuuuuuuuuucagaaaaguauaaacuugugcuucuuuuuuuuuuuuuaaguauuuuauuuauaugaguacacugucucuucagacauacuagaagagggcaucagaccccauuacagaugguugugagccaccaugugguugcugggaauugaacucaggaccucugaaagagcagacagugcucuuaaccacuaagccaucucuccagccucaaacuugugcuucuuaaagaauguagaugcuguguguguguguguguauugaugcacuuagggauuggagucaggguggcuaaggcuaauaguuacuuuaugaauguuaaaauuggaauaaaauauaaauaauaucaggaaaaaaaucuauucaguauagcaaugaagcaaacucaagaggaaauggauuaaugucaaauucauguugaguguggaauuacuguuaauaaugccaaucuauaaucaauuauuuuucugcagccgugguuuaaaucucugugauuggugauuuucacugguguuuuuucauccucucucucccgcuccaccucccuccauuucucuccuccaucuuuuuucugucccuccccaaccccuccauuucucuccuccauccucuuucugucccucgccaccucccucuauuucucauccucucucugccccaccucccuccauuucucuuccuacuuuauaggcuggaugauuggcaggugguuguuuugggcauagaacaggaaauuagucauuugguaguuggcagguguuuacugcuucauauuaaagcguuuauguauuaguucuuacauucaggcuuguuuuccauaauaaugcagagagaacuguuuuauuauuuaaaauuaauauguccacaucaauuuuucuaacugguugcaaaaggagugucuugaccacugagggaauguucguucuguaaaauacuaauuugcauaaauuaugggaugugggaauauuucuuuuguauaaucagaaacaaaggcgaaauggauuuaacaaaagcauauucaugaauuucagaggaggucacuccgcgggagucuuuuauggugagggguugcauagauaccucuuuauagcaugcagcaaacagugaagaagcagcagccaccgaaaaccagaggaaugaaguguacaagagaaggagguugcuaagacauucuugaugccucaccugcaguccggaccauucuagcugggaauguauuccuugguacagugcuuguaaacaaugccaggcaggagacuacauggcuucuucuuuucuuuuuucuuuuucauuuugcagaaagcagagaccauuggagaaaaacggccaagaggcagaccuaggaaaugggugaguaaggagauauaguucccgugcuuaacaggaaaagagugucuuaaaagcuaaaaugaaaacaauaguuuuuguuuuuguuuuccucauggauggugugacuugguaauuucugacuugauaagccuuguaagaccaaggcccgggggacuuaugauaacuccuuaccauucggcuccacaauuucacagcauguuuccuccuuccuuccuuucucuugccacaccaaaggagucuucaaucucccuuaaagaguaacaaagaugauuuguguguggguuggguaacgagagucaaagguauccugaacccucagaaguugccucugaugccgauaacacucagagggaacaugggaugagaucauuauucagaaacguuuuucucucucucucucugguuuccucuccuuuuggucgaaucuucuuuucuagguggucucuguguguucuuuagcacacugacuucuucaggaagcagguguaauuuccaguguucccagcaaacuuuaauaauuauccugccuagggacaagagagguacgggagccaggggaccuuacccaccuucuccuggaauguccuucccacuggcgucuccaaggcaaaggaagcuguuucucaagaagguggcuggcugcucuggccccagccagucugccucgcuucuuugcuccccucccccaaagcauuuccccaguuugugccugcccucccuuguaccguuccuuccugcucuucugggcuguuuccccuguuaguuugccggcccucucuccccaaguucugcauggcuuucuauuuauacuuugguguucucuuucauuuaauuuauucaucuuguauuuuuucccccucugcucccacauguguuaggauuagauuucuuagcacaaggaagcagggaugauguuuagauuaaaaacaucucagugcugcaauguaaccuuaaagugaaugcguuuuauuuagacuguuucccaagaagugaauucucgccaaauuguaucuacggggccauccuucagucuaaagcccagggccuuaaacaauagcccccuaggcugccuccuucuuccacaaaugcucaggauguggagaaucuucacgccacuccccccgccccccaucaucucuaugccuaaccccugaaauauguaaagcaauugcuuccaaugucauucacacuaagccuuuaaauauuugaggacaguuuacacaacccauuuguucucuaugucugcuaugacucucuccaauccuuccgccccaccccccacauaaaggaacauuuuuuuuuuuuuuacucauugcccaguaaguuuguucuuuaaauguuaaccaacuucccuggugugaacaagcuacuucaccaugcuccucuuguucuuuggguggggaggauggacaggauagaacaggaaagcucuacauggagaggucagaagcuguagcuaagaggacuuuagcauuuagcaauaccucuaaagcgccaggcuuagaacuuggaagcuucuaaacuccaggucuagcugauugguuggaaguuguucauaccugugaguguccccagauggcucacacuauagucugauggucucucucucuagucugaugguguccgacuucuuaucagcacucacgguucaguugcugggaaggaaucagaaacuugcuccuggaaaucagaaaauaccacugcuguucaacuguagccagcccagugcugacaugucacuaagucauacaggcuaacugcaggccugccugauauuuccugaguaucuggacucugaaugcacaccuaguccugcugaugacacaacaagaaagaccuguauacuuuuucuaauagucagucaaagaucuuugaagucaagauuaguaagacuaaaaugaaauaagcuguaagcaguuacagaggaaauuaacuaggcaaauaccuucuggcaaguaacccccugcuuuucauacccaccaccuuuggaguacgcucucagguucuugagucaaccuccacaggucuuagucaugucugcucuucucugaaacauucuguggguccagaauugguugaauugauuauaaccuaccccagugcuucagagaccucucccuuuguggcucacaaagcuguuucuacuaaacaugaaacaaauuaaaauugaauagguuuuaaauuuuuuuuuugaggcaggguuucucuuuguagcucuggcuguccuggaacucacucuguagaccaggcuggccucgaacucagaaaucugccugccucugccucccgagugcugggauuaaaggcgugcaccacuacugcccggcuaauuuuuuuuucuuaagggguucuuguuuaucuggaggguaacuagacuguaaacaucugaucuucaugcuggguaagaaguacuuuggaagcaucagccauggagaccuuggcuuccugagaacagcugugugacaccucccccuccccaccccccccccaccccauugacuuaccuggucucucauuuuuccuggcuggaagaauggaauguuuugugguuagcaagucccugaucuggucuuggaagaagagucccuccacuuaggagaggaaaucaaaggaaaugguauauuuuuucuagacaacguguuuccucuuugcuuggauaucuucugcuggugacuugugcgaucagucauagcgaggccuuacuuccugggaaguuuguaugcagaaguaaaccacagcaguccccauaggaaacgggcuugugcucuaugcagggaugacuccucuuccaacaguugaauucaccgauguccuugaguuggagauccagcuuuggacucacuggauugucuucguauuugacuuagagaccagauuguuuguucccuuuauucuuggagguuuuguuuuaaaguucuuuugagaaaaaacaaaauccuaugaaucuuuuuuuuuuuuuuaaaaacaagaaguuuauuuaaaaaacaagacgcuugacucaaagggaguuccaggauccauucuuuuucccguggaguuuaccccuucucaaggcagaucaucacgcuuguaacauuuauauacagaaaaguuacaagauuggcuuugguuuccauaauaagugaaaaacauuaaaguucuccaaguaaacaagguaggcagguaguucuguacuguugagauuauuuuuaauugaaucaaugagagcaaaacagcccacuuggauuacuaagauaugggugcuaugaugggcaugcuaccaguagcgaaagggaauauuuucacagaacuccaugacucuccccagaccaucuccaauggauggagaccaaaaaagagcauaugucauuuaguuaaagaaauaaagaaaaaaaaaaagaacaauaugcuugugcacacacacugauuacauuguguguaauuaaggaauggggaagaggaaaugagagagaaaaguacacugugguagucaggaugggguggagccaagcugaggauuucuaaccgagaauguguucuuaucaacaacaaaauucuggaguaaaguagcaacugaccuuuuucaguagacaccccacccccacaucugcugcuggaacacacagaucacgucuucagccuucauuuaccagugugugugugugugugcgcgcgcgcgugcgcacacuugacuaucacccaucuggacccucaucuaccucccugacagacugggcuguuccccacaggcuuucauuaguuuauuguugcuguuugcuucuuaaacugcaccacagaauucccugcccaucccauucaaauuaauaugacccuuguucucagccuugacuccuuccuuggguauuuuaccaaucaugacaaguguuggaucccucucagaugcugcaucauaaauuuggccucagauacgcacccuugucuuguuaaucuuacaaaccuacauaaccugccuggaaaagagcguuuaaucuaaugaggaucaguaguuggguauuuaaucaagaguugguuugccaaaaaugugugaaccugaagagagcucugccccuuagaaaggaugaggaagugguggguccagugaucccaugaguaucuuaacuagagauggcuagaaggacucuggaggguccagugaccccaugagcaucuugacuagagaugguuaggaccacuauuguccauugcuuccuuuggucucuucugcugcugguuugaauaguuugcagauuuauaauuuugauaguuuucuggauuuucagucucuguguaugcaaauaagaagugagagaacagaacuuacauuuccuucauagccaaggccaaggagcaggguuuggggggcuuggggguucaaguuuuugacccaccacucaacuaaguaucaucuuaaacaaauuaugugaucaucccaaggcuccauuucuccucuggacaagguacgagucucagaauuugugugaguguuaagugagaagugugcgaaggcucaguccaacucccaagguguggugcuugguaaacauuagagaucauauuuaacacauuggcaugcuccccccuuaacgcuaacuacagccugcacuucaauuauacacagcaugaggcccagugagaaucacacuccaugcugaccacauucccuugguguaccgagucuucagcgugugucuauugcuuaucaugaagguuaagacuugcuuacuggugauguuaaacuagguuuuaugucuguucacacucagggaaaauuuuuuuacauugaugccaaaacccuuucucuuuauaguagaaguuugauguugugccuuaauuuaauuugagaaguacuuuguaugcuguuuaccuaguauguacguguagaaacuugacaguucuaguucucagagcaucuguaucaucccaguagucaguucucuuacccacaacauucagguaggaccugugugucuccauuuugccuugaagaggcgcuuaucauugaacugguccagagacagaaaauguuuagaaaacaucugagaaugugggauucaggcucaggaacauaaggaaauaggaaagaugcucucuucacuugagaagcauaccauccagauguuucuuaggaaggccaguagggccucugggagaagagaagcaagggaauagcacauggaauaagagggcgaagacuagcagugccuuuaccuggucuauuuuuagaaccuuuucaagagagaaaaauacaccuuaauagaaauuaaugcuuacuuuuuucaaaaggaaaaaaaauauucuggagaucauaaaauugacccagaaacugacccaaggaucaggugccgacuuuagagggucacuagaaagucacuaacagucccagcuguuuccuuggcugcugauagucuuuauuuggcaauggggugugugcaggauguuaaguuaaaaauauacauuuccacuucgccuccuuccaggggcauuuacuuuuauuaaaaagagcuugcggcacacaggaaagugaugucauuucguuuguuagucacacauuugaagagucuagaucaacaagaagggaguuuuugucuugccuguuuuguagccaucucauaacauaagugaugauuugaggaccuagcaggagauacuaacucaaaauaaauuuggaucucaucagaccaacggaaacuguuuccuuucaaggauucuaagcacccaugugcugaagaaccuggaaaucuacuugacagaaaaggucuccauuuccauuucuuuacucuccagauguaugcuuccuuuugaaaaacuuguacccauuguaacaacacuugccuugaaauauaacuugaaauauaacuucaauguuuaggaagaguuauccaguagucagaaugcagacaauuuuaagguugaaugggggucagagggaacaaaacaaccuugauauauaacuuuuuuuuuuugaagucagcuaaauggaauugguaaauacaagaucauuuauuuucccuuaaaaacuuucaauaauaauaugcuuuuaaaaaaccaucagagcuuccacaccacccagcuguugcacaagaauauuccaugucuuaccaguagauauaguugacguuuacuuccacucuaccuaaaauagcaagauggaacaagccaaauguccgucaacagaggaguggauacugaaagugugcuacacuuaacacaauggaauauuauccacuugugaagaaaaaugaaguuguagaauuugcaggaauauggauggacuuguaacccagaaagaaaaucacacguucucucucauaugcagauccuagcucgugaugaauacauauauauaugugugugaacaggugagcacauaggccuguauguuugaccucugaccuguagcacuggagacaggagagaacugagcagacagagucauuaauagccugccugggcucagauagcaagucacucacugucgccagccgccaggcccaugcguacacgacaaagcuuucucauuggugugaggagccccgugaggagaagacauacacgagcagcuuuguccggcaagcgugcauacguucgcucuaguucuuggcauuuauuccauuucaggccaaagcaauauuuaauauuuagcaucuagaaugcaguuuuucuuuacuguacauaaguucuauguuauaaagcaagcucucugaauguaggugggcauucauucuucggcuuuucgauuucucuuaaaucugacgguuugugggguuuuuguuuguuuguuuguuuguuuucuuuuccuagacaggguuucucuguauagcccuggcuguccuggaacucacuuuguagaccaggcuggccucgaacucagaaaucugcccuccucugccuccugagugcuggguuuaagugcacacaaccugcagucacuaaagcacugcccccaauuaguuucaaaugcgagcuuacguuucgaggcuugguaaguuggugauaggucuauuucacaggcccccaaaggauugcgccucgugucacuucagccucugccucuucacuucuggaaauggcagucugcuuucuaaaauagauuugagcucagccccuugaaaggacuuuuugacccaauuuuggauuaucucccaaaagaugaacucacuguugguuuaaaccucacaaaacaguuuucuaagguaguuucucauguuguagacagaaacucauuccaaugcccuauuuguguuccguucccuuaccgauacacuuuaguacuagcaugacauuaaagaaaagggggggaaaucuuccaugggcaucuuauauaauuuacauggauguagagagguaguggguauacuaccaauguuuuauagggagguaguugaaugcagaaagcauuuuuuauuaacacucuucaagugcuagccuguguguguguuuguguauguguguauauguguauauauguauauauguguguauguguguauauauauguguguguauguguguauauguguauauauguauauauguguguauguguguauauauauguguguguguguguauauguguacauguaugcauauuuguaugcauauacguauguguauauguguguguguauauauauguguguguguguguguguguguaugcauguguguuuguaugugugcguguauguguguauacauuuaugaaccuaauuuucuucuucuggauguagaaguuaugccaaguucuuccuuccagccccaugcuccgagaaauaagacucagauucaagauauacuuauaaauacuuugggcauauaguuaggcucugcucugacuaaucagaacuaaaauaagccauucauuuuaaucuacauuuugccacauggcugguuaccugugcucagguaccaugaguccaucucacaucuuucccaggcagaucucuuaaauauuuacaacaguaucugggacaugccauuguugauaccugugcaguagccuccuucccaagggaugcucaggauggugugacuugugucauugugauuaaaagccguggguaugcaucaaauuaguuuucccuuuucacauaacaucccaggcauuuuuaagucucguuuuuuccaaucugcugauacauauuugaagugaaaauuuuaucuggcuggcuucugaccuaaugaguuucuagcuuuaugguuuggauguuaauuuuuaaagagucacuuauuuauguacaugagcacucuauuugccuguaagccuucaugacagaagacagcaucagacagcaucagcucccauuacagaugguugugagccaccaugugggugcugggaauugaauucaggaccuuuggaagagcaguugguguucuuaguuaaccacugagccaucucuccaguccaaccuguucauaucauaccuggggaugacaguuguuccuucuguguccuccuaaauuacaacucuuggaacacauauaauccuaaagagaugcuaguaagucucaaccauaaaaacacuauuguacaacaaaagaauggacuugguugcgucacccauguaagcuucaaaacuuugcucaaaaucuucacccucacccuuguuucccaucgaagguauuuguuucaugugcauggaucuuuuugccuguacacaugcaugguagacuuccccuugugagccuugugagcccugcagaggccagagagggugucagaucccguggagcuggagucgugagccaccgugugggugcaaagaaaccaaacccaggucuucugcaagaacagccacugucccuagcuuuuuagccaccucuacagccuccccacccccaaguuaggcagcauuaacucauacuucauuuccaucugcauuuguuauuagaagguuaaaguucuggcacuggaggugccacuugugcguuagaaagggccaagugauguuagugggaaugagagagaugaguggugaacgugggaaggaagacuuggagaacuucaccuccugagguaguagcugucacauucuucuagaacauguaggcauaucugaccgaggaggaaacggcuuggcccauuaaagguuguuuggagugaaagugaccagacaguuguagggacuccagacaaaaagguauagccacgucuauagaggcauauucuuuaagugggaagguugggaaggaagaagguugguaagcugaggagaccugcgauaaaacugaauccuucagcugaauccacccagacuaaaacuggggauaaaagagagugugcuaaacaccguaacgcuuaaagaauauuuguaagcgcucuugcuucuauauuugaaagccacuaauuguacagccagggcucacacaacaaguguccuuccucuacauauauauuuuuugaggggguugguuacucaacuuaggcuuguuucgcauuaacuucggcccugaucauauauacauuuggguauucuaaauagaauuugguucagugcuccugcagucucuuugcaugcucuuacauccugggagaaccagcugucagggggcagcugucuuuaagagaguccugggggcugccucccugaggccuuuucuuucaugauuguccgugaccuuagucauugaaucauugaauuguuucuggccucccaagccagugauugggaacaggcagggugguagggugauguuaugucuggggccugagccuguauccucaccacacacggggcccacccuuccuggucuggacagcucaaugcacagugcuuggcaccuagugaacacucaauaaauugacuuguuuuucugucucucuugggaucugaaguagaaacccucaaaugugagcacaaccccccccccuccccccccagcccuaggucccccaacuggaauucccaugagaaagcugaggcaaauguguguggauacagucccagguagccaacccaggaaaggucauugcucuggcuuuauaauugggcuaaaggaucuuaaaaagauuuuugucgggacgaaugaguuuuaacuuaaugcagcaucucuaagaucugcauaauaucauggcauuugagaacacauuuuauuaaaaaaaauagcugauuugguaucauuucugagacauccuguguuuugccuauauuguuuguguuuuauucacuccuacacacacauacacaaauacacacacauacacaaauacagacacaagcacauacauacacacauauacacauacacacacaaacacacacacauauacaucauacacacauacccccaaguagaaaagccuucuacauuccuccagguuccuagauauggaaagcauugaguuggaagagaaucuuuugauagucuugccuguggauauuuguucaaguggcuuucuugccuuuauuucuucuucccccuguuccuccaaaauucagccagacaauccuugucuuccuggagacucucacauguaguuguaagaaaugccguguauauuuuuguccagcucccucacccuggugccuuuuucucucuccuauuuuucucugcagcucuggggaucagcccaaagccucuacuacugaacgaugaugcucuggccuguauaaacuguagugacacucucucaacuaggauguugcuguuaaccaaaccuccuagcuaucauacucuggguucccagcucugcauguaauuauuugugugugucuguguaaagaugaugcugugaacuacuuuuaucccacguauagguucagaaauauaucaccagaagcgccgucuuuuaaaauaguuacuugagaauuuucaacuucgccaguuuccacagacauggagauacgucaugucuuuuaaauauccuagaacguggccuggcugucaagcguuggcagaggggcccguguuuccuaccuguggcuguaugggugauuuuugagauuuccuucuuaugaauagcuggcuagcccaagcagaaucauaggugggcuuggcacacagcuucugacuugccuggaguaagcucuacuuuacugcauuaagagucgugccaauuugagaggccaaggagggaaacuggcacagaagugcagcacacaccugcuuuuccugaggccacacgcaccgcgccucguugaguaccuguuugucuuuuggguuacguucaagucugucuucaaagucgugcacuuagaagcuggggauguagcuccgugguuaaucaugggcauagaaggugcagagcuuugggguuugauugccaacccucaaaucuagauagauagauagauagauagauagauagauagauagauagauagauagauagauagauguguccacauaaagagauauuuggugggcaaacuacccucuuaauuguaccgugaucaucuaacccagucucuagcguggacugcaggcaaaccucaucaccuugacauuguuaggagcaccugcaguaggcaacacuaucacugccgugggucucccuacaugcaucuuuuuaugugcacacgugcauacacacacacacacacacacacacacacacacacacacacacacacgcaugugcgcagaacacauauguuauacaugcaugcauguucgcacacacucguacaccugaagcaaagccuuagccugacguuaccacuuuagaauggaaagacccucuguauucuacuggucaugucugggguuucaguaguuagaugacagcgauuauaccugaauauaaugaaccaucuccauaaguaauuacuaugcaggcccuuuagagaauauguagauacauagagaauaauauacccagugcccuauuggagccugaaucccuacuccaugguauucuacaagagugauuuuauuuuuccucuuugggcuaauacuauuccuacuggcacuuuaaaagaaaacauuucuuuuuuuuuguuguuguuuuuguuuuuguuuuuuccgagccaggguuuuucuguguagcccuggcuguccuggaacucacucuguacaccaggcuggccaguacucagaaauccaccugccucugccucccaagugcugggauuacaggugugcgcuaccccgcccagcuuaagaaaauauuucuuuuuuuuuuuuuaaagauuuauuuuauuaauauauguaaguacacuguagcugucuucagacacaccagaagagggagucagaucuuguugcggaugguugugagccaccaugugguugcugggauuugaacuuuggaccuucggaagagcagucgggugcucuuacccacugagccaucucaccagccccaagaaaauauuucuuaaugacaaauaauguucaaauauauauaugcauauacauuuauuuaacuaauuauauauauuuauuauauauuaguaacggaaacaaacaagcaagcaaaccuagcauuucaaacauccauaaaccaguaccagagcagcgugcuguuauuucauggcaggcuucuuccguucuuaccggguucacaugaaugugugcagccugccggugcggaccuggcugguggcagaugaagacgcagcuguguuccuguguccugucacugaggcccccgcccccaccccgcggugccaaaacuggaaacugugaaagcauuaaaaugcugcucugauucguguuccgcuuccccagauaggagccuggauuugguccguagcuuauggagucccagcuucucauguucugcagaugacagugucaaagcagagagcaauuaaguguccagcuccuggucgcaagcgucagucauuaucccgacgggagccagguuuccugacugccaguccguugcuuuuccccuuaacuaaugaauggcuucaacuuguuggccugacuuucugacuuuuccuccauuaccauuuguaauguuggcccugguucccccucucccaccccaauccccaaguccuguauuacguuuucugaggguugauguaacaaaguacugcaugccugggugccuuugcacaauagaaacucucucucucucucucccucucucucucucucacauuucugggaaguagaaauuggguuuuuacagggucaugcugcucuccagaagccaguaaugcaugaucucucucucucucucucucucucugcgugccucuuucugucccccugccccguccugugugugugucugugugucugugucugucugucucuuucuccuguuucugacaagaucuucacccagguuagccuugaauuugcagugaucuuacugagccucccaaaugcuggcauuacagguguggggccguauacucgacaagcuucuaugugagaaucaauuuccugaucauucauaauuauuaauguuccuuaguuuuugggcaccccacucuguuaagguguggccaugcucuguauacuuuguugccaagggaggucuugcaggcuuguauucuaaacgccccuccccccuuaggaucccuaguaacccuaucuugacuaugaauucaaagacccuguucccaaguaaggcuucacuccuguagaugcaacaugaguuagaacuucaagaaaucuucuuagggaugcaaugucaccugugccaggccuccucagcuucaagcucacuuagaauaaggcagguauuuguaacccaccaggagaacguacaagggguuucauuaaaucuaaagcauuguggccaacauuugcaguuuguuauaagaacacguuggaaagauuuauaggcuguuuggggugugaguuuuagauuaccuccuuccuuugaacuggugguugggcccaguguuuuaaaaguggggaaugaauagauuugaaagcgucuaauuuuugucuuuaaugaagcuuguaagcuugggaauuucuaaaaagcuaucuaaauucgguagugcggaacacuaagagugugucugugauuuccaaauuucagggcacuuguuugcauaugcuaagccucuauuuaagacaaaaaguagaacuucaggucagugagguucugguuugcuucucuaggcagaaagucuagggugaaauguuugcaugaauauuuaauggugaaugccuaugaauuuucccaaacauaucccccaauucucaaagguacucauucccuuaaacuucaccgguuguauacaauucucuccuuauuauaaccauucucuuuaauaugacauuauuggauuaggaagaaguguauauagaaccuuaauuuguaucuuuuaaaaauauuuuaagacuauguaauaggaguaaacugccuugucuuuuuuuuuuuuuuaaacugauuuuuauauaggcgauuuuauucugccuuuaaauuaaugugguuuagcuucaacccuaccccucccauaaggcuaguccccauucccuauaaucuuacagaccugggagaacaauauuuucccuucugucauuuugauaauuacgugugugcugugcucagugguggccuauuaacucccaugaaguccgugggcuugcaaaguagccucagauuuccguacccuggaacugugagaaauuucuguaauggugcuuuagcaauaaugauggaggugcaggcguuuccuggggauuaaugaccagcugggaagaaccaguggcccucggcucugccucccagccagccauuaacuccaaggaaaugucuuuugcugaggucguuacugcuauuauaagcuuaaaauggaaaaacauaacagacauaugaguuauuuuuaugguuugauguccuuuccaauaguaugcaccaguucaagagacugaguguguagguugggucauuugacucaucccccaguaaucuauauguuuuaugacuguucuuacccauucuuucccauaaagaaaaagaaagaaagaaagaaagaaagaaagagaaagagagagagagagagggggggggagagggaggaaagggaaaaagggaaaggaaaggaaaggaaaggaaaggaaaggaaaggaaaggaaaggaaaggaaggaagccguuuagcuugguaauccuaucuuggucugagguuugaaaguauaaaguguuuaacuugcuucucuuauccuuugcaaauuacacuuagguuuuacauacgaucugaaggacugagacguguguguguguguguguguguguguguguguguguggugauuauuuuucuuccagaauaaaauccuccaaaaauaaaaaggggggggaccaacucccacccccauagggaccuuccuggguuucuucgaucucucugugauauuuaacaggcauccuuauguuuuugccuuuaugucuugaauccacgagagaguaacauacagccuaaaaacucagcauucuaaggguuuaaaaaagucuauuaacuauugcaguaagggggauccuuuaaugcaaagccaccugaaagccaggccagagucagaauguugucuccgugcuccccugugguuaucccugugcucaucuguaguuguuacagugcuccucugugguugucuccgugcuccucugugguuuucuccgugcuccccugugguugucucuguccuccccugugguugucuccaugauccauugugguuguuuccgugcuccucugugguugucucugugcuccccugugguugucucuguccuccccugugguuaucuccuugcuccucugugguugucuccaugauccauugugguuguuuccgugcuccucugugguugucucugugcuccccugugguugucccugugcuccucugugguugucuccgugcuccccugugguugucuccgugcuccccugugguugucccugugcuccucuaugguugucucuguacuccucuaugauuguccccaugcuccuugaauagaggguuuggguguguauguguguguuuaauaucuagguauuaaauaguagcuucuguguucaaauucauugaauggagaagaaaaagaaaagcacacaauggucuacucaaaucucacaaaauggcuucuuaaaaccaugcaauuaaaaguuuuuuaaaaaaacaaaaaacaaaaaacaaaaaaucaaauguauuucugcaguguuaugucaucaauuaccccaaagaguagcugcucucgcuaaucucuuggcuccugacacguagacacauaaauaucuaugacaagaggaccacuguuugcaagugagauugcaaaauaggaagcagcagauguuggaaaggaaaucuuucaagacagagugaccaggcucucucgcuuaggcuuuguucaaggucacgggcauaagaugccgcucuagaagauggagcauggucaugugggugggggagggcacuucugcggaccgggaaggagaugguaucacuucaacagaucauuaggcaguaacugaguagaggaagccgacaguuacaggaaaaaaaaauauuugcugaucacggaggacaaaacugagcuccuguuuggcaaaucagacuucuuuauauuuuguucaucgauccaugaauguaguucacuaugaaaguacauuucuuuccuuuucaaaacacuauuuucaguguccucugucuacgaucauccaugaauguauccauuugcaugauuuaaguaccuuguguaucuguggcaauuuuuuuuuaaagauuuauuuauuauuuuauguaaauacacuguagcugucuucacacacuccagaagagggagucagaucucguuauggaugguugugagccaccaugugguugcugggauuugaacucuggaccuucggaagagcagucgggugcucuuacccacugagccaucucaccagcccaucuguggcaauuuuuaauguuuuuguuuuauuuuauguguauggguauuuugucugaguaccuugugugugucugccagaagaggguagguugucaaagucuccagaauuggaguuauauauaugguugugagucaaccugugggugcugggaauugaaccuggguccucugaacaaagagcaaaugcucuuaacucuugagccaucuuucuaucccggaaaacaaaaucuuaaagagugaauucaguaaagacauaugugacucuuuucugaauaaacuauacuugauaugcuaccaugccaaccuauuuugugaagagaaucaguuuauacacaagcauuuuccuaauuccaccaugcgacuucaaguacauugggacuagauauuuaucuguucucagaaucuugcagcaaacauggagacuaugcuauauaaggaaaaaguaagcauuucugaaauuacguuaagauacuauuuuaaaauaaccaguauggugcacguauggaggaaguuagcuguuagaagucacuuguauucuaggacguuaaaaaaaaaauaaggaaaauguuugcuaggaaauaagauacagauauuauaccuacuagguaaaaaaaaaauucuguagaaaaauaaugaacaugaaggguuauguggagaagcaacgcuuacacacccaacuagauauauauguggaguuuaggggagagggccgagcugaagacuuaaaacaggggccacgggugaaagagucaaacuguggcugugggucaagaucccaagagaauggugaagacaagagcaaccauagaccauggagaggaaagagauggugaauguagaggacauaaacaaucuugccagcugucccugaugaccaaucgucuccagccacgccccuguuuacgccucucuccagccaugcccagcuccugacaacagccuggcucuuacuuucauuaguguagagacuagccucccuauugcggucgacgaguaggcacucuggcggagcaggcaaaugaaucuagagagaguccugugggggccagaucauuaagucacacugagugacaucccauuugccaucuggaaaagauaaaaguuuuguugugcaauuaucuuuaugggacaaaguguuucuguugguuuacuaaagccguuaagccaaaacagggcaccaguguaaggccuggucucccaagucgccuguaccauccuccuguaggauaaaaugaacaucugggaagagggcuaacaugugucucuggugaguuuaagauaacugcuuuggcuucaaggaucauuagauuucacagaucuaaugucuauguauguaauguauguauguaugcauauauauuauauauaucacugaaacuuccuuugcaugggucagauguugagaaaagucgguuguaauuugggauucaugcagaggaaaugcccuggaagcuuucacgugacuagguaaaggcuauguaccuuacuagucucccuggccccucuuauccagacuacuagaguuggagccccuacagugcggggagagcuuuuaaaccuuuuguaagcuguagcaucccagggugaauugacuugccgcagaaauuaaucuuggggcugauucuagcuaagcaguuguagcgaucuagcagaaauggcucaguccugcaaaacggauggccaaauaaaaccuucaggucucuggacggguagcaggcagugcagaugcaccaggggaaggacugguuucccacagcauggcugugccauuucagagcacuuggagaacacuguacggaugcaguuaaacauuuaugaccgcaugcagguccaggcagcgugagggauuuugugcaaguaguggcugaugagcaccccaaauaggaguucuucagaucuaagguauccaugguaaccaaguagguucccuuuccauugugcuuauuacuuuccaaccugcuaaccaggcguaggcgcugugggcuccaggacaccuaauuccuguaacacucuagagaguaaguaagugcuuuugggggggggggugaagcagacuuaaguaagggguuuugagagauuugcagaaugccacguagcagccaagacaguaauuugggguccaacugucaauuuauuugaguaguguuaugcagguaaaaaucacacagggaaaaaaagaauuaugauuauuaagaaaacaaugguggguuuuuguuuguugguuuuguuuuugcuggcucucugaggucuucuauuaccaacgugguuguucagcuguuuuaugaauagcacaagcucacuguuuucauuuggugaacagcaccagcuucgcuauucaagaucuugcucccaacacagggaaauauuuaauacaguaggaaaaaugguuugaauucaaguagcguuaauguugcagugugacuauaacccucuuuuuccaagaacauauuacaaaugaauuuuugugcuuccauuuagccuacgugcaauauaaccauuuggguuaaaucgcagccauaauaaaucgcaucaugaagcauuucaucuauauuucuuaauguuguucacaagugacuagaaauaucuugguaccuuuuauguacgguagcucauuuacauauuuuugacauugugagaaugaacuuuuauacuauauguguaaaguacuguaauaauuaagcguauauauacccuaaagaaauuuacccaaggauaugcuauaaauauugucaggguugaagaaaaggagaccggauccauuauaucuguucucucugggacauuuguauaccuauuugagguuugaaaaugaaguaauuauuaucuuucuccacuucuucccccucacgugcuucaccacaaacuuuaggcagcauucacaauccccauuaaugugagcagccauauuuccuguaaguagugauaaucuguaaaauggaugacaugagccugagguguaaacauauguacauccacacugguuggcgucacaugcccucaaccgguugaacccacguuguaucuggggagaguagagaaggaagaggaagagggugggaggaaaggaaugagaucugguggguucuuugguuucuaaauuguguagaacaaaaacagaacaguuuggauaggaagaguccuccgcugaccuagcccacugguuuacaucaugccagcuaagcacugggugacagguucaagggcccgcccuuuuuguugacugacauuucucaagguagccaaugacauggaccuguccuguuucuguaaugaacaaagauaggucaaacccacuguagcucugagcgguuccuuucuucacgguucgcucaggcaagaacaccuuugcuccuggauagacacacggacagccuugucaggaaagggaacuuuuaggaacuuaaucugugagggagagagccgggacauacuuggaguggcaucugagcagauguccucagcauuggccaccaagacuucgcuuaguaaguauguauaguguuagagccacaaaaguaacaacugugcaaagaaggacgugagggaccaagaagcuggaaagcccgucccccugaugcugagaaacuaguuggaucaugcacacacacacacaaaaaacacugcugccaaguucaaacaauagaaaaguggaggaccuaagucuuguggggacacagagucgaggugagagccauuaguuggccaggaaggauggcuggagaaguuugggugggauucugaaaaaaauuaaaagaugggaaucaauauauuuaaccuuucaccuguaaggcaaagagccccuggagagcuagcaugcagucucccugucucacaugucccugcaauucccuuugugccuguuagacuguccguagcagaacucagcaaaugcucgaacgacuagcuuuagguaccauguugcugaaaagacaaaacuuugcuucccaaucugccgcugaccaugacacccaaggagagcagaugucaggaacacuguguuagucucucucucucucucucucucucucucucucucucucucucucucucucucugcccugugugggguugcucacaaaggaaucuuugcaucugagaagggacagacagucaccuccuguggcugacccccacaaagagagggggagaaaucuacuaaaccgcuccuggaaaugcaauugcagaauccuuugagccccaagccuccuuuuucacugggaggacagauaagugcccggucuugcggugucguguuucugacuccuuuguuuugccuucagauuuaaaaaaaaaaaaaaugccaauuucauuuguccuucaagucgggagcaugucaaagagucccucugagugguagguggcuuuccggagcacacgggaaagaaagccgagucucauucuggcagcuguccagugaggauggagaggggucaaguuacuuccagugucugaacacgaaaaggcaaagagagcgcugaggugauacacuacauacacccucugggcccaaagucccauuuaccucagagauggagaaaaggcgagaugugaguuuauuuuuucuagauacuauacaggccaucgcucucuucuccaugguucuuguccaguuuugggacaucgcaaaagauggcuaaagaaccaaggaugagcugucagaauaaccuagaccauaucuauuucuaucuaucaaacacugaagucuccacuagauccgaagagaaugcucacgucagugcuagugaguugccaguucagugacugccuuuacugguucauaauucggcuuuguucucauuguugaguuaaaaagaaaucaccauuuuaucuaggcuaaccuugaacuuguaaccacccagacuuuggccuccagagcugaguagccaccaugcacggcuguuaugaaccguggcauuuugcgguggaaacuaaauuaagaguugugccagugucacagauucccugguacugcaaguugacacagugcaugcauauccauggcucauggaauaucauuauuuuuuuuuguacugugugcuuuaagagauuggcauuccuaaacugcugcacuuccuuggucaccgaggcgaaaccuauuuaugaaacauucaacuuauggagcacuuggugagacuguagcuagggguaguuuucuaaggauucaacucguuuggcucaauaccacguaggcugagguugauuguguuguugcuguuguucuuguuuucuggaaugcagccugggccgcauuaguuuggacguacaucauucaagauaggagaguaccauccccaucacugucaccuucacaggucaaaacuggaaagggaagaugguaggccauagacuaacucagaaggaugagagucaugaccaagacacggaagaacucuuacgacuguauuucagggaccuuauucaagagucaaguacacauugaaagccacacacugaaagcuagcuggauggaaucucagucuggucagaugucauggcucaaguucgcucuugcuguuugcugaagaagaggguauugggcguuggaucaaucaauccucagaugucguaggagagcuccuucagcuaccuggcuuuuucccauggggaagauccagaguuugcugauucuacauuauaaaaucacgguugggagauacaguuuccauuucauucaggcgugugcuguuuugaguguuguuccacgaggcuggcaaaaauaaauggguccuauuuaaaauucccaaucuguaggcacuaagaaccuaccaaauagaaaggagugucauaguccagaaugcuccuuuaagaccuuuuauucagagucuuaggaaagaagaaacagaaugucagaauuuauaaguaacuuguacagaaacacaagcuagacaguaaucaaauugacuccuggcucuggguguauaaccccuaugugccaugauuuuuuuucugcaccauacagccaacucaacuugaaaaauucagggaaucuuguguuuuagcccuuuucacauuuagcauuauuauuaaaaccauugauuuuguuuuacaaaauaaauggcacaguucuuaauaucuaccuuauauuuaauaagcauuuauuaagcauauaauauguacaugcagaucguuauaaguuuugugcgaguaaaucaaacauggcuuguagcagaaagauuuauaguuuaaggauaggcaagaugaagcuucuauuuauuuugaacuccagcuguauuucaagcaccauggugggcuuuauuaacauugucucaucucauuguguaagccuugugagagucacacaaggcaguuauuuaguuuaugugucaagaugugagccauaagcugccaucuaccagacucuuaucccagccauguaaugcaagcggggcuuucucggaggagguguguagugcuucaguugagcauugagggaugaaagggauuuuaaugggguagcuuuggagggauuucacagagaaggcaugcgucucacguaaggguagcacgggaucaauggcgguagagagaaguguaggauguguaccaucaaguuuccccaagcguaguuuggauagcguaaauuagggccauagcaugggggugagcauggaaagggagcuuccauaguaggucaggagggccagcaccgccaaggagaaaugauuaaagacucuaagcaagggaaugaccaaaccgauaugaauuuggcuuagaaaaacuguaaaccuguagccugaauuaucagccacggucuagagacccagacauagacuauuugcuguaccaguucugugcuuuagaaaucaguuuuaaaaccauguguuucuaggcuccguggugcacaggcucagugccugcagcuccaauuauuucacgaggucuuuggguagguagguauaugggggcaagacccuguguucuccgccuccaaaauacacgucuauccugcacauguuugugcuugcaaaugacuuaaagaaaaacaacuagcacgugaaaauguuaaugaguuuuuguauugacaaaaauuagcaaccuguuugugccuguguugcuggugacagcucuuucucugugguaacagaaguuagguagggugugucguggagaccaucuagcuaacaaagccuaaaauauuuacuaucugacaacagaacauggucaccaacaccugccuccgugucucuuccugggccucuaaauccauuuaaaugcauccuuuccucuaguguguggauggaaaauaaauuuaaggccauuaauagaagcaggagacauuuuuggcuuugccuccagcuauuauuuuuuccccuucucugggggauucugagcggucugugucuaaauucucaaagccaaaagguaaugagguagagguguguuuucuucaucaccuucuccuucuccuccuguggggauuuggaaaguguggauuucccucuaggugagagggcacguucuuuuucuaggcacuuuuagucugcacucuggugugaccagcuccauggagcuaugucaaacgggcugcuggggucugugaaaaucacccaggaaggcucagaaacagagaaacaaccuuugauuucaaugacacacuuaaccagagagggccuaccucucuugcucaaccuaauguggcucuauggguaucgcagacuugaaguugaacaccagaacauuccugaguuuucaggguucggguauagccaagaggagucagcacaacuuccucuuuguagguugaaagcaugugucauggaggggaagcaaaaaguaauaaugggagcuccucuuugccucuuugugucuuccccuccugagagagugugaugcuggcuucuacucguccuucacagacagaacacaggcuucuacucguccuucacagacagaacacagauuaaaugaggcuuuguggacacuucacacugaaaaggccagagcacuccccaguccccuguuaauaucuauucuaaaauacccaucucaugguuucccaucuuggaucccagaacaaaugcuuaagcuccggguccuuucuugcccggacagucugauauguucuucucacccuggcugcugugcacuuauugcuuauugcucuauuauuuaggagguagacccucucugguuuuccuuccaugcauucgcucugaguuagcuccaaccacauccuauauuucagcuaauugcaucugaacgccuauguucuuagcuuggaugguguccucuuccaccaggccaccgcugacccaucuccugucuccagcgcucccagguaugccuugauccauauguuuccagcuuccuccuccuccuuccacgcuuccucccuucucuguauggucucucgacucugcccacucaacuguacucugaguagcugcuuucucugucucuggucuucucugcucaguccaccccagauagugcucaaguguugucaaagcagaaacgucaucucuccuagcaaaaauucucaaugguucccauucuccccagagauaaagguccaaacaauuuauguugauauagcacuaagucugccuucugaucucguuuccuacaacccacuagcugcagguuauacuuccuuauucauaaagaauagucuugguuuaucuuauuuuuuuccccauauugcaugggcucuuucccacucauggucagauuguguuuuuucuacccccuuuucuccaucagaacaaaucuuacuuuaucucccaaaacccaguuccgauauggcagucccuuuuuugaaucauaccccguaucuucucugucaaggcagucgacacacgccugaagcagggcacauaucacauugugcugugacuauucagcaauguaccuuuccugcgugacacuauguuucauugaucuuugauuuuggugugcagagcacaguguuuaccaugaaaaacaucugcgggaugacuguguccaaguucugggucuguguccacaugacagggcuguuggauuccggugccagguauguuaggagugaauggcuccgugggaacgugacaacagauccccagcagaaaagccuucuuuccucucgguaucuucucuuuccuuuauggcccugagucaaguuaauuauagaugucagcaguuaugggauuagaugugcuuuucaucuuggaggauggcaaucauuauggggagggagaaaucuuucagugucgcugucagagaaucgcauuuaucaagauaagcuuaacuucccuuggaaaaaguagaugacuuggcagaaauucaguaccuuauuggacauaaaguuaugcaucuccauauaacguguauauguaucauguaugacacaucuucugugucccugaguguuugccuacacuucuguggugccuagcacaucccuucgguuugacuuggcaacauccaucauuagcagacggucaucguggacccaacagugaagacuggggguggggggugggguggcacaggguuccauuuccaacucuugcucauggaauuugcccacgcuuauagaacagugacaguaaugacagauugucuuacuagauggcuaagaugcacccuguaaauagggauuaaugcacggugccuacccuugugaaauuauaaaggucacuguaguaaaaaagacaguaccccccguaaggcagcuugacagauaacgaauuaauagcaaacaagaagugagauuucacuauguucuaccucacaauacaccuauuguacuuuugacacauugacgucuuaugcgugagugcagucauaaugaagcaggagacucugagggaaauuucagauuuccuuuauuaucuauuaaauggaguugggucuugggcuauguuacugauacaucagggauguaaggcucuacccuucacauugucauauaauccauuuauuaucuacaaaguuaaaaauauuuuucuuucacauuugaaaucaaaaugaguaaaugcacaucaguaacgaggcgauauaaucuaucaggcuaaugcauauguaaaauacacauuuacagguacauaagucuauuuauuauauacgguuggaaacucuuggucacacggagugcaggcauacagcuaggucccugaggaugucaaagggcaugagaaauuuuaaccaucuuuccagugcgaacaauucacuguccuacgcacaucuaagguugccaacggggaugcaagccaccugaaguuuuaguuuaaguuuuugucuuaguuuucuuuuucagaaagaggccuaagaugcccacagguggcgcagcuaccuucauuggaguggaguccagguggcccgcagagcuggguccucugaguagauggaugcucugaguggauggaugcucugaguggauggaugcucugaguggauggauguucuaacaggugcuguccagauuuacccucaagacgcccugaaaacugggcaagauauuuuuuuccuuaugauuaguagaugacuguaauucuaacauguccacuauccuggaccuucacguaacaauaugaagguuaauaucuuuucagagagucuuaaaaauaugagcaguguauaaacagccagcccugaugcccucuuuuccacuuccagugugucaccucuccucaagaauacagagucgcauuuugcaagaggccuuucuacagucacccccacccccaccccacccccacugaagaaauauuagacucucagauuugcauguacucguagguccucaccuuccuccagccagccagaaagacuuuugccugcccccccccaguaauaacguuuuuuuuagaacuacuguguaaccugauacccaaaccguaguuguguuuuguuuuaaguuagaucaaaagaauuucccaugcuaaguagcauucaguaguuacuacaaaaaaauaauuccuucaguauagucccagauggaauuucucuucauccauucucagccuagagcacaacgcuccugugucaugccacauccuucuuugguugugcuaacgacaccuguagccagguuauuucacuauuuaauugggcauuggaggcaagggauuaaucuaugacacuacuuucaggagguuuauuuaccggcacuagaaacugcggugucuaauaaccacugguuccugaguucaaagcccacuaaguagagugaauaaucuuccacacaguuucauguguucccuuugucguuuuccacaugaagaccacuaucagcuggcagucugaagugccgaugugggagccaggcuccgucuccacuuccucuuuucuuugaaacguuuugauugucaugagagaauaaauuggguuagcaaguagggaugcacucagcucugcuucuccagcucguuuuggaauauuuuauucaaauuaaaaguacuuagagggaagaaauaguacugcauucuuucugccugauucuggucucccucaguguggaaauuagggagggacuuguuauugccuauaguuuuuuuugacaaaacuauuucuuuggaaaaaucuuuaauuuuuucuucuaaguauguuuuauggggaugcaguagcuacaauucacuuuaucauaugcauuaagugcuuacaaauaguuugccuagcggcuguggucugccuaacuguaugugcgagguacuuucuaaaaaauauuaggaacucuaaaccauagcuuccacagaauggauucuaaguugccucgaaauggauacugcaugcuccaucccaaaucauagugcaggacucaguauacuaaaaugugggcagaaaacacccauuuucccauaggcuacuuugcauaagguuguaauggaugacgucaguccacuucacauuuccguacaugcgcaacaacauacuaaauuuuuccuccaaguaacccauguccugugugagccuaguaggagagccuagacugguaauuuucaguuauucgcuuugucacuauaaagcagucaaaaacaauuucuacuucugaaugguuuuagcuguuugagacauguagcccaggcuagccuggaacucaugcuucuccggggcuuuggagaaugauuuuugaaaccucaggaucauuuucaccacuugaagucccaagguucuuagaaaaucacuuugugacguaagaacaaaugcuuuugccauuuacaaacuuuuaaaguuucaaauagaacuucccaggcagccuuuagggaagccguguaaacacaugucccuaaggcccauuaaauuauauagucuuccacggugucugugcaguauuugccacagcagggaaagaauuugggaugcuguguaugccugggugagccugugugagcgugugugugugugugugugugugugugugugugugugugugugugugugugugugucuauacaggugagccucuucaaggacguuggagcuggagcaggguuugagggcuucaaacucagcuauggguggcuggcuuuuucuuuguagcucuggcugugaagugauuuaugggagcuguaugggccauacaucaccuuccugguugccuuuggugacaccuugucacauucuugugggccugaggaauucauuguucuuguuugaacugauaagaaagagagagagagaggggggggguugggggugggggagagggagagagaacuacaacaacaacauaaaaacaggguugggggagaaagaaagaguuaguuagagacuuucugaacaaaccccugggaaaagacaaaguggcaggcagcugacccggggagacuugugucuccugcaguucugccucaaguugcaggaagcugugguggacugagucuagcugaagcuuugucugcccuccagagauauuucuuuuuugcugggagguuuuccucagaggacauuggagagggcagagagggagggaguggcuuucuucaagaccagcagauagaauggcugagcagggcuugcaaagcaaggucgaaugacacaggucucugggaagacuaaaacucagggcuguaacuuuugaugugagccgguuccugcaacguucgcucagcacuccagcgugcuuuuugggcacagcgccauguugcccucuccccuuugacguguagggccccgggcuccacuuuguauuuuggcagucugcauacagaggcugggguuugaguccagugcuuugaaagacaaggaagaggagaacgguuuuggcguggggacuggccaaaaguuuguguguaauguuuucagauggucuuaucucccacgucaguaaagcaagugaaugaugcaucuggauuuuuagaucuccucccugauaucuuuucuuuaaagaggaaaaaagauuacauucuuugcaccugagaaaaguaacagaucagaucaugugugccacaucggaggaacuggaaagccucccgcguccuuuggggacaauggcuguuuuuguucaaggcagugaugcgcaacugugccacucauacucugucauggggcuuguugauuggaagaauaaccuacuuacaaggcgcccccuauggcaaggcacugccccaccccgguuuagcagugagggauuugcguagcagguacccuuuuguguuacauuguuacaaguccaugugguguuacacuguaaacaaguccgugugguguuacacuguaaacaaguccgguuuuaaugccguaaaucacuucaccuggaagcagccuucccaugcccugcccaugcacaccuccauuugaacuccagccauugaaagccagguuuagucuuccagaaauggaucuuuuuuugcaacaguguugccuccaguccuguacgcacugcuuuaccauucaucccccaagguuuccuugugcugucagcaaaggaugcaggaagaucugcaaagguaggugcuggggaagucaagagcagccauuaggugauccugaauacaaaugagagaacacuguaguaaaugggcaggcagccuugugagauggcagaauuaaaagagaaagccacuuucagaaaaacacuucuuucccuuccaauuaucuuccuuauuuccaagggacauuaauagguaacuaccuaaauauaugugaugauguaauaauuccagugcauuaauuguauguguguguagguaucuacuuuuuagaucuguaaaugcaauugcuuugugagucugcuaggccugcugguucuacuuugguggggcaccuagcuugcagucuccuguggugcuucacugcucucugcuggagaagcccaugccagcccaggcauugaggguggauggcugugaaggaacacaggugugaugacuugccugcgagucucccagccucugcguuuaaauucagugcaagauuuuuuuuccccaugccaaucaggaacuguaaggcuccagucauguuguucaggcuggaagauacaacugcaaaaccauccagacuucagccucuuccugcaaacguugcccuccacaaaaguauccuggguaauagugcacagagucugugggguuucucaaguuauuuccuuucauucccgacacaggagaauaauuuauucuguucuauacaucuacaucaauaaccuauaucaauaaucccaacuccaagggaaagucaagcucuuuugaauaaaugauauuaugcuugauauauauauauauauauauauauauauauauauauauauauauauauaugauccagagaaaauggaccaagaguauuaacuaaauaagcauaaagcauguuaggacauguuuccuccagacuuuuccaaggaggaauaaauauuaacuuaaacccucauuugcauggauaaaaauugccauaauuuagaagcuacacuucucaaguuugaaacaaaagcccaaauacaaaaaccacuaaaugucuuagaggacuaucauuucagauauaaguucagugugcauauagauuuguuuaugcacauggugcguguccacacauacacacauguccacaucuagguauuucgaugggaacucggagugaagcuguaaacuuuaacacaucuccagaauguuuuaugcucuggaaucucuucacaugaaaacaauuugaugaguagaaaucauaaaagccagccucccaacgcaauuagugcgacuccauuccucagcauuccaagugaauuauugcugcgcugucaaagacaacaaaaacauuugggaaggacuguuuauuuuacagcgguugaccaaaaguaugcaagugguuacaaaaaaaaguagccagcuaaaguugggaggugccacucacacauccugaaauccauucacagagcuuugacagucacuccuggucacugcagaauaagaucccaggaagauucguuuuccagaggaaaaauggacucagccgcagagcauuucaguccagagcagauugcuaagaccucugcccacuguccuguggcacugccuucucgccucacuccuaagacuuccugguucaguuaguucucccuuuguuugguugguuuuguuguuauuuugcuugccuuuuuccaaaagagcuaggaaaacgguuugaaaacuaucuuguuacuacuguuguucugggagagccugagcugcccuugguauuuaaagguuaaaaggaaggccgccgcugacaaucucauucaacucuugaguucaaauaguucaucucagaacuaagugggaaaauagaaaguuuaauaaacauuaaggauaagaaaauguaagcuuagagaggauccaaggcuugaauagggugucagacauggcuguaugaaaggacuggccagaaauaggagagagagagagagagagagaggcgcgcucacacauacacacacacacacacacacacacagagggguugggggagaaauaugaaugaauauguagccugagaguucugagaguuggacaaucuccaaguucucauuggagaauaugaaaugaguuuuccuugaugagaagacauuguuccaagacucugaaucuugaggccaagguuucuuuuacuuuaaaaccaaaaacaaaaccaucagguuuggggcuuuguggcagcucauucauugcacuucugagaagugauauuaauccuaacugccuccguguaguguagccuuuccacacugauguuuggcgugaucuaacaucacccaguaaauauugaugacagcauuccuuuuaaagccacgcuccugcauuugguaauuuccauacaguuccacacaaacauagcugguuuucuuguuggucugggaguuugggaugguaccaagucucugccguguauuacuagggcaguggacccguuuugaagaugcuacgggcauccaacgcuuugccuucggaggguagacagggaaaaggaggaaucaggcgagcaccgauggccucuuccaaccuauuuccacagcuucuccuugucccagccuguucccaguuugcaaguuuuggguucucuucgugcaagagacaguugucccuguuccucauuccucggugcagauguuguuguuugugccuccugagucacagagccuugucauucccuucgccuucucucuuucugcaguguuaaucacguguuugcuggccaggcuaugcaaauaacgcuuggcuaaaaacauuuaaaggauuaugaagcaaucuuccuuaauuguagcgaaacaaaacaaaacacaacaccacucccaccgauccuccgcugaacaauccaguuaggauuggaacaguccagaccucagccuuguccuaggccacgggagaggcagggaggggaaggaaccgggaauccgcuccauauccgggacuccuucacagagcucguaaggguacagccacccucccucguuccuuccugcaacuguagccuuucccucggcccagacauggcuugagggcagcgucuggcagggcugguucugcagccuacucggagguccaggcugugagguuuggauguggcuuuugcugaucgguauuuccaucuccugucccugggcggucagcugcuggcauggaaccacagagccucauucccucccaguaaucagccugucaccaaagccgucuucucugcccagagggaagcgggcacagaccccgccgaugacugcaugcccaacgcaaccuuugcagcgagcugagccuaaggcgugcccgcgcuucuguggcucccgggagaauccugcugcuaguugcgcagucgugccaguuggccccugcacacccuuuugguucauacugaaacggccagcaguucggggaaggaggaagccucugcggcuccgcuaugccgcuggcugccaggauugugucuguacuggguccagcagcagaaacaaaacagggcagagcccgggguggcccccgcuagagcagcugagcacucaaaacaaagccgcccucucugaggguagcugcagcaggcuccaagccugaggcuggaagagaaccuggagcaugguugaaucuucccaagguugggaaacugaggcccagagaaggcacaucuggguagccgcccaacuuggaguaaaaauggcuccaucuuuacuaauguuaaguuuuaauaggccgguugauaaggauucaguaaccuugacagagugcuuuaauccauucauaucucauaucuuuauaucucaucuggaagauggggagccagucauaguuuuuaagggucguauggacugaaugagaaaguguaaacaaagaagguggcauugugcccaucacuggagccuccggucagcguugcuggguccccaguaagacuugaguuugcuuugcagguguaacaagaagggcagggaauuguuaaguauccgcucaguuaaaagagguuuucuaagacagaguagcguuuuuuuauucccccacccccuuaaggaauacguuucaauugagaucacagugacugggcaggcaagauagcuuaauugguaaaggugcuugccuccaaaccaaaugacccaaguucaguccccugagccuauguaauagaggcuguccucugaccuccucacauaugagcugcagugacugcaugccuggugccuacuuguuuccaugaagaacccagcuugaaguaggaggacacagguaaacaacagugucuguguucagacuucucccguucaaugauggcgccuaggaguuuccaaaguucaaguucaaagugauauuuagauagaaaacacuuccuugaggauggaaggauuguccuagggguagaagaugaagaucaagguggacaauggugaauaauaguaccuuaggacaaaacgcuauugcuaauacaaauuuugucuccuuggggauaaggacugcguagacauaagaaacuuaauccccuggcucucagaguguuuugucucucagaaaccaaccugugacuuguugaauacugaucaauguaacagcaucggauauaucgucagcccucccuggaugccaggcauuguacgagggcuuuacuguagcucacuggaugucuacagcccagugagacgcccugacgggaaggaaggcagggcuuuagcgguucaguaacuuaaggagaagcugggggggggguguguuaaccagugaguacccugugcucucagccccugugcuacauccugguugccucuuaaucucugccuuuuuucuaagugugacauagaugaauacuucugcacccugguuuuuguuuuuguuuuuuuguuguuuuuuuguuuuguuuuguuuuguuuuuuuugucaccugugaauuaaaggcugggugcccuuauugccagggauaccuucaaaacuguaaauauuuccagcuacagcgcaaugaacaauggccagucuuguuuguucuugcuuucaagcaguuucucagacucuggcuuuguuguccaggcuacuugcccccauggaaucaauaacacuguccauaauggcuguugaggccaguaaguucguucguauguaaaguggcucacagugcaccuggagcagaaaugcugaccuaaagcaucaaccacuuguggcuuccaaaugggaauuuucuuccaguggugucaaauacaaacagagcaagccuucugggauuggauuucuagaugcugccaauguauaauuugcccccuuucuucugucuguaccaugaauucuauuugcauugagagucaucuuuuuuuuuuuuuaaugaaguguguauguuucucuaucuucccuucuggcccuaugggaaauuuaguuuuguuuuaauuuaauugcaguuucuuaggauuuuuauccggaaaaaggguuuugcuuuugaaucguccuaugacgggucaaacugcauucauuggcuuuacugugucuuaauuacaaauucugccgcggaaauccguccucggguuuucucuccuggugcccagguugaagcgagccagccaugcuuuccaggcagcugugaugacucguggaguuuucaaugacaucacgagauacacaguucagagacacaagagucuguuguucugcucuuuuggccgcagagcacaguucucccugggaacuguagccacaguacugggcuugaguuuuuauuaauauccuuguagauugaaaacaaaauauuuuccuccgagcuuucauucucuuccaucuggcaaaugcugcgauuugucacaugagccgaugugugucucauucccuuguuugccugugcccuggucucuggaagguguaugcuccuggggaauaagugagauggcuggaauuugcaaggcuggcugccccuuccauauuuuccugccucaagucacaauaacagaaauaauaagaacaguggugacuaacaguacauuuucaaaaccccguggucggguaaugucaaguugcgugccacaagacuacccuuguugaaggggagucccuggauugcauugauuaagaaaaagaccagauucuuaagcauggguggcacguguaccccauggcuguuguguaagcagcaugcaacaugaaagggugacccguggagaagcuggggugcugagccaggguugcaaagguugcucuuaggcuguuuccgacugacuuguccguugaggugaaggcucucaggcucccuuugucccuccugccaucaucuuguucaggcugcuguggguagguccacacaacagcugcuucuguguucccuucagcuccuucguccauccuguaucuguuagaagggagauccucucaauccaccuuucuugcagggcaucaguuggcuacaagacaacauagaggucacaggaggggauguggauucaaacccaacucgggcauguggcugaauucacgguguuacgugugugugugugugugugugugugugugugugugugugugugugugagcagugcaggucagagggcagucugcagggaucgagucucuccuuccgucaugugggcucugggacuugucugacagacucaaauugucagaguugggagcaagagccuuuacccacggagcgccucacugacccugcucauuaacaucuuucugaaacagggucucaucuuuucacaucaaguugacuagguuggcccugaguuccagccuaggcugaccuugaacuugugaucuuccugccagguuguaccacucagucccauacuucauauuuguaucugucacaugacuuugagaauucugauagguaguuggguagucaagauuucucucauuuggauuuuuuuuuuaagucuuauuuauuuauuuaauguguauggauguuuugccugcaugcaugucugugcacuacauucuugcuuggugccuacaggugccagaagagggugucagacccccaggaaucucacagagcuacguaugguuuugagccacuguguagguacugggacuagaacccuggucuucuggacggucagccacugagccaucuuccuaggccccuaggucauuuggauuuugcuaaaauuugguggaaugaacacaggauuauuaucauccccccaagucccccugccaaaaaagaacuuuuuuaaaaaaagaaauuauuauuuuuuuuuauuaugaguacacuguggcugucuucagacacaccagaagagggcaucagauucuauuacagaugguugugagccaccaugugguugcugggaauugaacucaagaccucuggaagagcagucaauccauaugcccucccccaccgcacccccccucccccaagaaaaagaauuuauaccacaagcuuccagugugguucugcacuucuugcuaggacagagcaauggaugcucagagcugcuguaguucacaggaggcucaugaugcaaccggcauacuacuaacauaguaaacacgcauccuaaucagugagaguucaaacaugcacaccucuggauagaagcagaugggcuggagagagagagagagagagagagagagagagagagagagacgcuucuggucugaggaugcuaugaaacauaguacugaaggccagcggggaguggggcagaggacugcagcugacagagcggcaggcccaucagccugugacuuuagagccguggguagguggcuguugacaaaccugaguugggaaguggauuaggucaugggaaagcacauaccgggccucuugugaggauuuguuuccuuugagaaaucccaugagauaagcguugccaucagccucauccuacuguugaaagaagcaagacacagagaugaagucaccgauggccaacagcaacagcgcaggcagggcagcugggcgucagagggguccuguuuuaccaccugcuucuauguucucgacccacuucuguggccagucacccuggaaacuuccucugcucuccccucuaaaggaaauccaaaugaccuuucucauucuguucuaccuacauuuauuuuuuucauaaucaucacaauagguaaggcuucacagagcaguggcaucaccaagucacagaggcgggaagaaacaaaucccugugggcugguuuuagcuacgaaucaacuuaguccagggagaguugcccaaauaccacccucccaaauauguugcagacuuaguaguuaucaggcauaggguacaacugaaauagugaacuuaaaauaucuuacaaucuuaguaaucucagcuccccuaggauagaaaccauaguuuacacaucucuggguacccagcccuuagcaaagccugagauguccuugcuguauaacugauguuuguugggugaagugggcagaauauguucguaggcgugggcuagaguccuuacauaauccuuccuauucuuuuaggaacauguucuuaugacuuggucaaugggaaagagcaaagcuaacaucuggugucguuccaaauuaguacauuucuaacauucugugugaaacauagaccuugggguagggugaugggggcggggugggggugacggggaacagcuguaucacacagcugucucaaaggaggcacaugggccaucauuuuuccauacuuccacacagauuuuugcccucgugcagaauagaaauacugaguuucuccccagcucaggcugcgguggguagguccacacaacuguugcuucuguguuuccuucagcuccuucaucugcccuuugcuucuuucugauguaaacacugcuuugaugccaaacccuaggaccuaacaggccuuuuagaaaggcugggauaaacaggcauuguaacuccagagagcaucccagguucacuauucaugucugccuccugaggcuccacauagugccaggcuuacagaagacucacagaaaacuggcaagccaucugcaguuaaccacagcaauaaacgaauacagaggaaacccgugguaaggacaggauaaaccgugaguggcuccaucagaagugauucaccaugugaaaaaaagaaaaaaaggacaauauuuuucuccauacacuccugguuuccauggugaccccggaguagcauuuggggugacaauaaggcuuaagaaugguucugugacaaggacuguggaggaaugacccugugauuguucaucugggugacagauacuugccaacauaugguaugucccguugaaagagguacccuaaaccuguaggcagcccaagauggucaaaggacuugacagauguuccaacugugagcugaugaaucaggaguacagucgagauagguaagaugccuggauaggucagaguuccagcccucuccgccucucuuugcugugggccugcugcaugucacgugucaggccucaguauccccaccgaaagucgguggcgauuccccugauagagguaucaggagaauucaaugauuugaguuucaggaacccaaucccgugccagccugacagagacaaccuucccgguucggcaacccgcuuucugcgcaucucauccucucugcuacuguuucucugccccaucucucaauugucccucgccccugucagaucagccguuuauaagaaugcgccuccgugucuccugacuggggagccgggagcaaagggcucugugccucuccaccaguacucacgaugauggucuuggcuaagggacaggagcugcuggcagagaccuaagagggaacacacugugguagcagcaugaaagaauuuggcaaggaggggcucaucacaugaucgugauucauacuguacucuugaaauguggcuggcgagcuagggggaggcuuugaauggcagcccggagcagagacacuaguuuucaaacaucacauucuuuuuauaguacaggcaugccucacagggaaaauauugaacuuggcccugccagcaccacgagagucgcccugagugugauuuuuuuuuuuaaauguuugagucguucucuguaucagauacucacugcauagaggaagucuucuauuagggguacuuugaaacuguguuuuuaauuaauuaacacuaacucugagcugguauuucauauauuguuagcugacucuuucuucccucccucucucucucucucucucucucucucucucuuucuuucuuucuuuuuuucuuuuccuuucccuuccuuucuuucuuucuuucuuucuuucuuucuuucuuucuuucuuucuuucuuucuuccuuccuuccuuccuuccuuccuuccuuccuuccucucucucucucucucucucucucucucucucuuucuuucuuucuuucuuucuuucuucuuucuccccuugccugaaauucuggagacaguuuuucagagacauuggucucagcuggauuaauuuuaaguuaucuccgugagcgagucaucgauaugggguaacagagcccgggaacucuucaaaguggggcugguugucuuggaaugaaccugauauacaugggaacaggguagcuagggccuagagggucucugaaagucuggcauaauacuuuccgaugccuuccacggugcuccaaauccauucauccuguuguuaaaacuuaaaacuaggaccggccagcuguugggaaaaguccuuaguuuuauuuccaccaaauggugcugccuccuggggcuggaaggagucugacuuuaagcacaauuauaaauguguaguucuucgggacgggcggaaaccuacaaaauggccuugauucccaaggcucaaaggcucucugcuucccgugcgccauaaaucaguaucugcaucagaaaguguaaagaccacaguguguggaggcccuucuuccucuucgagugugucuaugacagauuuauacugauggcuccgcugcaccccacucccaggcuccuauuauagccaugccccacugacucaggccccauuuccugcugaaggugaggcagggucccugcacgaaggguugaaauuacaucucaacucuuuaauugcuguuaauacagggaaucuuucaaggaccguagcaagccccgcucuguucacagccacuuugacugucuucucacaagguguggucacaacuaaaauaccaggcauuugguuucaugacaaguuccuuggugacagggcagcccacaauucaacccuuuguggaaagagcucaaagggauguuuugggaaagaacacagccuccucuuuuguuguaagauucauuuccuccauguguuuuuaaauuuuuuuuccuccuugaaaguacaagccuaacacuuggaaaaauaaucuuuaaaaaaaauaaaaauaaaagguagcauuaaaauuugcaguuggagagacggcuccgaggucaggagagacggcuccgaggucaggagugcuugcuguuguugaaagcuccaguuaaauuuccagcaccuacaugcuggcucacagccaucccuaacuccaauuccagaggauucuacggccucuucugaccucugccuacacugggcaugcaggcacgcacgcaggcacauggugcacacgcacaccucaugcaaaaugcucuuacacguaaaacaagguaaaucuaaaaaaccauuuuuaauccuuuuuggauuaucuguaaaguaggauuugucuucaaaacauccuucucuccugaggcuuucguucuugcaaagguggcagggucacaaacuaguggcucccaaagaccccagcagucaggaugagacucaacaaaagucccagaguagugaugccuacagagaacugcaaaccaaagccccuccaggggauaagggauagaaggcaucuggucuccuuugacaacgaugaaccaaaaggugagcgauuaagaugcgagugguucaagucuucaaaaaggaaauaaauacaacgccuaacgcagagucccuucucacaaggcgggcagcuaguuuaggcccuugugcgagguuuugcccagaauuggcaaaccaaaccaaaccaaaccaaaccaaaccaaaccauuuacaaacaucucacuagcuaaagugcuaucuaugauguaaucuuaguugaguuuugaagacuuguaguauuuauuaaagugaucucaaaauauaaaaacacacguacauaaugauaccuaguguccguccuuccuuccuuccuuccuuccuuccuuccuuccuuccucccucccucucccucccucccucccuccuucuuugccuuccuuccuuccuuccuuccuuccucccucccucccucccuuccuuccucccucccucccucccucccccucccucccucccucccucccuccuucuuugccuuucuuucuuccuuccuuccuuccuuccuuccuuccuuccuuccuuccuuucuuccuuuuugacuuuucaauucauauuauuucuauuuuccaacuuagccugagccugguguaccccuggugaugguaaugguauaaggguaccugcauuuacuucagcaugcuaaggacccagacuuaaauaggaaaucagauugccggcugcaaagccuagguuuaaaacucuaaccgucugcugcggcguuugugaacgagggaucuggcgaacgagaguuaugugugugugugugguuuguuuuauuggcccugcauguuucuuugaugauccauuuuccaagcuccuucuuaucuuuuaggagauguguucaggauuuaugccuuuggcaggcuuucagaggccuccggagugguggagagguacccuccauuuauaagguaucugaauuggggucauucugaacauuuacccucugcuguacuuaaaugccuuccuucucuggacguuucuuucaaauggauuuuucuuuuaugucggcaaaacuaaggguuuuauccuugaacacucuaguaauaaagcuauuucagcccagaccugggagggaauuuguuaaaugcauuaaagggguuugucagucguuuuccuaagccacuauugccugcugcagaaauauuguguucauuagcguuugcaaaacuucauguuuaauaauacaaagggcagacugagcgcucacucuuuuggugugcagauggauaaacguuauaggagcacacccccagguagagacuuauugggguaacucuuagaaagggcaaggguagccauaaacagggacacaauaaccccacaguucugugcacauggugauuugcaaggagagucugggagaaggguuuuauacgguuauauagcaaaccgugaagugaguacugagaaacacaacccaagguuugcaucuguuguguguaccccaaauagcauccuccuccgggucuguaauguaaauccacugguaccaguaaaaaggcauuuaaaacaaauaguaaaaugaaaggcauucacaaaguaauaaagauaccaccuuugcgagcccuuuccuauggauuugaaaaauguuagugaacgacucuccgaagauacaaauaaauaauauuuuauuagauuucagccggggagagaggggagggaaaccuucaacuagaauuacgugauuauuauugugcuuccucucagcccagcagacauuaaaauggaacauaaaauaagucuauaacaagaguuaugagcaaacguauugcacuuaggggcacacugugcagaaaagucauuaaaauuguuugggccuuaggaagcuggggaguggggggcguuggguggggggaguccuuuucugaaaaaugagaaacucagauauacaaaguaacuugcugagggacuaccuaaaucuuguuuuuaaaacaaacaaacaaacaacaaacggaauugugugagguucugauucaccccucucacugcuagcugcuucccaccaaacaaaaccaagaguuuguuuuccugggcucgcagacugagugaggcacggcagcauucccauagaccugggccauuguacaggcaaaccaguguaagccuguuaugucugacugguguucuggguucugacucacaaacacugcucuugugcacagauguaaaguccagugcagcccccuccccuccuuuacccggcagucugccugcggauucucuuucugguugcuuauauguguuuggauggucgugauaguucagcacacucuuucuugcuuugucuacaaaugguuaaaacacccagucugcucuuacaugcccucccccacccccaccccucugcuuuccugcugguugcuuucaugucacgauaaaucucaguguacucugucaggaaagccgcucugugugugugugugugugugugugugugugugugugugugugugccuaucuguaaagcuuuaacucugguuuacuguuuaacuaggaggcucagcaggacaagggagaucuuacuaaggcuauauugcaacuaagaauggccaagguuaugcugugcuaucaaugggugcuuuggguagaaggucucugucauucaucuuuaucaggauuuuuuuuucucccuuccugggaggagguuaaaaggaauguuucaaggaggucuuugaaacccauuuucuucaaauguucacugcaucuaagaucccauuuuuguccuuuauuugcuucagcauaccaccaggcugccaacaaagaggggccugugugcccaggaauuuucugcauuccucucccgaguaggcauuucucucagcuagaaaggcccuuuggcaaauucccucuaaucauuggauuuacccuggguucugauaggugccauucauggaguuggucugcugguucauggggccgaggcauuaauggggucuuuucaugauaaacaaaaccuggguaacauuaccagaggaaucacaacgcgacuguuguuaggaggugacugugcauuccccgcccccucacccucaccccaacccccacccccaccucucucucucucucucucucucucuuucucucucucucucucauucuuccccuuagucuuuuuccccuccucuauuuuuacaaauauacauuuuugguuggguauucuguacgaccaucucuggaagcagaucuccugacccagcugccgccggcgagacgaucaccaaaucgcaggccucuguuggcaacaggaugauucuaaaacccauaccuaauaguuccacggccugcagggagaucugcauguuccuaaaggguugaacaucauuggaggaacgcagcacgaagccucugcuuuaugcgucuuaccucuguauucccugccauuuaacugcugggagaugcuuuguaguugagaugaacaagaguguggccucaggagcugcucagucagcuucgccauuggcugggcugccuguaucagacuucaccguccuugcucuggacaacauucauuccuguuucuuucucagaagaguggaaagcugauuaguuggaagcuggguucuacuguagugggggaacaaaacauaaaaaccggugaaaaauagucuucccauucgagauaauaugagaugcugcagcaucauuuuuugauggggguggggaagagccaguaccaugaaguagaacaugagugguugggcuuacauuuccaggaaaguguuauuucauuaauguuucuggggaggggggggguguaguucaaaguaggcuaaugguuauuuuuauuuuuaacauuuuuccccuuuuuguuuaauuuuugcuacuagagucccagacaaaaggacuuaaaaaaaaaaaguguugaagagcagaaaggcaggaagcacgaagaaaagaguuuaaaaauucaaagggaguguuaggucgacccaaugguauuuuggugggugcagaugcuaccacaccuacaugcugcaacguucccaccaguggcugaggcuaaccugcguuaacacggcuauuuccucgggaaccucauccuccuuguggcuaacaaacaucauggcagacccccuuugagcugacgugugacagugaugauguuuagagccccaaguccuugucuagguaaguuuuuaaauacacagaugugcgaggcacaggggagaacauggcuuucuuccauagaguaguuuugcugauugucuuucuggcuuuuaaguuuuggcgaauacuguugccguaauuugcguaguauaggcgacuguaaaccauggacuuaguguuagcaucugcucuccaugaaaauuaguuauccauccaccucaacagacucagggaguagcuaaagaguccugcagaacuaaguuauaccaaguccuggaaaggugcuagggagaacauuauuuaccuucccugggggaucacauuugaaagucucuuuaucauuuacuacuugaaaugucacacucugggcuaauggauguacuugauggcugucccucaaaggcuucacuuuugcuuccacgcaugguaauccccgugcggcaauuuucacauauguuaaauguccaaccccgauucucacccguugucuuccuagccagccugcaaaauaacauuuggguuauuuccaaguuaacagcgaggacaguggagcccccggcacuagguauugaaagagcuuggaugcuacauuacaauccugcuuggcaaaugauuucgguuuuaaguuucuaagucagguuccauauagaucaucugugagaacuuaaaaguuuuucuucagccuccaaauauuuccaacuauucuugguaguuuacgguccacuggagaucaagcccuuuucaauguuuauauauucugcauuguaucuacauuuugaagggacuccccccccccccaugacuucuuuuuagcauaucaggcagagggaguggugcaugcuuuugugugugugcgcgcgcgccccugaagaaaacaugaaguauuuucuucuauugcuccuugccuuguuuuaaaaacaggacugcucacugaaugugcuggcuguuugggcuauguuggcagccuggugagugauuugacucuucccgucucucucuaccacuuccucugccgucacuggagucauaggcagcugcggcuauauccgguuucucaugugggugguggagauuugaacucaaguccucuaacuuucacaggaaauucucuuacccgcugagccaucuccccaacacccaugacgggucugcuccgcacgugugcgcucuuuucuuucacgagacgcguacaccuuggaauaucuacugcccgauacgauucucgcaggguauuuucugaguuucuggaagccacgauagaggaaagggaguguuugcgcuuaucccgggaccagcagaguucagguguaaggcgucagggggggcaugcgccauguuuggggaugccgauuagagaacggccugguucacuacacaccgcgccuuaccgagccugaaccuucuaaagggaaacaauggcuuuauuccuggcuacagagaccccacugcacacugggaaggcucggaauuucugcuucauugugaauucuccaagucacauuguaaacgcgcccgcgcaccuacgcaacuacuuucaggaugcuuagaguuucugccacucgugaagucaaguaugauggcgguuguguaggaaagucuauuaacagugaaagugauuugggguuauuuuagucacuguucugccuuuucuaguuugugcuuuacuguauucugaacuacuauguguuauguucccuuucaauguguuggacccaaugagaauaauuagcagagcagacugucucgaggcauccguuucauugucacaccaaaggcaauaaauaagucagagauucaaccucgaggagagugaauaucuauugcaaaggggacuucuuagaucagcuuacagaggcaggcuggguaguacagugguggcuggcuuuacagagaagaauugcucaguugaggaggcuggguaccucagcaguacaaccucacagugaaggccuggaaaguucccagaggaccacuggacuucagucuaugcugcgaggcaggagaagcggcuuuguuaccuugcuugccagagauggauguggcagccagagcagcugcaacaggguagaugcgcucaccugcaaaggugggcaggcgaaggcauggcggaauuuccccagaccuuuuuacaguugugcgcugagaaguaacucugggcaaugcugcuucugcuaagccuucaaugaaacauucucacagccccgcccagagguguagcucuuaguugaucccagauucaaucaagccagcaaccaagacuaacuaacucucucagguaguugucuccaaacucuucuuccaagguguguauucaaguaagaggaggucuauuuccuaaucagaguuuauggaacuagagccuugaguagguuaggaaucagacccaugccguuucuuaugagcuuacuagguacuggauacaaagcgccaaagaggccugaguccggaccagggguuacagcuaaagcaaacaacacagucuugaggacuacaguuagcaauccugcuuuuccgaagucugggaaagacaaagaacagaauuagcuaagcuuuuauaauagaggcguuaguucuuaggcguuaguucagagacucauuaaauccacuucuaaagcuagcaacacccaaacuggccacagcuuaaggguguuuuguuuauuuguuggguuuugguuuugugucagagagcuaacuuagagccaguucuuaacauuucagaaaguuugugagcuugcugauaacauggucauuauucacauauugacauaucaauuuauaaugaaaucagguuaauuagaaaagcaauaggcagagcucauuguuucaaaguauguuucuguuuugcucucaguuccaaucugaggauucucuuguuugucacaucugucuggagaagacauuguaaguaggacgccugcugcccauuucucuccagcccuggccaguggugacagguuguaagaaugaaguccaccacaguuagaacauuuacaccucagacauuggcaaaugcugcugagagaacuuaguguuuuuugaagggcugucuaagaaagucccaggaacaucuuaaccaugccuguuaaacuguaacguugugcucauaucacaugcauugugaauggcauaaaagcaguuaggauuccuggagugaccaaagacucugcugugauuuagcaaaggagacacagcacugaugacuuaguaaacuucugacuuaauggcauuuugggguuuuuuuuuuuuuuuggagguuuuccuccuguuugguguuaauguguuaaaugcaaaauugucagcucuaguccauguuggaguuguacuaauuuguuaacgagaugagcuauuuauuuuuguugauuugaauaucagucaaacauuuuguuugugguauaauuuaugauguuauuauugguaaugggauuauggaaaauuaauagcaaauuccacgaauguggcaauuaacucugaugccacaagcacccagaauuuacuaaguauuaugcuuugcuauuuauaaaauguuugcacuccuucacaaaaccuacaauauacuuggcauaaaucuauaugugcacacacauuuauauuuccucccagagagccagguguuaaacauuuacuagauaacagaagacaauggaagccuacgaccugaauccauaaauccuucagaguucuuguugacucuagcuuuuguuccaaggacaccagcggagccuuugaaauauaaugaaaaccaugcauauggugaaaaugugaaaaugugcacgcacacagcggcacacacacauacauaaugaguguauaauauacacacaaugacauacauaagaugaacuauccacugguacacacagcagugcacauaccuacacacaaguguacaauaugugcauuuguauacuagugcacauagguguaugcacacacacacacaagugugugugggggcaggggcagcuccacaaaccuauucucauuuaggaaaaccuaccugaacugacauaucagaaauauacuggguauaaaaccaaguauuuuauggaaggccuccaaaaucauauuucaagaacagcucaaacugaugugaauuaacuuuucauaaaaagauuaucaauuuccugaugguuucuuucuauuucaaauggggucuuccuuauuuagccagacuaaccucaaauuccugacccuucugucuuggccucuggaguaccuccaauggccaguguucaucuuaauuguugaaagcgagcuguuuauuggacucugacuccacacaaucaagacacagcucuugcuuccagaucaaccccaaaugcuuaguuguaauauggaucagccgauuucgaaggugcuugguuuguuugucauuuauugcuuugcuuuguuuucccuguuauaaauaaauggcaagguaccaggcuggucucaguuuguuaagagaaguaagaugcugugaaggcugaugagagccugaaguuacaucccauagcacaggacaaugaggcaaaguggcuguuacacacuagauucuacacaagccccagucuucaaaaccaaucuuuuagaggccuucauguucgagauucuaauaucuucauuuucccauagaagcacagcuucuuacugguaaaauaugacagagaggagacccaagucucuaucacucugacuuaaaaaaaaaaaagaaagaaaaaaaaaacuuucuugcgaagaaagaaaaccucuuaaaaccucuuaaaaagaaaacaaacaaaaaaaaguuauauucuuuuguauguuaucauugaauacacauugggccuggggaaaugcuuuucaacaagugugagaacaaacccaagugacagcuggguggccagaucuuuuuccugugguagauagugcacugugagagcagcugcucagagacggggaaguggggcagacagcugugugugucugcaucuucuuacuuauauuuggauggagacaaccaugcuugcaucuccucucucauacagucgguuuuuuguuuuuuuguuuuguuuguuuguggacguacaucuugaugcuaugcugccucauuaucaaaaaagcacagcaugucguacgaagaauccaacgucucccucaacuucuguccccgugcacacugucagugugccguuucccgguagccguucaaaacuguauagcuacguguuguagagugccguggucgucuaagucaggucgugugaucacagagagaggcuagaaagcaaugcuucgaguguacucacaucccucgaccucagcguuuguauccagaccucguuauuaaggcaagaggcacccgggugggaguuaucacaaugaaugccacuuauuuguuuuguauugucaucaacauuaaucuagacguuguuuuaucucuuucccuacaaaccccagaguuuggaaacaguggcuuugcugauuaaaaaacaaaacaccugaaacuugugccacuucaguaaagcaaugcccaagaccaugacaccacacugaacacauacaucuaugguugacguguacuacacaagaaaggaaaagagaggguuuccuuuccuuuccuuuuuuccuuuuccuuuuccuuuuccuuuuccuuuuccuuuuccuuuuccuuuuccuuuuccuuuuccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccuuucccucuccucuccucuccucuccucuccucuccuccccuccccuccucuccucuccucuccucuccucuccucuccucuccucuuucuuucuuucuuucuuucuuucuuucuuucuugucauuuucuuuucaugcacauaaauugcagcacacugcuaacagcaaaaaucaaugauccaagcuggggaaaguaggugucucguagaacaggcuggaaagagcguucacagaaaugagcauguucacguggcuaaggcgggcagggcagaacaugggccccugguuaagaugucagagugaauaucuuuuaggucaaagguaagcgcacuguuucuggcagcccugucacucugcacggguggaccuagaagggucaucugccuuccagugacaaugcuccuucauucuaagaaugaauauuggucaagucacagaaugcacaaaccuacaguugcgucacagcuccaagcagacugcgugcaggucacaaauccuguuccuuuuuguugcuguauuaaaauggggcucaccacugacugauucacucgaaugcucucugccuagaggagcuugguuuccuacuagaaaugaacagaggaugcucuauuuauuugaaggacggggagucacaauggccggcaacacuaaauuaaaaaaaaaaaaaaaaaaaggacccauccuccagugauaauugcaaguagucaugacaucucuauaaggcaugaagccccuguaaggcgugaagccccacuuauucgucuagaacuuucuauccuuaacucugucuggcaagaaggcgcugggcuagagcagcgccuauauacaaugacaagucggagagacuuuguccaaggucacagaacuggcgggcugagaggccuggaggacggucugaacugagagccuucuaccagucugucagugugcuggugagcaaagccacacuguagauuccgauuuacacucauuuuccuguggccggcuguggggcauuucauuuaaaaagacuucuggugccaaccacagcucccuagucaaaccuucccuuucaauguauggcugugccuucauccuaauuuucuagccagaagcaucuagagucuagacagcagggccagccccagcacuccauucaauagcugggucuuugcuguuguuguuguugauguucuaaccuuauagucguuaaauguuacucuuuuauaggcaaaacaaaguacagagaggaucaucugacaugccuagcuuauugcucaaaugauucugaaugacgccguccauucaaaguuucaaccaucauuuugauauuuuggggauucgcuuaucugcuagucugacggcgccagugauuuaucuugauugguuauauauaacucuguagcagagucagcuguuuuuuggacaaguuaugagcuaaaauagcaucuuuuucuuuuuuuacguuuuaaguagggguggugacauagucagugucagagugccuaucuguccagcauguguaaggccuuggggcuuguacaucaucucuuuaccucaacugcagaugaaccagcucauauagcagaccuugaaaugaaugcccuacccuuucuuagagaauuggcuuucugaugguuuggggaaaaaaugauaaaaugacuaguauguagauguauacaugaugggaugaaccauaaacauuaagauggacaucuauuauuauauauaacuagcaauucugaaguauuccguuagaccaaacagcauugcucauccuguuuguauaaagugccugggcaccgucccugucuuaggcuuuggucugugugccgaaaccuuucuuuaccuuuuuuuuuuuuucuuuuuuucuucaccaagcuuucuggcaccaugcucuaggugugaacuacuuguuuuuagaaaccaaaccagggaacgaaauauuguuacugauguaaggcauugcuuacacauuagcauagcuuuccgaccugaaagauagggaaaauaaauaaauagaaguuaaacaguaaaguagcucauuucaaagcccacacacacacacacacacacacgucgugagcacacugguccuugccuacaguuguuccuagaauauccgcagagagucaguaauguggguggacauguuugcucaucccuagucacacacagaacuguuagcacucacaguuagaguauuuuucguuaaaaguccacuuucccgggaggauucauaaaaaaacacaaggauuaaaauguaauuuucucuuaauccuacugcucaaaggaagucagagauaauauuuuaguauacauuuuucagcuaugaaguaaagaacuuugguucacaccgugcaauagggaaccgaacucauucagaaaaaucugcauuucacguuacauggaacuuggcauuugaccuuuuacauuuccuguuuuaguguaugcacaucccaccucaugugauacucauuuaagaaacuauagcaucccagcaauaguucacuuaagacagugaacaagcuguuguaacccucagccagagccuuccuuaccaaagagcugaugcuaugaauaccagucauagccuagccgccacuccauauguuaaucuaauuugacaggguaagaggcuuugaaguccuaauucucuuuugcauccaauaaaccaguuuuuauagugacugaacuuuuuagacaucagcccgaggcuaaucucaugucaggaagucgccauaaggucacauguaacgauggcuagagggagcuuucagcuuuccuuuggaagucuugugagcgaugcaggcggacugucagcggguugcauggggggacaggggucagugccucugaagauagcaucuugcaggcauacagauuguugcugucuugcacaugcccucaaaagaccuuuccuacacaagugggcccacagaagcucagcgagucguuacugaguguuuauauacaucucugugcuauuauuagugggcucuguggcuuuugcagggaauaauauaggcagagcacucuugguaaguuucggaugguuuggcuucuuauauuucaaugagaaggcaacuccaggcucccauuagcauuucgauucagaguuaugaggugguucaacuaaaaaaaaucccguucuuugaggguacuuuuuguuugauguugauuacauuggugguccuggcuaaggggcaagugugggaaaaagggaagggcauucaagaagaccccaaaugacaaacuauguuagacauccaguucuguagaguaagggcuuuacguuuucuuuuguuuagacuguaaguucuuugaaggcagaaaauccuaucuauaagguauuauaggcuuagggugaaaauccauugucuaaagccaguccaguugaccaacaucagaugagaguguugugauggcugggcgcauuaaagaucagggaucuugucaacuugaguuucccucacagucacugaugaacuaaaacaugccaggacccaggcagugcuaacuagcacuuuccugugcggcuaccaaggcaggagcagagaugacugaauggaguaccaggauucugucuuugagaaaaggagaaagauucacaucggggagucccaagccuuagagucuucaucccaguuaggguagcacuccgcacuuaauaaccaccgguggggaugcuaccaaaacuaaaagagccucuguagcccuccuuggaauacuuuggugaguucuuuaugaaagacuguaguuugggaacaaagagcagaaaauuaaaguggcaagacagcauuuaggggaauugguuauuaacaggaaucuauuggacccguacgcacuuauuuacucucccucucuccuaaggauguuacuagguaacaaucaugcugugacccgaugguucucccgugugguaggcaugggauuaaacagcugcucugaauaguaacaauguaacaauuaacaaugcaauccuuuccaacacaguuccccaucuuuuuucugcuuucugggucuaagugcuacuucagcaguccaauuagcuucuguuaucagaggaagccugcugcuccucuacccaaugucucgauucuuacgaucuuaagcgaaaccggugcuguaucugcagucugccgauauuagagugcuuaaaggaauugaaaugcuuuacuuuauagaggugcuuaaaaaaaaaaagccagauuaaacagucacgcaaaguaaaauuugguauaguuuuggaagaacuugcuuuauuuuauagugaaauaugauguaauauaaaagcacuguuuggguuaccagaaccuugccuucacguugcucuauguaagaauggaaaccugcguccagacuguggaugcucccaggugagcggcacccccagggcugugccacaagucagcccuuucuuugcugggccaucucagagauacaguguuucccuguucauucucucuguucucucauuggucucggccauacauucaagugucuuuggucuuuaccaccacuuuaaauuuuuguucucgugccuuacauaugggauauguccccagcauccuuucuucuuugucuucuacuucacuguauauagaaauacucugaugugccacuuccuuguagccucucucuugucugauaggaggcgcucugcuuugcuguuuauuagcucucugauccauaggaggcgcucuucugugcugcauacaugucugccucugucuagaaagaacucuucaucuucagcaacuucucugggacuuacuggagacuuacuauuauuauuauuauuauuauuauuauuauuauuauuauuauuauuaccaucauaauuucaauaggaguuuauucuguuuuccaaauagccaauuuacaaaggaccuaacuucugaaacacaacuccuuacgcagauggaggacuuccggcaacaagaucaaacucuagcaagagucuuuuuguuacagagcuaaucuugauauacugcagccccaccugaauuccacuguaauugccuuuacaacacauauccugccaucagcucugaaagguuucucucuagacacauuugcuggcuuugcuuccuuucuagggagcuguagcuuuacaaacuccuagagguuuucuuacuuuuaaacuguugaucuaauuuuuaaaagugaauaaaggagguuaacuuuaauuuguugguguacuacccuuaguaaucguguuaguaacuaaaucauuuuaacuccaaaauguacauucaagccuucuguuugucugcacauuaaucccauaccuguauaagccacaauacuuuccaaagcucacaucaaaguaauuguuuugccuggcgccaguacaaauuucugcugggaccugccccauuuaauauaaauuauauuaccuguggcauuuaagaggguguaaggugugcugugccccacaggcaggaaauuuaaacuauggauugauuuuuuuuuuuccaaucucagauguguuccucuuaugcagaauauuuagcgucccuaguuuucuguuuaaucuuucuacaggcaucuuuugaauuuugccuucacaggcaagacaaauucaaauuuucucacaucccuuuuuaggcuaagagugacaaauucucaugugagggaaaaacuuuagaaaaggaaggaagagaagggggguaguggaagagggagaggggugaagguaaugacauaaaaauggggcuccuugacccaauuaaccaaaucacugugcuucuagcaugaagucaugccucugcuuuguccacauagacgucauacugaaguacagcauccaugagcagagacucagagacagaauugugugcaaguccauucagcacagcgguauacccuaugguagguccaagacguuagccuccacaucugugguagaacaugcgaucacucagcguugggccggaaagccucaacccuucucaugaguucacauucccuagacucgccgugugacuccucuguagcccacugagguccuuugguuggagacuguacauguugcauuuugggcauugauggugaagucuauccacacucaguaggacaaagaaaaggguaaauuaaaguuacagcagagaguagaggauaugugagaaugggcagaaaggaagaagagacagggaaauggaaagagaucacaggaggaggcuaggggagcuauaucaguaaacacacucgccucaccuggccuccuuggugucuagagacuccuuuuuccacagcuuucccuuuuguuaaagaugaaggcugcggagccgcuguucucuggguucauuaaauuuggaagcuccgaauucaaugcucaaguuucugaaauacagacuaggcguagcagugacaagucacugaaugucagcagcagggggaacugcuugguaauuuucucuagaccccuauucucuuccucaguggagccccuacagacuucaggaauggccaguccuaggacguuaagacacagugcuguguccugacacacaacucaucagcauuucacucuuuucaguaaugugcgcuaaaauacagaaugggguuguuauaacuuuucuuaugugcaugaagcaguuugauugaauucaucccccuccccaacccccucgaacccuucauuuuagaacaacccucuguacacccaacacacuugggauauuugauaauuauagcauucaaggccaacuaaaguuacugaaaaugccuccgggccccacaguuggaugcagggacgauccgggucuugucacagaaaguagauauucaaaagcuggacuaacaaauguaccaaaucuacacuugacauuaaaguuagcuuuuagauuaaagaaugguuuaauaauggggcugguuguucugagaaucgggcuccugagaaccucucuagacuuccagccuuccccgaagcaggugauggagcagcuagcuuccacgaccuggucagaguggcuucucugcuggcacuccacuuggcagagguccaagggaaguugggcagugacagcacgaugagaacacaggagacaggcugggucacagucacacuaagcucugcaucugauucuccuauuaucuaagcauggccaacuccaugcuaaauaaugacagcuaacacuggcucuucccaaagacaagacuccaaagagcacugguucaucugaauugccaucaacagcaaauggaacucuguuuagcuucucgccugguuuccucugucacauuugugagggugaggucucuuacaugauaaagaauccccacauuucuccacacacacagacccagggcaucuuugagaaaacagugacacagaggaugguaaagguuugggauucacuauguguugcuguaugcuuauuaacaauuucaugcuucaaauuauuuuacgaucgugaccaaaggggaaugaggcaacugcagugcuaucuuguuacuaaagacuauguucugugggcuacagcacacacauggacauacaauacacagacacccauguauacacacauauacacacccaugcacauagguguauguaugcauagauacacaacacacacguguauauuuguaucuauacacauacaaauauauuguguauaugaucacauauauaugcgcauacacuacauacauguauguguacguauauacacauuuaggagcucucaugagcaggcuugcaaugcugauuccugaucuagucacucaguaagcucucuucucuucugaucauuguuaaagcccugaacaccccucuguucuuuuccucgacacccuccacagacgauucuaaaggcaagugacggauauuuaaauuauuuuuauuuguguucguaagcuaaaugagcuuuuuaaaaaauuaacaucaaagugaaauuggugcauuucuauauucaggaauuaguuuucugcaaagaacauuaauuuaaaacuuuucaacacagaaaaaaaaaaauagacccaacccugugaccucaucuguguuacauuugaauaaacgaaugaauaagcaaaugaaggaaagaauguucccuggaagccgaguagguuucaacaaagaacagagcucucagacauuguucucaguguguccaaaacucgucucauugguaugugugcaggaugacgucaguggccaggaugugggguucuucucuguggcucuguuccuugggauucuucauuguguuuaucagcucuucagccacccaaggaaacaaucuauagaauuacagucauucacguggauguuagaaaaaugagccaacauggugcgguugacaggcagccagcccucacagaguacuuggcagaauaggcuaaaauuccggggagggggacgggcagggaaauauuggguuugaaauccauucaaggacuucaaguuggaccucagcucugcugguuuuuagcuagaugguuccuuggcuugacugggucacagcuuucacaagccuugaaauguagacugucuuaggauaaugucugauauuuagugggacaccaugggccaauacaguguuugaaaugugaauguuauuaaaccuauguaaaagucaaguuuaaaaaaaaaauaacuauuuugagaguacaaaaaggcccucaagugcucaguuagccuuuaaaugcuuuaaugaguucuugcguggaagcaggaccauucuuaaauucucccuuuuaaaugaagauauagugugaaaauaucuuuggagaagcagguucuauaggcacaguuaguuacuccagacuuucucugggaauguuccagugugagugugugugugugugugugugugcacgugcgcacauguguaugugcauguauauguaugugugcauguauauauauaugugugcauguguaugugugcgugcaugcaugugugugugugugcauguguguacauguaugagucagggguuaguucaccugagguaucauuccccaagcguuguccaccuucuguuuugagacggucuccuaaugagaccugggcuugcugauucgguuagaaugguaaccugugagccucuccugccagggcuccuccugccucugcuucgccguugcuaagauuaccagcaugcaccucuauuguugcggauuauuucccagagaauacugcucugacuugaguguaagacaauagaacaucuuuauuagccagccaucgacuacacugggcgcucgggauggcaguauagcccugagccuucuuagggagugguuuuaagcacgaaaaccgucuucugaguugauggacuucaguuaacaagagccguuagccaggagaggaacuacagaagcuaaaauguaagguuaguacaguuuuggacuuucccagaacuauuauggacucugaugauugggccuuugaguucuggcaggcggggcugucuacagcugauuuuuauagccugaauggcacuuccaucccggagucauacaaaggucucagugacugcuaugagcugaggcucuguuaccagcuuuaugcggugcuugggguccaacucagccccuccugauugcauggaagaacguuaccaaaggagacagcucuaggcuagauggacuuacagcuucuguuucuauuugugaucacaauugccauuauggccgguccagccuuucuccaguugccccuuucccucaucaucuguccugguuugcgauuccaaggaagacuuccucuucucccuuuucucuugcccacuucuucauuuaauacucuccguguagggaaacuccucuuuuucucucuucugggucagccaucuugacuugcacaggaagaaaauuccacagcggcguucucuccucagcuacuaacuccagcgcaagggagccuucuggaaaggcagcuucucuuuuugcuguggcggcugaagcccguuuccuauucucuuucuucagagcagcuuucaaaacagcugguuaccauccuuuagguuaauccuuccuagacaguacuucaaaaucauuauaucauuuuccagucuuuuuuuguccaacaugaguuauagaacucccuuuagcuuuuucucacaaggcguaguauucagcccuuuaauaagcagcgugguauaauugaaagaauaugggcuucagagucagaccugagucugaaucagagucacauuacucacuggcugcuugaccccagucagagcccuuaacuuuccugaauggcaguuuccuugucugcuagguggggcuugaugagaacuaucuuacaggggccuugccagaaguucugaugcauguagcauuccuggcuugcucucaauauugugauaaauguugcuucccuuccuuccuccuccccuccuccuccuccuccccuccuccuccuccuccucuccuccucguccaggucaguuuccuacauuacaggcauagaucggaauaaaggguugagacuuucaaauaauucuuuuugccuaucgccucugaaacaccuccuuaauuauuucccagguuuuuuuuuguuguuguuaguagauauuuugaugcuauuuccauaucuauacacacacacacacacacacacacacacacacacacacacacacacacacaugcuccuccuagagaucgccauucaagaagagcaguauucaaggcagucccuuaacugguguugacaucuuuagaucauucucuuaucucauguucaccuugaggaauuuccaaaguuaguucuuuauuuauggucuuuuucaacaucagggacccacugggucucauuuuaggauaaguuacucgcucucaguuguacagccaucuuauguggcacucuuuggcaaagcugacaaaggugccuacagaggcagacauggagguuugccugggaagacagcuuacaacacagaggcugggcaggguuucaggugcuuuuauaccuguaguaaccacagucuuggcucuggugugauuuaauuucauaaauaagaugcucaaaauacauacacacgcugcuccugccucuccagcgccccaugacaccagccuuuccuccuuuuccuuccccuguaucuguucgcugccaugcaacuuauaaauaguacuuccuccuuuacucaagguagcuccaauucugccacaccuggcuguuucuuugugagccuuuuaauucccgcugugagcugcauauuuugaggaguuccccucucuuuguguuuacacugugcaacuggagauuccauaaaacagacuuuacugaaguguguuaacagagucuuaacgagugguggauuggcaagagcuugugucaguguggcuuauagucccccucugccacaugagugagugagugucucagcagccugagcugaggcacuaggagggagaagagcggcuggguaacagaacacacggcaguuuuuaugggaagcgagaggagaguucuguguuuacaaggacugggggggggggggggggggcuaucuuccugagccugggacauuccuccuccgauagaggaggcugaagacugagucccauucuucagaggcuggucgaaucaguugugcuggcuggugaaucucuaagacuuggcugacugaggcuucuucccugcaaugcacgggcacuccuaaauugaucuccagaaguuagaagacagcuuggaagcaaaggaacaaaaagccuagaaagagguggaaaugaagaaucgggaaaugugaagaugagacaaggaaaaccucccugacaucuuaaugucuuacagaugggucuuuugauggcuaagcuugcagugcccuuaaauuuaccuugucuggacuuuucuuccuguauuuucucuugugcuuguugaggccagcgccucaacacauuugcaugaggguaccugggaacacaauaaccuaaaaaccauugaguuaaguaaguaguaaaggcuaauaaauugucauaugauuucaucguaaagcauuccuuuaugcuuuauaagucagcagacaaaacgugauaggaaguguuccaggucucucuuucaauccagagccccuagaaaauguacuuauuuaugacuuguccuugaggguggcuuugaggcuuugagacaguuaauaucuacaauaguucuucggcuauggaacuuuuuaaaaaucuggaagggccagguagggugaugcacgccuuuaauuccagcacucaggaggcagagacagggagaucucugguaguuugaggccaacccgagacugcagaaaguuccuguuuuaccccucccccgcgccucuucccccuacacacaccugaaaaaaauaauacagaaaaagagcuagagagucuucaccgaagucuugcggaagggguacagaggagagaaugaagagcgggggugggggagcugcugaaacugaccccagaacuugggcaccagggcucaaccggcaggggguaacaacugaggcaauucugggagaagagauaguaaaaucugguccugaugugucuguuggagauggcagugaaauaucuccucugcauauuuuguagacguuaagaaauaugggccugaagagcggaugaaaggucagggcuggcgauaggagucuggggcucaucugugaugggugcuaauugaauccaugugggugcaccgagggaauaucuggagaaggagaugaacgagcagccccuggaugagccucgggagcgcuaacuuaacugcagaaaggaagcagaagugagaaggccaagcgccuuguccugaccacggaggacccgagaauguuguugcuuacccauccuaucgcugcggguccuuagaguacgccugaugaccuuccuauaaaagccaagggcaaaaaccaagagccuuggcuuuuuuguuuguuuuguuuuucagagaggcgggguuggggguggggggugcagaaucuaagcgauggaucugucacgugaccuagcacaguggcguagcacuccguuuaaugaauggcugcgugagguaauugaguaccugcacuaagcaggugacgugcuaccuauccggcuccugguuuuguuucaugaaagaggagauaaauaaauaccugccuguaaacaucaccaagcgauccaacguguuaggcacaaaggagaaauggaguugagggaagaaggcaugguagggaaaggaaagagcgucaaguuuucccuggucugugcggaucccggauccgccaucuuaauagauggauuggaccuuugguucguuuauguaucuguuucuucuuccuucuucuuucucugaugggacuuggagcuucuuaggggagacacgaauuacucccgaguguuuuuguagacucuaaugaggcuggcuaccuaagcacuuauccauacacugaaugacaagcugacagcaagguauguuuucacuaauuacuaaaagugaauaauuacccagaaaauuaaucagggagaacucccuguuucgauaagggaaaugaaagcacucuuuuuuuuuucuucccccuucagaggcaaagcuuuuaaauugggauuuuucuaaguaaaucauuuccaaaggaggcauuagguguguugcuuguggcaaaaucgucugagucagcuccgcaaaguacuguuucugaucacugaaaacggaaagaucugacauagacuucgucucuccuccccuguuugugagugaucuaacaacagagucugucuugaaagauguucaaggaugaucacauguucauuuaauuguacaaccugaggauccguaaagggagcuuggcuguacaguaagaggugcauuacagagaugcgagaaggggggggggggggcuuuggagauaaguauacacacuuauuaauucugaacuugggcaauugcaacaauuugucuacaaggucucuuuuauucuggauacuuggaaaacuucacauauauguauguguguguguguguguaaauauacauacauuuucauguguauauuuauaaauuaauauauuuaugcauguauacauauaccuuauguauacauauuuauguguauguauaugaggacauaauagaugauaaauauguaagcguucauauauaaauacaaguuaucuauauauuaccauuaauauauacucaauuucuguggaagaagaagaguaccgcugugauaaauuucuuaacaggauggaaaagggagagguagagcuagucuugauucaucuaacagaauuuuucuacuggaaccaauugcuaucagauaaaaguauuuuucagaccucauaaacucugcagccaugucccuuuggaaacuuuacuccacagagagagagauuugguuaggucccgcaaacagcagacagaaaagacuauaaaaauauagacuggcuuccagaacagaacaguagcccaucugugucacuuacacugauaaacacaucaagcaauguggcaagcgaucuagcaacucggaagaacuccacagacgugagagcagauggucugacucccuuccccgggaggagggcaaggaggaagggccaggggugcauaaacucugcacgugaaauaaaauagaaauguaauguuuaccccaaaaauguuauuuugaagcauaaaccagucauucuccaucaucuguuaauuccaggguuaauuuucuuaacccuggaagguaaaaucaucauuaaacuagugaggaguaagaugccuaugacccuggugugguagugugcucaguacucaagaguugguaguauacuugguacucaggagauggaaguguacucaguacucagggggcagaggcaggaaagccaaaggcucaagucccauccucuucuucuacagagagaauccaaggccagacugggcuagagaccucucucucaaaaaauuaaaaaaauaaaaaguaguuauuccacugauaacacuaaaacacaggucauacacaugauguuaaugguaaaacagcuauauuauuaauaauuaauaauaauaguaaauaaaaauacagcugccucauuagaggauuuucagaucugcuguucauccauggguggauuaacauugucauacuaccuaccccacgucugcaaagaauucagaacagcuuacaaaaagcaccacacuucaggcaacuggcguucaguguuuaaagacggacccugcugucccuggcauuugguaauuuguuggguuuuuuuucaggcaggaaguuaagccucuugaaugcucauauuuggcagaaaauaauuucauuuaugacucaacacauuuccgguaggcacaucucagcagagcucaggguagucacuaauuugaguuuuacauaguaacgcccuucaggagacaaaagucaccuuuuaaacuuucguuguaaaaguagcuauuaagagaacgaugaugaauccugguuuugcguagaaggacuguugacuccuggugcggguauguacagggaaccugugccucuagguaguaauaugguuucaaaagaaauccauauacugaacaaaauauuuccuggauucaugaauuuagaggcugggaaucuggggauacgccaagucuuugaaaauaucaagggcauacuaaaauauaauagcaugcucuugagaaaagaggagggggcgggcaggagaaaagggaaaggcguggcuuggaauguguauuuccaucuugcucuucuaagccuggcuuugggaaguggagucccauacuccuuccucaguuuccccaguugggaauugagguuaagcuguacacccccacuggcuggaaggacgguagcaagcuugucuggguggcacacuggcaaacgugggcccagucagggaaaagacaagcaguaaauaaaaguauggucauucauaaagagaguuccuaagaccugcacacgagagaacacauggcaucuucuccucgccacccucuccuaguucugucuucucccacacagucccccuuccaagcucagagggaucgaugauuagauaaaugagagauagguggauagauuguagguagauagauagauagauagauagauagauagauagauagauagauugauagauagauagcaggcagacagcuggauugauauaaagauagaugauaggugauagaugguugauagauaauagauugauuguuguaauauuugucuuucuagauuuagcucuuuucuuuuaacucaaugaucuucaauuucauccaguuuucuacauaauuccauucuuuacagcugagccaaguucugaguucuucaauaccaccaccauccuguguaagugagugaguguguguguguguaugagagagagauagagacagagagaccgagauaccaccacccuaugugugugugugugugugugugugagagagagagagagagagagaauauggaacauccauucaucuguugaugcucaucuccgcugguuacauguuuuuguccacaguaagcacacgugcauccgcacggugucccgacuugccuuccuuagagucuuuucccaggaguggcuuguuggauuggaugacaggugcagguucucaggcuguggcugcauuacauacucagaaaugaguuucuaagggaaucgucuucaaaggaagguauuaaaaggguucccccccccccccaaaaaaaacccuuaaccuuucuuuaccuaauuccauuguucuuuuuguguuuggagagaggaccucaaacuccuucccuguauucguuuaugggaugccuauuucgucuaggacaggcacucaaauuuuauaacccuggggcuauaauuaccaguuaguugucccuuuaguugccucaccuacuuuaacaacacacacacacacacacacacacacacacacacacacacacacaccacacacacacacacacacacacacacacacacacacacgggguugggggggggauagaggccucugaguccauuuagucagaaaucugucguuuggcagaagguauucgcuuugggauagaggagaaggcuggguggcucaggauggacuuucuccugcccucuguacccuccagacuuuauucuuacauagauuuuuuuuuuuucacucccuacaaguguguuuucugcuuuccucuuuuucaacuuucuccaggucucugggcacaggucucuccccccacucugugacuuucccaccauccugugugauuucuagaguggcccuggcaauaaacguaucagagaagggagaaaccauguguuuugagguaaaaauuuaacagaagaaagaaagaaugucauuuaucuuuggccgcugagaacguccagaagcuuccucgaaggcucuccuugaaaguuuccgcccacugucuuuuauuaaacccuggucuucccagggcgccuaaucccaaaggugaaguuuuaaaaauccuuugaaaaaaacuucuaacucuuuuaauuaauuauguuacugcucaaagguacauuuuccugcaguuucugauauaaacgcagcgguguguucuaagugauagccuuugccaccuugcuuuggagucuaacuaccagcagguuauaccuuguacuuagaaugugucuacaaaguugcaaaacauuccuacacaagucaucacaacucaucaccgggacuggauccgccuucaggaugcuguuagaucugagcagcuggagaaaaugcccuacuggugguuucggaacuacacugagggaaacacacacaggacccccuagaacaguucauuuccaaguccuugggaaagucacccgaccccaaucucaccugcguggcugagacugaguugaagcagucuggacgccagaguucccacucugugccuauguucuuaucugccuuuugggucugagcaucagacccaguaggggcauuuagcgauugcucccugaaaggagaucaauccuaggcuggcacacaguucuucacucuuuauccuuguggagugaagagaaguuaaaugcaaaccacuauaaagugcucaggugaagaucgaggcauguggcauccgguagauuuuugcaggaggccaugagcugcagacccugggcguuuucagcucugugccaccuggaggugaaugugucugucgccacaugaguuccugcauggcggaaguaagaugugagaggggcugaaacagagcuauuauugacugaaggcccauaaagcuguuuuuagaaagacuguuguagggggugggggugggggguggggaggcgcuuccuuagagaagggggauauuaugcauccucuuuccauuaagucuauuuugggaagaaauuacagaggauaauauaugaucaacucugagcaacacagccucuauucucauuaagcacuugcucagcccaaaauaauuucuccguucucagggaugcuaacccaggaccaucagcaucuccacuaaaucacgcuguuuauuaaggaagugcugaauuuuuuaagugugaauuuucgccccuagaauucccaagcaaaggggaacaacagggcugcuugcagccacaggggcggccugcagccagggcgccguuuguuuuccgagcagcaugggguuuccuccucuggguugaagauuuaucagccuuuggcaacuccuccaguuacugcggacaaguuuacuucucaauagcuuuacaaauugcguguuuaacuuuguagaaucaauuccugggagguagggagagaaguggagggcuccuccgaggcucgaggcucgggagagcggggcucacccuugagauuuaaggcggcagcacccguuuaccuccgugugugccacaaggugaacggguucuuucccuucuuucuuuuuuucccaucugcccacaguuggcacguuccguacgggcagugacuuaaaacuuuaaaagauagcgaccgaaauguucaguaauaagugucuguuuaaucauuaaacaaccaccauuuucucuugcccuuuaaacccaccuucaaucagcucggacgcugguuuauagucuuauuuacuacaaagaucacaaaggaagggcuuuugggggaccacuagcugcagcgccaggagaaagaaaacaaaggucuucuugccucuagcccuugcuguggucaccgcuggccacuguuaacugugguuaauauugcugcuugacugcaaugugaacaaggugugucauggcaguuucugagugagcaucaccaggguuccuuucucuuacaggaguaacugcgcugcucuguggcucucuuucagcacguuugaguucugucacuaauuuuaaaagaagcacauagcacacagguuuugaacuggccuuucucauccagaccuaaaaagaaaaaaaauuuuuuuuaaauuuaaaaaaauuuacuuuuuacaaauggcuuccucuuuccucacuucaagaugguuaccagguaccauacuuugaggaacugaaugugguucccaugguggguggaggggggacaugacaguuucucaaaauguugucuggugagguaccaucuaaggcccuuaaaagggccaugauuuuguauggacaugggguguuccccaaacagcuuguauaccuuaugacuccugcuuugcugcucaguauauaaagcacacugaaaacaaccagcccuuugaaguggccagguaagagagagauuugguaauuaaaaaacaaaaagcuguacuuggcagaauuugaaagugaucuccauuugcacauuugcacgggagaaguguaaaucagagaacuuaagagauuugcuuaaugcuuccgagagacuugggagcagaaaaugaguuagaagcugggauuuuuuccuugugaugugggcuuuccaaaugucuuuacuagaucagugcaaaugucuucugauucugcacuuagacccuagaacucacuggguuccauucauuuauauccuccucuuccucccugaccccauucucuuuuucuccccccuuccagcacucucucuuucccucucaguucugcucucucuuucccucuugcucucucccucugucccucucucuaucccucccucccucccucccuucccaacaggucacacucacaaacauucugaccuuccaagcaaacaacccagccccuccuuuacuuuaagcuuuuucauuuucugaauuuuuaaaaauuuaaacuuggaccgugcacagcaaacuuguagaaccuaaaucaagacauucagggaccuacccgaguuuuuguauagucuuggacacugagcccacaagggcuacacuucucugcucuuggaaccauuuccuguguccauagucggggcagggggcccugugagggacucugacaaggccaccucaggucucccgucuucccuguggagguguggugcccgccacacacuggcuauggaaagcagugaugauuguuguucuuucucagagcucacugaccacagagcuucacaucugaagacgaauggaagacacuggucauuguuuugaaugagaaaaauguuugaugcugugcauuuugaucauauucuuuuccuucuccuaccuccucucagauccugggaagaugcugcuaaauuuaaagacucaccuugguuugaucuucucgucucuucucuucucuucucuucucuucucuucucuucucuuuucucuucucuucucuucucuucucuucucuccucuccucuccucuccucuccucuccucuccucuccucuccucuccucuccucuccuccucuccuccucuccuccucuccuccucuccuccccucuccucuccucuccucuccucuccucuccucuccucuccucuccucuccucuccucuuuuuucccuuuucacaaaaacaaaaucgauuucaguuagaucuuucuaaaaggauguguacugaaauagcuaauccacccugggaaagcaaucuucgagguauuucaagucauuucugucgagcacuuuggggaauaccuguuucgaguccacuuuauacaaagcucagcugaaaguugacuuuaaggagacuauucagucaagucacugaaccggcagcaaaacuggcugucugcccuugcccgaguaagucacugauccauuaaaugaacuucuguaaagugucaggaugucgcagcaggcacaaaaguguauggcguuugguaggaaacagaaauuguucugugacaguaaguaaggcccauagguggaaggaaaucucgaaagguggacgugugugugugugugugugugugugugugugugugugugugugugcgugcgugugugugugugugugacaguucagagaagcuaaacuggcagagaccauuuucagagcccaagguauugugaguccugaccuaguugaaugcuucuaagacaaaggcgccuccaggaacuccuuuguccucugauguacgucuuaaugucugcacaaacgcuucuuuccuguggcuggacaguaggaaguaaucuaucuucacuccuauuugguuuguaaauaaaacucugaaaggggucuacugaccucuagacaggcgggcguucuccaauuuguuccucuucacucuuggaguuaagucaaagcgcauggccaagacuaccaccucuguccuuccgggacugucuacaaaagacugaaaaaugugcccacaccugcccucugcagggcuggcucacuuccagcucuaacgggggcaguggagaacuugggggaaccagagcucauauaagcacucugccuuugcccacugaaauuacaacaucugugacacucagcccccaaagggacccugacugugucuccugccagcuccuuugcagccacugggacucugugccuuggaauagcuaagccgccugccauuuccuccuuucaaauaaugaaacguggaaaugcaaaucuccugggcaagcuccaaguauuaggugguauuuccuuaauauauugcuucugauccuuugggggaaucaacauuagaaacugacuuuggaaaaugaagacgccaucaaaguucuauauuuugaauaaucaguaucuuaauuuuuuacaaagaugaccuaaguuuucuuauguaucaccuugaauuuuguaacuuggggagggcgagaaugaugauauugaacaagggagcgcccuaauuauuugagacuuugaaaaaaaaaagaagggaaaagguauauuuuuuaagguuuacugcugagcuuugcuguuaacuggguguuuggauauuuaccaucugcauacagaguuaggcauggggccgcuaagauggcagacuggagcugcacuggagggaaagacaucuguauuuuucacucacuugcacaguagcccuaaaauuuucaagcuugcuuuuuguucagcaucaaagaaagguuguuuuauaguuacugcauuuuccuuuuuuuuuuuuuuuuuuuuuacccacauguuccaugaaaggggugagaggcacugaguucuucuauuuauucuuugcaaaguuacuguuuugcccaugguccuucugcauaccguugcgcuggauaggaaaacauaauuuuguucuuuuuuuuuuuuuuuuucucuuccuuugaaggaaaaaaaaaauuuaagagguuuaaauaccauucacguuuuggaauuuccuucuuuauuuccuccuaaaccgccgucucccaacuauauaaagcaauccaauguugaaagaguuucacuccuauaaagaccuuuuauaugauuauaaccccccuguuuaucaagggcuacaagaacgggagccaggagcuaacugaguuuauagcuaugugucuaugaauauacguguuugugggcagggaggucuccauauauccccaaguguguccaaaugcucacagcguuuuuagcauacaaauugccaauuaaacaucuacaguuuuccauccccucuacaauuuugaaugugggaccuauuagcugaugggagaagauugacaccgucaguagcagacuaaaaugcuuaacaaauccaagacacugagcuuugucugagucucuggcccuuggcucggcuaauuaaauauugcguuaauuagccucguuccuuaacuguuucuugaucucucgguagaaauuugucuuuggggguccagguucucaagcgaaaggaacagcuuagggcccaugaaggagaacugucuugacugcuaccgagagauggaaggagagguccuccuauucucuuccuccuucugaauagccaaggaccuuagcccagagaauggugcccacccacuuugagaguacuccuccuccccauuauagguuucuggagauacccucacagacacaccuagaaguacguuucccuggugaugcuagcuccaguccagcugacccuggggaucaaccaccacguccauccuucagccucuuuucuaacauccaucugagcagccucuucguuccgagaugguuucuaaguaucucuuuuccaacauccaucugagcugcacuguuauuccuggaugguuucaaaguaucugucagcugccuaaauucuucucucacacaugguuucuaaaauuaccuauauguucacggcacuccuuccgagagaagagaauccucacaucuccuaaagagaaggugcuaugagcauuuucaauccugauuuagauaagugagcguucugggcgaucugcuaccccacacagccaaauaagcgggcuacagcuucucaacagugguggcuuucugagcauucaaaagucacagagaggguaaaacaagcauugcaggagucugguggccauuuccugugcucaguccuuucuccucauuauaauaauggucacauuguuuacuaguguuagcaucuuucuuauccuuugauguuuuggcuucucauuagagaacuacuggagcgcaugccaccgaaugguuuguuccaugcagcccaccggcacauuuacacuccuguguuuuacuaucuaauaugugguggccauaaccggagaaugcaagacgugccuucagaagaacccuggccccuauaauuuuuaccaaaucaugcuucgucaugcccccguuuuccccagugccaugcagcgugcacagaugcaugcugagcaaaacuggggagcgcuucggagcuuuguaagugaaugugaucuacauaucgggcgaaggacugggaaauguacacccuacccugcagccuggcaguugucacaggacuaacuuguacccucuuagcugacuccugaaggagcccgagaaagccauacaggugucaggagagagacccagccacucugaggcaacuaagcaacuagcuguucucugaaggacuuaagggcacugcagagcagacugggggaaagagcuguucccuuuacaggaaucccagcagaaagcaacacagaagaagguguccacuccccuaggacuggaguuauaggcaguugugagcugcccugguggggguacugggaacugaacccaggcccccugcaggagcaauaagugcuccugagggcugagccaucucuccauccacaaaugcaauaaacugcaagcuucuuucuaaagaaauucccuacagugguacauuuuaaagacugccucucuuucccagaaacaccccucccucccccuccccagagccuuuaaagacugccucucuuucccagaaacaccccucccucccccuccccagagccuuuaaagacugccucucuuucccagaaacaccccucccucccccuccccagagccucacagguaggagaacaggaaagacuuaaagcugagccuugcaggcagccacugaguacuaaggggcuaccuucuuaaugcagugucauauuacagcaauacuaggaaaaagcuuuaaggaauucucauccaugcccaguacauacuacuucaauguuuacugacuagauccauggguaaacagaacccaugggucagagguaguuuguaagccacuauuaaccaugauuccugugacaacugugaaugcaagggccgucucucugucugucuguguguguguguguguguuaugcgugcgugcauacuccauucaugauuccccccauucuuaagaucgguuggggagggcagcucuauccacuaaucagguacuuaaaauagccaugcuagugguggaugaaggaagucagucuagauaacaucucugugaacugugugccugugaacuuuaaaucacacgauacaaaggaaacuuccauugucuuguguggggcuugggggcggagcugaacaaagcacacgaaacacucuuguuuugguggccaaggauauuccuggaaggcuggaagccagaaucuucaaggccaccacaaugacaagacuccagugacagaccggcaaacuacaggaccgugugcaccacaagugcauagugcagaggccugugaucgcucccaagggugccaccaaggucuuugauauugaacaaugaaaucauaaacacuauugcugccccugcugccacugcugcuaccagcgcagcccaccccagugcuauuaagugguguuuauuacauuccuaccgcccgcaguugcucugugcacuuuagugacuucuaauuuaguuacccccaacaauucagcgaggcauccauguuacaccgaugaggaaagugacauuuaaacugcuuaagaagucaugcaacuccuugcguagagugagucccagaccccaguuuuggucuaucuuauucccaaaccguaucuuauaacgcuaucuugaaaguccuuuccuggcagaacuccccagguaccaggagacuguaaccuccaaacuauauuaaauuucuuggagggaaucccucccccaccccaaggcccaaaaaggcugccuuguaauagcuccaccugacugacuggcuuccacauccugaaagagcaaauuuauuuaaaaaaaaaauguuacagcagugacauucccucccaagaucagaggugcauacacauagguggcagcaagcccagacauaccaaagcguguuaucuagagccaaggacuuuacaccacugcaucuguagggagacaagcaucucauuucaacagacagcuuguucauauaguugggauccuccuggcggaacugacagggagucggaagagcauccuaaaacaaagagagcgguuauugcccucucggaggggccccugcgcgcccugggguucugcucuucaguguaacugagcagaacuccgguuggcucccaggaaaagccuggcggcacugucagauugaguguggcuagcauuauuuaucuauuuacuacccaucaucucugggauuccuugaaggggacaaugagucacagccaguauuuaggcagcaguggcacugucacucacugggugucaggaauggcuuccuucacucuucaguccgugaccaagugaaugcacucagcaguuuccagggauagcucagacgagccaggagagccaucucaccguaagguaaagcagguaaugccuguacauuguagaaagagggacugugcugcugccucaucggacagagcaaggcaacauccaagggaaagucugugcgaguugauuucagagccaggaagggguucccaucagccaccacgggcaggccagcacaguggaagccaaauuaacugaagccaaacuccauuggcacucugucucccuuccuuauugucauuugguuuggugacacaaagugaucuuuuuccaagaaucggggauggguuaacuugcuggaacugguccaguuaccugacagggaaauuugcucagcaugaaggaagaguguguuaguguugcuugcuugcuuguuuguuuucguccucuggcuuagugggucuugacuccuuugugguggugguggugguggugguggugguggugguggugguggggcugucaaaugacucauucacagagggcuucaugucagauacccugcacaucaaaccuuuauauuaggauucauaacaguagcaauaugacaguuaugaaauaacaaaaauaauuuuaugguugggggcaucaccacaacaugaggaacguauuaaagggccgcagcauuaggaagguugggaaccacuguuuggcugaacauuucauuacuaaaucaacaccucucacucuugugguucugagagggagggacggagggggagaagggagggggacguaagauaacaggguagaaagacggacucugagcaacuuuugacucccagaauuuaccacuguggaagguguaucaucacggcgcuggcuauauucaaaaacuuauauccuugcuagucaguuggaguuggggucuccuuguauuccuaaaagccuacagucauuuucuuugauuuacuugagacucaucagaacucauuaucuagguucuuauaucuugguuuaauucuuguuagcuuucaucacaugaacugacuuauaagaaaaaagauaaagagauauauaaaagauaaaaucauaucuaaaaaguguguuagcuuucuauuacaauaacagaauaccugagggaaucaaguuaaaaagaagaaaauguuauuuuaucucaacguuuggacauuucaggccacagagguuuggcuuuuuugcuuuggagaagaaaaauuuucuuccaggcaaugagaggauuuagacauuacauagaaaccuuucugaaaauguguuccauacagaagacaaaaaugugucaggcugggucagguggcuggaccgagucucugcggccaaucucauucugcacuaggggcguggauuguuuugagcugugaacguagcgcucucuccagcugggcaagaaaugcucagcauugagaucucugacuaguaaucaugccuugauguaaauaugcauaaacauuguauguauaagcaggcucgaaaugagcuguucuaaauaacuucuuccguguagcgaagcaauguaccaugggugaaaauugaguaucguggguggucacagucccaacggcaucaggcggugagcacagagaccacucaggacaagggauuaaaggcaagaaauguaugaauuuccuuaguagggagccaugggagugaggggagaacagugggaagauagagauggaugggcuguacgggaaccuguacagcauccguagagaaggccagcaucuucauccugccaauaaaacauaacauaagauuauaaacuccaucgcuguugaggcuacgucuuacauuccugugucguaugcaccauaauaauguauagcucucauuuguucuauagucaaauaugagagcgagugacaagaaaaaaauaagacaagggaaugaguaacuagcguuuaucccagguaccuuugcaucugcagccuuaucugaauacuuuagcguuugaaaggaauaaaagaggaauaaaaauuaacauuaugauagacgaggauuaagagggguaucgguagagccuauuugaugucuacuuuccucgaagucuaaggagaaacaagaugcuauuugauuugugaaacacuugagccuucccauguagccuaggcuagccucaaacucgggaucuuggcugccucagccucccuaguucugagauugcaagcauguacccguguaccuggcuugacauauugaacuuaaaacaacaaaaaacacuuuucugagccaaacaguuaccauaaaagauugguuuuucuagugcugauuugcccuuaaaauauauuggagacguucuuccuaauccugaucuuuaaaaaauuguuacuuuaaaauacaguuuucucauuuggucaucuuuugcccucaugaagcgauugucccagaaauauuuuaguuauauauucuuuaaaugaugccuuuucaagcaagcuggcaaaacacugacuuucauuuaaaauaaauaaauaaauaaauaaauaaauaaauaaauaaauaaauaaauaaaugcauggggguaagcggaaugauuacccaaaaggccucccucuggggccaugugguacagagaucuaguggggacgcagacuagguacucugggccagagcugggacuuccuaacaagugaccuuguagcuuccugaaggucaccucaccuacucgugugaaacucaauguuccuacuucagacagccauugugagacuuaugccgggccccuguguauuaaaucacuucauugaauacguacuguacugcucccaucugggcuguagaaacacaaaauuaagucaccucagacauuaccucaccugaguuauaauuaaagaugcucuuguuuggugacgugcagaagcaggguucagaccuaugucccuagaaaaggcuaaacaguccuaagcuaaaacuucgucguaguuguugugugaccgagagcccgcuggagaagcugagguagauaauucugggguugacauaaaguuccacuuggguuuggaauugaguaaguugggaagccagccagccacaugucccuauucuaaaauagggacagagaccucguaauucacggauucaggaaaaaaaaaaaaaaaagucacgaaugcacagaacaguagggaaggaccaacaagaaggcauccaggaugcgugagaauguggaaaaggaaggauucacuuccaccaguguugaaaaugcuucacgacguaagcuaacucgaucgggaauagcuuggauugaauauuaagcuuccuccaaggaaaauggcucugcagcugaagucagccgcacgccggugccgagaagagaguacuggaucuuggggucuaggagagagaggggucuggugagugccaccggguuccuaccucauaaaccacccaucccuuuguagaucuugagaacgugggagguuaucccuaaaacuaugauucauucagcuuuuaaaauucaguuuuugugaccaccuguucuaggaaauacuuagguagcccaaugacucucucaagccauuucagagcugggugugaugucacccagcacgcccauuaucaugguagaauucaaaaccugccucagcuacacagugaauuugaggccauccuggacuacauaagacccugucaucaccccacccacccaccccccaaaaaacccuagaaaaauagguaaauaauauaaaauguuacaugauucaguguaagaccggaaacaauguuuuuggucaaugaagcaagaauugacucuguaucuuuuauggaaaguaaaauauaaugaaaauaaccacacuauuuccucucauaaauaccguacauaugccaggugugguggugucugcuuuuaaucccaacacuugagagguaggggcaggcagaucucuugaguuuaagaccagccugguguucguagcaaguuccaggccaaccaaagguauauagugagacccugugucacgggguguggguguggguggggguguggguguaauuacuuugcccuauugcuucauggcucucagaauccccaaaauaugcuauuuccuuuuucauaucugcucuacagugucaugggcuucagaccccaagcuguucauauggacguuaagacagugauuugcuuugaguucagguugaccuagccuuggauaagcuaaccugugcagcaguacacugaagguuagagagguuccuccuugucuugauaggaucaugucccauuaauacaaagcauuucuucuaaguuucucgaugcugcucuugguggcgauggugaagguuauuuucuucaugagcugaauuuuagaaguuuggaguggaguccagggagauggguuggugaauaaggcaacugaagcacaagcuuagguaggucccagcuucagggccaguagcaucacauagaagccagguauguuggcucacgacccuaacuccucgcugggcaggcagagauggauggauuccuggaaugggccgaucagccagcccagccaaauaagugagcuccaagcugacugaaagucccugucucagaaagagggcuggcaaugcauguagcuggugaauaaaggcuacuugcugucaagauggacaguccgagucccauggaacccacaugguaaaagagaaccaauccccacagguuguccucuggacuccuaucuaugugauggcagccauacaugagccucugugaaugaaugcagacauaaaauauguaaguguaaaaaacucuauuuagacagagaacuacugaggaagaagacacccgacgcuggcaucuagacuccacgugcacacacacaugugcaugugcacacacacacacacacaggugaacacagauacaacugugucucgacacauacacaugcaucuagacuccaugugcgcacacacacauggaugugcacacacagaugaacauagacuccacguguaugugcacacacacaugcauccagacucuaugugcacauaccagugaacauauauaugccacacauacccaugcaucuagacuucacaugcaagaaguuuaaaugaagggaacccaaauaaguucuuucagucucuuguggugaauucuccaugcagggagaggcugaagaccagccagcugcccgcacugagcaagccugcugugugcacacacucaguagaaacagaaccauuggaguugaaacagguugcugccucuucaggaaaacaaucauuaugagaucucccacuguuagaaggagaagauucugagggaacuggucuaccugggccucgacagcuccuacugacuauuggcaucauugacuauuggcaucggccccuaagaaagagcugaccuagcagggcuuggcccccacagugaaccccacccccaaguaggccagaaagcacagcuguuccguuggggcuggcccuggacuagacugcuuugucuagucuguggacgugaagggguuuccucaggagagagaaugaauggguucaguuuguuuccguuucagaaauaaacucagggagauuaaaguuucuaugccuuaguuuccuggugagaaaauaaaaacaacgaggaguauaccuuccuugacaagggauaaaggauuuuuaccucucuguaggauguguguguguguguguguguguguguguguacagcauauuauauauuuaucaagauuuaugaaaacauaaagcuauccacucuagagauuaauaagcagaguuaucacucaguccugaggaagauggaguggccagugugugucugcuucccugucucaacacuuagcucugagcuaagugaugcuccaaggcagauaagaaagaagugggcgcgauuuguugcccagaaagcauccagcuggcaguuuacuuccuuucuguuuuuaugaauggcggucauauuaugauuuggucuguuuuuccugaccagagccauucauaaaacuaaaaacaaaacaaaauaacaagaagaagaacagcagcagcagcaacaacaaaacuuucugggcacagucuggagcaaaugggugccaacggcugggaaaacaucccagcggccuuaaccgcaacccgcguugaaggcauucaagggucuguuuguuugguggccugagaaguaagaagugcugugucuaaguguagccgggagaaggucugugacaugaacuaggcugggagccaaggcuggcaaaaguucagagauugucuuucuccucacugaagugucaggaccuaauucauggaaaauugggcgagcuggcagcccucucggaguuucauugagacgcgcuguucaggacucgcaugaauggagcuccuuagccaaaaaaggagggggcugacgagcggucggagccagacagccuucgagaaugugugugcauucgaaacggucugggaggagaaguacagguguaaguggcaggggaaaagaggaagaaaggccgucucgacuuaaaagcgacccuuugaaaaugagcacucucucggcacacacuucugacuccuaagaggcgugaagcgcacugugcuuccuggguucaagucagccuagggaaaaaaggaaacaucucaaaaccugggcuuugaugcuguuaucucugcugugaauuaaagucaugaggcagacuuuuuuuuuuuuaacagugaaaauaucucuuuuuaaaaucucauccaucuuuuaaaaaaaauacucugcuaauuuuauauaaugauuucaagauccaagaaaaacaucacucccuuacagacauucuguauuccgaacacagugaguuuaacccaccucccgugucucugaaggacuggagcaauuucaucucuuuggcuugaaucucuaagucaaagguggcucgguuauacuugcaaacuucaggaauguguaaauggaauuaacagggcuuauaaucagacacaacccugcugucaggaagugaguuagcaaaggucugggacuucagaucugucuuuugucucacugaagaauaacaguaauuucuggagcuugauuggaaaauuaauucaggcugcagagagaucucagaaguuucacucaaaaggggaaauagauauuauggauauagauaugaaaauaaacuauagaucugagaaaggacuauauccaaagcagcagaaggaccccuaggucuuuuagucaggguuucuauugcugugaugaaacaccaugaucaaaaacaagcuuggugggggggcgggggcggggagggauuuuuauucagcuuacacuuccacagcacuguucaucccugaaagaaaucaggacaggaacucauacaaggcaggaaccuggaggcaggagcugacgcagagggcauagagggcucugcuuacuggcuugcuccccaugguuugcucagccugcuuucuuauagaccccagguccaccagcccaggauggcaccacccacaauggucuaggcucucccccaacaaucacuaauuaagaaaaagcuuaacagacuugcauacagccugaucuuacggaggcauuuuuuucagaugagguuucugccucucaaaugacccuaaccugcgucaaauugacaaaaauguagccagcagaggccucaauguuggaaaaaaaaauuuuuuuuuuguuucaucuuguuuuuuaaugagcaaaucauuugaauggaugacuacuuaguaagcacuugaaagauguuucguguaauuagugaggaggggaauucaaauuggcauuuaacuuuccacccgguuggaagucaagacuuaaaaaacgacagacgauuaacaagcgcuggcacauccguggggaaaagauuagaacacucucucccgcaccaguggugggucuauaaaauagugugccugcuuuggaaagccauccggccacugcucaagucggguggggguggagcauugccauuaccacucagcaacaccgcuccuaggugacccacaaugaaugaaagccuaccgugguggaauauguccaugaaagcucacaggagaugcucucaguagccaagagguggaaacagcccaaguagacaccaaccaaugagcauccagauaaguaacaugggggaguacugcuugccauacaaaccaguuaacuguugacgucauaggaguuguuacaaaaggguugacagauuaaggcagaaaggauguaggugggcguacgguucaaggacacacaguuccguaguggcuggggaaacgagggcggcaggagcccgaggcagcuggccgcuuuacucucucuguuuggaggcgcagagaggugagcgugguugcucagcuuccguacuucagucuggaacacagacagugggaugcugcugugacaacuucgagggcgggucuucucucuggcuaaaacuuuuccggaaacauuuucacagacacacacacacacccagggguguguuuccauggugauuguaaauccaaauaucucaaauauuaccauaugacuuucccuccucaccuggaaacagagagagagagagagagagagagagagagagacagacagacagacagacacaaaagcaccuguugcaugauucuuccacuaugaaaugucugaaacaaggcaauuuagguaacagaaggcagacugaugcuaaauuaagcucaggagguugacuaggaaaguggagagccauggggaguggcuacaaauagauacaaaguuucuuuuauggaaauuuaaaaauguucucaaauuagguugcggcgcuaauuaugcaccaguugcguaauaaagauuccucucaauucacugacuucaaaugagugaauuucgugguuuguaagcuuuaucuugguaaagagucuuccaacucuuccaguucuaugauagcagacuuaaaaccaaguuauuccuauagcaagccuauuccgauaugaguacuaacccuauucugucauuccuccacauguggaggcucucuaacuuagaugaacuuccgggguguucaguuuucuccuugcuuugcagguccccagccacacugaaugaacucacugaacacucagguucuucccucccugggucucccugcaaacuaacaccacuucuuuuguuuguuucucccucagccacaacaagucguucagaagaagccugcucagguaagacacgcccccuugugauuauucucaaaaaaaaaaaaaaacucaagcaaaauacauauggagaaagguuuccaagccuuuaauuggcauuuucuuauucugauuaugacaaugucgaaaaagcauugaacauuuguuguauccuucagaaccaggaauuauauauauguauguaugugugcguguguguguguguauguauagauagauagauagauagauagauagauagauagauagauagauagagauagucugagauuauauuauuacaaacuccagacaaggccagugaacuaauucagccgguaaaggcacuugcuaugccgacuucuagugccagaguccacuugcagggcggccauguuugugugcagauaaacaaauccgugaacaacaggaaaccaucagggucuuuggugucaaagaagcaucaguaauguacaaaauaaaacugugucagggcuguaaauaaauauuuuaauuuuauuguauguuuuaccaauacuuuccuuuuggguuuguuuggugucugucuguuuugagagaaggucuuucuacaaaguucugguuuuguuuguauguuuguuuguuuuaagauaagguucuucuacauagcccuggcuguccuggaacucacucuguagaccaggcuggccuugaacuaagagauccgccugccucugccucccgagugccgggauuaaaggugugcgucaccaugaugggguugcuuuaccaauucuuuuuuuuagguuuuuugagacaggguuucucuguguagcucuggcuguccuggaacucacuuuguagaccaggcuggccucgaacucagaaauccgccugccucugccucccaagugcugggauuaaaggcgugcgccaccacgccuggcugcuuuaccaauucuuaacugcuaaguuuugucuuucccuccugaccaccuguagccccuuugacuugauacauaacuuacuaguuguaaaugacucuuaauaauaugacugaaaauagcugaucgcugacuuguucugugaaauccuaaaacaccuccagugagggugaucaacugggaauuaugucaauguuucccauuccugaacucucagaucuugcuuuuaaaaaaaaaagaaaaaagaaaagaccuaacucuauugagguaaaaguacccuuacuucuuuugguccaugaaccugaagauccuugucuaagcuacaguguauauauaaaagcauaggauuuguguuuguugaagacagagaucuuuaagaagauauaacuaauguauaaauuaaucacaauuuccaagaauguaaacuaaggagguaugagaaucccucuccugggcuaggcuacaacucaguggcagaggcuugcagagcaccugggagcuccuguucuuuucuucccguuuggauuugaacagacaugcagaacacgaagguagaaccuauuaaaguaagucacuaaauaaucccaugggucaugagguuuucucuuaagucaucauguagaccccccuuuacauaauuaaaaauagccauagagauguugguuucccuagaaaguugucucucaaaagaauggugcuuugcuuagacaaaacccacgcaggcagccccaacgugcgcuccucuaacacuacugcuugggauaaaaguacaguuuucaaagacauauaaggauacagggggagugacuaaaauauguacaugcauuguuauugauaaaugcaaauuugugauaagacagcagcaucaaaaaaucacuuuguugucccaaaccuaaaaacccagcacaauuugaccaguacuaaaaauauccagugucguauaacuaaauaaaaugcgaaaaaugcuggauaaggacuggugcuguauauuugagucagaggauaucacaggccucagcauguaccacagucuagagauuaauaaccuugugcgguuugcaagcauugauuccgagucuacucuucggauuguagggaaggcgcacugaacaaaaaaaacaauguuuuaagagaagggugaaaugcagaggugagguuccuaccguagccacagugagagaagaaacauaugcuuacacaaaacaccuaaacuccgggacagcugugagcaucucuuuugaauucuguuucuuuacgggagagccuuaauaccauggaaacuggcauacacuugcaauccagaccuagagaacguguuucaaaacgccuacgagcacuggccacgcacaccauccauucuguugacuugguuuggagaccuucgcauggguauuuauuuucuaugagccgucuacgugaucccgaugggcguccaagaacaaacgugcucagugaugaaaggaaaaaaaguggcaagauguucggacauuuguuggaugagcaaaugaccacagaaugucaaugcagauguaaagucaggaguaagggaaaguagagacauguuauagugaaggggaagucaugugcaauaguggaguauuacaguguaggcuauauacauagaaacauguauguauauauauguauauauauauauagagagagagagagaaaauaauaguauauauuauauacacuauauauagaauaguauauaguaaacaguauauauaguauagaauauaguauacaguauauaguauagaauaagauauacuauacaucccauauauuuuguguauauagcaauauauacaugucuauacauuuauucauauauacacacacacacacauauauauauguguguauauauauauauauauauauauauauauauauaugcaauugccucauagguagaaaucacuaaugugugucuguaaaggaaaguaccaaggauaauauaagugaaaucucucucucucucucucucucucucucucucucucacacacacacacacacaaacgcacgcacacgcacacccaccagggaaucagaaucuaaaagaagucacgggggaggcaauaggcgucacugaucuaucuggcugucuuuacagacguucuucagauuuucccuuuaaaggaaagcagcucagacagaauuagccgcgaggagaacacagcucaucggaguaucuaauuuauaucgucuugaggcacagugaugaguuauguaaacauggguacuacagggaaguucguggaggauaauguaaauuuuacagagcuaaaugcucucuucccuuuccaucuguuuccuuccacacauacacacagacagagagagagaugacguuucccugggacagugugcacugacucgggcucacgccuugagcugguggcaguuagcacaguuaagugugucacauguaaaacgagauagucaugcauacgaccugaguguuuccuucuggccaucccugggcuuuguccuguguauccaucuaggaaacaaaaauggccuaauaauuauuguucccuaauucacaagaaaaagcaugagaaaugcauaauuaugugaauacccaaggaggauauuauauuagaacucguuuuauuuggcugcuaaguuucucauaucucaugauuuacauuuuuaaaauguuuaaaaguuuuaauucaaaaacaucccccccacgcacacacaccucguguuuuaauugcauuuuuuaauguuuuaaaauuuaaaaaaaaauaagauuuaaaaaaaaaucagaggaauuguauagcaauugcuaaauccuguaauugagaugaaagccaucagaacacccuuccuuauaugaaugucacaugaauauuggauuacagaugcucucugguaaagagugcuugcaguccccuggauagggacuagcaagcacuguaaggucacugugaggggcaaguucagccugaugcuaacucucaacaucuguguuuguguuuguaagcacauguguuuauaaaaguuuacagcaagcucuguuaugcaggggggugaguuuggagaacgcaccaggugccaugaaucacaaaccucaagucugccccacaauccuuaugggcaggagcucaucgcuuccacucucauggguaagccugcgggguucacagugaccccccccuuuaaaugcccaaaccacagaaaacaaagcuuacuagaagcucuacucuguauuuuaaaguccuaaaguaagcaaugcuuagaaacuagcugauuacaaaucggcaaagucuucagcaauuugaaauaaguccucaccacguauauugaaaacuuguuuuagaaggaaagagugauaggguuuuuuuuuuuucuucuucauguuauuauuauugacagaagauacgguuuuuccuccuguuguuuuuagcucugcuuucuuaaaaagccccgcuagcuuuucuguguccuacuguuucccagauacacugaaucaugcuuacaaguggccccuuauauauaauccagacuuugcuuaucaaagggaaaacggggauuuuuuuuuuuuuuuuuggcucuguuuuguuuaauuucucccagcauuccuucuuucaguauuugaaagcacccccugaguuacugaaacaggaauaaaccuucucuuuucaacuucccaucaagagaacuaaaaacgguucagcuucugaacggcuuaaaacaaagcauuccacuucgaaacagacuucuuaccuguggggaucuuccacgugugguguggcgcaggggcgagggaauccugggaaaccccguuguccuguggcgcucaccccuuccaagauguugaauguuuucacagaaacuucaagggugguuuucgaggcuguuuacaugacagacaaccuaaacaguguuuggagcagaaugagagguuucguuuggggacaggcaagcugauacauuguagccagcauauccuucucaaagaaggcauguuuacugggugcuuuuagucuagacagaccaaggaggagggaggacgaaggcauucucccuccagugcucaccuucuaucuacaugguacguuggccaaaaugccguaaacgguucguaauaaaucagacuuacggucaccggccggcucccuugggagccuguaauuuauuugccuaagucauaaagagcauugauugacuuauuccccugcucacauuccuccgagcugguaaaacauuuugugggccaauaaauguuuggaccgaguggcaaacacgaaggaucccaucgaaggcuucgauguuuugcuguauaggaaauaacuucuuuugacuucaccucugaccccuggcauugcagaggucaagggaaaaggagagagcgaggcugaaaccagugcguaccccagcuggagggccuagcagcggaggggaggcgaagggcagggggagcacagaaaaaugguccugauuguuaacccuaaacagaugcagugauuagcuuagcccacaguccucgcuccggacggagcauuggcagguaaggcccgcugcuuccaggcugggguuggcuacagagaauaaaguagcuccugaauggaggggacaauuuccaaaccucaauggaaggcaaauucagcauuucuggacuugacagauuugcugucgucaucguuauuguuguuuaguucaguuucccagcuguaugaguuagcuugcccaagaaagagcagugcuggcugguccuccugcucacaucacagauggucaucccucucuccucaccuugauguaagcuggaucaaauucaaauuuaucacguaucuaaauaauugucugcgcuugucaacccacguuaaguauagagaagagcaaggagcugucaagccuggccguugugaaccaguccucaguggauccaacagaaugggcugccuggcaggaaagggucaccgaacccucccguagcuguggaaucaucacuuaauacuacuacuuaauaauaauuaaguagcaugauacuuauuauacuaauuacuuaauaauuacugaauaauacuaucuacaacgauuguugacuuuuuuuuaguauuuucauucaaagagucggcacucagggcagagcuggggagaggacacagcggcuaaagcgcuuagcacacaaaccucaggcccuuagaacuccgguaaagguccagugggcacuguagccugcugaugacagccucagagggcauaagucauuggagauucuuauagcaagcagguuagcaaauacccauugaccucugccugcccaugcacaugcagauuugugcaugcauguaugugcacagacauacgcacacauacacaacacagagaggaggugggggagagacauauacagccaggugguagugguaaugcgugccuuuaguuccaucccugagcuugagggcagccaaagucuuguaccaaccaaccaaccaaccaacuagccaacaaaaccugcucaaaaacaaaaaacagaaagaaaagaaaaauauacaaagguuuauuacaaccaguaugaacuucugugauuuuucacccuccuuaccauacacaacacaaagauucauauugucaccugccaccaaguuugcaaggaagucucuuccacuacagaccuccuaucuacucuuccacccccaccccccccccccaacuuaagccccaagcuccauucuuaucuaauauggcucacagccuugcuuguaccaauagacaccaagaguucacucugagcaccaagcgauccccuuaagucacuuaaggcaugcccaaaggugugagcauggugccgaaccaacacgaaagagggacauauugggguuuuaucagcaagcuuccaaagcgauggcagacuuccauguguacaaaagaaaaccagggcagaaugagugcaauuaacugauaguuauaacaaaaauauaguucccugacuuccucccaccuguuuuaugcugguuguucuaauuagcagugaauggcagggacauguuuagugucucgugcauucacugagugacguccccaugcaaaucugcuccgaaaaguccgaaaaguuuuagcguaacauuccagaagcugcguucugaacagguaaaccuugaccagagcgcugguauuuggcuuccccaguccauuaaccagccccuaaugaggugugugcaacucucaggcacacuaugucaaucuccuuagcauuucaaggcugucaugggaacuuaacagcagucaaugcuccuugggaaauggguggcaaaugggaagccaucuuuagaaacaucuggagaggugcaagcuaugguccagaacccaccgccacaucugcuaaguaacuaaagaggauugagccuagauguugaucucugugguggccauaucaucccuuuggggacagcagagacagucacuuaucccagauaccccuuguuucugucugucccuugcacagcacaggagccauggguuguagguuuaguggaaaggaggacuagagucaguuuuacaaccauaucuuuguacccaacucgauuuuucuuuucuucuauuaguugcuuacacccuggggugggggugguggggagagccacacacggagcaaaaacccaggucacuuagaaaggugagaguuggaaagagcuacccacccuaccaguaucacucucuuggccaaccuuggcauuguuuuggggggaggccagcagaggcuaggccaagcaauacgcucuccacuaacuaaaccucugagaaacccaccgugccaaacuuaugagagccacauugccacccaacguuuaguggagugagauuucccacccugagcuccuuguuaaguucccaauccuaauugauaguuagaagcagaagaauuucaaggucagcggaaagagacauaaauacagccacucuccguguuguguuaagagcugcuaagcaaaagaaucaagggacugucccguuggagcugaguuguaacuaagaggauuggcuauugggauuuccagccgcucagguccagcaaggcuccugggaaccuuccgcaaggcugaugacauuccaucuggcgcaaagucuccucccguaagcucauagccugagaacgugcuaugaucuucaaguacuuagguuucuagaaagaagacuaucaagcugauagaaacggaauaaucauagcuccauccaggggugguuuccgcuugacuucaucccauuaaaucugcucccugugagagggugaggugggacacagcuaccuacuccucugcuguggucucuuccagaggagcaaccuaaagugaguccauaucuccugucauaaggggaagugaguccauaucuccugucauaaggggaagugaguccauaucuccugucauaaggggaagugaguccauaucuccugucauaaggggaagugaguccauaucuccugucauaaggggaagugaguccauaucuccugucauaaggggaagugaguccuuugggaggggacaaaggagggaucugccaaacaguuuagugacuuucaggaauuuaaauauuaagugaaaagacagggucagagggcgccccauccucggcuugucucucauucgccugcccauggcuuugaucaugcuacauccuccuuucuaaccaggacuccguugagaaucucggggucauggccuguugccucgucaagaugugaagcccacaguuuggcggggccugggaggcgaagggagguagcuucaugcguuccacauuucccacagaaccaaaagcagacuaaacaaagucggugugagcucccgugacuggaugccgcugcgauucugcuuccgaagcugcaauccauucauuuguauguguguuuauuccugggauuuacagcucccucggucuuuaagggaagagaaugaaugcuuaaaaccucuugugaaggacuaaggaagucgugggcuguguagcaagccaggauagaggcuccacgacucugugugugugugugugugugugugugugugugcacgugcucgaauucaugggagggcaugagccuccugccaugaaggcuucucuccuccccuccccuccccuccccugauuugcuaugauuucgaagaagcgucacacaugguaacauuuaggaaccccuucacagcugaaguguuucagacacuaaugaaugggagcucgguuguguagcacagacgggcucugaggcauacuuuacugagugguauacuguagugaccugggaaaggaagcgggguauaaauugugucaguuagccacccagacgaaaugaagccauguggaaaaucaaaucuauuaaaguaugaaggcuguuguaagcuggccauucuuaaaggggcuucauuggcugcuggaguaaauguuuaccccucucccagaucuguuucacaugccgucuuuggagccagccggcagcguuugauaaaaaucauccucccacuaacgacacucuuuaucggaaauguuuauuagcuccgcuuuaccgcccauguccugaaagguauugcagguuuguuaaauaagcagaaguuaaaaagaacuuuguagcucacaccagcuugcaggaaccccaacaaauuccagagccauaaggaaugaggggaaaggggggcugggguggaguuagauuuauaugggcgagaggcccugagaaaacauauauauuagguuuucucugcuuggcuggcccaccguuaaauguuugccugauguugacggauuuaguauugagauugaacaguuaugucaaacuuagcccauugccucaaaauguguuuuaauaaauguaaaaauaaggaaacugcucucaggagcaauguacuugcaggaugggucugcugucgcucucccacagccuuggcugaggaguuguauaccagcccuguuugacccaaaccugccccuacuugccuuauauauaagggguauauuguuugucuguacacuaaggaacccaucuaaaaaaacacacacacaucuagcaaacgcccaaacagcaucaacuagcaaaaguucaaauagcaucagcuaccauuaccaacauuugguggguggguugacuuucaagagcagcuuuuuaaacccgaugacuguggcacaccauggggagaaaccaacucuuucuuggugagugaagucuccagagaccccacaggcuacuucugacgguaaacaauugaauuugcugaccagcagccauggugccuuaagucaacagugacaaaaaacagcccaggaaaaaagacaaccccuugauuccucaaugacacggguugagugccugggaauagaggucaggcagugucccccaccauguuccgcuuaagcaagcucagcguggugcaggcgacuccugguuacaggagugguacucugggcaagcauuguuccccaaacaaggccuaacccaccugccuuccguguguugcaggagacugaagagacauccucgcaagaguccgcagaggaggauuagggggcgccgacauucaauuucuaccucagcaucaguuggaucuuuugaagggagaagacacugcagugaccaguuauucuuaacugccacggucuuucuacuuccugcgggguggggcgggggcggggcugggcgaggggcggggccggggugggcgaaaucgcauaaccuugagaaggacuauauuaaucacuuuguaaucccuucacagucccagguuuagugaaaaacugcuguaaacacgggggacacaguuuaacaaugcaacuuuuaaugacuguuuucuuuuuccuuaacuuacuaauaguuuguggaucugauaagcaagggugugugguugaagaaaaccucuguggugggcuuaaucagucacuacaugcaaacccuaaaccggcacccuggugaccgggggcauucguauaagaaaagcauugugugugacucuguguccacucagaugccacccccaccaugaucauagaaaaucugcuuaggacaccaaagaugagaacuagacacuacucuccuuucuuuguguauaaucuuguagacacuuacuugauuuuuuuuucuuuuuuuacuuuucaauucugaaugagacaaaaugcugguguaucuuuucauacagcuagcaaaccagaauagguuaugcucguuuuuugcuuuguuuuguuuuucaaaaagggaaguaaacgagaaccguugacuccuccauuuauggacucauacacagcagcaggagugauaagcccacaagcucucuuucccgccucgggaaaucuacacagccaaaagccacuuagccauaaaugacacuugucagccuugaagcaucggagauaacuagcugaguaaaaugauccuguuuuggaauuuaaugaaaagguuaacaguacccaaugaacccacccaagugaugacaugggaggagcgaaaccgaaaucucuuuugcuauauaaaggacacuauuuuuuaaaaaaaaauaauaaaaacagcucccgcucucuguccucucucccucccuucucucccucgccucucucuccucucuauauucccuguucuucauuguguaccaguguccgugaaagaccgcaguaccacuuaccucagaugaagccugcguguuacauccuguaacaccuuucauuuugacauaagauggcuagccgaggugcauuaucuugguucggacugccaucucugcauucacgcugcacuuuuagccagagaugcaauaauccccacuccucaauacuaccucugaaugcuacagugaauuuacagcccugcacuuguuacacgcugcuagacacaagcccugcaagagaaaggaaaaaaaaaagcccaccaaaaccaaaccaaaccuuacugggucggcaucucagccauccccaguucucgaccauucuucucuguacucuuacuccgucucagcaggcuaugcauguuucuaugacuuuuuuuuuuuuuaauuaaaauguuacaaaugcuuguggcagcuuuccugcuagauuguuacauuaauuugaaacaguuuugagucaaguugcuccuagguucuuaaggagaauuuuuuuuucagugacacuacuuuguaucacacacacacaucuguaguguucaaauauaagucuccaaguuuguaccucaaaugaauuauugaaacaaauggacuuccugauuugcaaggaacuaccuccacacuuccaaaggaacgaacuugcagccuauaucacucauugauuuccuucccccauguuugaaggagcucaaaccucaccucucccucauugaaacauuuuuuuugguaaaagacacuugauagaaacacaauuuuuuuacauacuuuugcaaaaauaaaugaauuaaaaucaagccaaccuucaaagaaacuugaaauuuugcuacaaccagcucagccuuuugccuaaugcaaugaaaaaggaaaaaaauagauuucuaagauuuguugccuagaagaauaugcuugaccgauauuuuuucauguauuuuacacaaugugauuuuuguaaaaaaaugucucaagcagauuuguuuuggacgcuucuuguguagaguuucuaugccuuucucuccuauuaagugugcugacuuuccagaguguuacccacugggccaggagguaguuucucauaguggcuugugucaguauaaguuaauacugaagccaaaugaaacaaacaaacaaccaugucucuuccagcuguuuucagggagguuacuucaaaggccacgugccgcucugagacuggcagauggcucacuguugugagucgccaaaggagcuauggagagauuaaaauucaacaugacuguuaacaaugcauuaaauaaucaaauaaacaguggcuuauaaauaucagauucucauuccgggucuucggaugggccuuacagaaaccucauuuuggccagcucauaaaaacugaagcagcuucucguguuggccagacucggcacaccgagcaauuuccaucucugaugaaguuauuccuuauuuccuguauguuguacaaucaaaacacacuacuaccucuuaagucccaguauaccucauuuuucauacugaaaaaaaagaaaaaaaagagaaaaaaaaaggcuuguguccaauggaacagugagaacaucauaaaauuuuuauauauauaguuuauuuuugugggagauaaauuuuauaagacuguuuuuuacuguuguuggucacagcuaaguaagacuggacaucuaacuucucuaccauuucugcaagcuaaguauguuugcaggagaaacuuaucaagacgauuaacugcauccaacuuucuccccguuccuuugugugcccucugacuucguucucuguuccuuguguagagucgcugucugugauuguacuuggacggcuugcuuguggcaauaccuucucuaguggauuaucacugucugcacaauaaacauaacagccucugugggcc

SEQ ID NO: 12174 - RNA, 5497 nt, Mus musculus
aggucaguuaucuugagccuaacacgucgauuauaucauguugaagaugagcggguggcagcgacagagccagaauaacagccggaaccugaggagagaggcgaguacuggcuccgucuaacccuuaccuucccauccuggccagcauagcuauuuuauaaaguuggagacaacuguucuggaggauguagccccaccccuuccacuguaagcuuguagacugggaagggugaaggccgggaaucccugauucaggaauggugcuuacaggcccucucuugcauugggcgauugcauucccguucccuugucucgaguugguccccacucugcagagggacuccgguugccuucgggaacuugucucuguagugcgaacugcgggccagcuuaggccugggcaguucgcaggaaaggcggggcagcaggacacacccccaaagucggggacucuggcugucucagccuuuucuucaccagccucauuccccccaacucuuucaagcugaagcgccucagucaaggggccaacauggccacguuaguagcugacucucaaguucaagagaacgcgaagacugacagaucuuugcgagugggggugcuggugggaggagcauagauggguuuuucccuuuuccccagagguuucuagguuuccauacaagagagcagccuggaucucuuuaacuaugggaaauuauuugggaucucuccagggucuucugcuucucccagggcugauugaucucugcuucuuuccucagucccgucuccuaacuaaacuguguaaccauugcgucaggccagcccacuguuugucucugcacccucaggccuggggcuccucugcugaugaaagccaggucccacacacuggaagaccaagggaguuuucccuagaggacaacccugcagagaaacacucagggcaauauugcaucugcaguccccagagacagccagcuccgcucugccuuuaggcucagugggcuuaauucucuauaagggaacuugggggaggggcuuuuuccccauucauuccuaacaaaugccuaauaagcacccacuauguaccaaguaucuggggacccaggguauauuaggagcaaaagauaaaacuguucucaauaaaacuuacauuucaguauaaagcaaaagggaaaaaaaaaacaaaagcagggcagaauaguucagggcggugacuagagguugucaucagaagccaagccugugagccaagccccgguguuagagcuuuauagaagggagaggcugagcaacagaguuaagauaagcaugccaugccgguaucuuuaggaacaggacuagaguaagcaggagagggugaugaaaggaaacucaagcagccggucucauagagccuugcaagcacccucaugaugcuaaucuuuaacaaucaugaaacaggaagccauugggggaucugagcagaggaaugaucauagcacaugcauuuaauuccagcacucagagaggcagaucucugagcuccaggccagccagggcuacauuaugagacccugacucaaaauaaauacaaaaacaaaggguuagguauguagcucaauaguacacugcuugccugguauguagaggacccuaggucaacccacagccgugaaaauaaaguaaaagacaagaauagaaacaggaggucucagcugaacauaguggcacagccuuuaaucccagcacuugaaaggcaggcagaucuaaauucaaagccagagagucuacaaagcaaguuccaggacagcaaaagcuacauagugagacccugucuaaaagagaaagaaaggaaaggaaaggaagaaagaaaggagagauuucaaagaggcuuccaaaauaauccagggaaagaaauguaugguaaauuuauaucuggagccaggcagugguggugcacgccuuuaaucccagcauuugggagacagagacaggcggauuucugaauucgaggccagccuuguccacagugaguuccaggacagccaaggcuacacagagaaacccugucaagaaaaaccaaaaaaauaaauaaaugaaaaauaaaaaauugcaucuggaaauaauguaguaaugagaaauacuuagguuugggguacuuuuaaaguugucagugcuuuaggcugagcugugguaucugagaaaggggcaucaaggauaccaaaguuuuuggcuuucagcaccuagaguugccauuuaguaagaacuauacagccuugguaggaaaggccuuucauguaagcugaacgccugcucaacacugccaaggagcuggagaucccagagcaggucugcacugaggcugccaguggggggauggaaucugagcaagcacugcugaguuuacucuuccuucccucuaguucugucucccuuuggcggacuugaggucuaucugggauuuagagaaaacuuaguuggccaggacuuugcuauuauguaaucaagacggcaaaugucagcaacuaaaaauaaaguuaagccugccucuguccuuggaguuggcuucagggacacacacgcugcaagacacacgccuguguguguguguguauuacaagagaagaaauggcuucagggacacacccgcugcaagacacacacaccucuguauguguguguguguauuacaagagaagaacuggagccuggucugcagaguuguugaguuccagaauuccaggaugcccagggaugcacaaagaaaccaucucacaacccauuuuagaaaggaucuagaaaagggcuaggaggaguuagaaaggaucuagagaggggcuaggaggaguuagaaaggaucuagagaggggcuaggaggaguuagaaaggaucuagagaagggcuaggaggaggcuggagguaaaggacuguuuuuuccuuuucuccacaguguuccagaaggaagugcaucuucauacaccaccacaccugaaagcagguaaucuuggccacccucucagucagcugcgaaugcugcucauguugcuuugcugggggagaguuagacaaggccuucaucugaacaagcuuuugcugucagaccaugucuuucucugaccccauaauguuguuugagagcuggcuuucgaagucagccucaacaauggcaauugguuugucuucccaacucucaguccacaccaagauuagacccaaaggaccuuuugcccaagcuucccacacgagagaaaaaaagaguacaaauggccugguaauugccccuggaaauuaccaguaguguucccaagagaguugaauacuuuuacuguaauccuguaagaauauauauguauagccaagcccagugacuguuccucucucagaacuugagaggauccugaaguuaucuguaguaaauccuucucaauaaaggguauguucuaucagguguaguggugcauaccuuuagucccagcacuugggaggcagaggaagguaaaugucugagucaaagccagccuauuuugcagagugaguuccagggaagccagaacuauauauacagagaaacccuuucuugaaaauacaccccccacccuccaaguuuuguuuccaggagcuagagagaugacucagugguuaagagcacgugcucuucuuguagaggaucuagucuaacucccaguacccaaauggcaguucaaaaccaucuaugacucuaguucccagggaauccauucccucuuguggccuccaugucuaccaggaacacacacacagcacacauucaggcacucacuuauauaugcauagauaauaaaauaaauauaucuuugggaaaaaaaaaaagauauuuaagguuagguagccagccuggauuaagcuugguagugaccagcauauaaaugaaaacaaaacaaaaaguuggaaagcuguguggggguggugcauacuuuuaaucccagccuucaggaggcugaggcagguugaucucugaggccagugugaguucuaggacaggcagggcuacacagagagacccugucuugaacaaacaccaaaaagaauggcaaugagagcccggagaaagccuaucaguuccacacccaugcugccugugugccguaccugagucagguuuccagcagccacagaagguggcucacauggccuggaccuccagcuccaggagagccaaugaaugcugcuggcccccagacacugaauuacauccguuucaggguccuggccauggugugcaugugaucaucuggacaacuuuugagaguuggaucuggcagggucaaagucaaggcugcuaggcuugagaggcagccaucuccccaucccgacacaccaucauuagugugugugcaggucagagaacaacuugugcgaguugacucuucaccuccacccucugccaauguagccuucaaggagugacaacccaugcccuuaccuaucgugcaagaccaguaaauuuuaaauucuacguguuagaaaagggacaaggucagcucaccgacuguggugaauggaauguauguccuuuccagaaccugguccacgugcagucauggcagcugagucccugccuuucaccuuggagacgguguccagcugggagcuggaagccugguaugaggaucugcaggagguccuguccucagaugaaauugggggcaccuauaucucauccccaggaaacgaagaggugagugagaaugcugguccuaggaugggcgagcagagugauggugugggugccuauagccccagugcuugucaaguauaggcaagaggcucaguucauggccagccuaagcuagaguuugaauguagccuauacaagacccugucucaaaaaccaagcaaaaguaaaaccccaggaaacuggggguuuguaugccucuccugaacuaauuaauaucuaucuccccuucuucauuuccuuaaaggaagaaucaaaaaccuucacuacucuugacccugcgucccuagcuuggcugacagaggagccagggccaacagaggucacacgcacaucccaaagcccucgcucuccagauuccagucagaguucuauggcccaggaggaagaggaggaagagcaaggaagaacuaggaaacggaaacagaguggucagugcccagcccggccugggaagcaacgcaugaaggagaaggagcaggagaacgagcggaaaguggcacagcuagcugaagagaacgagcggcucaagcaggaaaucgagcgccugaccagggagguggagaccacacggcgggcucugaucgaccgcauggucagccugcaccaagcaugaacagugggcaucaccuccugucugucucuccggaaguguacccagcaccaucgcgccagcgccaagcaugugacccugcacugcacugcacaugcugaggaggggacugaggguagaccaggagagggcucggcuugcacauagacgguacauuguuuauuacuguccauguccaguaaagugacuuugugucaaca

SEQ ID NO: 12175 - RNA, 5497 nt, Mus musculus
uguugacacaaagucacuuuacuggacauggacaguaauaaacaauguaccgucuaugugcaagccgagcccucuccuggucuacccucaguccccuccucagcaugugcagugcagugcagggucacaugcuuggcgcuggcgcgauggugcuggguacacuuccggagagacagacaggaggugaugcccacuguucaugcuuggugcaggcugaccaugcggucgaucagagcccgccguguggucuccaccucccuggucaggcgcucgauuuccugcuugagccgcucguucucuucagcuagcugugccacuuuccgcucguucuccugcuccuucuccuucaugcguugcuucccaggccgggcugggcacugaccacucuguuuccguuuccuaguucuuccuugcucuuccuccucuuccuccugggccauagaacucugacuggaaucuggagagcgagggcuuugggaugugcgugugaccucuguuggcccuggcuccucugucagccaagcuagggacgcagggucaagaguagugaagguuuuugauucuuccuuuaaggaaaugaagaaggggagauagauauuaauuaguucaggagaggcauacaaacccccaguuuccugggguuuuacuuuugcuugguuuuugagacagggucuuguauaggcuacauucaaacucuagcuuaggcuggccaugaacugagccucuugccuauacuugacaagcacuggggcuauaggcacccacaccaucacucugcucgcccauccuaggaccagcauucucacucaccucuucguuuccuggggaugagauauaggugcccccaauuucaucugaggacaggaccuccugcagauccucauaccaggcuuccagcucccagcuggacaccgucuccaaggugaaaggcagggacucagcugccaugacugcacguggaccagguucuggaaaggacauacauuccauucaccacagucggugagcugaccuugucccuuuucuaacacguagaauuuaaaauuuacuggucuugcacgauagguaagggcauggguugucacuccuugaaggcuacauuggcagaggguggaggugaagagucaacucgcacaaguuguucucugaccugcacacacacuaaugauggugugucgggauggggagauggcugccucucaagccuagcagccuugacuuugacccugccagauccaacucucaaaaguuguccagaugaucacaugcacaccauggccaggacccugaaacggauguaauucagugucugggggccagcagcauucauuggcucuccuggagcuggagguccaggccaugugagccaccuucuguggcugcuggaaaccugacucagguacggcacacaggcagcauggguguggaacugauaggcuuucuccgggcucucauugccauucuuuuugguguuuguucaagacagggucucucuguguagcccugccuguccuagaacucacacuggccucagagaucaaccugccucagccuccugaaggcugggauuaaaaguaugcaccacccccacacagcuuuccaacuuuuuguuuuguuuucauuuauaugcuggucacuaccaagcuuaauccaggcuggcuaccuaaccuuaaauaucuuuuuuuuuuucccaaagauauauuuauuuuauuaucuaugcauauauaagugagugccugaaugugugcuguguguguguuccugguagacauggaggccacaagagggaauggauucccugggaacuagagucauagaugguuuugaacugccauuuggguacugggaguuagacuagauccucuacaagaagagcacgugcucuuaaccacugagucaucucucuagcuccuggaaacaaaacuuggagggugggggguguauuuucaagaaaggguuucucuguauauauaguucuggcuucccuggaacucacucugcaaaauaggcuggcuuugacucagacauuuaccuuccucugccucccaagugcugggacuaaagguaugcaccacuacaccugauagaacauacccuuuauugagaaggauuuacuacagauaacuucaggauccucucaaguucugagagaggaacagucacugggcuuggcuauacauauauauucuuacaggauuacaguaaaaguauucaacucucuugggaacacuacugguaauuuccaggggcaauuaccaggccauuuguacucuuuuuuucucucgugugggaagcuugggcaaaagguccuuugggucuaaucuugguguggacugagaguugggaagacaaaccaauugccauuguugaggcugacuucgaaagccagcucucaaacaacauuauggggucagagaaagacauggucugacagcaaaagcuuguucagaugaaggccuugucuaacucucccccagcaaagcaacaugagcagcauucgcagcugacugagaggguggccaagauuaccugcuuucagguguggugguguaugaagaugcacuuccuucuggaacacuguggagaaaaggaaaaaacaguccuuuaccuccagccuccuccuagcccuucucuagauccuuucuaacuccuccuagccccucucuagauccuuucuaacuccuccuagccccucucuagauccuuucuaacuccuccuagcccuuuucuagauccuuucuaaaauggguugugagaugguuucuuugugcaucccugggcauccuggaauucuggaacucaacaacucugcagaccaggcuccaguucuucucuuguaauacacacacacacauacagaggugugugugucuugcagcgggugugucccugaagccauuucuucucuuguaauacacacacacacacaggcgugugucuugcagcgugugugucccugaagccaacuccaaggacagaggcaggcuuaacuuuauuuuuaguugcugacauuugccgucuugauuacauaauagcaaaguccuggccaacuaaguuuucucuaaaucccagauagaccucaaguccgccaaagggagacagaacuagagggaaggaagaguaaacucagcagugcuugcucagauuccauccccccacuggcagccucagugcagaccugcucugggaucuccagcuccuuggcaguguugagcaggcguucagcuuacaugaaaggccuuuccuaccaaggcuguauaguucuuacuaaauggcaacucuaggugcugaaagccaaaaacuuugguauccuugaugccccuuucucagauaccacagcucagccuaaagcacugacaacuuuaaaaguaccccaaaccuaaguauuucucauuacuacauuauuuccagaugcaauuuuuuauuuuucauuuauuuauuuuuuugguuuuucuugacaggguuucucuguguagccuuggcuguccuggaacucacuguggacaaggcuggccucgaauucagaaauccgccugucucugucucccaaaugcugggauuaaaggcgugcaccaccacugccuggcuccagauauaaauuuaccauacauuucuuucccuggauuauuuuggaagccucuuugaaaucucuccuuucuuucuuccuuuccuuuccuuucuuucucuuuuagacagggucucacuauguagcuuuugcuguccuggaacuugcuuuguagacucucuggcuuugaauuuagaucugccugccuuucaagugcugggauuaaaggcugugccacuauguucagcugagaccuccuguuucuauucuugucuuuuacuuuauuuucacggcuguggguugaccuaggguccucuacauaccaggcaagcaguguacuauugagcuacauaccuaacccuuuguuuuuguauuuauuuugagucagggucucauaauguagcccuggcuggccuggagcucagagaucugccucucugagugcuggaauuaaaugcaugugcuaugaucauuccucugcucagaucccccaauggcuuccuguuucaugauuguuaaagauuagcaucaugagggugcuugcaaggcucuaugagaccggcugcuugaguuuccuuucaucacccucuccugcuuacucuaguccuguuccuaaagauaccggcauggcaugcuuaucuuaacucuguugcucagccucucccuucuauaaagcucuaacaccggggcuuggcucacaggcuuggcuucugaugacaaccucuagucaccgcccugaacuauucugcccugcuuuuguuuuuuuuuucccuuuugcuuuauacugaaauguaaguuuuauugagaacaguuuuaucuuuugcuccuaauauacccuggguccccagauacuugguacauagugggugcuuauuaggcauuuguuaggaaugaauggggaaaaagccccucccccaaguucccuuauagagaauuaagcccacugagccuaaaggcagagcggagcuggcugucucuggggacugcagaugcaauauugcccugaguguuucucugcaggguuguccucuagggaaaacucccuuggucuuccagugugugggaccuggcuuucaucagcagaggagccccaggccugagggugcagagacaaacagugggcuggccugacgcaaugguuacacaguuuaguuaggagacgggacugaggaaagaagcagagaucaaucagcccugggagaagcagaagacccuggagagaucccaaauaauuucccauaguuaaagagauccaggcugcucucuuguauggaaaccuagaaaccucuggggaaaagggaaaaacccaucuaugcuccucccaccagcacccccacucgcaaagaucugucagucuucgcguucucuugaacuugagagucagcuacuaacguggccauguuggccccuugacugaggcgcuucagcuugaaagaguuggggggaaugaggcuggugaagaaaaggcugagacagccagaguccccgacuuuggggguguguccugcugccccgccuuuccugcgaacugcccaggccuaagcuggcccgcaguucgcacuacagagacaaguucccgaaggcaaccggagucccucugcagaguggggaccaacucgagacaagggaacgggaaugcaaucgcccaaugcaagagagggccuguaagcaccauuccugaaucagggauucccggccuucacccuucccagucuacaagcuuacaguggaagggguggggcuacauccuccagaacaguugucuccaacuuuauaaaauagcuaugcuggccaggaugggaagguaaggguuagacggagccaguacucgccucucuccucagguuccggcuguuauucuggcucugucgcugccacccgcucaucuucaacaugauauaaucgacguguuaggcucaagauaacugaccu

SEQ ID NO: 12176 - RNA, 20135 nt, Mus musculus
augagugcgauugggacucugcaggugcuggguuuccuucucagccuggcccgggguuccgagaugggcaacucucaggcagguaagccgcgcgggagccccagcaggcuggaagcugggggcgcaaucugagcgcucgcagacccugggcaaggaguuuggguucugacgcuuugaacuggggggugcgguacagggucugcucggaccaccaaggaggggaccgugugccucaguucuuggagugggcuggucagggacugcauuccuguaugccuacccuuauucccagggcgucgccgacccucuaauugguuuuauucugaucugguuggugccgaacaguaguucacacuugagagucuugggaggagggugggcagggacccuucuguaaacguaaggagccuuggcuugaaagggucuccguuugcucucagguucccuggcccccaccccauuccagguuucaacaacccccaguuucguuguuuugccgacagggcggggcuaugcaaggguuugaaguuguuguuuucuaauguuggaaaaacaagaauggcaccuccucuuccgugaguggggcuguccugagaaggcugagauuaaccugagggccaaguccaggugacaucagugagaggucucacagaggcugacugccugcuuucccauaagauaaaccgguccccaacuuaaccaacuucucuuuaucaagacccagguuaauucagugaacauguugggcaucuauuacauacuauacuauuuccagguuauauacccuaagcuggagcucuggaagaaaggacaaucagaccucuuucucucuccaaucuaaggccaccucucccaccuucugaacauucuacucugugaacuggcuccuagacccaacuucugcccuucccccauucaaugccaucugagccuguuccgugucucugggacuauggacacuugaagagcacuagaauugguaucauuagaguccuguugaucuuuccccuuucccagauccccagaucucaguuugggguuggcacauucauugccccuuccccagagugggagugggagaaaccaccugugcuucccccacaguugcugggccuaaauuuagccccugggaucuugagaugugaacacucccagcugguggaggggguggucuggagacugaagugggaggggccaggggagugacuggaucacugucccaucugacugugcccccaccaaccaggaacccaagaguccaagauucccaccacccuccucaagaggcagggagcaggcauguuuaguucucuauccuuuaucuccauccugagccucugggcauccggcccugucucaagccuuguauagccccuuuguccccuuguguguguggcuggggcuucugagggcuggagguucuuggucugcgcagucaaugcucuccacagagaaagguucugacuuugagccuuugcuccucugugagugugguccaccccacacccacccgcaguucucgcugcuuccugugcgccccaaguugccugguuccuccuggguaguuguuuauacucccguccuacccaggcccuuugccccuguuugugaaauguggacuuuacccuaaggguggcagguaaccgagacagaccuguagggccuugcaaagcacaagacacaaagugugcaaggcauugugggcaggugggauggacuggacacuuguaaaacuucccaacucggggccccaggggcaaacaauauauauuucugcaccagaguaacuguguacguguuugugugccagcaugcacgcacagguacacaucauuucccuaugcagauaucuuagcuccuccccuaucugaggagaaggguuggcaccuuaacuuggaagagggguguccugccaggaaggggacagggguggggcacuuccagaaaugacuaaccuucccaggcguuuauuucaccccaaggacccuggagcucccagauuucucuaggagagucuagcuuguuuaugccuccuugcuggaacuggcccacuccuuccaucauaugaagaaaggauaaggaagaggaucuagaagaaggggucagaccagacauagaucuaacaggagaagcugaggccucugacucgcucucugccuccugccccgccucagggaagggugguuagaacaggugguuggugguguaccccuuacccccacccuccccacgugcucuuacugcgccagaggaaagauacuuagagcuccagggaggaaagugaaagcccaagaacugaaauguacuguacuggccucucuuuugggcucucuccccuggagugucuauuggggagcacugccauguuagcagucucuuuaaagaauccuucuggcagugaaauugggaagaaggcuugggaguggaggcucuguucugcuucucuccagaccucucuguuuggugaaaagcacuucgggacugcacagggaugccugcugccgggggagcuggagcaugcuggcuuaggggaagggagugagaagggaaaccagaguuuaggagaggggaggccaccaguuccuuaucauccagcuuuaaagacaaagcucccauugaccccaccuccccaccccacuaccaggguuucucccuccagugaggucacuuuucugaggccaaagcuccagggugagaggggggugcugcuaaggauggggugucugaggcaggguggggcagcccccuccuccuggauagaauugcuucauugugggcugaacuguggccccaggcacugcccccacccucugcccccaucccacccucuguagacacaauaggggcugugugcuagccccaaagagauguuuauuccagggccuagagagaggcaggaugggggcagagaaguaagugccuccguugaggaggagaggguaaauguucccugccuaaagaguguccuuuccagggagagggaaaguccagcaugucuucccucuguauuaaccccucagugccaaaucagugcccaaaggaggcacaguggacacuccagcguggaaaaguucacauuucaccuuuccaaacugugagaagcaaggaggcucuuggaggcugcgugggcagguuuaacugugggcaaccgagaggcacucauggaagggacaucuagcuuaccuaucugucucgccuccacuuucacaguauguccugggacucuaaacgggcugagugugaccggcgaugcugacaaccaguaccagacacuguacaaacucuaugagaagugugagguggucauggguaaccuggagauugugcuuacgggacacaaugcugaucuuuccuuccugcaagugaguguccccgcuuggucccuccuacacuuuccauagagaaggcuuuuccuuucuggggaccaucuuuugcugcaguuggcauuccuaagacuuaguaguucuuaaggcucaaaccuagggaaacagugacuguaauggggguggggguggggauggguguccugguccuguaaccaggguuaugugaaagccggccaccagaaagggacagggcaggugucaaucaauaagcuaccagaggacccagagucaccuggagaggugaggaagagacuccucacccuuccauccauuaugacucugagaagaaauaggaaauguagaucuguccucauuucuguggcuuguuuuugcucacccaaguggcacaguauuaugacagcaugcucccuacaaaucaggaaaggaauucagagcugggguuauagcucaguggucaggugcuugcagaacauacaugagguccuagaaucagugugcaguaugggggucgggggugaagagaaaggaaauucagggaggcuggacacaggacuggagucagggggcaacuaugguauacugguagagagcauuuaccaaacauuaagguccucaugugauggcgcaugccuuugauuccagcacuugggaggcagagacaggcagaucucugugagucugugauuagccuuguuuacaaacagcgagaaaccagaucucaaaaaaaaaccuaaauaaauaaauaaauaguuaaagaggccaggcagugguggcgcaagccuuuaaucccagcacuugggaggcagaggcagguggauuucugaguuccaggccaaccugguguacagagugaguuccaggauagccagagcuacacagagaaacccugucucaaaaaaauuaaaaaaaaaaaguuacagaggccuaagacccuguuguucuuuucacugucacaguggauccgagaagugacaggcuauguacugguggccaugaaugaauucucuguacugcccuuaccuaaccuccgagugguccggggaacccaggucuacgaugggaaguuugccaucuuugucauguugaacuacaauaccaacuccagccaugcucugcgccagcuccgguucacucagcuuacugguuaguuucugaugauccuuucuggucuugccccugagccuucuugccaacagguaccuccuuggugaugacccaaaacuugucacucuaaguucauuuucacuaccuugguggucuaaaaguccacuacucuuuaagcaguagagggucccggggagagcuggggcaccuguuccagguaggaggaaccuuaugugauggcgggguugaacugggaauuggaucuauugauaacccuucuucccuggaaucuuaccugugccccaaccggcugaagaauguagggguuaaacacagucagggcacucucugcucucccugucccaguugcuuagaaaacacucaggccuaggggagugaaucaggauguccuacccucccccacuggcuaaaccggaucuacacaggugucugaagaggcuggaguuucuuuggccugacuccuccucuuuucuugaagcuugaaucugauuggaccaccuguagcugaguguuuuuuuuuuuggauugguaggaagguguggaaggggaguugugccgcagucuucagccugucacuucucuucccaccacagagauucuguuagggggcguuuacauugagaagaaugacaaacuuugccacauggauacaauugacuggagggacaucgugaggguuccagacgcugagauaguggugaagaacaacggggggaacuguaaguggaugugaucgaggcagcucaccuugccccagcaaaccggagcgacuccuuucccacuccuacugcauucccucaucugaacccaccuuccccaaacagucaccucacauccuugacccaagagccugccagccaggagggacugggucagucuccuggagcccaaaccaguguaucaggaaaagaggcaaaagaugucuuggguguuaaggagggaagucagaucuuuggauuagcucccuguugguuuugccaauauaguaucucccagcugcccugagcuagucuacugcuccuuuccacucaggcacagaaucagcuugucuggaaggaaccagguucccgggauggcacuggacugagauuggcaucgccccagucccuccucuucagcugcccaguggguaguguggaggaguagcuccgccccuuguugucagguucacuugagcccagcccugcucuccaagggcagggagggacacagcccagagcuuccugggauugagguuccugugugcugacaucauacccuguggauucgagcaagccuuucucacucaguucugaugguccuguguguccucucgcuucccaaucagguccacccugucacgaagucugcaaggggcgaugcugggggccuggaccagaagacugccagauauguggguuugaauuuucuucuaaaaaguuagagcacacgccgucccauacccauuaccuaugcaguccugucugugucuguccgaacgcucggaaugagcgaugguggccucugaauuuaucccugaacaacguguguucucucuuuccguagugaccaagaccaucugugccccucaguguaacggucgcugcuucgggcccaauccuaaccagugcugccacgaugaaugugcagguggcugcucuggaccccaggacacagauugcuucguauguaauggugccaucagccugugcucugaugcaggguuaugagcuuuggggaggagaagggggcuauagaaaauauaaauucuaggagucuuuuacauucccaggccugccgacacuucaaugacaguggugccugugugcccagguguccagcgccccuuguguacaacaagcuaacguuccagcuugagcccaacccccauaucaaguaucaguacggaggagucuguguugccaguuguccccguaaguguggggugugugugugugugugugugugugugugugugugauggacaaccauagauuccacacaaaaaaguuugggaugcuaaagggauuaaguuagguguuaaucgggggaaccuagaugugauuaugugaccucaccuagugagugacaucucucacagugcccccugcccccagacuucugggaggggucacaacaaagagugaagaggccuggagcugcaccuugguugacagugcuugcuuaguagugugccugaaacccuaggcuugauaacuccaauacuacauacccugggugaaauaguguacuggaaucccggcacucugcgguagagacaggaggauccaaggucauccuuagcuacaugaaaaguuugagaccaauugcugcccuuccaaagaauucaguucuuagcacccauauacagccuauaauagccuauaaugcuaguucuagcggaucucacaccuauucuggacuccuugaguaccaggcacaaaugugacagacagacagacagacagacagacagacagacagauagcaauauaugcacauaaaauaaauaguaaauauuuuucucuuuuagaugaaaaccaaucuuuuuuuaaaauuuuauuuauuuuuauuuauuguguauugguguuuugucugcauguauuaugccuuugugagguuguuagaccuugugauaggugugagcugccauuuggguacugggauuugaaccuggguccucuggaagagcagucagugcucuuaacugcugagccaucacuccagccccuuaaaucuuuuucauuucuuucuuuuuuuuuuuuuuuaaaggggcuugaggccaucuuaagaauaaagagacugucuaaucuguaggacauaucuaaggaacccuagguuauaggugggacgaaucucagggcagaguggaaggggcaggggagcagaggaggggucugaguaguuggcuauuacucacuucuaaugguguucuucucuuuccuagauaacuuugugguggaucagacauuuugugucagggcuuguccugcugacaagauggaaguagauaagaauggacucaagaugugugagccuugcagagggcugugcccaaaaggugaaguggugggaggugaagaggcgggaaguggggagaacuuacacccagauuaaucuaugaggugacucagaacccagcgcugagacuguucuuuguuugcagccugugaggggacgggcucuggaagccgcuaccagaccguggacucuagcaauaucgauggguucgugaacuguaccaagauccugggcaaccuggacuuccucaucacuggccucaauggguuagagauucugcuuuuccacccuaaauccacagcccuauccaccacaugguucauuucaauggcuuaaaucuccacaugcaugacuagaaauguaaaucacagcucaggaggcagaggcagguggaucucugugaguuugaagccaggcuggucuacagugggaguuccaggacagcuggggcucccugucuugagaaacaaaaaccaaccaaaccaauauagaaauguaagucaggaugucuuaggggguauaaagggccugagagaauguaugacuccacuuuccagguggagcuugcuuuuccucauggacaucucuaagcagcccagucuuaccucgagaagugacaagguucagggacaguguuuguuaccuaaagcuuuugagaaguuccuccuuaaauuuaaauaaaaggaggcuggagaaauaggucaaugguuaagaccauguacugcaggcucacugaggcuggauacauugucacagucugugucacagucugugacaauguauccagccucagugggcaccugcacauaacaaggacugaaaauaauaaaaaccauuguguauuuugcauacuuuuuuacuuuuuuaaaauuuuauguaccugaguauuuugccuacauacacaugucucugcaacauguguucaccuggcacccacagaaaucugaagaggcuguugaauccccuggaacuaaaguuacagauggcugaaucaaacccuagcccucugcaagagcaaccaguguucuuagcugaugagacaucuuuccagacccucuuuuaauuuuuucuaguuuuguuuguuuguauauguagaccugugugugugugugugugugugugugugcgugugugcgugugugcguguaugcgugcauguaugggcaugcauguaccacagcgaguaugagacucagaagucaguuuuuggaaaucuguuuuuuauuuguacccuguggagccugggauuaaacccagauccucaggcucugcugaaucaacucugucugcugaaccagcuuuuguuuuguuuuuguuuuuguuuuuguuuuuuguuuuuuuucgagacagaguuucuuuguauagcccuggcuguccuggaacucacucuguagaccaggcuggccucaaacucagaaauccaccugccucugccucccgagugcuaggauuaaaggccaccaugccugacuucugcugaaccaucuugcugaccaccucuuuuaauuuuuuuauguagauauaacuuuagaguagcgcuuaaauuguaaaaaugacauauucuccauacauacuuacccagauuccccuacuacuagcauaauauaaaugcuuuuauuuaauuuuuauuuauuuuuauuuauuuuuuguucuucauaaugggguuucucuguagcccugccugacuuggagcuugcucuauaguccaggcuggccucaaacucagagaaucaccugcuucugccuuccaagugcuggaauuacagccaaaugcugcugugcccagauacauuguuuguuuguuguuuguuuucaucaucucucccuuuuccuuuuuauacacacaccccuuaucucuuuuuucauuuuuuuuuuaauuaaauaauaucuucacauguagcccaggcuagccuuggucuugccacucuugcuuggccucucaaguauuagugcugggaucacaggugugcacuaucaccucugcccuacuuuguuuuaugugcagggauggcuugucugcauauaugucugugcaccaugugcaugucuggugccugagacagaaaagggugucugagucuuugaagcuggagcugcaggcaguugugagccaccgucgggggcugucaggcuugcauggcaagcgacaucacuggcugugucggcuuuugaguauuccuuuucuuuuuggcauaagaugaucugggccucuguguauuuguuucccccaccaccagcauuucuccaaggaguucuauuuuuccuuuagaugaagauagacucaggagaagaggcuguguucuauaguaaagcagcuggcuuagcaugcacaaggcccuggauuugaucccuagcacuggggaaaacauugauaucuagaaacuguguuuugaggugugguguguuauuaccacugagucauaucucuccuuuauugacaaguuuuuacuguucccuuagugaccccuggcacaagaucccugcacuggacccggaaaagcucaauguuuucaggacaguccgggagauuacaggugagggaagagggcaggccucccugcuggaaggagcaggugacacacgcaggcacaccuuucaguuaaaccacuuaagaaaagucacacuuguggggcuugaaagauagcucagugguuaagagugcugucugcucuuccagagguccugaguucaauucccagcaaccacaugguggcucacaacuguguauaaugggaccugauguccucuucuggcauguaggcauacaugcagguagagcacucauauguauaaaauagauaaaaucuuuaaaaaauaaaaaaaaaaacaggaaagaaaaaagaaaagucucauuccagaggacagugaggcagguuacugagaaccugaugcaguggggaagacucucugcuuauacaccucuccccaaacccucaggcuaccuaaacauccaguccuggcccccucacaugcacaacuucaguguuuuuuccaaccugacgaccaucgggggcagaagccucuacaagugaguacugggcuuggugguggugguaggaucccuagccagugaggugagccucuuguuaugauauacaggguauuucucaaccaacaggcccuaaaugucugcuagcaugggaggccgggggggggggggggggggcggcaaaaagucagaguaaucccaaaugugguuaauuccaacacggacaggaggaucaccaguuaaggcuagauagcgaguuccagaccugccucaacaauacaccgacaccuguuucaaaaaaccaaaccugccauaagcggcaauucccucuccaugggucuaacuuagccuggaacagauuuguugagugaaagaaaccuccccuguauguuuaauuaacccuuugugguuugucuucuaauucugacuccuuauucgcagucggggcuucuccuuguugaucaugaagaacuugaaugucacgucucugggcuuccggucccugaaggaaauuagugcugggcgugucuacauaagugccaaucagcaacuuuguuaccaccacucucugaacuggaccagacuucugcgggggcccgcagaggagagacuugacaucaaguacaaccggccucugggagaaugcggugagaggaagggcccccaggggagggaggacagggguccaggcagugagaggauccggaaaguaggaguagguaugaggguggaggcuauaaggaagaagcauucagaaggcuuccugggcacccuuagagccuuccuaauuaugucuguucuuuuccaguggcagagggcaaagugugugauccacugugcuccucugggggaugcuggggcccaggcccuggucagugcuugucuugucgaaacuacagccgggaaggugucugugugacucacugcaacguucugcaaggguacgguggggagaaggccacgagggugggagggaggcccgaggauggauagagcaguucagguuauuuauuuaaugugcaugaguacacuguagcugucuucagacacaccagaggagggcaucggaucccgugacagaugguugugagccaccaugugguugcugggaauugaacucaggaccucuggaaaagcaguugguguucuuaagugcugagcugccucuccagcccuuucuuucucccuuucccucccucucccucuuuauuucccuccccuccuucuccuaccccucccuccagccuacucgccuuguaauccuuuuccuuaaccuuuuaaaugcugggauuacagcuaugagccaccauaucuggcuugccuaugucuuuuacgugugcaugugccuuugagacagcaacagagagacagagacagacagacagacaggaucaugugguccuaaccuagagcuugauagcuugauauguauaccagacaggacucaaggaguucuuccugcuucuaccuccugagugcugagauuaaaggugugugccaccacaccuggccuucucuugcuuucuuguuugcuggcuugccugcuugcuuuuguuuuuaaauagaacucagggacaucuuucuuccuuagccucuagagugcugggauuucagauguaagccaccgcaccugacuauguagacagcuuccugcuggugucuuggugggcaugaaguagaaggucuucguugcagguuaaggggaugaagggcagaagugauuccucccugugucccccauuacagggaaccccgagaguuuguucaugaggcucauugcuucuccugccauccagaaugccagcccauggagggcaccagcacgugcaauggcucgguauaguugcagcucugggaucuguaagagagaggggaaaugaccaaauuuccaggucagcccagagaagucagauagcccuggaguuuguacauggaggaugcugagggauuggggcugauccuuacugggaggacuggaauuaacccugacaucucauucucaaagaucuuccucuuucuacucagggcuccgacgcuugugcucgaugcgcccauuuucgugaugggccccacugugugaacagcugcccccauggaauccuaggugccaaagguccaaucuacaaauauccagaugcucagaaugagugccggcccugccacgagaacugcacccaagggucagugacgggaugaaagagaggagaggcgagggagagguugggaacccauaaucaggguguggagcagcaagaagacagguugacaacuuaagacucagguccagcucuaaaggacgggaggaagggaaacucagcacgggaguacaccauccuuaggagaagcugggauagcauuagcacaggaguuuuguucaggagagacucacuagugagccagauauggaggcugaaacuaucaggaaggauagaagggcggaguccccucuguuuuagggcuagguuuggggcuucaggaugagaugccacaguagguucucaaacaagcuuuuauauauggaaguucuuagacuucagucucuauuucuuuuuuuaaauuuauuuauuauuauauuuaaguacacuguaccugucuucagaugcaccagaagagggcaucagaucucauuacggaugguugugagccaccgugugguugcugggauuugaacucaggaccuucagaagagcagucggugcucuuaaccaccgagccaucucuccagcccgacuugagucucuauugccuuuaaaacuuuuuucuucuaaucacuuuucuuuauugugaaugugggaacugugugugcacgaacacaugcuacggugugcauguggagaucaaaugacagcuugagguaguucauucucuccuucccuuacacgguucccagggaucaaacucaggcccucaggcuuggcugcaaguauauucaucugcuaagccgucuuguuggcccaauccucucuugucuacuuacugucuaagaaggugauuuucuuuucuagguguaagggaccagaacuacaagacuguuuaggccaagcagagguauuaaugagguaagaucggcuuggagaauguuggguucaggaauguuugggagaaaggucagggaaagaacgauguuauuuguucugccauauauauauauauauauauauauauguuuuaccucauuuaugucucugcacuacuugcuugccuggucccuuuggaggccagaagagggcaugagauaucuuggaacuguaguuaugaaucuaugagccauuauauacguguugggaauugaacauggguccuucacaagaacagccagugcucuuaagcacugagccucucuccaguggcccacucugcccuuuuaaguuuucauuuuuagccuggugguggugguauacaccuuugaacucaguacucgggaggcagaggcaggcagaucucugaguucaaggaacagucagggcuacaaagaggaaccccugucuugaaaaaaaaaaaacccaaaaaauuauuuuuuacauuuuuguuuauuuuguuuuuguaacauggugucucuauauaguccugccuggcaugaaacuugccguguaugccaggguguuugauaacucacagacauccuccugcuucugggucccaaauaccaggauuaaaggcauguagcacuaugccuaccuuuaaaaguuaucuguuuuacuuuauauguaugaauagugccuuaaugaauguuuguaugugcaccaugugugcccgugcucagggagaccagcagagggcacuguguucucuaggaucuagaguuaggauaguucugagccaccauguggguucagggaaccaaaccuggauccucuuuaggagcucugaacugcugaaccauaucuucagccccccacccucacccccuuacuuuaaauaauauuuguuuuguuuuuaaagauuuuauuuauuauuauacauaaguacacuguaguugucuuccgacgugccagaagagggugucaggucucauuacggaugguugugagcuaccaugugguugcugggauucgaacucaggagcuuugguagagcagucagugcucuuacccgcugagccaucucaccagcccuaaauaauauuuguuauuuauuauuuggaaauguaauacaguuaugugauaucuuuugaucauaccaauccaccuuuaucuccuuccagauuaccuucaugcccuuccccuuccugauuuccuguccuccuuuucauuguuguuauuaauaacacccugggucuauuuagugucacugguaugcacgggguaugggacuguccacuggagccauucuucccuuuuauauauauaguccaccaucccuggacucaagaguccuggcuucucgaauucucuuccuagauuaacuuaaacuggcuuaaaagggggcaagcccuguaucuggguugauuccuucagugcucaugggcauuaauagagaugaaugcuaacucacauguacaccaaauaaaugaccuuugugaagccacuguaaacccaggaugcuggccuuuucuguaucccacagcaaaccacaccuggucauagcggugacaguaggacugacugugaucuuccugauucugggaggcucuuuucucuauuggcguggacgcaggauucagaauaaaagggcuaugagacgcuacuuggagcggggugaggugaguauuuaucuagcuuaacuuugggaagcauccuuuacaaucugcucccagggaaaaucgaugaaccuugguucucuuucucaggaaauauggucccucucuuugaggggaugguauagagcuauggauacagcucagaaugcuugccuaacauguacaaggacccagguucaguccuagcaacacgaauguacagugcacauauguguacacuccaguccaaaaaguagggagauguucucaucuuguuuuugccuuuugccacaacgaugaagaaacuacuuuccuucucuguggcucaguuuaugucucuuagauacaauaacauucauccuuccaaggugauggguagugguaugugcaaguuccuugaaagcuuaagcauuuugguccagggcaguaauucuggcacucagccaaggcagaaaagauugcccugaguucaagacaagucugaucuacacagcaaguccucaucuucgaggacagagggauagaaaaccagaaucaaccuugcaugaaaagucuucgagauggggguaccaccauaucuccucgauucccuccuccuacucaaagggaaaccaaucccucuugaccuuucucaucagcacagcuuccucaauccuauaguuccugaagugucuguuguuccucagugaaauuaugaagcuuuccaagacuaaggacuuaucuucuuacccuaggcucugagcucugcugcucuuggugcagaggcaauaggugggacuaggcuugugggagugggcuuuuacaaauaacuccuuccuguccaccccucagagcaucgagccucuggacccaagcgagaaggcaaacaaagucuuggcuagaaucuucaaagagacagagcugaggaaacuuaaggugcuuggcucuggugucuuuggaacuguacacaaggugagugacucuugggaagucuagagaagugggaacaagaugccagggaaaaugggagaaagauuuuggcagaacacugucugaaaagagugauuuuuuuuuaaaccucccucccucccuccacuucaaacuuuccaggggauuuggauucccgagggugaauccaucaagauuccagucugcauuaaagucaucgaggacaagagugggcggcagaguuuucaggcugugacugauguaaguuaaagaagggacuucaucuguaaucuucagacuccaauuaaguggaugccauaaugagagaggcaguguugguuucgggcauguaggcauaugaucuuguguuggcaaauaguguguuagauccaucuuaggcaugaguguuaggggaccucuggauugggugugcuuuuguggaguguaugcaaacccguuacuuccuggcuaacaccucuuauauuuugcagcacaugcuggccgucggcagccuggaccaugcccacauuguacggcugcugggacugugcccagggucaucucugcagcuugucacucaguacuugccucugggcucucuccuugaucauguaagacagcaccgugagacacugggaccacagcugcugcucaacuggggaguacaaauugccaaggugaggggagucaggggaggccuuugauagcaacagcuuagcuggggaaggucgggguugaggaaggaggauuaaggguuugaggucaugagugcugucuucaagguguggccagcugcuauugcucaguggccgacucccccaacccugagaccaccuccuccucuaggguauguauuaccucgaggaacacagcauggugcauagggaccuugcgcuccggaaugugaugcuuaagucaccgagucaaguccagguggcagauuuugguguggcugacuugcugccgccagaugacaagcaguuacuacacagugaggccaaggugaggugacaagggccggagugguuggguggcgugagcauggaauacagagcagucaaggggcucuagcugagauaaguaaaugaguccuggagauucaaggagaggaagcugagaaugacagaaaauuuaaguucgcgggaucaggggggaaugggugauagagaacuuguaguuuuaagaaaauaggugaaaauuaauggguagcaccuucaucuuuaaucuucagacuccaauuaaauggauggcccuugagaguauccacuuugggaaauacacacaccagagugaugucuggaguuacgguaagcaccccuuugucaucaccagcucaggucccccuuuugugucuccucuuaagaacuauaugccagccaggugugguggcgcacgccuuuaaucccagcacuugggaggcagaggcaggcggauuucugaguucgaggccagccuggucuacaaagugaguuccaggacagccaggacuacacagagaaacccugucucggaaaaaaaacaagaaacaaaaccaaaaaaacuauaugcccuugcaauccuuguauuaaagggaggccaacccucccuucccuuugugccuguaucuauuuuucauaauuauuacuuaauuucuuccuguaucagguguaaccguuugggaguugaugaccuucggggcagagcccuacgcagggcuacgacuggcugaaauaccagaccugcuggagaagggagagcgguuagcacagccccagaucugcaccauugacgucuacauggucauggucaagugugaguugucuucugacccuagccuuuucuaacugacucccuccuuucucuuccacggcucuguucucucuucuggcucaaccuccuacaucucucccuagguuggaugauugacgagaauauucgcccaaccuuuaaagaacuggccaaugaguuuaccaggauggcccgggacccaccaagguaucuggucaucaaggugaguaagggcuagaggaugucagagucauuuagggaaaggacguagagaacuagaacccaccuuaauggauuucuacuccuguagagagcgagugggccuggaauaccuccugcagcagagccaucugcucugagcaccaaagaguugcaggaugcagagcuggagccagaccuggaccucgaccuagacguggagguagaagaggagggccuggcgaccacacuggguucugcccucagcuugccuacaggaacgcuuacccggccacgugggguaagauaucuucuaaccgcacaagauucugcuacgcagacaccccccacacacacacacaccccacccccgugagcaugaagaaucaccacucaucagccuccacacuaagaauagauuucuuccuucauuuuagcccuuuccuuuccuuucccauucuagagccagagucuuuuaaguccuucgucuggauacaugcccaugaaccagagcaaccuuggggaggcuugucugguaagaugugcuggcgcuugcuccagcccaaagguuuauuauuguauguaagucuacuguagcugucuucagacacaccagaagagggcaucagaucuuauuacaaaugguugugagccaccaugugguugcugggauuugaacucagcaccuuuggaagagcagucagugcucuuaacuguugagccaucucuccaaccccgcaucuugcuccuuauccucucucucucuauuccccucccugcucuuucuauccucuacuacuccacuccucuucuccucucuucucuucucucucucucucucucucucucucugccuuucucugccucuacucccucaacuccccuccccaugcccugaauaaacuccauccuauacuaaaaaaaaaaaaaaaaaaaaaagaaaaggagagaaaagaaaagaaaaaggaaaauggagauguuucaaauuuuuaagguuuaguuagcauccugccaacagagaaggcccuccccgagcaacugugccuccuucugagucuguauuuuuauacaguccauauaauccuuguauugcuuccuaugacuuuuccuccguaggauucugcgguuuuggggggucgcgaacaguucucccgucccaucucucugcacccgaucccacgggggcgucaaacgucagagucaucagagggccaugugacgggcucugaggcugaacuccaagagagaguaucaauguguaggagccggagccggagccggagcccacggccacguggggacagugccuaccauucgcagcgacacagccugcuuacucccgucaccccgcucuccccaccaggguuagaggaagaggauggcaaugguuaugucaugccagauacgcaccucagagguaccugucacuuccagcguuacccucaaaucuucuaaucuuuuuuucuccaagcuccccuuaauuuuuuuuaucuucucugaugacucgcucgcucccauuccuucugguuauuucuaugaaguucuauauauacuuaagaguuucucucaaccauagguacauccucuucccgggaaggcacccuuucgucaguaggucucaguucugugcuggguaccgaagaggaagaugaagaugaggaguaugaauacaugaaccggaagaggagggguagcccggcucggccccccagaccugguucccuggaagagcugggcuaugaguacauggauguggguucagaccucagugcuucucugggcaguacgcagaguugcccacuccaucccauggccaucgugcccucugcuggcacgacuccagaugaggacuaugaauacaugaaccgcaggcguggugcgggcgguuccggaggggauuaugcagcuaugggggccugcccagcagcugaacaaggguaugaggaaaugcgagcuuuccaggggccuggacaucaagccccccauguucguuaugcccgccucaaaacucugcguaguuuagaagccacugacuccgccuuugacaaccccgauuacuggcauagcaggcuuuucccuaaggcuaacgcccagagaauuugac

SEQ ID NO: 12177 - RNA, 18389 nt, Mus musculus
gggguaggaguuugguugagcugcagcuguuugucuguuccacacaggcuugggcccgacgggggauacggagccccagguaccgagcugauggagcccacaagggcagaggcggaggucccgagaggagcgccgccuggccuguggcagaggcggggcgggccgacgucagggcuccagaaccuccuggagagggccgaaggggcugucccacaggccuagugggcgcugaggaggugaucggcagggcugggagccgagccucuaguugggaggcggcuggguucuggcugugguggccgcucgggggccgggcgcggggacccggagccggugaggaccagggccggccucgggacucugagcaccgcggugaggagggaggagcuggggucggagaccaggcagugagggaggggaagccagcccauuuggcuggagguguggaggggacagugcuacgcccagccccgaggguagccgaggcugggucucccgagacauccacuguuggggcucuuagccgagagaggcauucuuuucagggaaagugacuguugaaaggggaacuagggguacugguguugccgagagggauuuggucucacugaagucaaugaagaauguagaagaccaaaguggaaggaaguagaaacgguuugcuauuaguaaugggaacuucuggaaugauggugaggggaggcucaguaucuuggaaguuccuuacucuucuguuccuuuagugcuuggguguggugauuugaaguuuugggguacuucaggaauagggaaugaagacaaagguaaaauuauguauuauuccauggcgccuggcagcucuacguccagccccccccccccacacacacacaccacuuuaguuuacccugaccucauagcuagucaugacugcacuccuguuuccuuuagguuugcuauuguauucguuguuuuuccuauuucaucuacugugagagaacuaagaaaauuugggagugcuuugcucagucuuucccacuucauaaugugaucuguggugacuacgcuuauuuaaccuagauuugaggaacucugucauuugcauggaaaggggcaaagcaauccccagccauuaaaaaaaaaaaaaaaaaaaaaaaaggaccauguuuauugaaacuucugugagacuugcacuugagcauuuccuagauaguuaaugggacagacuauucacgccaggaacugugaggugauaucccugaagggauuuggggaagaauugagagguuagcuaccagaagguuggcaccauccuuucuucuuugcccacuuauucaggaacgugugugugugugugugugugugugagauuaguuauuuaggucaaaccuugagguauuuagaaagauggauuauagagaaugaagaagucuuuaaauuauauuauauguaauaaccugcauacauaugugagccacaaugucagaggauaacuuguggcuguuugguauucaaacauggcauguguguguguguguguauguaugcauacauauauacacacacacacacauauagagggagggguuugcuaaccugucaaauuuuuuauagauuggacccuauugguuucucccuuaggguucuaccuccucuuccuccuccucuuuccuuucuauacuaauguuagugaucacugaauuuauuuauuuuuuuuaccacauaguguccugcauauauaccacaugcaugcaggaccccucagaggucagaaaagguacuagacccgcuggacaauuaggagcugccguguuggugcuggaaacugaacacaggucucuuacaagagcacuaagggccgccaagccaucuccauaacuuguaucacuacauuucuuaauuaucaaaguaacacauacauauauuaaaguguuuaagcuguacagaaauauauaaaaucugaguccuucuauacauagcuuauuucauuuaggacaguuagagguauuaaauaagacuaaucaagagcagaauacuauggaaagaaugagaccaucauuuagugagcacaugaaaaaaacccaagcaaagacagguuuuuuucaugugcuccuaaaugcuguucucauucucuccacgacauucucuuggaugacacucugcuauuuauuguguucccuuugccguucaucuugccuucuaucaaauucagaacaaacauagagcuguccuuugaguuaucauuugccuucuucaguguauacacauaguggugcacuggguagucuagaaaccgcccaaaugcauaauaagcaagacuuuuauaggcaagaaagaaacaauaaggggaauaauuuuguuuaggauaguuguuagcaucucuacuagagugaagaaucagaaaccccucguucauccacauuuucacaguacuugacugucucuuccuuaucucagggagauggucaugguuccagaagagggucuuguaccuggcuugguauagugacccaagaaguucccauauuucucugaauuugaacuuggacuuuuuugacuuuuugaagcccucuaauauggucauugcacgguguccagcaaaaaccucaguuuaccccuccucccacuuucucaccuacacagucaguccuggagaaaacuauugggauguguguauguguguucacccucuguaaucuuugccauccuuuuguuuuguuuuguuuuguuuuguuuuucgagacaggguuucucuguauaguccugacuguccuggaacucacuuuguagaccagccuggccucuaacucagaaauccaccugccucugccucccaagugcugggacuaaggcaugcgccaccacgcccggcugagguuuuuuuuguuuguuuguuuguuuguuuugguuuuauuuuguuuugcuuuuccuaucuucuccuuaaaaccuuucaagaagugaucuggaagcugggcauggugguacuugccuuugauuccaguauucaggagacugaagcagcagaguucaaggccaggcuaagcuacauaacagacacuaucccaaacaguaucacuacugcccacaagguuuuguuuuuguuuuuaaauuuaggguuuaggauuguagccuagugguagaauauaugauuagcauuuaccagauccuaagcacaaagagaaugaaaauagagguuguauuuggaauugcuaaaauuuaagcuguaaauuauucauagugacuuaaaauauuaucucccaaauuuaccaaagucuucugcauauuuagggagcuaaagaggcuuagcaauguccaauuucaaacacaggccuggaguuacaguaguauacuaggagaagagggcuuucuuggucccuuaaacaucguacucuguaucuucucuuacuuugcuuuagugcaagaaugaguccguggugguuugcuugucuguguguguguuaauacauuuggcuucugagaaggagccacagaucggguaggagaagcaacagacaccuacuuccuaacccugagacaucucaggugggaaggggaucaguagcacagcuugugugaggccaaauggaaucaaagugugaaacagugaacuugaaguaaggaagcgcaauggcccuccgagaggaaggaugccacaaaaccauagacaguauauacucuuacuucccaagaaaguuucaggaaagacuuagucauucauugaacaacaacugaauugauaaaagaagucacccggugaggagaggaaaguacagguuucuggaguggcuagaguguaccuuucucuuagggguuguggauaccuggcugucugugaccuuuauuucuaaacuuguuucucaaggccagggauaaugaccuuuuuaaaaaacugcuucucaggugugguggugcacgcccuuaauuccagcacucuggaggcaguccuaucucugaauuugaggccagcccaauguacaaagagaauucuaggacugccagggcuauuacgcagaaaagcccugucucagaaaacaaacaaacaaacaaaaaucugcuuaacaucaccuaaaaccucaaagagguuuguuuuuuaaggcacuaggaguugccucaguguuacagagacacugugauuaggccaugggagacauaauaacggguggcaggaagagcaguuggcccaugugaauuacaacaguacuguguggguggggucacuccaucggaagagaacuguucuaaaaccugucaagaacucccuaaacugaacugaggucuauccagggaggaguagguuggggaagauuucaggaauacuuaaugaacuacuacuacuucucugaagguuuauaauuacacguuuuuaaaaaucccacuuuuugagaagguuuagcagaguaaauggauauaacucagugugguaaauacaugauaggaauauguugcugguuggggagauagcucuacagguaacgaaagguauugaaagcuugaugaguguucgagucccagagcccacauuauggaaggagaaagccaacucccagcggcuguccucugacugccacaaauguacuguggcagucaagcacacauaugugcacauauacacagaaaguaaaugguuuuaguuuuuuuauguuuuguuuugcuuugcuuugcuuuguugacacaggguuugucuguguagcccuggcuguccuggaacucacuuuuuagacccauuucucuggcucuuaagucuuggucauaauuagcuuuuugggguagucuagagcaaugaugaauuuuacuaucauaaggagauaauuauguaguuucacaagugacauuuauacucaacccuauaaguuugggauuuucuagguagacaaauuagggaagguguucuaaucuuucccaagucaauaauugggaguuagcacugccaugcugauaagcgauaagcaugcuuuuuaccuuuuggagaaacaagggggagcagggaggagguggaacucuuaagccagugacucacuggauaauguugaaucaacaguuaaagagcugagcuaaguaguagaacucucaguugaagauuucagugauuugggucuaaagcaaguagaaaggaaaugaagguauuuguuggcuucugccccaucuuccuuuaguaaaucucacauugacuccaaaacucacugaauccuacaaauugccacaguuucccuuuugccaacuauccaggcagggcuuguuuaaggccugcuacagaggaguaauggcaauccuaucggaacagugugagaauagauccuaguuaggaaaguuuccaguuccaaagcaagcacuuagcggagcugaacugagacagaagcucucucugguguacacucauauuuguauuuuaguacccucaccaaauuaagcauuccugauucuuugagaaguauaguagagggacuggggaaauaucucagugggaaacaugcuuuuuuuucuuuuucuagaccgggcuucucuguguagcccuggcuguccuggaacucuguagaccaggcuggccucaaacucagaaauccuccuuccucugccuucugagugcugggauuaaagguguucgccaccacgcccagcuccuggaaacaugcuuuugaagaccugauuuuaaucccuaaaacccaugugagggggaaaaaaccugucaccuacauguaguuccaggucuggcgagguguagagacaaacagauuaugggggcucacuguccauccuucugaccaagcacaauuggucagccagugagagacccuguuucaaaaaaaucaaauggacggugcuggagaaacaucucagcauccuccggucaucauaagcauguuugcacacaaacacaguaagaucuggugugucagugccuuuaaucccaccauucaggaggcagaggcaggcaaaucuugaguuugaagccagccuggucuacaguaugauuuccaggccagccaaggcugcauagagaaaccuugucuucagcagcaacaaaguacaauagagcuggauguaguuggcuuacaucuauaauccaagcaucugagcagccaaaacaagagguucaccacaaguauaagucuaucuuguucccaaaaauguuucaaacaaaauacaguggagggagaccaagugacauguuguaugucuguaaucccagcacauugaagacaaaagcaaaugaguaaaaguuugaguugaagaccaaccuaggcuacacagccacagccaaaaaaaauaaaauaaaauaaaaaauaauaauaauaaggaaggaaggaaggcaagcaagcauggugauauaaaagggggcagagauacuacuguccagcugucuauacugaaugccugaaaguuaacuaacuuuaugagccuguuuucucaccuguaaaguagaaauggaguauuugacauauggacuggcuuuuugcugacugaccuuacagggcugacauuugagacuggacagagugugguggccauguacugggaacucuguuuacugacagaugauagaucuccagaaguuuuccauagauguaguguacugaguugaagcaaguuauggggaauaacgaaggacugcagucucccucuaguuggggcugacaggcuaacaaacccuuccuguuauuuggacuuugcaguggugcuuggagaacauccucuugugucccugcccaguggggugaccuguggacagaccucaguccucucaaguuagcagguguuuccuaagcugcuccugucugugaggcugcccuuucuuuuugaucuugcaguguaacuuuggcugggcaagaacucaguaggcuagguugacugucaacuuuuauguuuucagacaaggucucacuacccuugacugaaaaagaguccucucuccaggaaggcuguuuguucuuuagaaggaacaaaccauuagcuguguagaaggaaggugacacccagcuagccagccacagccaaaucaacccucaagguuacagucagauugcuguuacuuuuuuuuuuuuuuuuuuuuuuuaauuuaaguggaucauuugcccauugucaacucuuaguugaaaaaaaaaaaaucagcugggaaugcuggugaagaccugugucagcacuuagguaccugaggcagggcagcuugggcuacagcuacaaggcucuauaauuuuaguaccaagguugagggcucuucuggucccugggaugcucuguauuaaguucuaaccuaaacaucuaaaaguguuuuaguagcccugauagcuauaggcuggccagagacagcuucauuccaccccucugauuucaagaucauuacuguuauagagcccacaguuugagaaacacugcacaguugguaaagaagcaaaauaguugugauuugcaggaauaguuuucagauuucuuggacaauuguguaugguguccauauguauagauguacacacauacacaugaaggagccagacuaguuuggaacuuacuguguagaccagccgggucucaaacucaagagagucaccugugucugccuccuaauaugugucuccaauaucacacccagccagagugugagucuuuagaacaguagcaggaaggcagcaagauggcucagcagguaaggauacuuguccaucucuggaacccauauuguaggaggagagagcaagcucuugcagcugucuucugaccuccacacacacauaaacuuagugguacuguaagucagggcuauuaggacuguugguguaguguccacagggcacagucaucugugagucccaugaucacugcuucaacccucugcuaauccuuuuuacccucaccuucauucccguuucuuuuuucauaucuugggugcuuugcaggaauauaguaauaauuaauauauguaaauguuaaauauaaauaugggguagcaucaagagaccagaaaaaaaaaaucauaguauggugcucaggaccugaaauucuaucagauggaggccagccuaggcuacauauuaagcaucaagccaacuauguagugagaucuuaucuaagaaaacuaagggcuugguauucaaaauacuugccugccuagcuugugaaaauccucagaaccauccagucaaccaauaaaucaaucaguaagaggaggagaaaacacacacacacacacacacacacacacacacacaccaguugcauacuaguguaccugugguuggacaggccagcuaaaguuugccgugauucaggggaaaacuuugaagaugugucagggauuuaagacuccuuuucagucuccauuucagcucccuugcuagucauacucuggaagagcaaucuuuauugcagaugcaguucuuuguguguauagaugauugggaggacuagacagggugggccuuaagcuagugauggauccuccugccuagccuccugaaugcugggauugcagguacauagcaccacacuugcccagaagcaguucuuguuuugcucuuuaccacucucacugaaggucagcuguguaggaccuuaucagaagugugaguaaccuuucaaugugguauaguuaauuaccagagccaaguuuuagaaacaaggaaaugagauucuguucuuguucuaaaaagugauugugcacaccuguaaccauagcacucagaggacgaggcagggagaucacuguaauuucaaggcuagccuggucuacaugguaaguuccaggccagccacuacuauucaaugagacguugucucagaaaaccagaauaaacuuggcauaaaauccaugugggcuugccggucuagcacuucagugggagugggugaaggcagaagaaucaggaguucaagucacucugagcuaucuagacccuguuaaagaaaccuuauugaguuuggugguccuugccucugauccuagcacuugggaagcugaggcaggaaaauugucacagguuuaaagccaaccuggacuauauaccaaaauuuuuagaccaucucauaaaacaaaacaaaaaauguuuuuuuaaaaaaugaaguuuagccgggcagugguggugcacgccuuuaauuccagcacucaggaggcagaguaaggcggauuucugaguucaaggcuagccuggucuacaaagugaauuccaggacagccagggcuauacagagaaacccuguguugaaaaaccaaaaaaaaaaaaaaaaaaaaaaaaaaaugcaguuucaauggaacugugucuaauuucaucuauuuuuuucuuuacaggacuguugaggccuggaagucccuccccuuccccuucccccuuugccgcuuuguggcauuccccucccucuaccuucuccuacuuugauaaccuggcuaugacuagcagaaguacagccaggcccaaugggcaaccccaggccagcaaaauaugccaguucaaauugguccugcugggagagucugcaguggggaagucuagccugguguuacguuuugucaaaggacaguuccaugaauaccaggaaagcaccauuggaggugagugcuuaguaggaagguucaacacuuaguaggucuugaaaagaacaucugggacaugauuuuagaacugacucucaggauggguuuuuaaucccagacaugaaaaaugcaggaagauuaggcauucaaggccauucuuaacaauagaguuugacaaggccagccuggccuaugugaggcccuauuacaauuaaaaagcaaaaucaggcugagcauggugaugcacgccuuuaauuccagcacucuggguguuugagaccagccuggucuauagaaugaaauccagaacagccagggcaacagagaaacccuguuuuuaaaaagaaaaaaagagagagagaaagcagggugaggcgcuucuuuccuaaacauggaaacacucuggaagcaaaggcaggggacugcuucaaguucucggacaguccaaggcugacacucaggaacuggagagauggcugagaaguuagaaacacauacugaacuuguagggacacacacagacacacacccaaguuugguucugagcaaaccucagguggcucacaacuaccugugacuccagcgagggggagguuggggggcaguuugcgaggaggguggucugacacauuuggccuacuagcacacaauaacuuguaauuuaaaaaauaauaauauaaauacuuaaaaaacaaauauauacauaacuaaaaaauuuuaaaaacaaauguucaggcccauugacacaggccugcuaucuuagauacuugguaauugaagguguggggaucuuaugugugcaacagagugaguuccaucagucuucauuacaaaccagauccugacuaaacaaaaaaggacuaggaauauaguucaguggguagaguacuuguuuaguaugcaaaaggccucuuguucaauccccaguucuauccccccagaauuguguugcuguaauggagcagugauucauauucagaugagucccuugguaaucaaucucacacccacccuuacggugcagcugcuugucagugagcaccgcucacuuaaugccuugcuuaagucuggguuggaaccuugcuaaagguuuuccuggggaugcuggagauggcucagugguuaagggagugugcugucccuuuagaggaccugaauuccuaguguccucagaaggugggcagcgcagaacuaccuauaaucccagaagucaaaccacggcaucccacaccucuucuggcuucuguagguaucugcauucacaugcaugcacccauacacagcauacaaauauaugguaaaucuuuucuuuuugauaaaauuuaucauuuuacuggaaaaaaauaugagucaaugagauggcuuacaaguuaaggugcuugcuguacuaaccugaagauguggaaggagagagccaguuccacagaguuguucucugaccuccacaugugcaucuuggaagugugucauucuaguaccugccaucagguuuuaaaauccugugggguugguuuguuugagauggagacuugaguaggccagacugguauagcaagaaugaauguccuugucuuucuuucuuuucuuuuaauuauuuauuuauuuguaugguauguauguauguauauauguaugugaguacaccacagcuguacagaugguugugagccuucaugugguugaugggaauugaauuuuuaggaccucugcuugcucuggucagccucagcuagcuccagucaacuucacucgcucagucccugcuugcucuggcccauaaguacauaaguacacuauagcugacuucagacgcaccagaagagggcaucagaucucauuaccagugguugugagccaccaugugguugcugggauuugaacucaggaccuucggaagagcagucagugcucuuacccgcagagccaucucuccagccccggccuugucuuucugauucuccuuccuccaccugccaauugcuagacguacagguguguugggcccugaaaaucuaauuuuuaaaaguuacuguuuuuauuacuuauuuaacuuuuuauauauaauuuauauuuuuauguguuuugacugugugagcauguuggauccccuggaacuggacuuauagauagucguaagccgccucagggguauugggaauugagcccagguccuaugguagagcagccagugcuccuuaccucugugccaucucucuaggccuuauucaacuuuuaagaaagauuccuuucuuuguguguguguguuugugugugugugugugugugugugugugugagagagagagagagagagagagagagagagagagagaguguuuugccugcauguauguauguauguguaccauaugugugccuggugcuugcagaggacaucagaucccuggauuuggaaugauggaugguugugagccgccauguggggacuggcaacugaaacuugguccuguguaagaaccagugcucuugaccacugacucauccugacagagaucuaccugccucgaccucccucguguugggauuaaagacacaacaccaccaugccugucuccuuguaauucuuuuuguuugucuguuugaauguuuuuuaugguuauagauuuauuauuugggguauaugaauauuuugcucaguugcguauuugugcacuguuagugcuagguuagaagaggauauuggauucccuggaagaugaauugcauguugugagccacaguguaggugcuuggaaucaaacucugacaaaacaacaagugcucuugacugcugagccaacucuccacuuucuccuccuacuucuugacguacucuuauacuuacugccuccuuuuuuuuuuuuauaaagauaggguuucuuuauguagcccuggcuguccuggaacucacuauguagaccaggcuacccucaaacuuaaagagauccgccuaccucugccuuucuagugcugggauuaaaggagugugccaucaccacccagcuuggagacuuuuuuuuaauuaauuaauuuauuuuaauuagauauuuucuucauuuacauuuccaaugcuaucccaaaagucccccauaccuuccuccuccccccccccccccagcucggagacucuuaagugaauaaaugaacaaauaaaucuaaggguuccuuuggcccagccuggcuuuaaacuugcuaaauagucaagugagaccuugaacucuugagccuccugccuguacucaaacauucagaagccaucuugcuccuguuucaaaaguuacaugaauggaggacacuaacccuguagcuggugggccuugguggcaacuggucuuaggaugugcagagguaacaugaaggggagugggaucuucccacccuuugucccacuuacaacuuguucauuuucuccuucauagcggccuuccucacccaauccguguguuuagaugacacaacagucaaguuugagaucugggacacugcugggcaggagcgauaccacaguuuagccccuauguacuacaggggugcccaggcugcaaucguggucuaugauauuacuaaucagguaagugggcuaagaaaacuguucacugagcuucauagauauuaaguuagguaggagaggaaagaguucuuaaauagcaagaaagaaguaccaacuaugcuuccaagcacuaagccggaggugcagguugucagagaccuaugauuucagggaagaaagggcaccugaagaggagagguguggggcugagaaagugaugauuguggacuggcacucauuccagcacauucucucucauguuuucccaggaaacguuugcucgggcaaagacauggguaaaggaacuacagcggcaagccagcccuagcauuguuauugccuuggcagggaacaaagcugaccuugccaacaagcgcaugguggaguaugaaguaagguggccuacagaaucccuagcacacuuggucuguaugugggaccucuuuuucccagucuccugaaauuuucaugugaggcuuucguugucuccuucccuaguuguauaccagauuagauacagcaacagugugaccaaauggcagccaacagauuuuaaaggaaucagaagaaaguuccagauuagagggguagggaaauagcaguuguaggguaccagggugaaaacaggaagcaggaaauaguuagauuugagguaaggaacuauugacauaccauagcccaaagaccccugucaguuuacccugcuccauguuaagauucuucacccugggguaaauugcuuguguggaaggggggaggcuuggauucccagcaucaauuaaaaaggcguggugaggcugcaccugccugcacucucagugcuugggaugucucuggggcuuacuggccagcuacucuagcuaaaacagaguagcuguuucaaguucagugagagagguugucuuaaaaggcaauaagguagggguuaguaagauaucuacagguaaagguggggccuaaguucaguccuuggaguccaaauaaagaaggaaggagagaacgacuuccgucauugacucugaccuccauaagcauaccauggcuuucagccaugcacacacauacacauguguacauauaugcaaauaguuguuaucugugccuuggaccacccgcugccugacccuaccugcccuuggguauuggaagugaggugguguggaaucaacaacacggacugagacuucagcagcacgcucaucugaacugcugcaagcuccuuuaauacccucuacucgugccccauugguccccaaaacagcaguuuggcugacauuguuuacauaaauaauccuuggucucaagcaguccucaauuagguccuccugcaggagaugccuuugcagcuguguggccccaauauuuauacagagguggcugugccugugccuuuccuccuacaaacaauaaauugaaaagaaaaaaaaaagaaaacaaauaagaugagcaguaguuaaggaagauacccaaagucaaccucuguccucuaccugcacaucuggauauguguacacacagagauuccugacaucucuguugaauuuaguggcacggguuuaucuugaugggaaucauuacuauauuauggguccagggcuauauauaaaguauguauuauauauuauauaccagggucccuauauaaaaggucauuaagaggagagaacauaaaauauucuuucaugcuagaguacuacuugagaauauaaaagcaaugcuacuuucaucccuuuuaggaggcucaggcauaugcagaugacaacagcuuauuauuuauggagacuucagcuaagacugcuaugaacgugaaugaucucuuccuggcaauagguaaggucagaguggucugaagucuucuuucucuccuuguagguaaagcugucauuaacccaaaaccaaggauaggguuuuauaaauuacuguagguauggggcuggagauguaguacaguuguacaauacuuacauaggagauggaaggcccaacacugccaagaagcaaaacaagaaaaacuuaauccuaaaguuagacaugguucugcaugcuuaucauccaguacuugggaggccaaaacaggaggauugccauaagucugaaacuaauugcacuacauaauaaguauuaggccagugguucucaaucuuccuaauucugcaacccuuuaauauauuucaucauguugugauggccucaaaccuuaaaaugauguuguugcaacuugggcagcagaagcuaauagaucgaucgcuugugaguucgaggccagcugggucguuguaaugaauuccuggucagauagagagacccugucuuaggaaaaaagaaagggggcuggcgagauggcuaagcggguaagagcacugacugcucuucugaagguccugaguuuaaaucccagcaaucacauggugacucacaaccaccuguaauaagaucugacucccucuucugaagugucugaagacaacuacuauguacuuauguauaauaauaaauaaaucuuugggcuggagcaagcagggacugagcaagcagaguugaccagagugagcggggguccaacaagagcaagcaaaggcuuuaaaaauucaauuucuaacaacuucaugaaggcucacaaccucaucuguacagcuacaguguacccauauacauaaaauaaauaaauaaaucuuaaaaaaagaaaagaaaagaaaaggacgaaaaauacagccagggcuagcuauguguugaaacuugugucaaaacaaaaggcaaaacccaaacccuucacucuggcaccguaaugcauacgcagaaucucaccagucagggcagugggcuaacacugaaagauugcagccuaaacucuuuggcaagauucauugaagcacaccuauaaucauaauacuugggacuuagagacaagaggaucaagguugucuuuggcuauuuaguaaguuugaggucaaccugggcuacauaaaaccugauuucaaaacaaaccaaaagugggccggagagauggcucagugauuuaagaguacauacuguucuugcagagaacccacuuuuguuuccaaguacucacaucagguggcucacaaccaccugcaacucuagcuccaagggguaugacaccucugaccucugagggcaccugcaucugugugcaccuagccacucauacacacauguaguuaaaaacuacaaaagaaaccaaaaaaaaccaaaguggcauaguggugaacaccuguaauccugccauucaggaggcggaguccagaggaucaagaauuugaagcuaaucuggacuacagaaagaaaccaaagucagagguuuaacaguggguucagucccuagcaccucagacaaaaaaaucuucaguguagaaacagcuucacuugcuugguaacguccauccuuggguggcagcuuuagcucucuguguucagugagguuugcaaaaacuugggcccucuucaaaucauuguuuuaaucucucuuauccccucucaauagucgucuuguuuggggugggaaguguauaugaguaaaaucuaccauacuuuguucuguuuuauuuuuagcaaagaaguugccaaagagcgaaccccagaaucuggggggugcggcaggccgaagucgggguguggaucuucaugagcagucccagcagaacaagagccaguguuguagcaacugagggguggcucgaagcaaauauguauggaguuagcacgagagcuaagaaauaaccuccauccccaccccucagcacacagucccuacgguaacagcacacugagcccuggcucccaagggcugccuccugacagcuccgucauggcacuuuuuaaugcuucagcaaccaacaccaggcagcuguugccacuacuaugcccuaccuggggcuuggggucacaucuccccaggaccuuccuuccaaaacaaacuucuucacuucguguucuaggugcaagacagugaccuucucauugucccccacccccguguuuuuccaguguuucagagaagacuucugucuccugccucacaucccaccuuucaucauuacucccucuucuugauccuguuucuccucuuuacaagaugaugaaggguaaucccagggacugagaagggagggauauacuuuuaguuacauuaaagaccuuguggggagaguaaggcucgcagcaggagggagugaggaaacauugcuuucccauuuuauuuaucugguaagaguuucuugucuaugaaacacugcggcaccaaugaguaggacuuguggagggcguuccuagguaggagugagaacagggagucaagcucgcaggcacugaaugggaguuuauuaguaggacaaagguugaggugcagugucauccguggcucuggaacuugccccgaggcugguuucccuuuuguccccauccacucaccccacucgaguguggggauuggaccucagagugcuccaaagaaucuucacugguugccugcaccuuuagcucugcugugaucuaauuggaggagguacucugauaccguccucugaggccuauguauacauaggcauuuccccuacccuggccuugagauggccuuaaccccagacaccaugccccugcaguuugcacuuuaauugaugguaguucagucaagauacagguuuuuuuguguguggggggggggggguugauugauuuaccuauccuucaaccguuuuaauuaaauggaaucuacaaugaaugagguuuggcccuauagaagacaguagcaguggcagcuacucacacccagucuccacugcuagcuuccugacugauucauaccucuauucuuggguauagguuugucugagcaacuggggaguggccucagaauagcaugggccaugguaguggaguaaagaaaggucaggcaaaaggaguguucuaucuucccaggguucacauucaguuugcuaugucuuaccaugucuuuucuacuucccuguaaauacguauaagucuuuauucucuguacagucugcucugccuccuggcucccauuagccuucuuuucuucuccuuuuguuaauaucuuggguuuaguuccuccuucauucccccacuuacucuuacuuaauccguguaccacuaggggcuccuaccacaaaggcugcuuguccaaugacagggcagcuagaacugaaggugccucacaacugccuuguaucaucagagggcuuugguccuuccuaagucucuggccucucuacguccuauauuagguguuugagggugucugugggaagccaucaaagcaagaggaaacuugguauuuuagccagaguuugggagaaacaugca

SEQ ID NO: 12178 - RNA, 18062 nt, Mus musculus
gggcgugugcgcugggcgcaccugagaguacuaccgagcccugggccgcacgugcggggagugugagugguccgcugcaaaaggcgucucgcugccuaagggaagggaccagggacuggcgggugcccggcccggcgaguggggaaggggcagcgaccauggagcgggucaacgacgcuucuugcgguccgucgggcugcuacaccuaccaggugagcagacacaguacggagaugcugcacaaccugaaccaacaacgcaaaaacggcgggcgcuuuugcgacgugcuccuacgaguaggcgacgagagcuucccagcgcaccgcgccguacuggcugccugcagcgaguacuuugagucuguguucagcgcccaguuaggcgacggcggagcugcagauggugguccugcugaugugggaggcgcggcggcggcuccaggcggcggagcuggaggcagccgcgaacuggagaugcacaccaucaguuccaaaguguucggagacauccuggacuucgcuuauacgucccgaaucguugugcgccuagagagcuuccccgagcucaugacggccgccaaguuccugcugaugaggucggucaucgagaucugccaggaaguaaucaaacaguccaacgugcagauccucgugcccccugcccgggcugauaucaugcucuuucgcccaccugggacuucugacuugggcuucccuuuggacaugaccaacggggcagccauggcagccaacaguaacgguauugcuggcaguaugcagcccgaggaggaggcugccagggccacaggugcugcuauugcgggccaagcuucucugccuguguuacccgggguggacagauugcccaugguggcuggaccccuauccccccaacuacugacuucuccguucccuaauguggcauccagugcaccuccacuaacuagcaagcgaggccggggacgccccaggaaggccaaccugcuggacuccauguuugggucuccagggggcuugagggaagcaggcauccuuccauguggccugugcgggaagguguucacugacgccaaccggcuccggcaacaugaggcccagcacggcgucacaagccuccaguugggcuauaucgaucuuccuccuccaaggcugggugagaauggguuacccaucuccgaggaccccgauggccccagaaaaaggagccggaccaggaagcaaguggcuugugagaucuguggcaagaucuuucgugacguauaccaucucaaccggcauaagcuuucccacucgggggagaagccguacucgugcccgguguguggucugcgguucaagagaaaagaccgaaugucguaccaugugaggucccaugaugggucagugggcaaaccguacaucugccagagcugugggaaagguuucuccaggugaggauggcacccucccccacucccugcuguguauuaucuuaguucugucucgagacagauccuucccaggaucuggggauguggaucuuguggggguagagggucacuggaccuuaauagaacauaacauguuuaaauguuuuaagaucuccaacuuugaugguguggccaagagcugcaucuaugccuucaggcaaguucucuggcaccagggugcuuacuagcuucacccucccaggggccuuguaggaaggggccggauuccuuaggccagagccauugggccuccccauucuucuccccugguucccuuuguguuuccggcaccaggcguggggcccccucugggggcgggaggcugggcuccucccucgacuuuccccgccugaauggcuucggagggaagaacugaacaagugugucuaggacuccuuacacucccgaggccuagauccuccaccaguuugaacaggcuggccugcagcaguagguuccagcuuugccccucaugugacccuagguuugagagacauaaaagccggcuacgcagggcuguuuugcaguaguaauacuggaaucugaugcgcucugacgugguggcuucagaauccaguggacccacaggucgucuguuuguucucaggacagaccuucuuuucaacuuucagagagccuucuugggaacugaagacuugccugggagcagagggcugguuuuguuuuuguuuuucucccaguuugagaauauugaauaaaaggcugauuuuaacugaaaucccaaggauuuucaguaugugugagagcuuagagacagaauucccccagagaggccccaaguaggaaccagucuuaccggucagacagccccugcccaccugcucuggcgggcaucuggcuugccaguccagcuggggacuuaaagcuccaucccuggccucuggggacugaauuccauccggguggcauucauuggcugcuguggccauuggcugcuguggcgggagaggcuggggggaggggaacgcagugcuucuaaggggcuuuagucuggacaaugagucccacacccaccccucccugaaaggcugggcaaggcauccccgugucauucuaaagcugcugccucagguccuaggaauccuugaauuucugcggaggaggggggaugugggggguggguuaguuagaucagagggaaacauuugcuccccucccaaggcggguguguggcugagaugcuugggccccuggagcuagagcuggguggugacuuugucuuugucuugcugggguggaguucucccuggggugguggugguggagggaggcuggccaaguuuggcccaucucuuuugaugucuuguuuuuaaagucuguugaucucuuuuccaggccagaucacuugaauggacauaucaagcaggugcacacuucugagcgaccucacaagugucagguagggacugggccagggaacaguuggguggaaagaugcugcuguccuccagccuuggccugagcacugcuuugcaccccaccccccaccccuggucgcccuguccuuucucuggccuccuuuguucuauacccagcuuccucuguuuccccagggcuaugagacucuuuguucacuuguuucgucuccacagccuuucccuccuuucuguugcuuagcuuuccuguccuggcauuuuugggcauuggcuggugggccacacuacacaaguguuuucaugguggaucugacaccuagcugggccuggcugcugguucccaguaauuuguaugaacuguagggguuucaaaagggcuuccgguggcccagccaauaacccuuccucugguuugagccgagugggaacuuguggguuccuucaguggagaaagcguggcagaagaggcuguagguagggagaggauggucucaucucccaacacaaacagcaagggcaaggcaaggcaaggcaaggcauucucuucuaguguggaaucacguaggggaggcuggacuggauuuucuccugucugcuugaacucucuggggacucugcugggaccuagaaaaugaguuuucuuucuuggccucugagcauuuuuuuuucagugugaugcaaaguacaccacugucuucuugguuaucucccuucugcuguggcaagugcguucaacugaugucaaagcagugacaugagcuauccuacagccucugucaggggaucccugcuucuccuaaccugcuggcacggguggguucaggagaauauagggaggaauggccuugugcagcagcacagagcuuccaggacuagggcuucgcugcucacagaugcucagccgggagccuggcagccgcucccaaggaugcugacuccagauaggccugcuggaaucugucuuugccuugcugcuuucugccgcuccaucucugauuuugguugccacagagcacauucugacucccagguagugugcugagcagccccagacaggauaggagaaacccagagggcagugggggugugcccgguggccuggggggguaaccugcacucucugcccuuuuuccagguguggguugggagcagcagcggccugccgccccuggaaccucuuccuagcgaccugccaucaugggacuuugcccagccugcuuuguggaggucgucccauucaguuccugauaccgccuuuucccuuucucuaaaaaaguccuuuccagcccuugaaaaccugaguccagcacacuccagcaaugcgcucuucugcucagccccaccaggauaccugagacagggauggacagccccugagggcagccuggcuuuuacucaguggccuguaggcuaaccugggucccucuggagagguggaggcaaugauggcuggcuggagacuccugcuuuuggcagaggauagcuagcaagaugguuccugcccagcacucucagauccuuccaagauguccuaacauuuuucccagcucaaagcucucaaguagagauaggaaggaccaccuuucugaaggccccuccccuguaggcgccauguuccuuucugaaugcucuccucuccccuccccuaccucaacagggcugccaacuuuggggaaucuagaaguugggaauucuagggaguuaagccccagcuucugugucccuuccccuggucucacuuuucacacugacuggggcucccagucacccuccucuuaauugggcgggagggggaaucacccuacuuccagagaaguguccgguccgguacagcuuccgguacagcuucaacuagguucaacugugcagcugaacucuuaaugucucacaagggccugcuuucaggucuggcuagugaguucucauggcugagguuuuuuaaagcgggucugcucagaacuaaacuaaccaguauuguauugugauacauggcuuuagggacugacagagcagguagacacucccucccccagggccccuuggugugucccuuagccccugcagacugccuggagaucaggaucgaugauaaaaguuuucauucuaacauuugaggcuuuguguguuuuguccuuggucugucagugacaacuggcaccauugucccuugguguaugagccagcuccugcccugccucugcccuucagcacacaauuucacagaccugacccuguagccagagccuuauaaagaagauccagcaaggggugugcuggcugucauucugccauagaggauaaaagggggccaguuacucagacugauagaaaagccuuugcaagguaaggagccgggagcuucaggcuugagucucccuuaccuggucuaacaagcccuagccauugacuggaccuggaauuuagccagaguugagagacuggaguuucucagccaucucccauugcuucugguagccccaugucugagacugguuaaauaagggugagcugagggugcacaaagggguuagagccaguggagcuggacuuucauguguugcucuuagauuuuuuuccuggcuguaggaggcuuugcaaaaugcacccuguugcuuucagacugccaaggcugccugggcuugggacgcacuaguauucuugggguuccacucagaacugaaagcuuuagggaaugugggaagagcggcagcaaguaguguuaggaugcauacuaacagcagccgacugugugaaccuuggcugugggcacaguaggcacuuaaagccaacaggcagucccacugugccauuggccggcuggcuuccuuucgaggcccuuuuguuuacucccugucuacaggauggggaguucuggaacucagguucuggguggccuuuuugaggccugucucccucagcccuucgagucucuccugagucaugugaccauccuguuuugugcuguguguuagucugaaguuuugguugguccaggcuuggacuuaacacaggaaaaccuggggacuccagucacaggauugcuugaacagggacaccaacaacuacuuuacguuggcuuugugacaaggugguuauuucuguuguggcuucuuuaccccagcagaagucccuaauuauguuugcuccggauuccuuaagagauaaucaguggaggacaggguaggggacacuagcugcaucugugguuuugacuuugcuuaguuaacccccaaauauuuaauucaguuggggauaauggaggauuggcuguccauuaucuugggaaccaaaguauuacagggcaaaaccuuucuaggaaagaucccaaguaguugguaaagaagcagagucucuuuccugcccugggcuuccucccucuggaaagggaagaggccugguuaguuccaccugguucaugucaguuccuuagaguucugaggcuuuaaacuuucuuggugguugagguggugcacgccucuaaucccagcacucaggaggcagaggcagaggcagaggcagaggcagguagaucucuugaguucaaggguggcccggucuacagagugaguuauaggacagccagggcuacaugauaagaccuugucucaaaacaacaacaucaacaaaaagccugcccccacucaauagcugcaggguuaggguaguuuuuggaucuuuggcagagccagcuccuuguccuuggauaaaugagcauguucacggucucccgaaguauuuauaagaacccuuuccacgguuuacagauugcaggcuaguuggaaguuugaauucccugucacuguggccucucacugugucaugagaugccugaguuggguccuccugaugccucuggguugcucaggugcuggacuuugccugcacugucugccccaggacagaacuggauaccaaguccauagggccagggcugccuccugucuuucauagaauggaccuguauugacuucagaaaugcuaagggcauagauuugacgccuguucucaacucagucauccuacauucucauagggcaugugucugcccagcuguaaauugaucaauaccaagagcccccuguuuagcugggaagacugcuggaagacugguccagaugcuaagacuguuccuuucucuaguaccggaguccugugucucgggcaaguuuacuuucaaaguuaagguuccuuugucacaagauuaaagcuaaagcauaaaagcagagauucaccggacgaguugucugguuuaaguuaguauuguuuaccugugacauggggaaaccgggaagcgugagaugcacauaucugggguugaggcaaacuguggcaucuucugccuucacagcacugcugucgaccuugugcuugaaccacagaguaagauaaauggugugugcaugcaugcgcgugcccacccgcccgcaagagugucaaugguguucugacacuacacaccuugaggucucagguuaucgagauccacuucuaaccaggaaguagaggcagcugcauucuagcaaguuaauggaguggcuccucuucucucagaugugaaagcugcuuucacucacaguccuagagcugagagcacacacagaagagaaauaaguccaguuugacguuagccccugaggcaucccuauggaaccaaaauagcuuaaaagccacuagauccgccuuuguuacuuucuguguuccccaaggccuuugcaugcccuggcagaggaagggauguuggggagagauaauggcuagggagcuagacccucauccucagggugaauagcuguguggccuggccaugagucgugcuggguugugccuuucaguggcuacacauuccuggagugugagggcugcucuguggaugaacuacacaaggcaaaugucucucucagucuguacucagagccugcucaguguugcaggcaggcccuguccuuguccuuaccaccacuuccccacagugacaacgcacggaugcucugaugccugcagucugcuucuccauucucacuucagcagaacugacauucauuuauuucauaugcugcuuuuuuauucacguuacaagaauauuaggaaguguuaucuuuguacuuuuguccugccguuuccauuucccuguggccaacacgaaugccauauuugaaugaaauggguacauuggauucuuuggauaaggcaguaaggggaacccagagguggagaacaggaagccugacuuuuaugcuguaacucaauuauggccagugcuccuaaaguaagugcuuugugguuaagagugaauagugguggaggugaacaccugcgauccuagcccucugcagaaggagcugcaguucaaccucaacuucagcuacguaagagucagguuagccuggguugcaugagaccuugucucaaaaacuaaggagcaggggggggaaaugaauaaacacuuaacucuccacucaguaaaagcacacaggccuuggguggccauguuuugagcuugccugugguaaagaaccaguaaguccgacucagauaccccauuagaaggcacugugggaaggaggggcagccacucggcauggcuaguagagccguguagagccauguugcaguguucagccuccugaaggcacuguuuucacaggccggccgggccugcuuggucacgggcagucgguccuguucuucaugcuguucuccuuucugcacgcagaccugcaaugccuccuuugcgacucgagaccgccugcgcucccaccuggccugucaugaagacaaggugcccugccagguguguggaaaguacuugcgggccgcauacauggcagaccaccugaagaagcacagugaggggcccagcaacuucuguagcaucuguaaccgagguaauuuccccacuguuuccucacuccagagaaugagccugcucuugaggggagcccguccucucuucugaaugggaaaugcccucacgaggcuuugaccacaucacucagcuaguuguuugaaaccucuuccuuuccaagagacuuagaugaugggaacagacggagagacucacucgguucccaagcucagggucagauacaccugcucaaguggcaggaugcaugccuucacaaagagacuuaacaggauuggccugaaugggcuauaaaccuggccacucacuggcaaagaggcuggcucuaggauggacaagagacaaaagcuuucuaguauaaauguuuaaagagauuccaaguggauuguggcccugcagaaaggcagaagcggacagaguucugaguagggcaguuugcgggcagggcagugugccugagcccaaggcuugcugacacauugucgagcccaccagggcugcaguuuuguguugggugaucucuguccggcaugucugaggaucugcuggguugagucggcuguuggaagugcugugacuuuguuuguaagcacagugucugugcuaaggaggcuggggccgccguugugggagccagagacugcuucuuucaccuccuaugguugcuuuggccagaugggcauguggcuuguuuuccugggcacucuuguguugguauuuuuguaagucuagucuauggcagggugagcgucgaaucaggaugaggagacuugugguuuaguuccagccccuuuccagguagcuuugggcuuuccuuccuugcucagaagugauuagacucuuccccgcuucccucucaugggguugcuguuaggucccuaagaggagguggcugauagcucccuggauccagaguuguaccuucagggugccugugcuuacacugugaaaugguaaaaugguuccguaaugcuccgucauagugugguauggacgggugcugucuccacaggucccaaaguucuugauggagguauucuugcuggguggaugguuuuauuggagucuuggaaccaggugcuguucaaagacuacauacaccuaccucagauuugccuugaugccacugauaacugcugcucguuccacuaagaaaccugcugugaaugccagcacaagggcucuagcagcuucugcugcuucuuguuucccucuaggggcaaacggugaggacaaggaguguugugggacagcgucucuuggggaugcuccggucuuagacagcuggcuuuuuuuaaccuugcuucauccuaacccagcuuccagagaguacuuccuaguaacgcuaaacuuucuacagugcaccaucugcaggacuuugucaaguuuccuauaguuaccaguuccagaacuggcucagugggcagagcugagagcuacuaaaaguagugaaggauauuaaugauaaaagcagaaagucgccgggcagugguggcgcacuccuuuaauuccagcauuugggaggcagaggcaggcagauuuuugaguucgaggccagccuggucuacagagugaguuccaggacagccagggcuacacagagaaacccugucucgaaaaccaaaaccaaccaaccaaccaaacaaacaaacaaaagaaguaaaaacaaaaccagaaaguuaaaaaaaaagaaaaauaaauaaaauaaaaagaauccuccaaaccagacaguccugcccagaugauggaauagagcaaggaacugauacaggacagcagacucagggccaugaggaagcccaagugagggcagcagggaaguuagcccaccacaauaagguguuccucaagaucugcaaagaggacuugaacagcagccacaagccaugugaccaggguguggggauaacccgccaaagugcaguccacugcaggaagacccauucuuccaagucuagcucacacuggguacccggaggagcggagcacugagaggaggacuguagccuuuguggaagaguaccucuggacucauucuucagcagaaauaccaacuagcaacagcaggacaccgaugcaaacaaaaccaacaagaggguggaagaggaugacggggcuuugccaggcuuacauaaaugaguguucugagagcugggguugugacucagugguggcacaugccugguauguccaaacuuuauggucagucccaggcacacagcccaaguauucucaguaaagacuaaaucagauaucuuacaagugucuuuugaaagcuuuccaucccaauaaugcuuuauuuuuuaauauauguguauauguguauguacgaguguauguauguguccaugugugugcaggaacccauggaagccauuggaucgccuagaacuggaguuauagguggucaugagcugugaugugggugcugggaaccaaaucuggguguuuuacaaaggagugcucuuaaccacugagccauccuuccagccuugccauaaagaccaggcuggcuucaaaguuguccucuugcuuguagucuuugcauuugggagucuaaggugagaagacagcucaaauuccaagcuaagcaagacugcacaggugagaccuuguuacagaggagaaagggcuuaguggccuacuccuguggcacuuggaaggcagagacaguauucuuuuuuuuauuuuuuauuuuuuuauuuuuugguuuuucaagacaggguuucucuguauagcccugcuggcuguccuggaccucacucuauagaccaggcuggccucgaauucagaaauccgccugccucugccucccaagugcugggauuaaaggcgugggccacuaccgccuggcggaggcaguauucuuaugaauucaggucucaccuggacuaaauaucaaguaccaggccagccaggaccuucuaucauaaaacaaaacaacaacaaccaaaacuacacaaaggaaacgucuuccugucagaugaccacacaguaacgagguagugcugugccuuucuccugcaucucaggugcacugguggagcugagcccuuccaguuuggacacagagaaagcauuccucaaucucugcauggacaaggacuaggaauugcauagauaccacagggcaagaaaaucuaacugaagaacagugacuuuuggcauuaccaaacuucauuucuggacacggagggaccugcugaugugggcacaaugcuuccuucagcucccauaucacaucauggaggccucuuuagcucuuggucaaagagagaguaggugagcucagaauuucagcuaaauacaucuggccucaaaaauguguucugcucagaaacucagcuucugugucaucccagcacuugacuugcugaacggcuguguuuaagcugugggcuuuaaguggcagcuguggauccagucuugccaagugaguuugcuauagauaguacaaucugcaaccgaggaaagucaggaggauccagcuaccguugccuuagaauaugcagggcguuuuuacuguguaccugcuguauuuuggagguagagagcucucacugcacaguggauauaguaauuccuggugcuuuuucccauucacuuggauugugguggaccugcccuggcuugcagugagaagggcuucauaccgcuucagaggccaaaaaggaaugaacaccaaaggaaaauuccccugugaagugccagccagcauuguguccucacaaaguucucauguccugugcggguuucuggggccacuagaccuuguuggcuuguguugaaagggcuaagagccuggaucucuuccccuuagccuugccugcccauuccugacugcaaccugcuucuuaggaaugucuggccccaagccaaauacuuaaguacagcacaagacagcuuuccagggaggcuagaaagcuagcaccugauccaggucgaucuuuaaaguagcuguguuaagaaggaaaugcuguccugaccccaguuugccuccgugaccacugccaccaccugcuguccucaaggcugucugcuggcagccuacucuaacacauuuaucaucacacaguaguggugauaauaauccuacaaguccagaggacauuuuuguuguuuguuuugaagcucaagggcaauuuuauuagaguuugaaagaaaaaugucagggccuaucaguccaguucucuugagggacagaacugauagaaugugaaaaaguagauacaugaaaaggggauuuauuagaaugcuuuucaaggcugugguccagcuaguccaacaacaguugucugccaacagaagguccaagaacaagaaguugcucaguccauggggcuggauguucagcuggucuucaguauacaacagaauuccaaagaaguaggcgcaaaugccaaggaggaauggacuugccauggagagcaagagcagacaggcagagagagagcuuccuucuuccauggccauuauauauacaggcugcuagccaaagggcgacccacaugaaaauuguaucuucccaccucaaaagacccagauuaaaauuauuuauuuccacuucaaauuauuuaauuaagaaaaaaaauaucucccagguguacccagccacuugggauuuaguuaauuccagggguagccaggcugacaaucaagaucaaccaucacauaggaaaacaagcuguaaaucucaguagcuugcugggagaagagagaugcagaagagaaaggucuugccuuuuaaauuaggaaugaaugaaugucaauucugaaaaaaaugauagaaaggaaaauaaaaaguuacacuauuuugaguuagaacccagaaaagugggcaggcuuagcugcaaagguaugaaagaacugucccagagggcuuuuuauggcuggguaaagacagagacccauucaggagaccagugguuaagggccaaguucugauaguguggauuucuaggguuccuggaaugaggucagcuucugcugguugguggccauacauguuacaugcaugaaaauuaccacuauagccuuuucucuauucguuggcaaaauggguaaaguaauaauuuacaguggguauaaaguuuggggaacucuguagacuauguaguguaacauguuggguuccaggacaccaucagcauuuaaaaaugaaacuuggaggugggcaguggugaugcaagaagagacaggcgaaucugaguucucugucaggcuggucuacagagugaguucuccaggagagccagggauacacaaugucuggaaaaacuuuuaaaaaaaaaagaaaaaaaaaaccuuuauuuaaaaaaaaaaaaaaaaagagugaaccuuugucacacuuuaagcaguguucaaaaaaacucucugugcuuggggagccugggugggaggaagccacggcccacggccucaggaaagccugggccacacaaacaacaaaacaacaaccagaaaaugagugaauguaugaauacuauagcaauucaagcuuuuuugauuuguuuguugagacagguuuucucuguguaaccccgacuguccugggacucuagaccagagagacccagcugccucugccucccaagugcuggaaagcuccacccugcaguucacacuuuuuaaaaaguuugaugcagaaaucacacaauacauuuccaucucugagccuuuagcagggcaaucucacuguggcuauaguuuuaaaagggaacaaggggcaaacaagauggcucaguggguaaaggcacuugccaccaagacugaagaccugaauuuaaugcugggggcucacaugguaggagaaaaccaacuuuaacaaauuaucaucugaccuccaccuccucccgccccaguaaauaaauacauguaauaaaacaaacggaagugcaagugccugaggaaugugcuggacagaucuagaguggacuaaaggaacaagaguagagccaggcgugguggcacacgccuuuaaucccagcacucgggaggcagaggcaggcggaucucugaguucgaggccagccuggucuacagagugaguuccaggaccgcuggggcuacacagagaaacccuguuuaaaaaaaaaaacaaaacaaaacaaaaaggaacaagaguagggcacugacccacccccacccccagugacccuuacaauauuaaaacgcuuugguuccugcuaaagguacuuucugauccuucacuauggugagauucaauggcacacuucuuucuugugaaacaagucauuuuauugccugauuuuguggcugucauccuccaaaggccuugugacauuuguggaaauggcccaagaucugcgcuucaaacuugagauacuuacgccuuaaacugaccaaagcaugagugagguguaaaguggagacuacuucaagauggcgagagaucauucuggguguacucgauggauuuuccaaaaccaaacugaaaagaccaccauggauaagggaugaccaugaugucacacaagcugccuccguucuucaaaggguggaaucggcucuuaagucauuguucugaaggcggaaaaguuaaaauaaaguaugcuccaacagguagaagaaaggggacccccuggaagcauucauuccuuggagacuucacuugucuccaucugguuuuccuuuauauuauaagcaggcuucugcuggcuggaguaccauauacuugucugaucacauuucuagccacggucucugcagcugacaugggccugugggacaucuacucaaaccaccugguacuguggcaccaagcgagccaagauggcuggccugggcccuucaauguagccuuggcagagaagcugacugacucauggacaguggagcucuccguucugaaccucauggccucaugugaugauugcagaugcuuuugagccaaggagagaaccccuuccaggugcagcugaccagggaaugcuagccagagcugccaaagaaaaggcguggggagcagagagcuaucucuugcuggcugugggaucucaucuccuuuugucuuguuuagguuucuccucugccuccuacuuaaagguccauguuaaaacccaccacgguguuccccuuccccaggucuccaggcaccaggaacccauccugaaugggggagcagcguuccacugcgccaggaccuauggcaacaaaggcaagcgaccccuugcucugcacuuugcuucucugcgcagacuguguugugggggcgcugggccgggugguggggaggcaagaaucgcagugcucucuaggacaaaguuugccacggguuucucacuccaggacagugagugaggcuuuaggguacugcugauccagccugccuccucuuccccagccuucuuccuuccucuuggcuagcccccauugacuggagcccuacaggguugcccuagggcaggaagaggagcacugcaugaccaguuacucugggcuuagauacugccuauugcccuguaggaccuguguggaccuggugcugaaugcuuucuucuugguugaucuugugggugggugggagccagcggcuggcuuaucuaugauaucgguggucgguugucauuugugagacgcauggcaguaaaugagcuaccugauugccucugguuugggauuggugugacaagaguuuccaggcucauuguuaacuuguugguucaugguguuuggggugucauguuguugccuuuugccaggacguggcggaugguagagauggcaugccccgugcucccaucacagaccucccaucuuggaauggcucucuggacccaggcaggaagcugguaguugguaguagaccccagugugggccaggcaagguagggcaguaaggaacauccaugucuuggucuagaugggcuccccagcugacagagcuguucagaguugcuuuucaucugugugcuuuggcuguauggcccuggaaagggcuuugcagaaauggaaauguagaccuuguauaagcguugguugccgugugagccaucaguaggaucuagccgaguagaggaacucaugguucucguucggccugcuuugugaagguagccacugguguagcgcagggacaagccaacgaccccugcucaucauaaccagaacaguuuugcaccuggaggcaccuggagauuggggaucucuggguuguucugggcagaaguaagggggaucccuccuuggccuuccgcccuugaagcaggcugaggugauggugaagucuacacacacauccucauuuagagcuuauagugagggaggcugguggcuccagggcacugucaucuugccccuacaggcauuccaugcuccuacucagaccagccaaaccuccauggguucugccagguuagugacugagcuggccugucauggucccuccaggagggaauggcucuaaugccuggccucaucucugcccucuuuuguuuugccauagaaggccagaaaugcucacaucaggaucugauugagagcuccgacuccuacggugaccucuccgacgccagcgaccugaagacgccagagaaacagagugccaacggcuccuucuccugcgacguggcagucccuaaaaacaaaauggagucugacggggagaagaaguacccaugcccugaaugugggagcuucuuccguucuaaguccuacuugaacaaacacauccagaaggugcauguccgugcccuugggggucccuugggggaccugggcccugcccuugguucaccuuucucuccccagcagaacaugucucuucuugaguccuuuggauuucagauuguucagucagcguuugcaucaucuuuaguggauccugagguggaccagcagcccauggggccugaagggaagugagacaugcuguguccccacagaacagccgcuggggacugcugagcaaugcugugaaugcagagggaagugaugucuuuggguucuguagcugagagauuuuuauucauuuuuaaaccccaucccugccccucccucccuccauuaaccccaccugcuguggucuuagaaacagacucucaucugauacucucuguagaaauacugagagacccaauauggggcaagggcagaaagcacuacaucggccucugaggcaguaccaguucugguuucucuaguggucugaagccagaauuucuggugcucaguuauugguguccucaccccaacucuaaggcacucuugggccucgcuugguaguuuuggucccucccacuucuuucauuccucaccccccugccucuguccucaaaagaaguuaaguagggucucuacccucuuauggccaacu

SEQ ID NO: 12179 - RNA, 7832 nt, Mus musculus
agaugcgagcuuagagcggcgacugggcgcugaggaccugcuugcucgcugcucccaucccgccgccucaucccgccgccucaucccgcgugcuccacuccgcuccccuccaccgagccguccacccggcgccaugcaucccgcgcgccccgcgcucugggcggcugcgcucacugcccucacucugcuccgcggaccgccgguggcgcgagcuggcgcgggcgcggugggcgcgggccccguggugcgcugcgaaccgugcgacgcgcgugcgcugucccagugcgcgccuccgcccaccgcgcccgcgugcacggagcuggugcgagagcccggcugcggcugcugccugacuugcgcgcugcgcgaaggcgacgcgugcggcgucuacacggagcgcuguggcaccggccuccgcugccagccgcggcccgcggagcaguacccgcugagggcgcugcugaauggccgcggguucugcgccaacgccagcgcugcaggcagccuaagcaccuaccuccccucccaaccugcuccagguaagcugucccugccacgugcgccacgcgcaacucccugggacccgacgaggguggcagggaguguaucuucagauguuugucuuggcucauauugaagguuggaaaauggacccugggaggcggagugaggcacugaacccauuuuuccucuugcuugguucucaaaguacagcuuuucuuauaaguugcaaaaugcgcucugugaaaauagguagaauucagugccaggacgagcggguagcaagggagacugccaguggacagaucccagucacuggagagucuccucgcugagcggggauacccagguuuaggucuguguaacccagcuguugaccuggguuuucauuccucauaaauugggaaggagcgcgucuaucccagggaagcuugaguguaggaaucccggguuggauccggaccaugaagguauuugcaggcagccacgcuguuggaaacaguaccugucuugaaacauccuaucauuugcacgggcuaauuggcaacgcaggauugugucccaauuuauccaaaaacuaacgagaugaaauuaagagcacuggugucuuugaaacugugaaaccuaaaguucaaaacugcucagugucaccaggagcugcaaaaagguuugagcccgguucgggccccauaggcgccauccuaugcucugcagcagcgccuuccagauucagagacugcauuuggugcagaggaugcagacucaggccgguucccugccaaagcagagacuagaaaugcgaaguacgacccaggaauguuacucuuucuaauucgaccuaggugcagcagcagcagcaguggggacagcgacagcgccaaugagaaaaaugcaaacguuuaacaguuaccucuccugcugcaagcccuaccaagcaggcagucacucuaagggcauccuucguuccuuuaaggaaaaaacaaaacaaaacagaaacauuuaaauggauuuggcagcuguugcucuaaauggccagcauucuuagcuguugcucuaaauggccagcauuccuagccagucucgcuuaguuaugugagucaaguucuugcccugaacaucugaaggcuagaauucuccgguuucccacaccaggcuggcagauggugcagaucgagcccccaggaccagggcuagcuggguagagagucucuuuaugauuucuguggcugcugaccuacacucccggguacaggcaaguccugguauguucauccccgagaagcauuggauuccuggcaaagcaagauuccaguuguuucgcugacucagacaaaggcaaaaucaugccauuugccugugugucuuuaacuucuagugcguucugugguauaccaaaagcaaucuuaagaaauacuagcauugcuauuuugaguuaagccuuaaugaccucuauuaauaaucaccauugaacacuguaguaaaaauugaugugagcuuuaauuacaaaagaguuuggaggcuucaauauccauugaaggaaaaaauauaguucugugacacaauucacaauucccuauuuaauaguucuauuguagucagcuaucuaaggagaacaaagagaaggaaaaaagggacguuuaagaaauuacucagcuucuuggaagauaaauacaaauacaaucauuuacauauuagcauuuccuuugucccuguacuuucaaaaaaaaaaaaacccacaaagauucaagcaaauugaaaccaagucuacaaauugaaucauggcucuccuccgccaggugcuagucuagacccgaggaauuuugcuugcgggggcaagaggucauugaggguuugcagccgagucucagggagccguuugguagaugagaaacucaggcuccuugggcaagagggccuucugggauccugcacgccaguuccucugagagaugggagaagcugcgaccuccgacgguuucuagcaaacgaagcauuagcucuuggccagaggcccagagcuuccucgugggcaggaugccucagccuggcauuuccugagaggccaaaucaaaaaagagaggccagcuggggcccugaacuuugcacccagacagaauaaauucagaaccagaugccaacugggacuccaugcucagaaagcuauuaaagccccuuugucaggagggaaggaauucuauggucaugaucugaagcuuaaaccuaaagcuguaaagcucagaguugagaguugggggccaauuaucuggccuuggguccccccuggggcgggggggauaucuuacugcaaauggaguggucagccacaaauuuagucacauacuuagauucaauuaaucuguucaccuuccagcguuccuaucaguuaggaccggcucccuuagcaccuuggguuaugaaagcuaggaggcuuuucuucccgccuccccucuccccaucuucaaggauugaauacacuuuagcaccuagaggucuaagcugugggugauacguuggugcuaucuguauucugugugcuccacugcugaagggggagagggugcacccaagaagaugccccucccacccaaaacacagacuccacauggaccuugaaguugaaagauguacaagcuccucagaaauaaacuucucuagcaugccugcuuaugggucccagaagugagauauuuaacaugaaaccagagcaggcggaugacagaauccccagaacggugugcuguugacaauggguagagaaugaaauauacuuuucccacacaccccucaccacccccacccccaccucccaacagcugugcccagggcugaagcacauuuggaguccuguuuucuggucagcuucacagcagcaucccauggggcgugacugcccccugcugguagcaggcggagccugcugcuuucuccucuauggaagggcuuggagcuagcugucucauaaacacauuccacagagugacuuucaaauugauggcuuccuaaaguaaagcagucaccgugcaucaggcgguauucuagaaugcuuuugcaauuguccuuuucuuagcauacuaagaauuguugaauggcauugccuuguaggugugaccugccccugacaagguuaucaucccacugucaguacuaaucauuuccuuaacccauauucucucccaggaaacaucagugaguccgaggaggagcacaaugcugggaguguggaaagccagguuguccccagcacacaccgagugaccgauuccaaguuccauccacuccaugccaagauggaugucaucaaaaaaggccacgccagggacagccagcgcuacaaaguugacuaugagucucaaagcacagacacccagaacuucuccuccgagucuaagcgggagacagaauacgugagaacuuuuucuuuaguugggggcaaggggaguaggaaacaccccaagacagccuuugugcagcaagucccaggggccugguucauagguaggcaguccaagccccaccucccguucagagacucuugggagguucaaggugaaccacacuaguaaacagugugcugagcccugcagaugaagacguggacuucccccacgcugccuuuauuucacucaaugcguuuuccaaagccuccuggccuauucuuagcccacuuuccagcuccucugucuacucuggagagagcaaaagagauagaggcuggugguuauuauccugggacccugugugagaaggucacaagaagaauaucccuaugaggcacaccacacauuccucuugggaugguccuguggccacugugacauugucaaaacaacaauuguguccccagggucccugccgcagagaaauggaggacacacugaaucaucugaaguuccucaaugugcugagucccagaggcguccacaucccaaacugugacaagaagggguucuauaagaagaagcaggugaguggggucccccgggauguuguccucugcuaucuccauuggcuugguggguaaucagcuucacgguuaccuccaggaaccucacccgguguggcucucugcccaccugacuguguccccucuucugauacauguaugcgucgcucaggggcuuucuaauugggcgguucacaacaugaaucuagaagacaaaaguaaacagugcucaccccagcaugcccacguucuaguguuuauacagcagucuucguuggggagccugagccucucguacuauccacugauuggauuaguucagcacauuuccacuaaagagagacuacagacgagguugggugcgaggucugagagauucagccugacccagcacagaggaagcucaccaagcccuccaaccuccccagagaggcuccagcacacacagcugugcauggaugcacaccaccaccgacacgucgguggcucugcaggagccauggccaucauaauuuugccucagcccaguagaacaacacuggggcgucacuuugggucccagcuaccaguuuguccucagugucuguuaggguuucuguugcugugaaaaaaaaauacuacaaccaaaaccagcuugauaucacaauccaccaccaccgaagaaagucaggucaggaacucaaggcaggaacugcagccauggaggaguacugcuuacuggcuugcuccccauggauugcucagccugcuuuuggauagcaccaggaccaccugccaaggcguagcguucuccacagcagucaucaaucaaggaauguaucauuggcuugucagcuugucagucagcugggaacauuuucucagcugguguuuuuucuucucuagagacucuagcuucugucugucgaguugacauaaacuagccaguacacaugauauucaagucccggucuugucucucucucccucagugccgcccuuccaaaggcagaaagcggggcuucugcugguguguggacaaguaugggcagcccuugccaggcuacgacaccaaggggaaagacgacguacauugccucagcgugcagagccaguagaugcuccgugccacguaagccagagguuccggccccggacucagcuccuuuggaaagugguugagguuaaggggaauugcuaggagcaacuauggcugccagguacccaccccucauccugggcucccuggcccaggagcugcagccaggcccagagagaggcagguaaaggggauuguucagggagaagaaaguccuuaaccuaaccacacccccaaggacagacaccagggucaguguagcuucaaaaacucucagcucuguucuaaaugacuucaaauaugcacuauuucauaugcaagcaagcacugugggggguuuuaaauaaaacuuuauccgcaguaguccugaggguuagagcacacuguuuucuuccaggagaaccuggcauauuugguuucugaauuagagaugucccuaguuuuguuguaauaauuuuuuuugaaaauuagaauauuccuuuaguuugugguuaguuugaucuuuaaaggaauuauuuaaaccuaauaaaacuaauguaacacugauauucuaaaccaccauuucggagaauauuauuguauuuagcauuuuguuuucuuucaguaaaugaaggaauuaugggaaagaguaaauaugcuuugcuuucuugacaauuuucauaggcagaaaaagauuucauuuuuacuuagaauauuucccucaucaguuggaaaaauaacucuaauuauggauagcacuuuuuaacaaugaaaguauuugaugguguuuggugagaaagaauagacugagguccacccccucaugcugaacaaaagggggagcccccccugaauauuggagguaauuauuucaauguaugucuuacucuuuuucuuucuuucaucuuccuuuuagauaauauggagcucaaauaugccuuauuuugcacaaaagacugccaacaacaugaucagcagcuggcuacagccuugauuuauauauauauauauauauuuuaugugugugugugugugaguguggugaacugagugaaaacaaacacacacacaaaccaaaguuuagacagauuucugaaaugccucuggucauuuaaauagugaacuugaucaucuuccuacuucccaguagucaacaaaaagcaguuugaauuuuccuguugcuucuuaugagagacacucguguacuccaggccccggaugccaucugcccccuaacucacccacccaguacgggcuucaaugcugcuggcccucugccuucuugauuucagacguuccguggcugauauagacaaauccucuuuccauccccuguaaauaagugcaggcccuauggagaauggggaaacccauaaccgagugacccggacaucuggaagcauaugccugaggcucaugguccuuauugugccaucucugaauaagggccuggcccuguauccgcaaguggccugaucuacuugggaacugugggagaggauauguguugucucucuuacuaaaaaugacugagaauguucuagggcacucugggagcccauaaggacaaggauaaggaccuuucuuugucaggcaucuucuugaugacuuggcccagcagaaagccccaagugggaggagcagcaucggacuccacguucagagaugucgcaaauaauggugcgcuuaguucuucagaugacuucaaaaaacaauguuuucugguccagccucucaaaauaaaguuuguugugagguggggcugcgggaaggcaguuuuucaaaaacacagauuucuuuucaucuuccuaucuaaacaggaaagaggaguggcuugucugagagccugguaagagcauggagaaaaucaccuguauguugaucuugggguccuucucaaacucucuuuauaauucacgcauauaugcagacaaaguacguucuuaauuguuaacauuguauacaacguagcccagauauaauagaaucuguacuagauaauccuagaugaaguguuagagauguuaggugauauaacugcagacacgcccaaggaaaggagccugugucuggaggcugggcugcucucccccaggccgaggcggaggaggucuggcaacgcagggugagaggagacuguacugcauccuacgggguggacaugcgcuguacagagcuuuccuugagagcacaaaggaaucucaagacauucugccugccuaucagcuuuucuuuauuuuuuuaauuaaguuuuuuggggaaaaauguauuuuugaaaaguuugucuugcaauguauuuauaaauaguaaauaaaguuuuuaucauuuaaa

SEQ ID NO: 12180 - RNA, 6000 nt, Mus musculus
uuacaguuuaaacugcggugugccgggucguugguggcgcagucuucggugaguuuagcugugagcucgucgugggugagggcgucuugggcgagcuugggguggcggggagggcagacccgggacuggagguugaagcagggucgggacgugugcuucacucggccccgcgucccgaggcgcucuugucgugcucgacccacagcaacgcuguuuuuacuuuucuucuucccuccccacuucaggaucucaagcagcccuggcuggucuugaacuuguuauguagcaggaggccaaauuugagcauccucuuggcuucucuuuauagcagagauuguaggcuggagacaguuuugaugggugccaacauaaacugauuucuguaagaguugaguguuuuaugacccuggcgugcagauuuaggaucuggauuaagccuguugacuucuccagcuacuuauaaauuuuugugcauaggugcccuggguaaagcuuggucucuguuacugcguaguuuuuccagccguccucaaugccaauauccuaauauucaggucucucccuuagaguaauccagaauggcuacucuuaucuuuguugauaaggauaaugaagaacccggccgccguuuggcaucuaaggauggguugaagcugggcacuggugguaaguauuuccugccuugagauacacagguguugugaauggucccagccuacaguucccaauguaaccuaggggggccuugaacuucugauccuuugacuccaccugcccagugcagugauuacaggcaugggccaccuugccuggcuuaugcacugccgggaauggaacuuggagcuuuucaaaugcuacuaagucacguguccaggcgcucugcuuaaaucgguuuuuugagacauagcuuuaacuggccugggauuugcuaugcagaucaggcuggccuugaacucaggagauccacuuaccccugacuccuaaauucugggauuaaaggcgugcgccauggugccuauguucauacuuauugucuuaaugagguuauuuagagugcuaaguaacugccccaaaugaggcacagguuuguguguaagaauugaguuaaguuguauggccuaaucuuuaagagcaauacauuuauuaccuuuauuuguguauguguggggucacacgcaugccguggugugccuguggaggucagaggacaaccuguggaaauugguuuuccuuauacuguguggguucuggggacugaauucagguugucugguuuagccgaaagcuccuuuauuuacccacugagucugugauuuuuuuuuuuuuuuaaugauuaucccuuuuucaacagucaaggccuuagaugggaaauugcagguuucaacgccucgagucggcaaaguguucaaugcuccagccgugccuaaagccagcagaaaggcuuuggggacagucaacagaguugccgaaaagccuaugaagacuggcaaaccccuccaaccaaaacagccgaccuugacugggaaaaaggugagugcgggcuaugaacaugaauauuuguacauguguuggcacuuaagaaaaguuuauuauuuuuauucauguauacguagcuguagaugaauacugcaugugugcaguuacauaaggaggccagaagagggcgcugggugcuuggaauugagucugacuccuuuggaagagcagcaagugcuuuuacccucugagccauccuaagccccacugcagcacuucugaugcuuagaaacuuacuucccaucugccucucuuccucucaguaggagguaaagagagguccacaaacucacagagaggagucaggcugguacuuccaguugcucagcaucuugagaucgcagcuuuuaggaguagcuaacccugauuuugccucagcuguucuuaacuaguaccaggaagcaguugguuagaggccaugugacagaugugugaaguacuuagcugggcuugauaagcaccugcaaucccagcacuugggaggcugaagcuggaggagggguuggcuggaggcuagccugaacuacaugcccccacucuggcauacauacacauagaucggaugggaucaagagcgcccaggcuucuguuuugacuugcuauuauugauugucuaccugauaauucuuuggauguuuuagguucugcugcuacuuaaguccauauguuuaaggaacacaaacuuguuaauauuagccaaguaaauaauuaagguaacaguggcagaaaaauuacacuuuuaugaggucaaauugacuuccaggauuagccacuauucuggggugccucaagucuguuuuguccacuguuagguuugaacaguugaguugauuagcuuuaaauuaacccugcucaggauucuuaauaauauauguggacagguacuaagaggucugacuuaaagaauacuuuuauuuuauguauuuggauguuugccuguaugguauauguauugguuaggguuuuccugcuaugaacaaacaccaugaccaaggcaacucuuauaaggacaauaugaauuggggcuggcuuacagguucagagguucagcccauuaucaaugugggaagcuugguaauauacaggcaggcauggugcaggaggcacugagaguucuacaucuucaucugaaggcagcaaggaccaggguauuaaagcccauguccuuagugauacacauauuccaaugaggccacaccuccuaauaucaucacucccugggucaagcauauacaaaccaucacaguauguaagugugccacgugccugaggaagaccugagacaucgcuucaucuggacuggaguuacagauaguugugagccacccugugggugcugggaacugaaccugagucuucuguaagagcagcaagugcucggaaccacagagcaguugguuagaggucaugugacagaugugugucuucccgucuccuuuguguguguguguguguguguguguguguguguguguguguagggcaggacagggccggugcgugugaugguaugcauauccgagucaggacaacuuccaggaguccauuuucuccucaccuuuacacugaguccugaaaacuaaggacugacuucuuagaagacagcacacaaugaacacauucaaaguagugaugccaucauuggaagaggcuguccaaccgcaagcuaccuugcagguuggcgaaacugcauucucucagugcuuguucucuuggguuuuucuagaucaccgagaagucuacuaagacacaaaguucuguuccugcuccugaugaugccuacccagaaauagaaaaguucuucccuuucaauccucuagguaaaaaugucuuuggcacgaugggcaggcccucaguuugagauuucucuuagacucuaacuccgugcgacucuaacguguagcccuagagucugagacugucugaaccugacuuacuuugaauacauagacuuguucagggggacucacuugccagagcaucaccuucugucacgggggagaaagggagcagagauguugaggaaaaaguuagaaguucaaggucaucauugugugaguucaaggccaaccugauuuacagagcaaguuccaggacagacagggcuauguagaaggacccuuucucaaaaaaaaaagauguagauacccgaauauugaaacauuuugugucucguggugcaaccaugacggugcauugcuugauaucaccucugaugccaucagaaagggccaaguagagcugcguuuggacaugcacgccuuuagucccagggagaggcaggcagaucucuugaguucaaggccagccagggcuauguagagagacccuuucugaaauaaaccaaaaaagaaaaggccaaguauaaaguaauauaagauaaaaauuugaaauuaaugucaugcuaacuauuauaggugaauguucuacacuucuaaacuuauuacuguuucugaauucugucauuggugacaaaauuuuccuugaagugugguagacuucccucauuccuugaagggaguaugggacaaguacauucucuagauuguaguuuaacuuucagaugaaaacugccuuccaggaaaaaacaaaaaccaaaaccccaggcuuggcuugcggcucagaucacuguaaauccguuuucugugacaucggcacgcuugucauguuuucuggugugcagaaguucucauuacagaaucuuugacagggaaugggaagcugcucuguaguucagcguugaacucacagugauguugcuccucucucacccucucccaugcucagauaauagccacaucccaccaugauacuucccagaaccuguuagagaauguucaaggucugggcuguuaaaauuauacuuuuuuugggcagugguggcgcacccuuuaaucccagcacuuaggaggcagaggcagguggauuucugaguuugaggccagccuggucuacagagugaguuccaggacagccagggcuacccagagaaaaccugucgucuugaaaagccaaaaaaaaaaaaaaaaaauauauauauauauauauauauauaugaauaugaaagaaaauuauacuuuuuuuccccaaguauggcaaaaguaauaguuacauuggggcaguaacuuuauuaucuaacuggcuuuuguuaaguuggcucuauuuucuauuuuuuuuuuuaaauuuauuuaucuauuuuauguaaguacacuguagcugacuucagacacuacagaagagggagucagaucucguuacggaugguugugagccaccauguuguugcugggauuugaacuccgacccuuuggaagaacagucgggugcucuuacccacugagccauuucaucagcccuaggcucuauuuucuaaauggcgaauaguggcaaagaauaggcugacuggauguacuucccuaccccaugcuuggcuucccuuuguggcagacuuugagaguuuugaccugccugaggagcaccagaucucacuucuccccuugaauggcgugccucucaugacccugaaugaagagagagggcuggagaagcugcugcaucugggccccccuagcccucugaagacacccuuucuaucaugggaaucugguaagggaguccguucaaacucgggcuguaagcaacuugucacaugacacguuuuuguugucgggacugaauuguacaggugagucucugggcagcuucgggauauuggggccaaguuuagaauaagaacuucccucagucauuguguaugguugagucccaaaagaagguuuucuggaaccuuggccagccuuuggugauagcagugggugaaguugaacacagagcugcuuaggcuaggaguugaagucugugguaacugagacuggaugagcacuccagguuccaccuguggcugucagaggaccaguguagacugacaguaacuugucaaccacugaaagcuuaaggcuuuaguuagaacgggugugugugugugugugugugugugugugugugugugagggagagagagagagagagagagagaaagugccucaaaugagauggguugccggucugauuuuaugauuuugugagacuuuaugcucaagagaacaaguagcuuucgcguauuuuaaagaccugcuucuugacuacccacacugaugccgacacugaugcuacauguaaaagaucugcaugugugcgugagauucauuagaugaauguaggaugaaaguuagcagcuaauguuuguuauggaugauggcuagaaaggaagugcagaaucuaacgagaaacuccucuucuuccagauccgcuguacucuccucccagugcccucuccacucuggauguugaauugccgccuguuuguuacgaugcagauauuuaaacuucuuacuucuuuguaguuucuguauguauguuguauuaauaaagcauuugugcauauguucagauugugaauacuua

SEQ ID NO: 12181 - RNA, 126193 nt, Mus musculus
gguggggcgggggcaagugucagucagggcagaacgcggcgcgggcagcggagacccguggcacacaggaguccgggcuggaacgaggcccgccgagauggaguuccugcuggggaauccguucagcaccccuguagggcagugucuugguaaggccgcgcguggggcaggcgucgagugagccacagcggcugaccgggcuggugagauccgcgggccuccucccggcacugaaaucaccucacgugcggguugggccucugccaauaaguggugucaucucaaagguggacugggcauccuugucacgaggccucugccugacgcuggugccaccucacccuacaaggaggcucccccgaggugccgauuggacuuagagagguccccggcaucccugcccaucagggcccagccuuucaagucucuccccagaaguaguguccaugcuagucugcuuacccuugcguauugggagaugucacugcgaguacucuuccccagguaucucgcugccuuugcucccagggccucugucucccggagccuuuguggaauggaacucuuucuuccguccuugucccugcucauugguaccaauggcucugaggcugggcacuuucccagaaaaugccccaugcugcacgacuucuaauuugagcugcaacucagucaggcuguaggagggacugggaugggggaggcccucggggaaagugacuggcuuggcagggggauggcguggcggcagaaucuccuaggccuccuaggaaagaagggaggcagggcugcuuuguugauaagcaguccauuggaucccggaaacuuggacuccaguagugacuuugccagggacgcuccuccugaccuugugcgcuuuauauuuugacguucucuugucugccacacgggguauuuggagauaagauguggugggacucuucaaguucuaaaguucugaaucuuccuuguugauauuaagcgucuccuuacauugccucuugcucucccacuacauaaagugguaguagaguaaucagagcagcugucaguaguguaaggaguuagaggcgggccgcaugcugcauaaggaauggcacuggccgcugugaaguuuccuuacagaagaaaacacuggcagaccagggaauaguccagugguagagcauuaacuuagcacacacaaaauccuggauuugaucuaggauccagcacugcaaguaaugaauaauaaagcaauuuggccuuucauccaaggugggagcuuaugccaacagaucagucaaaagugcugacuagcuuuaaaaacaaacaaacuuggggcuggagaacuggcucaccgguuaaagacauuggcuguuaauccagauucaggcccuggcacugcauaguggcucacaacuggcuguaacuucacauccaggggauugauugcccucuucuggugucuuuuauauacauaccuaaacauaccauguaaauggugcacagacaggcaaacaaaacgcccacauauguaacauuuuugaaaauuaaaguugggucugccggcugguugaaaucaucuuuuaugaacugggcucuguacuauccuuaugggucuuauaguucaagcaguagagacuugcuuguuucuacuuuguauaugaauuuauagccuacuuuucuguuguuaagcuuacaaacuuacggaggcuuuuucuguuguugauugacauuugggagcauucuguuccuuuuggguuuuuuguuuguuugguuuugguuuuuggcuuuuggcuuuuuguuuuuguuuuuugagacaggguuucucgguguagcccuggcuguccuggaacucacuuuguagaccaggcuggccucaaacucagaaauucgcuugccucugccucucacgugcugggauuaaaggugugugccaccacacccugccauucuguucuuuuuugauaaagugucuuuuauaagugaucauggauucugggaccugaaagucuuuucccacuucuaugacgcuucuuucucugauguucacucaaguaucucuuuuucucuguauguauauguguguguauguaaauacugcaauuuuauguguuuacauauaaacacauauaugugcauguauauauauaaauauuucaauuuuauguguuuguuuugccuucauguaugucuauacaccacuugauuccuugugcucacagaggccagaagagggugucagaaccuggaacuggaauuacagacagcugugagcugccaugugggugcugagagucagaccuggauccuuugggagagcaccagugcucucuaccacugaguuaucucuccagccuccccucuuauauugaaaagauuuuauuuuauuuauguaugugugugcaugcgucggugugagugugaauagggugcccguggaggaagaagagggcaucagauuccauggugcagaguuacaggcauuugugauccagcugauaugggugcugggauccaaaccccaguucucacgauugggcagcaagugcuguucagcaccgaguccucucugcagccccgacugugucucccacccacucuccuuucugucuuccucuucucuccaagugcccuuucagcgcagucuaaauucacuucuccacccaauguugagcucaagccagggaacuagagggguggagugggggguaggggagggaagcugaggcauaugaagggcagaauguagagagaaguaagggauguagggccauuugaauggauggaaauaaguaaacauguuagaugugaccugcaucaaaugaccuugauuauggaaccucagaagguuguguaggcauuccaagccugagagugacugucugcugagcaaaaggagggaagggcggggagagaccugugucuuacugagugcuuacuuugaaggguucaugucugcuagcacuugaucucuuaucuagaacauuguagagacucugugaauugcguucucuguuuacagcagaacagucagggcuggguuuucuaucagaaguggcuaugugaucuggcugguuuaugaucugugaaggaaaguacccucccaggccuuagaucauccacuauugcuuauaaaagacacuuaaagggcuggauagguuuuuaaaaaauacuuauuuauuuauuuuauguauaugagggcucuauccuuauguacaccugcauggcagaagagagcaucggaucccuuuacagaugguugugagccaccaugugauugcugggauuugaacucaggaccuucggaagagcaguuggugcucuuauccacugagccaucucuccagcccgaccuaggugauucuuauuaugagcacuuguuccucuuacagaguucacaaguucaguucccaguauccacauggcagcucacaaccagggaacugguguuacaggggauuugacacccguuuuuggccuuugugguaugugaguggugcauauguacacauacaggcaaacacacacaaaauaaauaagaaaaggaaauuugaucaugaagaugauaaagggagcauguugcuaggcagcuacgagccagcagcugggccuuggucauuuuagcauauaaaaaugauaaauugagagguugaaauuuuaguggauguucuguaggauuguggcaaagaguaaaggugauuuuugguacuuuaauuuuuuaaaaaguauguaccuaugcucagaaugguggugaauacuaguaaucccaggaggagguggaaccagcaggauuaugaguucaaagccagccucagcuacauugagaaugugaggcugucauggguuauaugagacccuauuccaagaaaccaucaucagcaacaaaugguauguuuugggaauggggaaaggguguagagaaauagugaccacaaggcuaaugcguaaaacaguggcugagggacugaagagaugguucaucaauuaaaaacccuggcugcccuucccaaagacccagauucgauuuccaguauccacacaauagcucacgaccauuuguuaacuccagucucaggaacucugagacucuucuggcucuguagacugucaacaaguaugcaugugauacacagacauguguaggcaaaacacccauacucauaaaaauuauaaguagauaaaucucuaaaaaauguaauagcagcuacagggcuggagagauagcucugaggucaagagcaccaauuggucuugcaaaugacccaggaucagcugccaguagcaacguguugccucacaauugccuauaacuaauucuggaagaucuccaucggcuccuacaugcuugugguacacauacaugcacucaggcucauacacaugcacauaaaauacaaauagguauuuaagacaguugcuaaaaguaguucucuaaggaucauuugcuccaucuagcuguuuugugauugguuguccuucccauuuuagaaauggggaaacugagguucuaaagagagaacaacaguuucaccaguaggugagacagccaggaucucuggaccugggauuuagggcuuugggagaaaaaacagagcugccuggacuggugacaagauguaggugcuuagaugucagaagagaguaaaggaagggacgggcauguccucugagguacucuguaggccaagaggaggguauggugaggaaagagguugguguggggaaugggguagguaagguucagugacaagaugaagcccuacucuggcgggcaauauauauauauauauauuuuuuuuuuuuuuugagacaggguuucucuguauagcccuagcuguccuggaacuuacuuuguagaccaggcuggccucaaacucagaaauccgccugucucugccacccaagugcugggauuaaagauguguaucaccaccgcccggcagggugggcaauaucaaagaugacuuuuuuuucccccugugcuaggauuugaagccaaugcuaaauauggcuuccacuaauuggcuucaacuuuuaguuucccacccauaaaguucuuauuagcugcacaugccucguaccuacuauguaucuuggucauuucugaguaccuguaaagucccaggccucgggaauacagauauuugugggguucuccuuggacccagggccuuaugagugcuagccaaguguggguauucagauauuuaaaagcuacugucaaggagccuuuaggagagaaaacguccuuacuaaacaugucuugggcuggaguggcugguggagaaauuauuguagacuucuugugugguguuguuugguucaguacguagucugcucauguaguauuggcagccaggaacacagucugaccuagcuaucugggcauuucacauauagauucaguucuuuuuucuggaaauugcucaugaccagacuguguaguuuggggcuaagaagugugguagaaaaaauauuaaacaaauucaaguaugacuguuuaauagcaaccuucuauacucaguguuggaugaaguugaaugccacguaucgggagguccccaagucaggucccucguguucugcagaugcaugccauuucccuugcauuggcuagacauguuuucagagauucauuucaauucaaugauuaucucuuuucuucaaaguauuugagccacagacaggaggcagcuaaccaggcacaguguuuguaguguuggacaugaaguacuuuccaguguccugugaaugagaaaggaagaacucaagccuggauguuuauauuaagaguaauuaguugucccucugagugcuguaacaguugucaguuguagaaagcccuuuagccuugucauuuucucuuuuaguacaacuauguaagauacauacaaagagacuaaaaggaacuuacagugucucacuuuggaacuuaaaauuacuaagcaacaacagcaugcagacucugugcacagaacauuacugaauccucagaacacugaauuauuugagacuuauaauuucugcugaauuaaagaaauccggcucugggaagcuaagagacuugugcaggccagugacagagugaagcuuggaauucgcuccuggucagugcccacuuggcauuggcccauaugucacuuccuggacucagaaugcaugauuugucaucaucagaacccggaagaccugccaaggccccacucagaguuuccaaggcaggcucuagaauuuugaauuucuaauuaccucccuaaccccgugcugcucucugaaugacacacucugagaaacagugcuguagacagagugguucacugcuuugcaucuuuucuuuaucuuucuucaaacacuacauauggacuuugagggacuaucucuuaagggggauuauuuccaauucauuuccucggacauuuaguggcuuuaucuuguccaccuguacaugucuagcuaagcauuuaccagauuguacagucaaacaaagaacuuggacagaucccuagaucauauaagacagaaaguaauuggguaagacuggacagguuaauuaaauaacauaauaaaggagaggaagaaguauuaauaagaaaguauuuaaagccaggcgugguggcucacgccuuuaaucccagcacuugggaggcagaggcagacggauuucugaguuugaggccagccuggucuacagagugaguuccaggacggacagggcuacacagagaaacccugucucggaaaacaaaaaacaaaacaaaaagaaacaaacaacagaaaaaaagaaaagagaagaaaagagaaaguauuuaagaguaagaucauuuaguuuucacagcgcugguguaaagagauaaguuaucaucucugguuugcagaugggagccaucaaggcagcacaaagauguguuaaccuacuuggggucauaguagugaggggguuagagucuaaacccagcacccugcuuugggaguugcacugggaugcccagggaaguuacagaaagaugauuuccucucagcaucaaagccccaccugugcagaaugaaaaagguagguccuacuaggaaauuagcuacagacagugacacuugcuccaaggucagggguagggacacuuccuaugaaccuccaucaaagaugaaagggacaagccacagguguacugggacaaagucuggaguucugagaagauuuauccuucauugccuggauagguuauaaaacaccagacuagaaggacacaggaggcucagcuguuuuuucucuuccauugcuuaacaucugcaagugcagggccucugggagugccacgaccugggcacuauuuggaauaguucacauucucauauaaaaaaaaaaaaaucacaaagaaaacaagaaaaacagaaaaauucaaaggagaauaaaauucucaucauaaacuuccuuacaaguuccuucagauuuuucuuguuuuuauguauguuuuauuucauggaaagcaauauccucuacccucuagcauguuccuguauaccucuuaguuacauauuuucugacuuagauuugagauucucagagggagggggugauaaacacugugcuuugaggagaaucacaauagggauguugcucuuggccuagagauaaagcagccagaauguuuugacugacccagaagucuggaaggauauaacauucaaguuuugugggcugggccagcuugguuuuccuuuuuaaaauuuuauuauuugugugugugugugugugugugugugugugcgugcgugcgugcgcgcccgcccgcccgcaagugugcacuuguugccuguauauauaucugugcaucacuugcaugcagugucuaggaaggcuagaaaggguaaucagauccccuggaccuggaguuauacaugguugugagcugcugugagggugcugggaaccaaacacaggucgccuggaauccuaguaaaugaccuuaacugcugagccuccucuguagcuccccagcugggcuuaacucuuuucacuuauguguauguacgaguguggcagugcucaguuaucuuauguaugaguguguaugaguguggcugugcucaguuauguguguguguguacgaguguggcugugcucaguaccacagugcucagguagaggucagaggacacugccugggagucagugcucuccugucaucuugugagauccaggacuugaacucaggucauuaggccugugugugagugccuuuacccacuacugagccaucucucuggcccuuacuauguuuagaaaagaggguuauauaagcuaguuucagacuuugccucuauguaguguuccuuucucuugacaaaagauucucuuugauuuucuccaucugaacaucaagccugcuaccaccuuucuuuaagcugcccucugaaugccuccuccuguuuguggcauccuucugucuuugcuuccccagugcucauuuucguguuuuuuguuguuguuguuguuuuguuuuguuuuguuuuuguguguguguguauguguguguguguguguacauagcaaacuaaauuuauugaugguauucaagagaguaggacuuccuaggccuuucuuguuauuguggagaucugggauggagaugcuuagugucgggagcugaguugggacagggacagggaccucucuaucgcucucauguccuugcuggggugggugguccagggcuucuuacuccuuggaagccauguaggccaagguccaccacccuuuagcuguaacuguagucacugucuaaccaggaaaugagcuuuacagaguugucauugagagcaaugccagccccaacaucaaauguggaagaauaggcaucacuguugaaguugcaggggacaaccugguccucaguguagcccaggauacccuuuagagggcucucagaugccugcuucaccaccuucuugaugucaucauacuuggcagguuucuccaggcagcaugucagauccaugguagacacacugggaguaggaacacggaaagccaugccagugagcuucccauucagcucugggauggcagcaccaguggaugcagggaugauguucugggcagccccacggcuaucacaccacagcuuuccagaggggccaugcacagucuucugaguggcagcgauggcauggacuguggacaugagcccuuccauaguaccagacuugucauggaugaccuuagcuaguugguggugcaggaagcauugcugacaaucuugagcgaguugucguacuucucaugggucauacccaucauaaacauagggguaucagcagaaagaauggagaugauaauucuuuuggcccuacccuucaagugugcuccagccuucuccaugguagugaagacaccaguagauuccguggcauacucagcaccagcauuaccccauuugauguuagcagguacggaagauggugauggccuucuguugaugauaagcuucucauucccuugacugugcuguugaauuugccguggguggagucauacuggaccauguggaccauguaguugaggucaaugaaggggucguugauggcaacaaucuccacuuuaccaacugcagagcagaugguggcccugguaaccaggcacccaguauggccaaauauguucacucugaccuucaccaucaugucugagcgauggggcugacacugcacaagaagaugugacugucucuagaguaugggggagcagagagcuauuuuauuuuauuuuauuuuagacagagucuuacuauauagacaaggcugacuugggacuuagagaucugucagccucugccuccugagugcuaggguuaaaggcuguuccuagugaacuuuucauuuuggggaucaggcuuagguccuuacaugacugagcugucccuuagcccccauuuaaccauuuuaaacacauaguacaguaguacuugugcucauuuuugugcggagcaucaccaccauccaucacugacaauuuuauuucacaaaccagaaaggccauccccugggcccacacccuauccccugguaaccgccauugugcuucagauaccgugaacauaacucucuaggacuuucguaugaagaaccauccaggaucuguccuuucaugucuguuucacauagcacaauuucuuaaaaguucauguauuagagcaugucaguuugucuuuccuuuuaaaggcuuugucacauuccauugugugcacccacugauggacauuuaaguuccuucugcuucuugcugcuguuaguaaugcuacuaugaacauacgugugcaaauaucuguuugucuuuguuuuacauguguuuagauauauacccagaagugaaauugguagguaauaugguaauucauuuuuaaguuuugguggcccugggggcauuggccuagggacuucacaugugccaggugagugcuuuacuacugagcucuaccucagccccacuuguagauuuuugaggauccaccuugcuggucucccagguacagcacuuuaccuccccucaguagcaugcaaacuucaucccccaucuuuauuaacaauuguucucagaucugcugcuuuccuuuguaauguccaugcacugggcgagguaugcucucuccuaaucuuccuuccuuccuuccuuccuuuuauuuuuuuguuuuuguuuguuuguuuguuuguuucuuacggugcugugcauuguugaagguaagaucuccuaagugcaagcccuuaauugugguuuugauuuguauuucccuaaugauucaugauguugaacaucuuuccauguuguuauugacuaucuucuuggagaaagaucugcucaaguucuuuaccuagguuuugagauguuaauuuuguucaguuuuaggaauuuccuguguagucuugguaucagcccacagcagauguccaccacucucuguaggacacuuuuuaauuuguugcuccuguccuucagugagcaguuuuuaguccagccugucuuuugcugcuuuugccuuuggugccaugcuuuuauuucuuccuuaguggagccuaaggauaaaacacuugggguuaugaggacuagcuagccuggcuccucuccauaugcuggguggugaaauaccuuuuuucccuuuguggggcuggacaaggucucauuguauagcccuggcuagucuagaauuguguagaacaggcuggccugaaacucagagagaccuacccacaucuguuuuccaagugcugggauuacaggugugagcuaccaugcccagccugucaaaaaaaguuuucucuuagcauguauuggccauacauaucaucaggcuccccuuauagcaugugcuguauuugaguguaucagccuccauuuuccucucauuuucuuccugcuccuugccuugcucucuccaguuaggcccuccucuuacuuuucuggguuuuuuguuucugugagccagugaguuuaauuagaauuacuuacaaaagcgcaaguaacuuacuugugugggcaccacuaaaacagucucucccuccuccagcaaccauuuccugccuauaaauacucaaagaggaauggacccuggugaacuucuccccauaacagcuguuaacuguuagugagcucucagggaugggcaaggccuccugaggcccuccaucuucauggcacaauggugcugggcccaaucauuugccugugaucacaaccucugugaguuuaagagaaggugaaggcaauugccaucaaaucugagaaccuaaguucaauccccaggacucacuggauggaaauacagaacuaaccaccacaacuguccuuuaaucuccacauacaugccauggcaauuguaugcauguucaggaacagcacacacacacacacacacacacacacacacacucaugaaauauaaaauauuuuaaaagugcaauagcaugucacaccuagaagacaauaguagacaguacuuuuuccuugguguucucugagacuuggaaagggagauacagauaucccacugaggacuguguguguguguguguguguguguguguguguguguguguguaggggggauguuugcccacacuuguacaugugguggccaggagucaacaucugguguuuuucucuaccacuuucuaccuuauuuuauuauuacauuuauuuauuuauuguguguggaaguguaugagugcaugcaccauugugcacaugggaaaguuaaaagauaaauugugaagccuggcggugguggugcacgccuuuaaucccagcacuugggaggcagaggcagguggauuucugaguuuaaggccagccuggucuacaaagugaguuccaggacagccagagcuauacagagaaacccugucucgaaaaaccaaaaaaacaaaaacaaaaacaaaaacagaaaacaaacaaacaaaaagauagacugugggaguugguccuguuauucugcagguggguccuggggauucaacucaggucauccggcuugguagcagcgaaugcccuccccugcugagccaucuugcuagcccaucuacuuucuuuuuuuggagacagaauuucacugaacuugguauucuccauuuuggcuacacuugcugggugauccuccaaaacuugccugucucugucucccagugcugggcuuauaaaugcacugccacaccaggcuucacaauuuauuuuuuaauuaguggguuuuccuguggccuuugacucguaucuagucggcugacucugcuaugccuuccgguuccgcauccccugcucuacuucuggguuuaacuuuuccaccccucguacccugugguccccagagaaguaccuugguuuuuuuuguuaguuuguuuguuugguuuuaugaugcuggaguucaaauccagggccuugcacaugcuaggcacugaaccacugagcuaugucccuagcucuucuuggcuaaauaucuuacaaacuuaauuuucuuuaauucucacaaaauuccagguagguaaugucauucauauacaugauauuguuuguuugucuuuuuguuugguuugguuuguuuuuuuuuuuuuuuuuggagacaggguuucucuguauagcccaggcuguccuggaacucacucucuagaccaggcuggccucgaacucagaaauccaccugccuuugccucccaagagcuggaaugaaaggcgugcacuaccacgcccggcuuuguuugucuuauagagacauggacuugauauguuacucagagugaccuucaaccccggggaucaagugauccugucagcccagccaccuacgcagcagagacuacagugcacaucacugucccuggcaugacucauauuuuacuggcucuaccucuaaaguaggcaugagccaccacacccggcugccagcggcugcuuuaaccauuagugcugucuugguagucugggaggcaugucaaaaauucucuuugggguuuuauuuuuuaaauuaagugcaaucaagaacaacucacucgccgggcgugguggcgcaugcuuuuaaucccagcauucgggaggcagaggcaggcggauuucugaguucaaggccagccuggucuacaaagugaguuccagaacagccagggcuauaaagagaaauccugucucaaaaaaccaaaaaaaagaaaaaaaaaaaaaaaaaaaaaaaaaaaaaagaacaacucacucgggcuggcaagauggcucagcaauuaagagugcugacugcuccucugaagguccugaguucaaaucccagcaaccacaugguggcucacaaccaccugaaauaagaccugaugcccucuucuggugugucagaaggcagcaacaguguauacuuauuuauaauaauaaauaaaucuuuaaaaaaaaaacucacucuaucugaaacuagucuggaacucacuguagcccaggcuggccuucaaccaaugcaauaaccucuuugccuaaaacuccugaugcugagauuauaaaugugagccaccacaucuagcuucagagacggauuucaucucagaaaauugggcugagaugcauagaacugaaggaccauccucaaggcucaugguuuauaagugccagaguggggacuucucccgcuugacuguaggcacuuuuuuugugcuacuuuauugggcucuuguaucugccaccuuucuaucuguguuccacccuaaucccuucuaaucuccuaguacuaggcuggagagaaaaaagguuagcggggaaaaggggcauagaccucuuuagacuacuuccugcugaccugggguguugaguucucuggggcaaauccaacaucuuuguuguaucuccaaccagcaacccagcaacccagcaauccagaacccagcaauccagcaaugacaagugcaauagcaggaacuggcagcagggggagcagcugcugccccuggcccucugggcucuccuauuuauacucucuucaagaguccuagagguaaacuuucugcaccuggcaaaaaucacacacacacacacacacgcacacgcacacgcacacauacacacacagcacaggauaaucauaguuauccacuguggacaaucugaagcagccccauauuccacaccugagauuaaaacaaaaacauauucacauagcauaaguggguuuuuaaagaaaccgaacuuuucacuacacuuggcuccuaaacagaauggcuuagugauuauuuguaugacugagcgaauggaugucugaauuacuucaguggcuggaaucuaggaauaguugucuuaacccagauuaguccucacaucaguacugguucacccaguucuuccugguaggauugugagagcaagaguccuccgcccacguguguucugaggauugacucgagagugugcuuccuucagcagcccugagacuuuccagcaggacaagccacggacuccacucucugauuuuguugaagaacuaugguuguggguggauggagaggagaugccagcugcugguuauuguuguuuucugguuucucagggguucucuguguagcccaggcuguccuggaacucacuuuguagaccagacuggccucuaccucagagauucuccugccucugccucccaagugcugggauuaaaaggcaugagccaccacgcccggcugccaguugcugcuuuaaccauuagugcugucuugguagucugggaggcaugccaacaauuaucugugggguuuuauauuuuaaaucagugcaauugagaacaacucauuauaucccaaacuagucuggaacacacuguagcccaggcuggccuucaacuaaugcaauaaucucuuugccuauaaaugugagucaccacaaucaacuucagagacagauuucaucucagaaaauugggcugugaaucuuugaaagcuggugacgagaacagggacccgaguaggaauacuauuaagcaccagcccccccucccuuuucuuuugcugcuacuccugagauaaaucauagaguucuggcagauggcuagucaaagaaaggaaauguggccugggacauuguauugcuggggaauuugaaagcugaauuugcuagugccuuccagagagagaaucagauucuuagguuaacuuccgaaaugauuccucuuccaccucuccuccuccuccucuucucccucuuccuccucuucuuccucuucuccacuuccuacuucauguguaugaguguuuugcuugcauguguguguaugcaccacaggcauaccaggagccugcugaggucagagaagggcaucaauccccuggaccuggaguuacaggugguugagcuaccguguguguccuuugagagcaagugaucauaaccacugaaccaccccuccagccccaacuuuggaaauuccuagaccagcaacucaaacaaucauaggguuccagauaaaggagccccggcuuccuguggucucucucauuuauauaggggaaacagacccagagaggguaggucuaugcuguuuuuacccucacaaacacuucugacaccaaaaugugaaaacuaccccugauaccaaccgggaguccuaugacucugcucaguucuaccaccgcuuggagugggugcagaccccguuggguagggguugacuccuauacaacuauccuucuucgugcaucaaugagccuuggucacugccccugugcuucugaguagccaguucugaggugggaacucuuaugacaccuucuuccugcuugauagccacagcagcuuauagaccucagcuugcucucugcucacccugaugcaaaggauucagcccacgaacagccaagugaaacagugcguggacaggaaaaggaggaugagcccgaggccucuguguccacaucucccuguaugucuacaugcuccagucugggcucuuacagcccauccgucagggucuauggaggcaucagcaggguagccaugguugguuacacaucauugucccuggcuugcucagcuucagagccacacccuuccauggggugggguuguuauggacugaaaguuccaaccuuuugaaccugccuugguuuuuguggcaauuagcucuccugcugaagcuaucucagggucccccacugccuguaaucucauccaggcuggacaugguggcacaugcuuuuaauuccagcacuuggaagucgaggcagucagauuucugaguucaggggcuagccuggucuaccuagugaguuccagacaacuggggcuacacagaaagacccugucucagaaaacaaaacaaaacucccucccacaaagaaaaugcaaagcaaaagaagccacuccaguuugugccaggaaucugaacaaaggcaacaugugcuucuccugccuuggugggagcuuucccaagucccacacugagucaguuucaugacacccacccacggggcuuucuauuuacccacaguuucuugucagucauuucuuuuggcuacuuguuaugguagagaggcucaaugaggcaguguccagaugccauuuaguagaagggcucuugacucacucacggagguaaauacuuuuauuguuugaaaguuaaucuccugauucagauugcuugguaggaagaacaguuuggcuuaacuccggguuugaugcuuaaaugaaacuggucccuaaaacuaccuuuagcuucuguuuucuuggcuuuuucuggcauucauuucuuccuuccuuccuucuuuuucuuuuuuaaagauuuauuuauuuauuauauguaaguacacuguaguugucuucagacacaccagaagauggcaucagaucccauuacagauaguugugagccaccaugugguugcugggauuugaacucaggaccuucggaagagcacuuggugcccuuaagcacugagccaucucuccaguucucucucuuucucucucucucuuuuugagauuuauuuauguauuucauguauguguguacguugucacuaucuucagacacaccagaagagagcaucagauuccauuacagaagguugugagcuaccaugugguugcugggaauugaacucagaccucugggagagcagucagugcucuuaaccacuaggccauuccuccagccccugguacucauuugaaacagagaaauacgucucaaaugaggaccuaggacauccgagauuggucagcacucugaaacugcuuuucugugugauguugaguaggucguguccuacuuguuuauguauuugaauuacagguucuucagguucauucccaguccugcaauguaaggauaaauuuuauaagacaaaagaugacuuucagugccaggcggugguggcgcacgccuuuaaucucagcacuugggaggcagaggcaggcggauuucugaguucgaggccagccuggucuacaaagugaguuccaggacagccagggcuacacagagaaacccugucucgaaaaacuaaaaaaaaaccaaaccaaaccaaacuaaaccaaaccaaacaaacaaacagcaaaaaaaaggugacuuucaguuugucucgaaacuuuuaccccuccauagggguagucuuaagaauccaauuuauauguguguauauauuuauacauuuauacauauacuucauacauuuacuuacaguuaugauuauaguaaauuuauuuguauauguuauauguauaacaaauauuguauauuugcuuucugauguuuucauugagauaugguuuuccuuuuugguuuuuugagauggggccuuauguuuuuccuauaggaaauacaauguacaaaucuuaguugaugcauucuugacaaauguguauguuuguagucugcacccugccaagauguggacagucaaccucacacaaggcugguuggguuuuguuuugaugcuguucagggcaggcuuccugucagcacaccugcagaggcagccgcugaucuugucugucucuggaggugaggugcagcugaguggagucacaugacgugugcucuuuugugcugucuuuuugcccugagaaacccuauaccuguaugguauuuucaccacuugcuacucugaaaggucaugaaguuuggcuuccuuccagucucccugagcugcuaggguugagaagugagggcccucugccaggggcccaccauauugucugcugaaugugcuggacgagauggaaacaacaguuugguuuccagauucuagguugaauuuguuucuauaauuguuggugucacagucucucuugucagcugggcacauucagucugccagcagagaagacuaacucugacacccgaaaaugucacuugcaauggcauguuucuaaaaugguguccuugggacgcacuccucucaguuuccuauguacauaggacagacggcuccacaggugagcagugucagaagggaaucgaggagguggagagccuugcugaacucaggcucagugugucugugggcuucacugcuggugguugcgucuuauguuuguuugucuucagaguccauaacauugguuucacccugguuuuugccuucgcugacuuggucuagcccuggucugccugaccaguugcucuuagcuggccucuuucccuguucuccuucccuuucuauauuguaugccccauaugugggacaaaccuguugggaacuuccugggauucucccucuccugaacggcuuauaaaugcugcugguguaggaggcccucccuggcugggcuccugccugucucuuccuugcaggcgcugugcaugcgcugugcuguucuugugcucucccuggcuguguguagcguguuauggcuccugugcaguggucucacuugcuuguguuuuagauccauaaucccuuccuggucuacuuuaggaccuuaugcugacaacaauuccuaaucugcagugguauggcauuucauauguauuugauagauauuugacuauuuaaguguggucauuauuagccuuugguucugguauuggguugaguggccucucuaggugucaguauacauacaagcuuccuguuuucuauguggaaaauaugucagagaggaggaauagggauguacccugacaguguacuggugggaggaagggacgaaucauguuuaucccucuggguauuggaggaagcuggcucucacugcacugcucagugggcuuuaggcuccggcacacagcuuauguguuuggaaccaagacuauuucuuguuuugcagcuuucucucugggaguuuuaaggacaugguccuaaaagugggcuguguaauuuuaccucuuucaugacuuucucagaaucaaaaaccccagcaggauugaagcccaguguggcccacagcacagccugcugggggugucaucucccuccccuggcuuccugaggaguuguaucuggggaaggacaucgagauccgguguggacugguuugcccaucuauaugcauacuaccuagcacagguuuuaucuugggucaggacccaggugaagcaagaacucccuucccaaagaaguagucaguugcuuuuugggaauugugguccucuguucccucacggcugagaaagugucaagggagaccaucuccagcaccuuuuagaaagaucacuaaaaaucaacuguguuuuacugagucucaugccagugcacagagcaacucuuuagacuugugguuuuauuuuggcaaaguauacaugcaaauaauacaauauuugucaccaccaccacauguuaaguauagaauucaaugguacauacauucaaaguacauucacauuuaauguccuugugcagcggccacaaccaucauuuccagaagcuuuuuaaaaucuuuccccacaagccgggugugguggcucaugccuuuaaucccaguacuugggaggcagaggcaggcagauuucugaguucgaggccagccuggucuacagagugaguuccaggacagucagggcuagacagagaaacccuuucucaaaaaaacaaaaccaaaacgaaacaaaacaacaacaacaacaaaaaaaaaccuuuccccacaaaauugugugcccauuaaacacuaacucuacacucccucauguucccaagcaacuaccauccuauauucuaucuaugaaucugacugcucaagagccucguauaaaugaaacuauauuguauguaucuuuugaaaccuggcuugacucacuuguucuaucuccaaggcucauccuugguagagagcaugucagaauuuuucaagacagggugucacuauguauccuugacuagccuggaccucuuuguagaccagacuggccucaaacucacaagauccuccugccucugcuucugagugcaggaacuaaaauugugugccacuaaacccacuuuucuucuuuuuaaaugcugaauaauauuucaucuuauggccagacuguguccuguaauacauuuguuugcuaguggacacuuaggcuaauucugccuuuugacuauuuugaauaauacccuugugaauagggguacugugagugcucuguucucaugcacaccagaagagggcauuagaucccauuacagaugguugugagcaaccaugugguugugagccaccaugggagaagguacccauauuaucaugagaugguaaauauuucuguaucuuacgguaacacauacacaagagacaacagucucuaaaaaagggcaggaaagaacucaauggaacucauuuuuaaguacaugagguuaagaccaaauaucaugaaaaauauuaaugcuauugcuaauuacaaaagguaacggaacaucuuagcauugaugcucuuggguuucaagucagcauguaagagcaugggccuucccugucguguggugaagaacaguuucuuuccuacccucagcacaggcuuugagugagguguccggugagaacugagaauuucacaccugcaguagccccugacauaguucccucugagaaguucugcagacucuccucccuuccaucuuaacuguguucucaugcagguuccaccaggcacuuacuuacacuuaagaucuguggauuuaaaguagaaugaacuuuucagauauugaacaucacaagcuauuuuauacaguaagcccuaaccaaccaauuugucauuuguuuugccauuuguuugucuguuuuguuuuguuuuguauuugagacagggucucucuacauaacccuggcuggccuggaacuagcucuuuagaccaggcugcuccugcuccccugugcuaggauuaaaggcaugcgccacuacacccagcuugccagccaacuuugaguuucuuggggcaccuauacuguuuuccaaagcagccauuccauuuuccauuuguaccaaaagugcaccaggugucauauuucuccauaccuucccugacacuguuuuucugauuuuguugauaguagucauguuaaugaguaugaaggcuguuuacauaucuuuagagguauuuuaugaagugccuaccguagaaccaaaauaaaggauguguuucuagaagagggcagagcauagaaaccauggguaaaauacuuuguuuugcagcauucuguauuuccugugaugguacuguauggugacaagaaagacuuuccuugaagucgacgcuagucagcuggugcuguagguuagagucaaggcagaaccaagaguccaugagacuacuuguggcuauguggcauagcagaaauuacagcacuucauuacagugguagcauugucuugacuucagucuugacuuucagugaucucaucccuccuaguggggcagcucccugcucuggauacccagccaggcagguucgacccuggagaacagaaugaggaauaagcuuuugccccagggcccugaguaccucgcuuggggcugaguuuaggaguuugcgcugauagauaugcagaagcacauauuucauguauccaugcugagucucagggugugaugggagggagacgaagccgaugggaggcucuguguggagagaacguuccugagcugccuggaccugguuuugaaggauaagcagggguugaccagagagggaugaguuuggaggcagaaaaggacgcccuucaguuuuuuguuuuuuuguuuuuuguuuuuuuuuuuuuacugaaaucaccgauugagguucuuguguaagagaauauuccuaggagucuccuuuaaaucuugacagccuuggguacuggcuaugauaugauccccggcucagaccucuuucaaggcaaaggacagaggcugcaguggagagggauuagucuguuggguauaagcaucagcucuguuauagggccuguaaggcugcuuuggggggaggugugcauaucaaccuuccuguuggguugacaagaagaaggaaugugauaugucuuagauggcuuggggaggccuucccaugguauuuuucuacacaggggcucugucucuccuuuuaugccagcuggauaccccaaagcacuuuguccuucauucaauuuguguaacacacaagugucauaugacauagacccauucuuguuuuuaagauaguaggcaauauaggagccucuguucuucaugaguaagcccauuaccaccuucacuguacuccaggagguaaugccugggagcuucuuaccaagcaguuguuucccuugcaguuucuuuuauauaagugggggccaauguaggcuuccuuuuacagcccaugugugucuuggcagcauguuuugauccaccacaugcauggcaacccacagacuagauauucaggcauacagacauucuccuucuccuggccaguggcuuuggguccugaaguaacaugccuuuguuccuuuuaacauuucucuuauuuagauucugugugagacucuggagugucuuagucacgguuucuauuccugcacaaacaucaugaccaagaagcaaguuggggaggaaaggguuuauucagcuuacacuuccauacugcuguucaucaccaaggaagucaggauuggaacucaagcaagucagaaagcagaagcugaugcagaagccauggagggauguucuuuacuggcuugcuuccccuggcuugcucacccugcucucuuauagaaccaagacuaccagcccagagauggcaccacccacaaggggaucucccuccuugaucacuaauugagaaaaugccuuacagcuggaucucauagaagcauuuucccaacugaagcuccuuucucugugacaacuccagccugugucaaguugacacaaaacuagccaguacauggagucauuucauacaggcauggcuacauugcccccugaaaaagcuauugugaauuagccugugagccacggaaacuuggaaugccuacucacuucauagcucuucuggguggguaccgugaacuuguccacuggucugaggaggggcuauggcauguagugguucuggggucauacugucuaauggaagacuaucucugacaucucuguuaaagccuggacaucucucucugaguucuagguucuuucuggaaauguagaggugggacaugcaacaagggaggcuguugagacucugcccuccuguagucauggccuccccucugagcaagucuuuauuuuucuugaaaguuuucuccuaagaacauuuuacuuggggcuggagagagggucaggaguaaagaccacuggcuguuguuaacagaggaccuagguucaauucccagcacucacauggcagcuugcaaauaccgcuaacuucaguuccgagaaauccauugcccuuuucugaccucuucaaguacuagacauacccacaguaugcaaagauacaugcaggcaaaacauucauacccauaaaauaagaaagaauccuucacuugccauuucccacugguuuucauaugaaguguauccaauggguaucgauuccugaugcuguccugcuagucaggaggaaacugaauuucugucgcugccccaugguuacaaucuuucauauaccaacuccaguuuccuucacuuuacugugacacaucuauucugcuuuucagaaccacggagucuuuccaggucaauguugcuccucuucaugguuaagcaguaacauaaagagaauucacaugcuuuaugcuuccuuuaauuagggucaggacagaggcaggaugcuguucucuaacaaugaguuaaaaggaaaagcugggugugugaggugacugcagucuguugaggggcgcuguucauugacuugcagcgcuucaaggcagguuucaaaugggucugaguuaugugaauaggucucccagaaaguaggugacagucagagaacagacaugaguccacaucugccuaugcugaagacaguaccuugcucaguagggcuccgggaucuggagacuccaucuacuaugguuugcauacaguugucacaugccccccaaggcuucacaggcuaauauucggucccuauuccgagguauuaagcuaguggaaacuuauucuaaugguuguuuagaaggggugccuuugggagguauuuaggguuagguaaguuggaacucccgugacugaacccugggguagucauaagaagugggguauuuaauaagaaaagacuagaagagaugaacacugauagacccacuuuccuguucuuugugauucaugugauuaucuuguguuucucugggccuucugccugcaaaaggcuguaacuggagccuacugaccuuugaccucuagaauuaugagcuaaacuaacuuauuuauacugccaccagucuauaauaucaugauauuggcaucagaaacuagacucacauaacacacucuaggacuucuccauagaagugaagaugaaauggcuucuccuugguagguccuucagcccacugggccccagauaggcaucuguuuucuucucuuucccuucccuguacuccgagcacuggcugagaguuucuuuucaucccuaggaccaucuucagagcuucccuuguuucugagcuaccuaugcauagguuuuucuacauugauucuuuguuuuguuuuuugagacagauucucacuauguaucucuggcuggccugggacucgcuauguagaccaggcuggaccugaacuuguagagaucugcuuuugccucccaagugcugggauuaaaagcaugcacaacucuccaugaucuuuuuuuuuuuuuuuuuuuuuuuuaaauuugggaaaauuuauuuacaaaagauuuuuucccucuucacuugucauuaaugcaaaguaacauuaaaauaauaaaaaggcaaaaaggcaggcucagagcacucacaacacaacgugacaaccugaguucaaucucuggaugccaugguaggagaacugauucucuagguuuuuuucugaccuuugcgugcacgcuguggauacacacgcgcgcgcgcgcauacacacacuguaauaguaauaaauaaauuaauuuaugaaagugugaaaggggagaggaagguacugauaaauauuaguguucacuuguccaguucaaggcccuaggcuugcuucaucacuacucacacaaaauaauaauaagaagcaguaacaccauacaagggugaucuuugcugcaucccauugguucccaaggccccaauugaggcucacucccaacuaggagaaagcuugcugaaugguggaaaagugguuuuccuggugucccagcacuaaguuggggcagaagcaaaaagacagguccagcguucuucaucacugccacccugacccauccaaccuuaccugccccacauucacacagucuguuccucccacgcccuccccuggcuuucuggcuccugcucuauacuccuuuugucccccaccuccugcuggccauccacugugaauagguaugaccuucucucuauagaaucaguaugaccacgaagcauggguugcuugguccauagggguaaagggagcuugagugugcaggagagcaggcgauggguaagguagacacgaccugcuuuuucucuggguauugucuggagugcuagagcuuugagcugaagacagggcagaggacuguguagcaggcugggcccugcauuacuucuacacuuucucugguuuguguuagaagcucuaccuaggcucauagaggcauuagggaacaccggcugagcucuagacucaucccagguaggaaccaaagcacauucaccuagguauagagagcaccaaaaguccaggucucagcgaaagacugauaaauggaaguuagugcccuugucuuugaaaaugaagggcacagggcuggugagauggcucagcggguaggagcacccgacugcucuuccgaagguccugaguucaaaucccagcaaccacaugguggcucacaaccauccaugacaagaucugacucccucuucuggugugucugaagacagcuacaguguacuuacacauaaucaauaaauaaaucuuuaaaaaaaaaaaaaaaaaaaaaagaaaaugaagggcacagacuaggguucauaaugaaaaaugaauagugucaucaugguguauuuacuuacugucuuugcguuucauguuucccaauuaugacuaauaacaucucuggauuauuuaaagcucagauugaauaauauguauaaaauacucaacucauugcauguuuuuuuuucuuacaucaaacguguuuuugaaaugaauuaauuuuaaauuuagaccguaucaaguauauucuagaauauacuauuaacuaaaaaaauuaaccgggcggugguggcgcacgccuuuaaucccagcacuugggaggcagaggcaggcagauuucugaguucaaggccagccugcucuacaaagugaguuccaggacagccagggcuacacagagaaacccugucucgaaaaaaaccaaaaaaaauuaaaacaagcuugagaugcguguuugugcaggcccacaguguauggguucacauuguguaugaaggccaaaggucaccaugaaaugcugccuuaggguugcuguugcugugcuaaaacaccaugaccgaaagcaguuuagaaggaaaggauuuauuuccauuuguaguccaucauccggggaagucagcaggaacucagggcgggaauacuggaagaugaagcagaggccacggagggacacugcuuacuggcuugcuucccauggcuuguucagcugcuuucuuauacacccagagcaucugcccagagguugugcugcccacagugcuuuggacccuccuacauuaaucagugagaaaacgucugucccacaggcuugcccauaggccagucuggucgggauauuuuucucagucaaaguucucucuucucaaaugacucuagcuuguguccaguugacaaaaaacuuaaauaaacaaaaccaaacaaaugaaucaaaacuaacugagacaggugucuuccuugguugcuuuauaccuuauuuuuugaaacaaggucuuacugaaccuguagcuauacugguugaccagcaagcccccaggauccuucugaaucugcaucuucauuguuagaauuauagggaugcacuaauaugucuggcggcagcggcugcuucuucuucuucuucuucuucuucuucuucuucuucuucuucuucuucuucuucuucuucuucuucuucuucuucuucuucuucuuguuuuuucaagacaggguuucucuguguagcccuggcuguccuggaacucacuuuguagaccaggcuggccucgaacucagaaauccaccugccucugccuccugagugcugggauuaaaggcaugcgccaccaugccuggcuaugucuggcuucuucuucuucuuuuuuuuuaaagauuuuuuuuuaauuuauuauauguaaguacacuguagcugucuucagacacaccagaagagggggucagaucucauuacgggugguugugagccaccaugugguugcugggauuugaacucaggaccuucagaagagcagucugugcucuuaaccacugagacaucucuccagcccuaugucuggcuucuuaagggauacugggggucagaguucaguuccccaugcuucccuggcagguacuuuaccuaaggaaccauccccucaacuuuuuaucuuauuauuugaagcuaauauagagucuuauauagcucaggcugcccucaaacucacaguauaggccagcccuugaacuccugccucuguuucccaagacuugggauuauaggcaugcagugcuaugcccagcuuaaaguuuuuuuguuuuuuuguucuuuuuuauugaugucuucauuucuccuagaaguaugacccacauacuaccaaaaaaaaaaagugaaagauaaauuacaggguuaaagagauggcucagcaguugagaacacuggcuauccccucccagaagacuuggguucaguuucaagaguccacauggugacucacccaucugaaacuccaguuucagggcagcugacacucucuuuuggucugugugggcacuaggcaugcaugcaguacacagauauauaugcaggcaggauacagauacauagagaauauuuuuuaaaacaauuaaaaggaaaaguaaauuacaauaaguuguacuuucuagaaagaagaaaagcuuugaaauuaguuuuuuuuuuuuuuuccgucaguguauggccuuguaaauccugggccacacuuucucauugagcucgaucccagcucagaaaaaaaugcucuuugaauccuagaucugauaaucuguuugagcuuaagauuccucaucugugaaauggggaugaaaaguccuacuuugggacuggggaugcagcucgauugguagagguuugcccucacacagacccauugguuccguccccauuacugcagaaaacuugucaugugugcaagccuguacuucuggcacucaggagguagaggcagaagauuaguuuaagguaguuuaaggccauccucugcuacuucacaaauuucaagguagccugagcuccaugaaauccugucucacaaaagaaaauaaaauucuauuuuuaagaauaguguugagaggcugaagaaauaggucagugguuaagagcacuugcuauucuugcagaggacuggaauucaguuccuaguuccugaguuauaugugguuacucaaaaccacauauaacucagcuacaggagaucugauguccucuucaggcucuuaugggaaccgacacucacagacacauacagauacacacacagagagacacacacagacaaacacacacacacacacacauacacacagcuuuuaaaguagcaugaaaugagaugucugcuaacagcaucauaacaaaauaccacauacuggcuggcuuugauaguaccuacucucucauaguucuggaggcccuggagucuaagguccucgcucccuggcucuugcagaaggccaucuaccgccaucuaccuucuugcucugugcucacacagccauucuucuaggcaucugagauuugaagaggacugcucuaacaacucuuuuauuuuguucuugggguuuuuuguuuguuuguuuguuuuuuguuuuucgagacaggacuucuugguauauccuuggcuguccuggaacuugcucuguagaccaggcuggccucgaacucauagagauccaccugucucugccuccugagugcugggaauaagggugugcuccaccacugcucagcuucuaacagcucuuuuaaauuaacuguuuaucuccaaguauaaccauauugugguguuuuaggaguuaugcuuacagauggguagggauacaacuaacacuucacauuagcuagauugagaucucuauggcuaggaggcaauucuucuuaucuaguucugugucuaguucuuucuguuccuuguugaacacuguauuuaauguuugggauuauguggaggugaaguaguauucauuaagaacauuccuaauuucuaagcacuucugcuaaaauuagaccagcauggagggugacauuuagagagcaaaaccagccugcugcugccuacaauucuagcuuagggucaauaauucaucagcugcaaaggccaggcuugaccggauuuuagcaaaggauuauacuucucuucuguuuuucccuaugguaccaagaguuaaacccaggaccaugucuaugcuaagcacacacuuuaccacugaacuacauucuuagucccaagauuauauuuuaaauuuguaaggcucaagauagaaaagaaaccagacaaaaggauugauuuaaaaauuacacaaaugagccaugcaugguaguacacacuuuuaaucccagcacucaagaagcagagacaguuagacaagugccagagcagucagagcuacacagugggacccugucucauacaaacaaacaaacaaacaaacaaaaaaccaacacaaaauuacacaaguaaaauacacucaguaaaagaagccagacacaaaaggccacacguuguuugauugcaguuacauaaaauguucagaauagacaagucuauauccagagagagcugauuaagucauauagccugagaagaguggggacugcagugacuacugcugggacacaggcuucuuucuuuccuggaguuugagaucgggcugucucucagguguuauugcuuuuacaguucugguagagugugcuugaaauucccuagcacuguggaacaaaacagaaauauccuggaguuaacaggagagcuacuuaugcauguauauaaauaaauaacuaagucucuuggacuugugcccuucacaagggugaacuuugcaguuauaaggauugacuguggauggugagcuguguaacguuucugaacuuuguuccucagguuuccuuuccuaaguuguuuucauuuuuagaauguugagguagugucuugcuacauaacccaggcuggccuagcacuccacguagcccaggauauccucaagcgcaagaucuucuuguguuccucaaauuuucaguaauuauuguaauggggggagggaaccagagcucugcauuucacuaagauuucuuagcauacggcuuuguaugcagagaaauauccuugaaauaccaagaggucaccuuugcucuuaacauugcuugacuagaagagaugacuaaaaugcacaggccaucaguaggaaaugaguauaaguguguugcucauaaucagguuggccccacguaaccuguuccuccuagagagucugucuccuugucaguggcugaccugugcucugcagggauacagcucuuuuuuacugauggaguccacagaugccuugaaauccaugugaguguucauuuagagaauugcugguuccaugugugacuuguuuucaguccaaugcugggagauuuccgagcucuauauauuuuuaaugugcacuaaauaauucauuaagguuguucgugcuuaccucacuuccaacgugccuguuucuaccucauuuuuaaccucgcagagccuuauagcaaucuguuuccuggcuaauguguaaccucguggagccuuauagcaaucuguuuccuggcuaaugaccacauaaagucaucucagaaaggaaagcuggagacguucauguuaccuuugccaguuugugcuuucaguccacccuuugguauuugcaaaggucagaugagcuauuucuguguccauggcccugauuaaugggaaaucuugcauucucauugguccccaaggaugaaggauugguguggugguggcaggcagcaucugcuggaaugucagagcacaguguugggaauuggaugagcagcaggccuaugaagcauuaaggagguggugcuccucugaugcuagcccauaaggagguggugcuccucugaugcuagcccaugaguuucccucgucugcagccaugcagacagcuccgggagugguucuucuccuccauuaagccuuguugcuaggaauuuaauguggaaaguacaauuugccccuucccuaagaggacuguagacuguuugucagccuccugauucccugagucuucccaagugcccugugaguuggcaugcuuguauuuagcuucuuacccuccuuuucaacuuaaauaaaaauugcuguguuggcauggagauuucagagagagcaggugcuuagugcacuggggagaauaucucuggauaacaggggacuugcuucccacccaagagcagaugguccauguucauuuaucuucugaccuuucuuugcuucucagacaccaaauuucagaucccagggaucauaaauauucuuuaaguuuguagccauagagaugccgagggcagcaagcugugggugucauuccccacuuguuagaacacuucccagcacuaaaucagacggguggaacaguacgcuuuauggaccccugaaggacaccacagcaaggcugccguggccaaggucaagcaggaacccucugcucagugcugcagacucaccuguccaguugcuuggcagcuugccaagcagcugcuccucgacaccaugaugaugggcacagaccaguuuugccugcccagggggucucauuauuaaugucuucaauagugcuaaagccaccugguguuagucaccuugucugcugccucucugcuccugagcaccugcuuucucgucaggagacagacccacacgugugguguggagugcucugcgaacaggcacgccugagcgggacagagggaggaugccuacacaaagggguagucugagcuagucaccuuaaggaguaagcuacuaugccccacugcucugggagguuuuuaauuuuuuuuuaauauauguguaugaauguuuugcuugcauguuugucugugcacagcaugugggccucauauccacagaggccaauagagggccucagauccucugcaaacauguagaugcuggaagccaaacccagguucuuucaauagcagccaguacucuuagcugcuaagccuccugggaagauuuuugguuuuguuuuuuaaccauuuuuucuucccuuucuuucuuucuuucuuucuuucuuucuuucucucuuuacccccuccauuaauugauuuauuuauucacuuugcacccugaucgcagcccccuccuuguaggugcccucacacagccccuccccuauucccuucucucccuucuuuacuguccuugggacuucaagcaagugcuguccacuuccccagcccagaauuucuauuuaagagugaccauucagggugauauaaaagggauauaaaagguagucuaagaggagagagaugagcuaaucugacgucaccccuccuuuuggcaguugauagugggaggccuggaggcagcucagccugccuaucugcacauucacauucgugccuuccccacuucuccucagcccuguagucuuccuagauccccauacccucccgacucccaaguccuguucacuucccgaggccuccccuggcucagccucccucugcaucugacucuccaggcugcucugccugguucucaguggagacugccugguacgcucaacugcuggcucagcuuagccacacaggauugaccauucagcaagaagaaaggaggagcaccuugaaguggcuuaggugacucuuacaguggcucagaggggacuugggguuugggucagaacucauccaguuugagacuccuaagaguaagaagucuuugaauuuuuuuguuucugcuuuuuauguucuuauuauggaaaguuucaggcaucugcaugagcagggaagacaggcuauggcauggccgagcaucugauccagcuggucucauguggcccagccugcuccccucauccucccucccaccuacauuauuuggaggcaaauuucaggugucauguaauuuuacccgcagauuuuaccuguguuuaaaagcaugggcuuuucaucugaggucuucucucagagccccagguucucaccucugggcuuggcuuugagagcauuuccagagguggggggcacucccugaauguuggcagcaccguccugugggcuggguccucagacugaauaaggcagaaggaccuggaggguaagugaccaaucgucaccccacgcuugugcugccacaggggaguugugcuucccaccugaccaaaugauaagaguauuaaguugugagucaaaaggaaccuuucuuuuccuuguugcugaggucaggcaucuugcuacaucaacaaggcuaguagcuagcacuucccaucccaggcugggaguagagcuggcccagccuuugggauucuggcggccagcuuguugccucaguuugcagcaggcucugcuguggcauaaagaagcauaacuguggagcaguggaugugccucagugugcuuaacauuuguaaggcuccgggcuccuuuccaaaccaaaccaaaccuucagagcagaugagggcaagucccguuuucaacccugacauuuagcaguacuaccaauacucagucuuuuggaacaugguaccuuagucugugaaccugggcacauaaccacuccaugacaguguuacaguaagauuucagugaacaguguauacauuggcacacaauaagcucugaaugccuguaugucauuucugagucucuuagcagcccugcacaguuguugcuacccauaauuuauaugugaaaugacugaagcauaaagccaaggugaacgaacaggccugaggccuuggggcuaauaaauugcaaagccaggcaugugagccuaggucugacugaccuggggucccaggccuuuauuacugcuguuauuuauugaaccuuguggcuuggucuugugagaaagaacaugcugaucuugggucgggcaaacaggauggucuagcccuugccuagaucugcuguuuuaaguuugugcugauucguuacaagccugggauuccagggacaaauuuuucuuaugacuccucccaccucgucuccuuucuucaugcugucuuucauuuuaggagcuuguuggacucacuagcaccugaaauggggagaaguaaagagagcaaaaugcagaagaaaagccaaaugcaaaaacuuuacaucgguuuuuccuuugcuguuuuuaaggaaagagggcagaacuaauguaauucugcuuucucuucagucuagguugugagggauugccagugauuuuccauucacauuauaaaauggcuagggauggggaacgugaagaugauuccacagaagcaggucgcaccugcuaugcuggauuucguguucugcuacacugcuucuuguagugggcggcuuagggacccacagggagcugcaagaacuagcuauggcuguagccugcugccuuagacggccuguccuggaaggucugguuuacuguggacgauucuguuggcuuuuccugugugcaucauucucagagagcugugagguucguaguuauauaaacagggaugcugcuaagcaguuaagagaguuguagccaguucucuuccugugccuuauaggagcuucuggaacuugcucuucaguugcguccugaccgucuuagaagaacagagcagcagaguuggaauagggcagggaugcucuccccaaggugcccaggcacaguaggcuugcuucugaaauggcuuuuaucugacuguuaauugcagagauggccuccucugugccuuugauguuauucuggacagccauugucaaugguacagcauuugcccaauaaggcagaggaacagacuuaagucaaagacugugaaucccaacggugcaacucucacaaguguaacuuacaaguuccauggcagagccucccuuuuggguagaaacacaaaaccggugccucacugcaagaugacagccuggcuuucuugggacccggccaagcaaacaauuugagaugaccccacacuuaaccagcuaauuccuugggcugcaauccaaaaucauuauggaauacuguuaaaauuguucccucugaaacccucgggcuauuuauuugaauuagugagguuacuccaaugacagccgaggagaccagucuguaauuaggagacgcugccuugaacuucacaagaauggcccuucucagcguugugagugccuuucuccuggaggccuucccgccuuaccuuacuuuugccccuuguuccaugucauggcucaguuucuucaugcauccgucuucccuguuugguaagcagagaguucucgcucccugaguauggugacuggucugagauccgggcucugucucuuacuaggaggauggacuuuuagggaaguuaccucuuuuuccuggaucuuguuucucauuuauaaaaugggucuaauauuuacuugagaggggucauaaagcuauucguugaaagcuuuuauuguuugucaguuacuuuguauaacacauguaagcuuaccucaucuaaguaauagcugccucaaaugagauuccuugguuuaaaauugguuuauuuuuaugugugaguauuuuuccugacuguauauguauguaccacaugcauacucauuauccuugggaaucagagguggguguuggauccucuggaacuguagcaugagcaccagguagaugcuaggaauugaaccccagccgucugagagagcaguaugugcucuuaacugcggaaccuucucucccacuggaaagucuucauuuuuauacauuguuauuauuauuauuauuauuauuuuaccuucagcuggucucaaauucacuguccuccauccuuggcccucugaauguugguuccuucccagcuccaugucuuacagguuuuacuuuaauuuuccuuugagaauauuggauauaucaaucuuaaguucaaaucuggauuaauuuuucaaacuuuauauuacauaaaaaauuaacuauaugcacaaauaaggagucuacucuaacaguccucugcaugaguggagcccugugccccugaaagaggcucaccaucucuaauaugacacguuggauuuuacuaaucuguuuuuguuuuuagcuuuuuguuucauuauuuuuguuuuuguauuuugagacagauacucuguguagccuuggauguccuggaacucacacuauagaccaggcuggucuagaacucagagaucugccugccucugccuccucagugcugggaucaaaggugugugccacgacugccuggcuuugcuaaucuguucauuuguuccuuuucucuguccauauuagagucuuugaaauuauaauuauaacauuucucccuucccuuuccucccccacucguauuauuucugaguaaguuucccagucauauuauuuagccauguauuuuaauagguagcucuaaaaaugacuuauuuuuacugugggaucaaaucuagggccucauaauacuaggcaaacacucuacuacuuagcugcaguccaggcuggaguaguaauaaauaauaauaauaaugucauaauuucaccuuaaaaauuaacugaagguccccauggggagagggcuuagugguuaagaguacuuguggcucuuccagaggacuuaaguucaaucccagcaugaacaucaggcaacuccagggaauccaacaccuucuucuggccucugacagugcccacauacauguggcccucacacacagacacacaggcacaugcacacacaugcauguacacacacaaaaacacacacaaauacaaagaaagucuuuauuugauuuuugagacaggaucucucugucuggaacugguuguccuagaacucacuauguagaccagguuugccuaaaacuuacaguaaucccacugccucugccucucaaugcuaaaauuaaaggugugugcaaccacaccugacugauaaaagauuaaguauuuuaaaaguuuaacagaaguuuucuacucuuguauauucaguuagguucagaguucuaguugccuuauaacgucaccuauguuaguuuggcugggguguacugagguucaauauuaguuuauugaugugucuccucgcucuugauuuguuggcccuuugucuaagugauuuuaauuauaauuuaccuacugaagaaacuaggacauuuguccugaaguguuugccacagucuagaauuugcuuuauucucugucucuguuucugucucucuaucucuuuaucucucugccucucugucucuccucucucucuauuucucuggcuccaccuccuaauccucucuuguuucugucucuccucuggugguguuggcagugcacagagguggaggucacaggaugaguuugaggagucaaucucuccuuccucuuuacuuggguuuagggaucagucaggcuggguggcaagugcuuuaucaacucaccaggccuuuuuuuaaaaauuaacuccagacuuugcugaucauauuuccaggaugucauucagcaugcucaccuuucccucuguccuccauauuuugugcaaguuggaaguugaauguagagguuguagauuuauuuucagggguuuuguuucauuugaaacggggucucccauagcucagacuggucugaauagaggauggcuuugaacucugauccucuugucucagcacucugaguacugggauuacaggugcuaccaggucuggcuuugggcccagauuuuggcaaaaacuauuucagagguugaaucauuuucucucaggaagcucuuaauguuggguugccuuucaguuugaagugucaacagccagccauugguggucagugccuacauaugcucauugacagggauuguaaaauggcgucugucuuaguuacuguucugccacugugaaaagacaccaugaccaaggcaacuucugagagaaagcauuuaauugggggcuuacuuccagcuucagcggguuaguccauuaucaucaugacaggaaacaugguggcaugguggcguggugcugaagaaguagcuuagagcuuuuacauccagaucugcaggcugcaggcagagagaaagagacacugggccuggaguggauuuuugaaaccuccgaguccaccgcagugucacaccuccuccagcauggcuccaccuccuaauccuucccaaacauuucaucaacucaggaucaaacauucaaguauaugggccucugggggccauucucagucaaaccaccacaguuucuaaguugaacuuaauuauucugagggccuguuucucaugguaccuauccuugagcuaagcaccagaaaaucucaguaaguaccaguaauaaagaauguuacucagcugcaguacaucugacaaguagaguacuugucuagugggccaggacccggguucugucucucacagcacaagaugaugaugaugacaacgauaaaaauaaugacaagaacaacaaaucccaaaugguaauuagagaaugcuugcccuucauuagacuuguucacugauuggguacugugaaugguucucccuggaaaagggaugaagucaugccuuagaucugugcccuuuccguuacucagaaguccaagcuuuaguuguagauuugacauuggcuugugcccugauaugaggagcacugaaggaugucaggcagccuggaugcaucuuguagcugccacugugcaggaggugaggaggagaggccuugagcuugagaauucucuccagcuguccaagcaaaccgacagcuuuuugucuggaauuagucucagcaccaaagugaacaaugcuagagagggaccuucagaccagauaagguugccucacugcaaguccugggaaagggcuagcucagauggaagcugcauaccaggagacuagcugcuuaccaagaccuuaaugugacuguuuucauccuguuacugagaaacuguguuauagcucauaagcaaaggguucuggccuggaagccaggcagagaagggugcaugcuuguguguguguguguguguguguguguguguguguguguguguugaauauguguauguaugugugugugaaaguauguguguguguauauauauguguguguuuguguguguauugggaguagucacauaauuucucugggucucaucuuccugugugagaaaagugacaguaaaaaguuucuaccuuagucuucugguaaagauuacauaaaguaagagaugagacauguaggaauuuaaagaauuuagucaaggaggcuagagagauagcuuagccauuacuucuggcucuacagacacaugugcugucuauauacacagacacauucaauauacauaaagaaaaaggaggauuguuuaaaaagauccagucauggucuguugauguugauuuauggcuccugaaauuugucccuguguguuuauguguguaggcaugaaaguggagucuggagaggucugcagcguccugagucccaugaucucuucuggacuacacuaucacauuuugaaugucugucuuagccuucuuuguugccucuccuguuagucauuuauugcauagagcaugcuagucagggacaggauuguugucagcccaaugaggaaugcagcuucgggcugcuccagugaaaucaaagaccccagugucucagagguagaagugcaauggguugccaagggcagcaucaucccuucuagggcauucugccagguggcuuccagcccagcuuuguguauuccagggaugagagcugcucacugcccacagcacacccccuacugcucucuucucaagagaggggcuuucguaauuuuaucugaagccugucuccucauuucacucugccagcgguuggugcucuucccuuuguacugugagcaugaaggacagcagaggggagugcucuugacaguguagcuggagcaagccucccagagccgaccugcaguguagugaagccuagccaaccauguggcacucacugccuuugugugaagucagcagcagagacguuucugaacguggcagaaaggagugcaguuaucuauuaaacagugucagauucaggagggcuggugugacaugcaggaggcuauugcaggagcucugcagccuuccuacugccccucaccgaauagcucucucugauguccuuuguuaagucccugcaugggaacacugcauuauuuagugccauuuauccuggcucuuucucauucccacaguccacaggaagagacuguaacauaugggcugugugucaguacugggcagucugucagccuuagaaagcuguuagggagccgagggcugcuaaugucaguggguaguucagagccuuaagacauagaguucuuaaucaccaggaaggacucuccccuguaaugacacagacaagcaggaaagaaccuucgcuucaucuggcugggugcacuugcacccauccauacuuaccggaucccccugaucugagcacggggcgaccagaugugaagcgcugaaugcagcaguauauucaucaggguggauauuaaugcccugggcuuccguuuccauuucuuaacaaagauagaaguaaaacuguucuuauaguagagugguuaguacggacaugcauuugcuuugggaugagaagucauguugaaugacccguguugggcagcccgauuacucugaaagcagcucucucucuuauucuuuaaagcucuaaggacaaagagucucugccuuccuuuuugccccuuggcuuuuguuacaaaugauguaggacagggagcugacaaggacaucaugggaggucagagcaauucugacuccucacaguagggggcaacuuuagacaaaauggaagauuugaggaguugagacccccaccugacuccuauuuauuuacuuauauuuuuaagaugggguuucccuuguagcucuggcuguccuggaacuugcucuguagaccaggcuggcucaaacucagagaucugccugccucugucuccccacuugugugccaccaccaccuggguggacucuuuuuuuuugagacaagguuucacuguguagccuguagcccugauaaccuauauauaugagauauauauaugagagauaguauauauguuuugaauauauauguuugaauauauauguuuuauucuuugggaauuucauauauauauauauauguauauauauauauauauauauauauauauauauauauauauauauauacauacacacacacacaugcacaaacacacacauauauaugugugugugucacaaacugucacaguccaguuugugcugcccauacagucauggguguggacagucauggguguggacagucauggauguggggccauccacuggaacacugagaaaaggccacacccuuagaagaagugacucucccucucacugccauucucugucaguagcucuucagccaggggugggggcuuguugggagcacccccauggugaaaaguugugcaugucuuaugcaagcagcugugacuacuguguuugugggugcagcugccaugccaugagcagaagacacugcuuugacccagccuuccccaacugguagcugguacagucuucuccccugacucuggguucuugaaccucaaaacuugaaaguaugaagaaauauagagaaguaaagaaaauaucauuccucuacuuccuguagcuauuccuguaaauaccuugaccuguguauugcauuguuacugcauuuuuaguuauggagaugacguuauagauggugugugcccugucuagucccccuuuaacacguagugagcauuuucuagugagaaagcagcauauaaauacuauuuugcuuucucuuuuugccucucuuagaaucgaacacagaacuuugcaugugcuaggcacacaccuuuugaggucuggcccuuguccugaguaucauuugacaugacuuuauaauguguggucauuacugucaccuuaguguuagguaucuugaucguuuguuucuuuuuuguccauguugcuaugacaacugaugcaguaaccagcaucucagguccuaaaccuuuucuuaguuuuagauuauuugcuuacaauaaauucuuucaaguggaauuacccgguugagagacauagcauuuguuuauuuucuuacuauuugcuuauagacagggucucuguguaacucaggcuggccucagccuccuuaguacugggauuacaggugugcacuaccacucucagcuaauagacccaguuuuauuaaaacuugauuauuuaaauuuggaaacaggaugcugccuuuuugaaaacaggaugccgacaugucguuuaggcgucccuugaacuugcaaccuuccucuucagcuucccaaguggcagccuggccacugugugcaguauacuaaacugguaagguuuugcucucgggggcuggggguggggguggggaucaaguugcuuuaauauuugcucagccuuuacuggcacccagccuagucugcccuaggcuagagugggucgguaguauauagagaaggcugagaaagacuuuccacaguuuguagacacauuccaaagauguuaaauguuaaccaggcuggaagcagaugaggacuguugcagauaugcauauagaagggcagcaaggagcagauagggccuguggauggagcagccucacaguaauaguggggaaucagagaggcucugugcaggccaauaacguggccagauuugugaucuggaaaggucgcucuagcaguaaagaagguggacuggccacgguggaaaggaugucuuuccuccugagagaccgguuaggacuauccucgacaggcugcacuaacagggaauccggcgcuucagacuugucucuuuguuagggaaaaguauguuucacuuacauuucuauuucuucaauuucugcugagguuggauagucucaugucgauuugccauacuguuugcuugugugggucuugccuccaaugaccuaaaugcucuuuauauagaaggacucuugucccaggcuauagacauggugguauccuauguauaguucaguuuuaugucagaguucauagacuuccaggagaagcaggugacugguccugagguuccggggcacauccuccucugcccucucuggcccucuaagcucccuccuaaagcaccaugacucaccaagcuuguugcuaaccggaaagagcuuguuaggagggaaaaauagagaagaucacuuuucugucauucagguuuggaaugugucacucagggugugucaaacccugaccccucaguuaacuggggggggggggcuuacugauaagggguaguuuuguuacagaugaagaucaguuaaggcuguagcugugaguagguuacaagcuuuuggcuaccuucccacaccugacucccugcucagcugccauuccaccguuaacagcauccacuuguggaucuugccuaucaauauaauuaggaguuugcaguccaugacuuacugaggugacuucaggcaggggcuugcugagacuauacuaauuggaaacuuuucuugguguugagauuuacuuguuuuuauuuuaugacuauagauguuuugccugcauguuugucugugcaccacauauguguagugcccacacaggccagaagagggcacuagauccucuauaacauaugguuguuagcuaccauguuggcacugggaauugaaucccagcccucugcaagagcagcuagugcuaacaggcaccaggcagucaucccuccuaucccuagaaaacuuuucuuaaguuggcugcuugccaugcuuugggguuuugugcauuuuggcuucucucagaggcuuuauauguaaugcauggaguguccugaguuccacccuaauugcugugugcaggguaguuuggcagcugagugcaauacaguggcugaguaauaaauccacuggccuuuacagcacguccaucagcaaaccacagggaccuugagccuguguuuuauucuggauuguuucuccuuguuaaaucaccguuguuucagaugucaaaacauugccaucauagucagcagccuugccgugcuguccuacauacauaaucacacacuugcuuuggcugcagcccuuuuuugcuguauaauuguacacaaaggccagaugugagcuauggcguagagguggaugaacugacccaccaaaggccuucuaaaaacuauccuguuauucuugaugacuagauagcauuaguaauuaaaaaaauucucuguguguaaauaaaauaaaaugggugcuggagugauggcucccagagguccugggucugauucccagaaucaacagagcagcucacagcucuauguaacucaguuccaguggauucgauacccucuucuggccuccuuggguacugcaugcgcaugcuacacagacaucugaguagggaaaaauccauacacauaaaauaauaaaauaaaauuuaaaauuacggauauaucuuaaaaugaaaguuuuaucucuuuugagaugaaguuuuauuaccuuuccuaguucgucucugguucuuugcucaaauaaucuuccuaccugggaucccuauagcuaagcuuacagaugccuguguaucgaucaaagaaaucgucuuuuuguuagaaauugccccuccucauacacccaaaccaaaacagaugacuggagagauggcucaggguugagaguguucauuguucuuccaggggaccuagguucugucccuagcacucacauggcagcucacaaccgucugugacccaggggacccaguacuccuuuucuggccuccaugggcaccaggcaugcacaugguacacauacauacaguaguuauauauacauacacauaaaaauaaaauaaaauaaucuuuuuuuuucuuaaguaaaagaaagagccaggcguaaguugccuguuuuagccuaagguuuuagagguugugggguugccuucccgggggggugggaggagggcguuucgucugcacagguuucgucugcacagguauaccuuucacauguuaaacucugugaacuauuuuuuauuuccacgcacagcugccugcucuggcuucaccacuucccugucccugacucagucgucauccgcacagugacccuuguguucuagguagggggucagucaccuugugggugaugcuguuguccccaucagccucauguuuuugggcccagggcacaucccuggguuuugauuucuaaaacgagcugauaauuucccacaucccauuauugucucccaucugcagccagcccuccgugagguguggcuguaacaacagguuaaguuuucuagagaagggaaagaagaucagaguaaauauucaugaguuacuucgaauugcagcugcacugagcugaacucucaaggcauguagaaaccucuguguaaguuugccaguaauucccaaaaagcugcuuaagggggcaccagaaucuccugaagaguuucuuuaaaaugugcacgaagccaggauugauggagagggcgcaccauagagaauguagccuuucucuguaaugaaagugaaacugcucagcagguacccaguuacuguuccucauuuauuccauaccgcccuaguuuucuuucuacugcagagaccacagaggaaggcuacuuacuggcuugcuuccucuggcuugcucagcuguucuuuuuauauguagcacugcccuagugggcugggcccucucauauuaauuagcaaucaagaaaaugucccagagacguguaccacagaaugcccacaggucaguugugaugggggcaaccucaguuaagacuccuucaacccagguggcucuagugugugucaggcccuaaccagugcacugauagaaccuugguucuguuuggaguggcuuugcccagcuaagauacuaccuucucuggcucccuuguagcuaggaguggccaccuauaaacucuggccuguaagcugaagacuccuaggggagcacuccuucauaaguggacacuccccagccuuuguacccucucccuuccuguuucaugggcuuucagguagcagccacugucuuguaaccucaaguagaugaugacagucacauaguucucaagucacuguaccuucaugcuaccugcuucaagauuucuucuuguuccacgagaaaaauaaacccccaucugcuuaagcaaauguugguuuuuaauugcuugcagcugaaugcaaucauaacugauaagguaauguuuuaauauuuuacaagggagaaauauauuuacauauuguguaauuaaaaaugaaaaauaauuuaaauccccacagauuucugugccccacaucagaugcacugaaauagaaucuuugggcucaggaugcacauaucuacauuuuaaacaaacucugcaggcgauucugguauacaaggaaauggcagaaucauuuucauccuuguuaauauugugagucccauuuuacagaugagauacugaaucaagggaauaaagcuccaugccuauauccaggucaaugcacacauacguguguaugcuuggaguaaagggcuuagggugaaacccaggguccugggaugccaggcaugcaugcugcuacugaggugcaccccuugugcccaguaucccaguaaccccuaagugagguuugacucuggaccuaucuuguuccaaaauauauaccuccucacuuccuuacccaaggaaaccuagcugcucagcauagucaaaccguuucugaagggauccucuaaaguggaagguccugucuccguauaauaggcugcuagcacuguccagggaccgcaucacugcccuggcugaccugggaaugagugcugccuguucucaugaguucuugguuuuccuuucuacuuuugaaacaaaaauguauugaaauuucauuuucuccauagguuuucuuggguuagaaaugacuuagaaaugauuauaagucuuauccagguaagguaaguaggguaauuguagucuuuaaaaguguagaaagcauagagcccguaauuaguacgcacaguguucauauuagaccugaccggccauugaggagugauagauuuuuaauuaauuaauuaaaucuuguuucucuguguaguccuggcuguccuggaacucacucuguagaccuggcuggccuugaacuuucuccugcuucugccuucccaguguugggguuaaagaugugugccacaacaccuggcuuacagucauucauauaucauggauuaauaaaugaacaguaaaguacauauuagguucagguagauauguaugcauuugaggucagccuagucuauauagugaguuccaagucagccaaggcuucauagugacacugucucgaaaacaaaacaaaauaacuauaauuccaggcucauggucaucuuugcuuuauuuucauuggaaguaaaugauuauuaaaaaaacagaacaaacaaacaaacaaaaaaccuuaaguuucccccccccuuuuuuuuuuugacuuguaccaucacagagagaggcagggaggguggcccagggcagugaggcagcaacacuugccacagaaaguuuuccuggcacguugaggagcuccuugcaagagaauacugagagggcuauuaucucagacaagugauggaauuaguuggugcaggcccgcaugagcccuugaguauuguuggcagggucugguggguauugcuggcaggaggaggugcuccugucuuuuucuuccccugccaaguguguaguuguguugcuauagaugccuggauuccccuuuucaucacucuugcaagucuuugauuugcugguucccuagcaccaccucaaccaauuuggggugggaguuguuagaaaaaugagcuaaauaaagcuuaugcguucacaggucuggugcauugaagguagcucagcagaaugacugccugauggguagcauauaacagccuugucuucuagggccuugagaagaacagcaugggcucagaucagagcauccaagugagacccacucuccugccuucccugaauacaggcauggagucagggcagcucucugugcugggggucuucacaaaugcacagaacuaagcuuuuccuagagagcugcugcacaucaagguaacaacuucaccuuaggccuggccacugucuugcuauucgugagcauccauauuauuuuuaacauuccuguuaguagcuaccgugguuugguuugagugaagaaccuguugagaagguguguagaauugugugugagagcuuuucuagaaaagucuaccagauucucagacaucuuauuuaagaagaguuaaacaaagugcuggucuguauaccgggcacugucuauggggauccaaggagcucuggcccuggccagagcagccaaagaguugcagcucucugagaggaagccagagcaaggcaggcugcagggccucuuccacagcugcugcugugaaguugauggcagucaggugucgugucaggaugcaguaggcaacuaggggcaaagguuggagcuacggaggaggaaguggcugccguaggcuccagcacucugcugguugggucagguuaagauccagaugaaagauucaagagagaacccucuucccuggaguguuacagcucgaucgguaagacaggcacucagacaaucuuuggugaaauaacuugugcaccuuauuccuugaggauagggccuuauaaacguguugggguggggugggaucuagaggcagaugcuuucuauugccuuggucugagaugucagggaugccuuaucugcauggggaaggacugcagguguugucccuaagagacugauuguaacaguccucuccguggggugucauggucacauguuucagaacaggaaccugguugaggguagauuuaaugccuaccguucucaauuaugaaaauugcuggagcuccugaauccacuugaccuuaccagauuuccugucuaguggcacgguccccugccccacacugcugcucugaacaguggcuaucugaauuucuuucuggcauccuaaaauaucagcccucuccucaagccuguuacucaaagcaccuguaggcaggagggauggggcggcaucuggguagcuaagaacaggugauaccccaccggaaggcccuggacugucccugcuguugcccucaggagccccugaagcuccagugugaucuaacacccucccugcacagagcuaggaguggccaugguccuggcugcccuccugcccuuacuucucaccacagugucgggcugaggggaggccuguuccccagcuguaccuggggaguuaaguaucaggagccacagcagugagacucauuugcuugcgggucuggacaggaagucugccuggcuuuguguugcccacagugcaggcagcacuuugugaaucagaacuggaggcauuguucucugauuaccaccaaggaaugcuuuuccugaaugguuccugugggugugaguagcucugaaggaagaauucccugagacauuucagacaguagcuauuuauguucuacucuuuuggucagacaucacugacuaccugcugugugcagguagaacucgcugucuaucagggaaggcaagucuguggaaagacauuauuuaagccauagagaguaagcgagcccaucauagggaucccagaggggcacaauuaauucugcaagugcacuuguggggguggccucccucacuaauaggaggccaccgaagcuguguguuaaagggaggauguggcuucugcagucuccugugagccuucccauuauggaggcaugcauuuuuaccuuguuauuaguaugcacauaauauuuugugcugcugccuuucugcuuagcauuccacugcucauuuccacuuagcaacuaggccaaaguauuuaucauuuuuaaaagcuacauagcauucuugccuuguugauguacccucauugcauagcuguccucucauuuguugggaagagcaguuuuucucaaugaugcaugcuugcaguuggcgcuucuucuccccgcuuccuuccuuccuuccucaggcaucuauggccaggcuaaaguuaugaauggccuuaugcuuucuccuuggcuuuuuucuuuuucuuauggaaaguuccaaacacacaaaaaagggaaaugaugauuauaacgauccccacguauuacucauugagccucaauaauaaucaguccaugguuauuaccacaccaaaaauaaauuagucgugacucuucauuuucuaugguauuaaaaauggaagcaggguccucaucuccacuaagcuguagcuccagucuauuguaauugauuccuaagugggaauaccuggucauccaaaugaaagcugacgguuucccagugcugcuuuggucacuuucaugaagccaaauugcuuuuuguuccaguguauucuccagagaaguuuugcuugaccugucaguuagugauugggaauguuuuuaucaagaaaggaucugccugccuacagggccuggccuccaaaggaguggaagggagggggaggaggaggacugguaccguucuucacuuccaugggaaacucggcuguaucacccuucucacauacgugaacugucagugugugggggugacacggugucaggcucuccccaugagcccacccuguuaaagcaaacaucgucaugcugucauuuccagcaccgagaaagaaaagcuacauggcauuaacuuucuuuuucuacaguaaaaucuccuaagcuaggaagaugcucacuccccacugcauuuggucauucuguuugcaugucucccuuggcaagcuuuguucuguauuguucaaggugacccaguuagaacuacuguuuaaagucaugcuggccucaguaaguuacacaaccugugugggauucagucuacuagcucugcauaguguacaaggaagugcauggagucucuuaauauuuuaagguggccacauuauaaucucuccuauuuguucuguguugauauuccugauuuuuuuuuuucgugaugguggauaggaacaaacagcuuccuaaaugauucacaacccugcuguauuugucaucacagacugaaucucaguuugggccucuuggauuaaccaauacuuagccagcuccuggguggccuccucugggauuaggaauguuaacagggaggcugggccaggugaugugccuuugagagacugggagucuuggguaggcagcucuccuuagagaagagucaauacauucaguaagauugcucgugcucaguccagccuagagccuauuccuuacuguuucuuucuucuuuuuucuucuucuucuucuucuucuuuuuuuuuuuuuuuuuucccuucgaggacuuuauauucuuucaaugcauaaaaaucaaaaaaccaguucagcuucuaggaauaucauaaauguaagaagguacugcuaccaccauucaauauaacugguauaaauuaguuuuuuugguuuuuguuguuguuuugguuuuuuguuuuuguuuuuguuuuguuuuguuuuuguuuuucgagacaggguuucucuggauggcccuggcuguccuggaacucacuuuguagaccaggcuggccucgaacucagaaauucgccugccuuugccucccaagugcugggcuuaaaggcaugcaccaccacgcccagcccuaaauuaguuuuuuguuccuucaucugccuugcuauuucugguagaaaaguuaaaugacuguuuuuucacaugaagugcuaugucacuaccaaauauguauauuguguaucucucacucccccaguaguacuagccagacauuuuccauauacauccuuuuaaaaguuaguuuagacuguguuucuuuccauuauuacauaauauuucucucugguuuuuauagcuacuuauaauggcuauauacuauccaacugagggcccauacauaguuuauauagccauuaguuuucuguuugagaaguuuuuaaaauauauuuauuauuuuauguguaugugugcacuugaguguaugcaugugaacuacaugagugcagugcccacagaggccagagaggguuggguucccugaaccuggaugcacaugguugugagucacccaauaugggugcugggaaccaaagaguauuaaauaauaauacuuuaauuauguucccaguaguuuuuguuuucuuuucaaucgcuuuauacuaaaauauaauucuuauucacuuucuuaaaguauacagcugagugaguuuguauacccugucuacccugaguugugcgaucaugacuguacucagcgagaacagccccaucaucccacaggcauuagcgcccacugcccacucuucccagcucaccguccuaagcaacuggugaguguucucuaccugugauuaugaaauuaaaacugaagcuggguguggugacacauccuucaauccuagcacucaggaggauaaaagugcuugugggggccagaagagcaacuaaagcuaaaggccccuggaacuagagcuauaagugguggugaacccucugcuguggauacugggaaccgaaucugaguccucugccagagcgaaaugaucuuaacugaugaacagucucccaaacccauuuuagccauuuuuguggcguuaagcaaauuuauauucuugugcaaccacuaccaccauacgauuucauaacuccuccaucuuucuggauuuacuacugucuuuuccauccacuucagggcccugguaaccagcauucccuguuccucuggucugacaagccuaccuacuccucauaauuucauucacacaauauuugucuuuuuguggcucguucaugucacuuagcacaaugcccgcaagguucugcauguuguggcacaaaucagaaugccauuccuuuugggggcagagugucacuauguagccuaagauggucugaagcucugaguguuccugugccaaccucugagugcugggauuacgggugugcaacgucacaccuggcuucuuagugcugagugagagucuucugcauucaugcacuguauuugucucugcucugcccgugcugugaccagcuggauuuauacuuucuggcaauuaugacuaaggcuacugucuuaguuagacuuacuauugcagugauaaaacaccaugaccaaaagcuagaugggggaaagaaagaguuuauuuagaacuuaugcuuccacaucaguguucauaaucaaaggaagucagggcaggaauucaaguagggcaggaaccuagaagcaggagcuguuguagaagucauagaaggguguugcuuacuggcucgcuccccaugacuuccucagccugcuuucuuauggaacccaggaucaccugcccauggauggccccacccacaaagggcuguguccucccccaucagucacuaauuaaagaaaugcccuacagcaaugucguauggaaacauucugucaguugaguuuccaucucagaugauucuagccuguguuaagaugacauaaaauugaccacccugaacacugagcacauuuauguauagaaaacgccuucauuucccuugggugcccuguuaugaauaggauuguaguauugugcauugcuuuuuccuuuaguguauuuguuucuguuuugagucuuuuuuaauuuaauuuuauuuuauuuuugguuuuucaagacaggguuucucuguauagcccuggcuguccugaaacucacuuuguagaccaggcuggccucgaacucagaaaucugccugccucugucucccgagugcugggauuaaaggcgugugccaccacacucaacucuguuuugagucuuaaagggguuauuauuaggucaaagaauaagagccuguuauggcuucagaaauauuuuuauguauuaauuuuuaaaaagcucaccuccuuuucugggauacccuuugauacuuguugcccagauuauuuuuccagaguuauaaaugcauguuaccuugacaaaaacaugacaugguucacugugaccuucguagaaguaggcaguguucuguucaagauacauguuuaguuucauuguuuugacuuggacgucuuuuauuauugacaccuugaccuuaaugaauaacaucugagcuacuauuggcaucuucccccagguggguugcuuuugaugaugccacgggugccuuuggguacugcagaugcuguggugguagcaaggugcuuuucugcacacaguuuugaaggacagcccuguaggaguuaguugagcucucuaccacagugagcaggagcuccgguaaccucuggaaggcuucuccuggcugggaauuucauaaugguucuuugaggcagaaagcaagucuuccuuuucaguuuuguucagggugaugcuuguggucccuggcucccucacagagcugguugcucccuggccagcagggcacaguuaaggcuucuuugccccucccuggagucugggucacuaccaugcuuuuccacuggaggcugcacugaaagaaagccuuggagacaucaaggccuuuuucucuugaauccaucuuuccauaaauccagccccuaaauacacauaacgugugguucauaggagcucaguugcugggcacuugucuaagacacucaaugccuuggcuuuaaucccccccaaaucaacuuguauucauaaccucuguaauggcccaaaaguugauauaucuucaucggauggaguguuugggguaaaggagcaaugugugcuugacuggcuuguaacacacacacagcacacagagcacugucauacacacacagcacugucauacacacacacacagcacacacacagcacaccacacacacacacagcacugucauacacacacagcacacacacacacagcacugucauacacauacagcacacacacacacagcacugucauacacacacacacacagcacacacacacacacacagcacacuacacacacagcacacacacagagcacugucauacacacacagcacacacacacagcacugucauacacacacagcacugucauacacacacucacagcacacagcacugucauacacacacauacacagcacacacacacagcacaccacacacacacagcacugucauacauauacacacacacagcacacacacacagcacugucauacacacacacacacacacagcacaccacacacacagcacacagcacacagcacaccacacagcacuguuauacacacacacacacacacacacacacacaccaugugguucacccuauuuauuauuuauuaucauuuuuacgcccuaccauauuccuuguuucauguuuguaucacuaguucccuuaguguacucugaggagauuuuuuucuguuaugcacaccuuucaacgauuaaacuggguuagcgaguguaugaaauguucccugcaucucaaugagcccagcugcuuccaugucugucagauuaaaaaccaugccuucgaccaguuugcuguccuggguccuuacuucauuaagcaguuaugaugaacuguccuugcuucuauaccuguccugaaagguacaaaaguauugucacgaggcauuuguaccccccuuuuuugacuaucaggaauaugaaccuagaggaagaaaaggccuccuuugccaguuagaagaaccuggcacucaggaagagauuucacacagcccugauaacuugucagaccacucugcagaaaauaaaccaagacacagugggcaagcucacaccuuaguaaggccugcuuagcuaggcauaccuacugcucucuauuugaaccuaaacucauguuaggacuguguagauggacuugaggggcagcgugggccucucgugguuccuuuugccaguguggccacauugaauacaucuccuuucuuugcuuuucccuaguauuuaucucugcaauuggccucuugagggucccuagaagagccuggcuugguagagcuacugagacccagcuccuaacuccaguaacagcacuuccugcccacagccccccaagcuguucccagagugauuugucaacagggaccccuauuuuaaaagccccagacugcagaaagcgagagaacucuuacaaguuagccuccacucucuaacagcucuguucucccugcccccacccccacuccuccauccuccucauccuccgaguucugcucuucuaccuuguuuguacccccucucccucugucaucauugcuaaucauucuucauucuuuggacugucagguuaagagcgcaccucuuggcuaacauuuguuccugguguccuagcucucugcuuguaagucugugaucuggcuaaacucccugaggcaaagguucugucuugacuugcuauucccaucacagucuaacacaugacccacagugggaugucccccacccccaacaccaagguaucugcuaggcuucagccagagcucuaccugaacacugagucccaggagacuuuuauuuucucagucaacaggagagagcagccuguuuggcuaggauaagcgaucaaccuccucccagccugcuggcuucuucaggggccccuucuccuggugguagcugguagcuguggugauggccaccauauguuugcaucccagcccucccuagcuccuuucuguacucauuuacuccacacauagcguauuccauugaguacaaagaaaggaauacaucagacuagugacucugcaccuggagaacacaccccacaugcauuuuaaaucuguggauuccccuuaagggaauuccaguuaaaaaagaacuugggucagcagccuugggccuguguggcuaacaagcuccuauuuucucuguuguugggcuggccugaagggcuucuuuguuuggguagggguggaugugaugcccuaaugaggcccuguggaauccuggcucauacacagcagccugcgggguggaacucuccaggcaggaaagcaaguuggugaguuuguggguuugucagauuuuaaagaacacagaacaguguuaaaggggugaaaacuaacuggaguauuguauucuugguuggauucagcacaaaaauacagagcaaaggcugaaggaaugugaguagugucuggaguuuagcuaauaguacuacacuguguuccguguuuaaguuuugacagaugcacacugguuauauaacaugccaaugugggaggaaacugagaugagaauucgggacuauuggugcuucucaguaaaucuaaaauugcuucaaaacaaaaaggguauuaauaaagaaggaagaaaggacaaggucagucucacgcccuucugccccucuuacccuggucuuggagcccuccucuacagucaggaaggcugcuacaggcacucuccuuuuugcuccaggcagucugcuccuuuguccuugguguucuuuguuugggaauagguuagguuacaagaccagguccagccagaggaugggagucaugugguuaccaggagcuccuaccuccugcccugcaucaagggacuggggacuucuuagccuuucuucacuuguuagaaacugcaaaccgggggcuggagagauggcucagcgguuaaggacacugacuccacuuccagagguccugaguucaauucccagcaaccacaugguggcucacaaccaucuguaaugagauuugaugcccucuucuggugugucuuaagucagcuacaguguacucauguauauuaaauaaauaauuucuuaaaaaaaaaaaaaaaaaaaaaaaaaagaaacugcaaaccugacuggaaaggaaagggagggcgaagaaccugauguaugugggaagcugauggcagcugaggaugugcccaguggucagacaguugcucagcauggucaggucccagguuccaucccugugggcuagauugaagguuguguacuuguuaagcagcaaauugcauccucuguucuauuuuucuauuuaaagggguuuuguguauuccugaagauucagaugaguagcuucgagggcaagggacuacuggggggcuagcaacaacacuguacuccucuccugccuccugcccucuuccaagagccaggaugaaauauaccucuuucuccuagcugguucuaaauccccuaagggcuuuaaauauuuagauucauuaaaaaaaaaaaaaaacgugcaguugcugcuccuucacccuaaagaugaaacaagccaagcuuugaggcuucuucccacuaagggagcucuuuauaccuuccaucaugaaacuucuggcucagaaaccuagaaauaugaaagggcuaaaggacauuuggagcuccuggaugcuugaaucuggugaacuguuuuccuguagauggcaguggugacacaugagugcucauggaggucuggagggaauggugcuggcagggagaacccuucagacaacaauaguaacaagugucagcuccuaguauggcuguggaggaggaguuauucgggaggggaggcuccagcagguguuuucucuauaguauuuaguuucccuucaggcaacuguguaaaggaaaucuguuguuacuauauuuuacaaaugugggaaaggucugguacccugggguacccguuaccagaaggaucaagacagcagaagucugaguucacugccauuccaggcugccacugccaugcacaaaugaagggcccuggcaguccaaagccagcuucuuuuucaugcaggagaggggguggggugggaaugugaaacaggcccucuauguagcacaagcugauuuugaacuugugauccucuugccacagguucccagugcaaggauuacagguaugugccaccauguccagcaaggucagccacuuaaagacacucaacagcaagucuagcuaagggcaaaaauguacuuuuggcucuugagccacuaaaaaagguagaauuucugagaacccagaauugccuaggaagcuccaugccugacccuugagguacuguggucagaagacguccagugaggugguggcucuguaguggcugggcuggagcaaggccccaggucagaggugagccgggguccucaugcaguugcugcuuucacccccaguagagacugcuguucugcgggauagagcugagcugaaccuuuggacgugugcgcucaucaccgucaugguugugcuuugaugggucugugcaggcaaagggugcucauuccuacgacuucuauucaacaaagaaguggagaugguagcuaggcuaguuaggaaagagaagaaaacagaaggcauccaaagggaaagagagcgguaaaugcuagguuaagauguugaagguucagaaacccugccauggcagccaacaaaacacaaaagacuguccuucagagugguccauaguauccaugggagauggggcccuuccugucaucucugucagagagcccgaggauggcagagacaguagauugcuguggaaguugacaauuagagagaaaggugaauugugaagagcugcagcccagccuucacauuucuuuguuuuguuuuguuuuucgagacaggguuucucuguguagcccuggcugucccagaacucacucuguagaccaagcuggccucgaacucagaaaucugccugccucugcccccgagugcugggauuuaaggcaugugccaccacugcccggcuacauuucuuaggaaagaauggaauuuuuccaguaguggggguuucuacacauguacauguagugcuugauuggucauuugaaaacaccucagcagagaacucuuauaucucaagaaaauacugaaaaauuuuuugaauuguuguagcuaguaaauuggauuuuuuucuguuauauauuuuuuaaaauuuauuuuuauuauauuuauucauucaugggaaggggcagaggauaacuuguaggacucuguucuuucuuagcauguggggccuagggaucagcgagcacuuuuacccaaugagucauacaguguuaaauauuuucccuccccacaguagcgguuucaauauucuugggggcucuuucuuacaaauagaguuuuugaaaugugguuuauguugaacaugaguguuucugccaguaaagaauaaaacaauuguguguucgugugugugugcguguguguauacauggguaugcagaugcuacacuccacacauagagcacaggaguugguuuucuccugcugucuuguugaggccuaguuucucuugucucugucaugaugaauacucgagacuagcuggucugcaggcuucugagcuucaggcagugcuggcucugccuccuguccugcugcaggaaugcuagcccugcaaugauacuuuguggaaggcuguaggguuguauacugugaacugcagaauauugcugcaagaagcuagguacgguuguuugcacaaauacucaagaggcugugggaggauugcugcaguugaagguugugagcuuuguaagcaguaauucauauucucucucucucucucucucucucucucucucucucuuucuauauaaagggaugagugugcauuccuugaagauuuagaccaguggcuuugugggcaagaggcugcuguguggacagcaacaaugcugcaccuccccaucuccugcccacgucugagggcccggaagcacagcucuuuuuuccuagcugguucuaaauauucuugggguuaaaauauuuagauucauaacaaaaacugugcuguugcugcuccuuuaccuuacagacgaaccaagccaagucuaggggcuucuugcugcuaacagagcucuuuguggaguugcguggauaugccugggcagcgugucaagacugucuuagaauaccagacagacggaccagcaguguacacauagacauaggcacacacugcugagagagauuaaagacaagugaauggacagacaguuuuuauuaaauggaagggaagacaguauuaagauauuaaugcuuggggggagcugucuagagagauggcucaguggguaagagcacuggcuacucucccagagaccuggguucaauucccagcaacugcauggcagcucacaacugucuauaaauccaguuccugaauaucugacacccuaacgcagacauacauguaggcaaaacaccagugccauaaacauuaaauuaaaaauauauauuaaugcugcccaaaaugaucuauauagauguggggaaaucuaucaaaaugccacucacaguuuuuguaaaaguuaaaaaaaaaaaucugacuuagaauucccaugaauucugagggaaccuucacauagccaaacaaagaucaaaauuggaagaugcauacuuccuggcuucaaaauuacugugaaacuagauacucaaaacagcgugguuccgaccuagaggccgaccuguggaccaggagcagaggagcaggagcccgggaagaagccccucccucccggcgcucacugugcuuccaacaaggcgccagaguccuuuaguggaggaggaauaaugaucuuuacugguggugcuagggaaauaaauacucacccauaauaauaaauuaggucuuuaucuuacaucauauacggaaguuaacuccaaauugaucaaauuucuaagcaaaagagccuaaacuguaagucuuagaagaacacaggaguaaaaaucauagugauuuaacaauuucuugggugugacaccaaaaaauaaaagcaacaaaagaaaaaaaaauaaaugugacuuuaucaaaaugaaaauguguuugguugagugugguggugugcaacuuuacaguccuagcacucagugggaguugggggauccugagugcuaggccagccugugcugcacagugagagcuucucucaaaagauaaaaacaacuccuuuuauguguuaaggaauauuuucaagagaaugaaaagccaaccuacaaaauuggaggaaauauuugcaaggaauauauuagauaaugaauuacuauuuagaauauguaaagaaaccccaaaacugaaccacaggaaaaaaaaacccaacuauccaauuuaaaaaacgggcaaagaauguuaauagacgcuccuccaaagaagaugcacaaaugucugggaacuguguguuuacacgaacagauguucagcaucauagucaccagggagaugcaaaucuaaacacaagauucuacuucacauuugcuaggccgggauuacaugauugaucucaguccugcuucaaaggccuggauauuuacucucuguugucccaucugguaacagaacccgaguuuggaugugguguuuuucaucucagacagauugugaggcugcuccauucuaccuuaguuuauaaaagaggguacaucaccaccuuuuauauaaaaguuuccucuaauccauguaucuccugugacugacacaaacuagaguuaucugaggggaggaagcccauggaucagguaucuucuugacugaggacugaugaggaccugccaguucacugugaaugguuccaccccuggauaggcggcccuaguuauaagaaagcagccugagcaagccaugaggagcaagcuaauaaccaguguucuuucgugguuucugaaucccuuccuuccuccagauucuugccuucaauuccuguccugacucccucagugauagagcauggccuggaagaugucagcugagguaaaucuuuuccucccaaggugccuuuggacgcuguuuuaccucagcaauacaaaccuaacuaagacauguacugcuacucaaaugauagauaaauggccucuguauaagugggacauguccuuacuucucacacagugacacuuguuuuuuaccuagcauuagaauucgcacauccaaaucaaagcugugcuuacaagcagugaaagcacacuucaagguuauauagcuaguuccuaaaacauuugcacagcugcauucauugggcuacaaagagcaauuguuuuaguuaucacuuuuuuuuccaaaaagaauaucuccaucuuuucacucucuuuuuacauaucucccaucuuuucacucuuuuuauaucaugcgugguauugauagaccguucacuaccagacaaagcagagucacucgagggcagaaccacauagaagcuugaaguaauuuuaaccaggguccacagaaggcacaauguagcuggcacagaagcaggcaauguuggauccuuguauauaagaugaguagaugagaaaguacuuuagcaucaguaauauuaagagccaagugagccccuguggugcccugucuaccuugcucuaccguaucauguauguaagaaagacaguucaagaccaggaaccaguagcuuuggggcucucaaggaaaucagaaggcagcugucgaguaacaagcugauaaagacagagauuggcaccagaaagagugguacaaggcccccaucauuugagcuagggaagaagauagugagggcagaagucccgaagauguggaggccucaguucugguguagcucugggacagcagaguagucugcagcccagggcuccucagaggaauguaagaucaguucacaaagccucaccaugagaugaucugacaauuccagucccugcucuuccugccaugcuggcugacucugaacaccccuucccugaagguguccuuucccagaagagauguuugguaccucacucugucacacccagaaggggcucaucugugcuuugcucgggcagcugucucagcaggaggcucaucuugaagcaaggggcccgacugugagccugugcuucugaccuuucaaggcagcccagccaggagagagaccaccugggcagggcacuucaucgcuucacagaacuugggcuauacucacccaggcugcucuuugguaaagccaccagggacacagacuugggaggcuuucuagaggaaauacuaaaucaaugaaauguuauuucuaaguuugguuuagcagcagaauccauuaaccuucuauucacccccuuccuuccucugauaguagcagcaagguguucaaaggcauggccacuuauucuuagggucagcacguuuauuucaauuucuaggguuuugaguuuuccagcuaaaugauacucacuuugauuauaaggaaccaacccaagaagagugcuucuuuauucccgcuucauuagaaagccacaccugcugaagccagaggaggggaucaaggccaucagagcagcucaaucaauucuuauuuuucuuuucauaaaagaauuuucaugagaugggaacaaagucaugucugauugauucugggauugaggccacucaauguggccucccuuauuuagucuggucuccaggcuagaggagagcaaaguucauuucuuuugccacguaaauugucaaauccuaaaauaaaacuugguauaaugguggaaauguagugcuccagggagcaguaggcaaauccuuccugccagccaugagcaagaauggaugaagacuaauacagcagugaccaucguuacaaaauguugaacuuccugaggcuaugcuaauggccaggagcuggaauaagaagaauaaagcacccagauauacaucccaccauaucauccuaauauuguugccacagcauuugcuucauucagaaaagacuacccccagccugguguuggaccugggccagaaaucccucaagcuuugacccugacagaagugugcauucucucuggagcaugauuuucuugccuacccagcccucccauguaucaguccuaaggcagccugcugagaggagcucucaguggguugguuucuuggcugccauaucuacacuuggaugcuaaauauacagacuucagaggcgccagcgcuagaaggcaaaagagcacugguuuagcauuuugcauucagcgacauucuuuuggugagucuggaaaagaaaacagccagauuaucuccgcagucagcaagugugggcaguagcccagaguuaucagaacaaagaacuggcauucaggguacuucaggccaagcuggagaaagaagaaaaugggguuuugauagguagaaagcucauuggguaaugggucaauaauaugcaaugaaguuucuggauuacuguuacuaucagugaggcaggaauggcccccaugaugcagguguuccacacaccuauuauugccuucugcuccagcuuccugacauccuaugugaauguucacaguagaaguuccauuuccauugaagagucaagaggacaaacuuuaacuucuuagccuugcuuuaugggcuauccuuuuguacagccccgucuguacccuucccuuaaaaggaagauaacagaggcagaaggagguucauacaguacccucugaucaggcugcagaugucagugcaguucugucuauaccuugaaggcaaaguaaagccauguuguccaaaugccauuuucuugagauugacaagagccugagaugugccgcauacuaaauuggaagcuaagaggaaagagaugauuaagauacccacauugacgguccagccugggugcugacagaggaugccacauacugugggugguugaugccuguacccuagugcuuaggagcucuggaggaggaugugcaugccccuuaccacacagugacagucucugcaucuagggcaguaaggcugaaugaaaagugccgcucugccucccacugcccaucuacagagcaugagcugagggugcaggcuaccauacaaggugcaguccuuaaccugggccacacaucugcauuaccacgaggcuuuccagaauggcggcugaguaccuccuuuaaucagaucagaaucucuggguguguguguucuaaguauuccucagacaggccaugggauuuaaacaaugcugaggacuacuagcuuggacuaggcuuccaucagacauaaaugugcugcauagcucccaggugaugugcugaugcuacaggcucgaggggucuugaaaugguacaguccaggcaucuucacuggguuuguuuucucugccagaaaauuaagaagcaggcaacaucugaaaugcaacaguaacaggggagaaaucucaagcaccauaaacagagucaacauuuaaagaaaggugguuauugucagggaggaaacagacacgcaggacacggagaaaagaccuccacaaagcagauggggggacucagaaagccaaaauccagucucuucuugggggcuuguguuuugcuuuauagcuucugaagagcuuuccuccccuacuuuaggguuggucaguuugaagacaaauaggacaguugacuggucuacaacugcugugggacaugaccugauggggcccggaacugugugacauauauccugauagggccucgaacuuguugagccacucugucaacaggggcccugcuagugagacauaaaagcugccagguuuuuaugucacaucaggaggguaagaagcuggccaucuuggcaauucaccaccuuuauuuacuuagcuguggcucaccucccugucugccuaccagggagucuguuuaacuccugguccuucauuaggaaaaggugaaagagauguagccccugccaucguggggcucacaguccagagagcagaggcaacccagggucuaggucugacccugagcccacuucuucucugagucuuauguucccugucaacagaccccaguggucuucacuucucucuucucuccaaccugugagaccauugaucuauccguacuuuuucuuccuuuuugggugauucaaaguuguguguguguaaauauguguaucuaaguguaaaugcucauugaggacagaaaaaugcguuggaucuccugaagugggaguugggaguugccuguugccuguugggaacugaacuugggccucuggaaaaacagcaaaugcucugauucaucacuguucuguggcuguauagagacaccaugaccaaggcaacucuuauuaaagaaagcauuuaacugggggcuugcuuacagcuucagagguuuaauuuguuaucagugguguagagcauggugguucgcaugaugcuggagcaacagcuaagaucuucacucugauccacaggccaagagagagauccuggcagcaugggccuuugaaaacuaaaagcucacucccacacuuccuccuacgagaucauacauccuaauccuucugauucuucucaaguggugccaccccagugacagcauucgaauauaugagccuauggggaccguucuucaaaguaccauaugcucuuaaccagugaacccuuucugcagcccuuggaggauguuuuguuuguuuuguuuuguuuugaggcaguguuucucuguauaacccuggcuguccuggaacuugcucuaaaccaggcuggucucgaacucagagauucacuugccucugccucccgagugcugggacgaaaggcaagcgccaccacuguccggcugauucuagccauuuuugaggaugcaguucuguagcauuaaguacauucccauugcugugcagccgucacugccauccauccccaaacaacuccauuuccccagcacagcuccccauucuuccucagucccuagcaauccccauucugcuuucugacuccucugacugcccuggauaccucacaagaugggaccguacagcaucuguccugggaacauggcugcuuccauucagaacacugucuucaggguucucucauguagcagauaccagaauuuccuucauccgugaggcugacaaguccauuguguagauacccauuaaccuauggaugaguagcccgcuuucacccuuagaacauguggacaaaucugcugugagcaugaggauacacaugccucuaugaaaggaaauacccgaaacacaaguuauggguucuggguucaguuucuugaggaucuacaauacuguuucuauaauaucuguacuguuuugcuuucucuuauauuuuugguugugagccuagccuuuaacagcugagccaucucuccagcccacuguuuugcauucucaauagagaaggguuccuuccaguuuuuccacaucauuaccaacacuuguuaucuuauguuuuuaaaauaauagcuaguggagagaugacccagugguuguuaagagcacuggcugcccuuccaaaggaucagaguucaguuccaguauccauaugacagcuaacaacuaucuauaacuauaguuucaggggauccgaugccuucuucuggccucugcaggcauugcauacauguggcaugugguacacagacuuacaugcaggcaaagcacucagaaacaaaaaauaaaauuaaauacacacacauacuauuaguaugugucuuaaucagggcuucuauccugcacaaacaucauggccaagaagcaaguuggggaggaaaggguuuauucagauuucacuuccacauugcuguucaucacugaaggaagucaggacuggaacucaagcaggucaggaagcaggagcugaugcugaggccaugaagggauguucuuuacuggauugccuccccuggcuugccuccccuggcuugcucagccuacucucuuauagaacccaagacuaccagcccagagaugaucucacccacaaggggccuuuccccuugaucacuaauugagaaaaugccuugcagcuggaucucauggaggcauuuccucaacugaagcuccuuucucugugguaacuccagcuaugucaaguugacacaaaacuagccaguacaacaugagaugauaucuauuguguguguguugggggguguuguuguugcugcugcugcuguuguuguuguaaugcuagggacuagacccagagcuuuacaaauguuagcaagcauuuuaccacugaauuaugucuauaauccaaagauauauagcccaggauagucucuaacucauaaucuuguugccucuucuucaucaguauuuaucacaacuagcuuauucaaguuuuuuauuuguauuucccuaaaguaaauauuuucuaucacaucucucauaugaucauuuauauaauauuauauaauauagauacauuuauauuucuucuugggagaagugccgauuuggauucuuuacuccauuuuuguuauugauugagauucuauaguucaaucacgcuugugauucuccaccucagcuccuuagggucauaggcauacacugucaugucuggcacccuuucucucucacucauguguauaucguggggcucuuauacuauauuagcucuaaauuuauuaaagaggugaacacaacuguugcaaacuuuuugccuauggaaagccauuuuuuuaaagauauauauauauauaugugaguacacugcagcugucuucaaacacuccagaagagggcaucagaucccauuacagaugguugugagccaucauuugguugcugggaacugaacucaggacuucuggaagagcagucagugcucuuaaccacugagccaucucucuagcccaggaaagccauuuuuaaaacaauuauuuuauuaugauacauaguuuuguuguuaaguugcaggguccuuuauauucuggauauuuuaucauaugugugauuuuucaaagacuuuucuccauucuauagguugccuuuuuaucuuuaauucaugauggaggccaaguuugguggcacuaagaucagagccagggcuuguggaagguaguuaccugccacucagcucagccacugagccccagagguuuuaauuuugauuagccuagugucuguauuuuuccauaaaugauuguccaugccauuaguguuauauccaugaaauuauuaucaaaaaugugucauggagcuuucuuccugccuucuucuaagaguuuuacaguuuuuaacacuguguucacaucuuuaauaaguugaguuaauauagcguaagaaaaguguacaacuaucuucuugcauauagaaaguuauuuuuaaaacaauuauuuuauuaugcuuugccugcauauaugucugugcaccauguucaugccucaugcccaggcaugauccucuggaacugaaauuacaaaugguugcgauccacccuguggguguuggcauggaaccuggguucuccggaagagaagccagugcucuaaccgccagcccuccagccgcaagaauccuuuuuuucaaugucaggauggucccuucuccuccauuaaaugcuuagcaaguuguuauaugucaagggcucaacaccauguguuucauuuagugagcuuuacgucauugugacaaauggugucaguucaaggucaguuggcucuguuggugggaaauaugugggugagcaaaauggcucccuccagcgucuagaaagcaacugaguuucccaaauccucucuaagaagcuccaccaccucccacuggccccagagacuggcaaauaagcucuuagccuuagcuguuugucgggcagggugggggcagagggcagggggcaggggccagggggcagggggcagagggcaggggccagggggcagggaccagggggcagggggcagggggcagggauuaagaucuaaacugugaugucauaccugcugcagcucacugaguuuucccuucuucccugaggugugguuuaaccaucgcagaugcuuuucuauggcuaugauagcaguuaucuacagaggacaggcugugugugugccaggcuguuuccuaagggauugcaccuagugagccauuuaacuuuucugaugagauauaugcuauaguuuuacuagguuugauacuuguaaguggcggagccuauguucuagcuuguugguuuggcuccgaaaucuguggucuguaguggcucaggccuccuagauaugggauuuggagacuagagcacccuggcccucuggcugaguguuccuugauguucucuugugaaagcaguagccccaguggugguucuagucucauuucacuuccuuccagggccccauacuccaggagaaauauaaagcaguuucuuucugauuucacagagaaggcaacagauggcucccugcagagcgaggacuggacacugaauauggagaucugugacaucaucaacgagacagaggaaggguauguuuuccugggaaaugccuugucucgguuugggugggauagcauacauagcuugucagggcucagugugcugggcucaacucuggugcuuguuuguuuuuuuuaauuauuauuuucagucuguuugcuuuggcauuaauaagcugaaaugcagucaucugucuuuucccaccccagccuacccacuuccucacggcagugccucaguuagagaagugaggccucuccaucaucugcucugaaccaggaggagaaauggagccgcuuggcuuccugugccagucauuugccucuccccaucccgccucagccccugcuuccauggugcagacgggggcucucugugcauggguugcuuucuaggguacuguagaaguaggcccagagcauaaugagauaaaggggcuacuaaaggguacccauggcucagagcagcugagcacgucugggguguguggacugaauguuuagcuugucucuggccuuucugcacugcuuuagucagaucuugguguuaucagcacuaugucgucgccucuaugccugcccugugugcauauuucuuacagacuagccugauucaggauuaguccauaaacaccccguuugcucuuacuguguucuucucaacuccagugugucaaggagaacaguugggacucaggcagccugggcuuguagauuggugguauuaucuacuugcuagucuucucaaguugguccugugaucauuugacagagacuuacaguguuugcaggcgcuguuguaaacauggagggcacagcaguaagcacgacacaauuucaccucuuagggagcugccagauuggagcaggggccaaacugugaacaagagaaaccacauaagcuggucagguaggcggagccucauagggaacucuagggaggaucugggcagaugaggugcuauggucuugcuuuaauuuugaauggucaucccauguucagaaugggaucaccagggcaggacaaaggcagagcagguaaaccaguaggggucuauugaaucgcccuguugugaauugaugaugguaagcuggacuggaguggugguaaggaugcaggaggcaucauuagauucuggggagauucagaaauuaaagcuaacagaauuugcuggcguggaauaugaggaaaaugucaaggauaacaccaaaguuugggaccuaugaacaacaggcuggagcugcuagugcugagguggaacaggcagagacuagaucuagauccgagcuaaggucaauguguggcccaccacuagggcuugccuaggggugcuggaggccauaccucagccugcccaguguggcugucuccaugggagaagagcugagaugccuuccagaggggcuuugagcuuggcuucugggacagugugacuugucuucaagguagcauaagaagcagguacagguagcccgaugucacaugacagguagucaggauguaggcuuggaaguguggcucaggucagcuuuucaucugcucuauucccugaagaauguacuugcuucuucccccaccucccaucaguucccgaugcaggugccaaccagugccuugcucacuagcaagucuuccagagcaucccuggguuuuugcuugaaaugcuuaaucacacaccucugcagccucuucaggcccuucagccucacuaauuuuucuuuuagcuccuugaauucucuacaauuuugucuccagucagauaucuaagcauugagggcagaaaguccaagacccccugagaucuucuuccuucuaaauuauuuaaguccuuucaaagugugagugaccaggaccugcuuucagucacugcucuaagaagggcugcuugugcauuucccagcgcccuaaccuccuguucacauguguuaaagugacagcauggugauucucgaagaguuucugugcuugccucuauuguaaugugucugcugaaaucccucccauauggggagagagaaaacaucacacauacacauucucucucuucucucucucucucucucucucucccucucccucccucccucccucccucccucccucccuucuucccucccccccucucccucucucuuucccucccucccucccucccucccucccucccucccucccucccuuccccuccuguuccuggcugagggcuucuaauguuguuccucauguuucucccagccugucucucugacacuaagcaguucccauccgcuauuguaucucaacauaaaucucacuccuccggccccuucccucuugucgucuuaugugguauuauacuugggcuucaaaucuuugugaugucucuuagugucuauucuguccgacgguuucuauucugugcacuucaugagagcaagaauucccucuguuacacucaguauuuuaucucugccacaaugcagcugacacauaaucagcguguguguguguguguguguguguguguguguguguguguguguguuaugggggccuguuucauguaucagagucugaccucaaacuugcuauauagagaaggaugaccuuggauuucugagccuccugcauugccuccuaacgacugggauuacaggcaucaccaucacaccugguuuauucagugcuugggaucaaacccagggcacuccacggagccacgucucagcuccacaaucagcucuuaauaaauauuuuaaaguguguaaagaauuaaugacgucccuaagguagucugaugagaaaugcaagcauguaaauacaaucauaucacagcgugacaaggauuuagacagagacaaaggaauggagcaagagaagcugcauauagcuacagaggcagacacgugccgugauucucagccagccccggggcugucagcagcaaagccuuucugaaggagaugacacuucaguagacucuuauaggauaccaggauauuagcaggacaggcagguggaugacagggagagaaguggaaucucuaggcuggaaaguagugugcauaucaggugcauaggaagcauggcaguguggauuaagggauauggagccuggacccaucuaccugggcuagaagcuuuguucaggagaaaagcugugacuggagacauaacuugcagcuguuugagagccacuaaagagcuccccacugcuggacaggagggcucgcaggagucugagaagggugugggaggccagagacuugucuugagacucugaaaggcugcccuauggggcccccaccugagagagcucucuacugaacgcuccuggacuuggcccucucacacaguccaugucucccuugauccggcugccugccugcccgaugguggccuuacucagcaguuguuccuucagcagcauuugaaaugguucuuccaaccugacugugaugcucuauucugacacuucucccucaaaucagcagaaagaaaugcuccucuuuuugcucucagguagcacuuccugaagcuuagaacuugggaagggauuuucagcuuaaaccuaaguagagucugccugcuaucugauuggacuucacucacaaucugggcaugcugacauacugucagccagagauacacaguccuccaggguagugccuguuuuucucaucauggaaauccaagaggggaugagagagagcacguagagagauggugcagucugucagucuggggugacaguggugagccgagccugcagacaggaagguagucuucucuaaccacuaaguugccuacuuucuucagcccaguccauccaagcacauaguugccgaacugcuguauuuauaaaaucuguaucccuguuggaaauugcccaucuggagaacccuugagucuugccaggcacaccuuuagucccagcacuugggaagcagaggcaggugaaucccugaguucaaggccaucuacacagagaagcccugucuugagagaaaauaaaauaauaauaaaguucugcauuuggugggcuuccucugucugcacgcuugggcugggacugggcuguuuuuauuacuaaggcucugcacuaucuuaagucugauacauauaacauugguuugcuugcaugucuuccuucacuacucaggggcuuccuaugaauuuuaggauuauuuuucuuauuucugugaagaauauuauuggaauuuugaucagaauugcauugaguguauagcucauacuggacaaaauaaccuuuuccacaguacuaauucugacaauacaugaacauaggaguucuuuucaucuucuagugucuugguuaaaaauuucccuaaguguuuucauuguagacaccuuuugccucacugcuaggguuguuucugauuuagggcuccuaugaguagaauuguccacuucuuucuuugcauguucaucauuguugccuuaucacagcuuuuuacaugcugauuugguagucugauacuuugcuaaaguacuaucagaucuaaggguuuucuggcagucuuuagguucuuucucuguagcccaggcuggcuuagaacucacucuguagaccaggauggccuaugucuuacucauagagaucuaucugccucugcuuccugagugcuggcccaggauuuuauuugcaaggucauaucaucugaagauaccaaucugacaucucccuuucccauuguaucuaguuuguuucuuuuugagaauccaaguacuauacugagugacuccagaaaggggaggcauucugucucaauaacugacuuuagaggaaauccuuucuggcucaguauaagauuguguauggcuuuaucacauauacagccuuuauuuuguugacuaugaucccucuauuccuuauuuauucagggcuuuuucaugacaagauguugaauucugucaaagacuuuuuuuuuucaucuauugagacaaucaugugauuuuuauacuugauucuauuuauucuuaugcauaugucuuuugaguuugguucauaaaaaaugaacaaaaaguuuuuuauucucuuuuugcagcugcauaaaggucaugauguaauuaucccuguuuccucuuguagacauucuccuccccccaagucuuucacauuuacagacgugcuacagugaacaaccuugauccuacacuaguugacauugggcuagugccccaugaagcuugugaggaucauaguuuaucuguccuuuugccaggccaaaggaugccauccgggcucuaaagaagcggcuuagugggaaccgaaacuacagagaagugauguuggcccugacggugaguauuguuucugggaggggaagccuaggacaccuauacacaaaaauuacucucccagggagccaugcugcccacucaaaugggccaccagcauguagccugugcugucauggcucagcagcagcuuccaggguccccugcccuaaaugggucgguguauaccaggagaacauaagauguggaugacauuguugaaccccgcagcaguggguuggagcucaggauuggaagaucuagaggccaggacagaucuugugccugcuuccagccuaucugagaugcugggagucaguuuccuguuuauacagguguucaccuuuaucugucccgugccuucccaggauggagguuuucagauguugcgaugguuacagccaccuucuaaaguuggcugauugcucugcuuucgggcucugagaggccuuggaguuuuaccuucacagcuagggaaguaucaggcuguguuauaccaccauagaauggucuuuuguuugagaugaaaaugaaaauaauacaaagguuccugaaaaagucagccaaaugacuccuuucagggcaaauagauaagaauugugcccuuccuuaagacauugagaacuaaaaaggguauuucaggugcuauuucugacuuaaaagcuaacaguuuuucagaugccauaaaaucugggccacaguggcuuuuuaauagaaacuguaacaagucaccaugucagcuucugcagguggggaaaaguggguuauuuaucucaaaaugccgcagcauguuuuccuguaaagcagaggagcugcugugaucucccugcccccgccccaguacaguccaaacuuaauaggagagcacucuaacucaggagcuugggauuugcacagcagaggagaaaagucaguugagaaauaagugaaagcuuucuuuuuuuuuuuuuuuuuuuuuuuacuucaacauugguagagcccagggugaagugugaauccucaaguguagugaccugcaucacuggggagccagcucugacauuuguuccucuauauaccagcuucaugcauuucccugccucccuacagcaucccuuggcagccuucuuuugaucuucaccauggcugaggcuuuucugcaaaccuugggacgccuguggacaugcagaccuguuguccuugcagcuagcucccugccuggcacaguuggcauggucuagaucugccacgaugaccucacuuauuaguuucugucagcccuguuccuuccugguggccuuucccagcugcacaucugucccugccuaggcuguuaguauuuauccaguggagcuagagguccugagggccucucugccugugccuucacauguguguuccuaacaucugcuucucguugccuagaggcccccuuuguuuauuccauggguuuuggcugaaucucagaaaguugccacugugcugcauucccuaaaacccacaaagucagguuugccaagauccuuuuugaaagggcggccuaaaguggcuuugauagagaagacuuccugugccuccuacauacagaagcuuugggcugcugcacgcacauaugcacuggguauuuuccaaggccaggaugugacacacugaccuuaaagucugcugugcaggaaaacugaaggaaagaauagcauccuguccauggucucccuagaaauagaagcagagccggggguugaccccagucuacuccccuguuuuuaguuauuuucacucaggcuuccugagccuccuaccaugcugagccucaccugacccucaggaaagaagggcucagcagcucagcagcaaucgucagagucuagagaguaaguagagaauccuagaggaaaggguaccugcaacaugcugagaacagaaagaacgucucugguuccucuuggaagcaucgugggucccugagagugagaacuuuuaucucagggucacccagaaucagauacagagauuuaaaaaagggaguucucugggcuggagaugauucagugguuagagcacuguucuucccggguccugaguucaauucccauauacaucaauuaaauaauucucaaauaacucauauacaucaauuaaauaguucuuaaauaacucauauacauaaauuaaauaauuuuuuaaaaaaauauuuuuauuuauuuaauguauguaaguacacuguagcuaucuucugauaccccagaagagggcaucagaucucauuacagaugguugugagccaccaugugguugcugggaauugaacccgggacuuuaaaaggaacagccagugcuuuuaaccgcugagccaucucucuagccccaaauuaaauaauucuuaagaauaaauaaauagggcuggagagauggcucagcgguuaagagcaccgacugcucuuccgaagguccugaguccucuucuggugcaucugaagacagcuacaguguacuuagauauaauaauaaauaaaucuuuaaaaauaaauaaauagaaggaaaauuccccuuagcugaauaaaauuuaugauuauggaccuggagagauggcucaguaguuaagagcacuggcugcucuuggagaggaccuggauuugguucccagcacaauugcagagaauccagugccuccuucuggccuucacaagcacuguacacacuuggugcacaggcacacgugcaggcagaauacccagacacacggaauaaaaguaaauaaaccccuuucaaaauauacugcaguuacgcagaguccccaaagacaauguuuacaacacuuccucagugcaccaaggaccaugugcagucuccagaaguacagcgaaagaaaggaggaaggguggugugggggauuucagagcugcugggucucccaggggaagucucgugacacugccgagcaucagcgcaaugccuuccuugagaccuagcucaaagaacaagagaagggacaaauaaucugugacacagucguuguucuaagaccucccagcugaugcggcugcuuggaagagagcuccgaaagggaugaccugguccucaggugggucaggagcucagggcuccugagacaaugaaucagaguuccugacccaggcuggggaaguaauuuagugguagagugcuugccuaccaugcacaagggauggggucaauccguagcucugugagagaaggacaaucuauccuucucuguuucaguuuuuccuuccugggccuuuuagcuuugaaaaauaagguaccaagguauauuugaaggauaguaugagaauagcagcuaugagaacagaaugaaauuauauguaauauggagggaucucacuguaccugguauguagcugccauccaaucuaugucauaaguguaaccuuuucucucuguacauugucaaggcaaaagccugaggcaggaaccaccuaggguuccuucauaagcuacuuauggucacacaggaacaaugaggcgguuagagcuguccucugccgaugucacuauucucguauggguuauuuguuagcaggcccucaagggguggcuugggaaagguugggugauccagugagcugcuuucaggagggacagagucagaaaacuguguuugaggcuggagaggcccucccagaacuccccaguaccucaccugggaaaauccgagaagccauggaugcagcagccuucugaaguaguccuaauggccauuugcccuguacagcugcagaaacaguugacguguguccucucuaacucucccugcaaggaagagccccgugcucccacuuuccagauggugacacagaggcugagugaaacuugcccugggccaucagggagggaguagcaaagcugagucugucucccacugccaccugaucagaaccuaucagcuguccuuucucaaagcuauugaggccuagggaccgccccagagaagacaggagugagcagggucuuacugaaggcagcugggguccacacacuauccgucaaaggucgcaguccaucguuguugcugauguucuuugcagagcaggagugugcuggggguguuuauuugcuccucacacacgagggucaguaauucacccagcagccuccucucgcgacaaagccugggucccauugccuaagaucucacacucaggucuagagaaaagaauuaaaauguuaacuuccaggaaccucucagucauuuugacaccauuacaugaccgugcaaagucuaugucucgauuaccaaccuaauugccugguuacugugcaggcccaggaccuucagucaacacaggauugucauucccaaggaagagggaugacugaaugagugagggcacguaugaggguuggcuuuggagggaauguaacaggaggaugaucuggaagcauggcuaaacaggugagggacucagcucccuccccuccuguccccaaugugaugaccucccccaaccccccacaacuucaggugcuggagacuugugugaagaacuguggccaccgcuuucaucuccucguggccaaccgagacuucaucgacagcguucuggucaaaauuaucucucccaagaauaacccucccacuaucguccaggacaaagugcuggcucuaauucaggugagcuggcuuccuucccccaguuugucgggucuguaagauggggacugugauacacgcucaugcuuucccauuauuucagagaaaaagauacaaauaugggggguuaaauauuuguuacaaaauacuuauuuucuuuauacucaccucauuggaaauccuaagugguggcucucuugcugguugauagagccuccaggaagcuucugaguguccagccuccuguugcccagacaagaggcuaacagaaugggcuucaacuggccucugagauaccagaguauaguggauaucaauggaguagaaaagaccauguuagaaucaugugccaggugggugaggucacagagcaagggccagcucuggaguagaaaugauauuaagggguguuucacugaagaggugacguuucuguuggacacugggaaguagggaugaguuuaguggaaaggccaaauguaggaggcaucucaggaggaaagcaccugugcaguuauccauacuugagauauaccugcuauucaauaauaacaaauaacccccagucuagccccuuacagcaacacuguuaccaucucucuaguuucuauaggacagacacucgggugcagugugauugggagauuauaaaugugcccugccgucacuacugaggcucaguacuccauuuccaagauggugcccagacacgucuggugggggaagcuucaguuccuugauaaugugacaagagacuuguguuucccaacacacagacaucaaggaagucacacgucgcaucuuuucuguuguuccauuuguuaaacagaaauugcuagguuaagcuucaagcauuuggaauuaagagaugaggugaagccggucgugguggcgcacaccuuuaaucccagcacuuggggggcagaggcaggcggauuucugaauucaaggccagccuggucuacagagugaguuccaggacagccaggccuauacagagaaaccaagagagagagagagagagagagagagaauaugaaucugugagcauguuuugaagauuaucuuauggagagcagaguauaauauagaguguccagggcugcgcuuggggucagggccaggaugggcaggaggugaggccaaagauggguagggcuuauacauugugugugcugagggccuuggacuugguccugcagagguaaugguggaaccauuaaaccuuucugaucuggguuguacacagauuuuagacagagcacccuacugucauggcaucugaauccauaagugcauccaauauggaucaguaaugcaugugcaagagccaagaugagagggagacuccagcaggggcaggggcugauagccugguuuaaaagauggcagacacacagaauaaccaggggucacuguauguuagaguagaaaggagccugcugcucugucuugagagcugucccagcuccuggagcacuuauuuccuccuaaguuguucagaugugccugccgcagagaacucccacccugcagcacagucuggcuuucuuagucacguccucuucuaaagaucuuccaaugcagcuuugcugucuuuccuguucaacucaguugguuuccugagagccccgggcugcuauguuccuagggacuugaguaauugguugucaguauugaauaguuuuuuuuuuuuuuuuuaguuuaguaaaugaauguagcucauugaggcugagagaaagggcagggugacagagcccucucuuaugcccugacccugugcugccauuuugcaccccucccucaauccuggaguguacuuccccaguuccacccacucccauagccucuccugagauuagacuuccaaggacaugaaugguagcuuucucuuacaaaaggugggacauggagcuuaaacucucuacaggguccacaauagcugcagaacuggaaggagacauccauugagggcuugcucaccugaggacgacccaggcuccuggguaaacacagcuaacuugauggugugaucugcuaagggaagacagggccccuucacuggcugggucccacaguucuaugccccagaagcgccuguuucuugccugcucugaccucacaacuuucucaucuggucacuacuucccuaagucuagcucguccaagguccuaccgcaacacuucuagccuugggcuggugcuguaacuucugggcaucucccuucucuauaaaaugaaggcuggguuucugcccuccugcucguggccauguagcauaggggucuaccuacaccugucuccucagcccucuucucacuggcugagcaacagcaguguacacuagccuaaagucugauggugugagugagcuauaguuucuuagccuuccuauggacaggggugcuuuguguuugggguugcugccgcaagccuccaguguggguucuuggaaagcacaugcauuuuuuuuaacuaggcaugugcugaguacaugaagcugacaguuucacuucaguaccaugagagaagguacugggucaggagggaccaggacuuguagcuguuccacacucucaccaacaugccacuuucugucauugcagcccguuugaugcacuuggggaagugcuucaccaugucauauuuagccacuuuauugacuguaucagugaucaucaguguucauggguuuggccacugugaucucaaccaaccuuagcuggaaacuauggaagaaaagauagcaucuguacugagcaagcggcgauccucccaugacguuacucuacaagcuauucauauaacauuggcaccucacugguagucugaauaaaucccuaaaguaaaaaucaagaaauacugagcuaguucauacaaggaccagauuaaccacagacuuugguauccuaacagauccuggaaccaguccccuuguggauacuaggaacaacuauccuuuuaaaaacugaaccagcaagccaggugugaugguacaccccugcaaucccaauugggaggaggcauucgaggucaaggccaaccuuggcuacaucguaaguuugaggcuacaugagacccugccucaaaaauagaauagaauaaauuagcgugguaacaaucauuguuuuucuuuauagcugugaauagguagcggccuuuaaggcaaauccugcuggauuggaaagugguuuugcuaauggugcaggugccaguauaauccaaacucuuccuuggugcuugcuagaguccagcugcuugagaagguagggugagguuaguccugcccuugcccucagggagacagccaguuauaaagagagacuggguuugcagucaacuggagcugaaacccagcuaggaaggacuggagcuggccucugacugcugggaccgaaggcgugggcccugcccuaaguuucccauuccagagaagccgaaugaauaguuaaguacuugagaagcuuugaaguaagaagcuauacagacaagcccuaccagcuuccuauccaugaaacaugcuucaggcuuuuggggugggguugggguggggaggggacaucuuggcucucauucccagcugccagccugagccaacugacucuuauuuuaccucaaagauggaagcgcaguuacugcuagacagagggaugaggcaacuuuucugaagucucuuguuccugugguggcauaggugaagagagcuuguucuccuaugucugccugcuccaaccuauugucucccuacccuucauuggcuuggagucacaagcgugcuuggcuuagaauuggccuuagaaguggcauuuucaguagcauguguuuaccaucagcagcccucggcgccaaacagacucuaccaguuggguagaacacuuguuaggcauauggaagauccuugguuccaucucuagcaagacacacacauacucaagcaugcacacucugaugucuuccuccuauacuccagucugccccucagugaggcuuucugugccuucuaaugugaaggcuaaaguuauguuuuaaguuuaaauuacugugcuuaagagaucuauaaaacaaucaagagauuuuggaaacuuaauuuuuugguaccucagcagcuggugauuguuggucccagugccugaaguggggaaaaaacccuauaaaacaaaaggccucuaacugugagcacuacuuguccaaggacagauaacuuucuggaaugcuggggcuguuguucaagaagauaacaagccuuguguuuucacuucugcaaacaaguuugguugccccaacugcacagcaugugcuugaucacacguagguaggaaguacguccggaugcaugcuugaccccauuggaugaagguugggauggagagggaggcuggaaaggucugagagauuguguucuuccauagugucagaugucugguggcaccugagccuuaucacugagaaacaugcugacuacacugcuucaggugaaagccucuggcaacuucuggguucucuguacugucggggcagaaagcccauacuggagcauggccagaagagggcagagguauccuaggacccagaguucaaaugagcacucaucucuugcuuugaaaguugcuacucaaaacuugaggacuauagacauagaccaaguguagucaugcuaugucuacaguuuggcacgaaaugcuaaggcacaaauugaccuuuguccucccauugguccugcccuuggguccuucagucuccacauacugaaacuacaaguaggaaaagagggaauuacauaaagaucuuggcuucuagugaaguggccaccaugucauuugccagacagcaugguggcagagaaccugagagaaugccagcacuguacugccuggagccuauaucccaauaaggcgguuacuagggaagcaucccaccucuacccucucuacugauccugcgccucacuucagggcucaggguggccaagaacucccaggccuagccuaagcuccccucaggaggauucuucucuagcucagccugcagcaggaguccuacuuuaucaugcucuuauugguuccugacagccuccauggccaucuccucuauucucugaaguaggaaaauaaagaugcuuaguaacugugagaacuuaauuaaauuuagucugacaguuauugacugacugccuuuccuguacaauggcaagagaccuguguguaccuuuaaagauaucugaccugguuggggagacaagagaaguuaucuaggcaugucccuaaaaggugcuggagcaugugacagcuguaauuuacccaucuccauguccccacaugcacuguuccuuuaaaaugaggguuguuucccuccucccuccucccuacucccuccucccuccucccuccucccuguguuugucccucuguuggcaucagaugcuuauucagaggagauuacugugugagcauaugcuuuguuuucagcaggcuggccuaggcugcccagggguccuagacaggagcuggcacuguggcaggugggguuaggguauacuaaccaagacuucuugucuacaaauuaaagccaguucugcuugccuggcuaaagaggagaguuugucuugacaaagcaggaccucccggaagcccuagccacccuggccaggguaugacuggacaugggaaaugacagaagaggccaggaaaccuucacgucuucucugugcacaccacuuagcauagcaauuguucuguucuagaguacaagcuaucucugauccugggucaccaacaggcuuagauguucagaggagcaauugucuuacaaaagaaggauccaguucucuguuauguccaggguugggcuccuggcaggaggauaguccuaccuugggacaugucucaguucucuaggguaggcucaguuccugaguaagucuaaauaugaggaggggugcugaggaguggggcguguguaccuagagagaacggcguagagcaaggaagcaguaagaagaccccagagccauucauuucuccaagaaaacagaggcaggacguggcaccaggaagaacugccgugcuucccccaaccuucccuagugggcugugacuccuuaaacuuauuuuuauuauuuuuuauagggcuagguauagaaccuggggcuggugcacgcuaagcaagugcuauaccucuagcccgcaggcucccaaguuugcuguuuaaacugaaagccuaaaauuacaggacagagcuggauuuugaguagggaacagacuucaugaugcuggaagaauaggcgaggcuaaggaugugaggcugcaugggucuccagcugggucuugccagcagccucuguagguaccuucagugcagaagaaaggauuggcagagauaggcugucccagugccguggugauguaaaauccccgaguaugcauauuaaauaaaugcaucaaggagagaaagccaggcugauggugugguuuguaguaugugagauacauuggauauaauuaaggaagcuuuugggaaaauggccuuuuaacuucuaguggcucuagugguuagagauagaauuucuguagcugccucuggauuggcuggagcuuauagcuguaggccauuaaauggugugaugguaauauuucuaaaaaguagcaucucuuccuuugggugcauauuguaauaaagggguggcacuggggacccuauuucugaagaggcuguugaauaauuucuggauuugauuccucuauaacuuccaaagaacaggauuuuuuuuuuugguauguuuguaauuguuaagaaguuugugcaucaccagaaauggugaucugcucacaguuuucuugcuccucuuuguccucucuucaagaaaaacugcuguuggaacuuucaauuucauuucuguguuugggcagauguauguugaaacugucagcuguacaauguaauagaaaaacaccagauugauacaggacucuagggagguggggugagccccagccacuggcuguggguggucugguucccaauggacucuugugccccugggcugaaaucaugucaccugucaguggcaggaccaggccagacaaguuuugcacugccuaaucugcugaggaaaacuggagucagccuuggcuuccacacacaucaauuucuccuuuucuuucuguucaauuugcccguggccccugccuccacgggcgugucaggcauccaguugggaggcguucagguaaguccucacuuccuucaacaucucuggcaguugauuuccuugagaugaggcaaaugccuucaucauaguaugugcaagggacuuaguguuauuucucugccacuucucuaaggaaauacaugcugaauuaaguuuuaugaguugguucacauucgaugacaucauugaaauccagggcuucagcugcugugccucagcacugguugcagaagaggggcagaauaggauuugccagugugccuugugugggcaugucuggcacaccggccgcagagaggguggaaggaccgcuuguacuuccugacaggccuuccucucuccucccaggcaugggcagaugccuuuaggagcaguccugaccucacagguguugugcacauauaugaagaacugaagaggagggggauugaguuccccauggcggacuuggacgcccugucuccuauccacacaccccagcggguaagcuuccagcuaguguuuucuaggaagacugccuguagaacagccaggcguuguaccagccuuuugcugaugccuuugcauuauucaguuugucauguguucuuaaagcuccagggcaauucuuuuuaauaacaagggggauucagugggagacagcugggugacuggugauuaaguggcagcaguguuucucccaguuucacacugacaguggaggaauaugguagaggguucaguugagcaguuuucauggaaauggcugcuuuggcuaagccuuccugugagggucauuugcaccugcauuacagaagacuauagaugauguaagagaaucuguccuuauuuucugugguaccaaggggugaugcuugcucaucagaggcaaggagcaacucuuagcauaugguacaguauauauaucaaguagauaauuucuuuacuuuuaauauaguacuggagauagaacccagggccucaugcaugcuaagaacacauucuauuacuaagccacauuccaguccaaucagugaaucuaaaguguauuuugaguauggucauccagcaucaguccaggcauucuugaauucugucagcgcugggccuuagaacccagaaaaggcccguuuuaaagcauccugaagaaccucuuucacugcugauagugaccagaguggccuuguuuuucagaauuaaauggaugcugguagugccaaucaugguuccuuuggguuguuaguuucuguacuggcaaugaagcagcucccaguccagaggacagagccaggauagcccagucugaagaggcaccagggauggcucacauggccuuauugggcuccaucugccugccucucauauggggaccucaaggauggcaguaugccucacacauuugugugaacguauacuaauauuggugaauauaucugagaugaaaccuaagugggcagaggacauaaagaaucacauuuuccaaagcauuauucuuguuaugaucccucuaaaccaguuaccuaugguuuguuguauaaacauaacccguuuuauucuuuuauaauggcacagaaugaacacuguuauuguucuaauaauuacaaagaacaaucgguaaauuacaugauugcuauuuauauuagucuucuuguaaaggccaaauguagucuuguggcaccaaguaaggauucaugauuaguaaaugacuuuuggguugcguugcuugucugcagcacauuguuuggaagggagggaaaagagggagaggagggaaggagggaggaaagaaagagacauugguggcucugcugcccugauaaagagacucaccagaguucuguauaaucuaacugaaagcaccaccuauguuagggagagugccaugcuaaggcacuuaggcacccaagugaaucaaaaaauacuguuguugucaugccagagugucccagaaauggauccagcugccaccauucccaggucccagacacagcccaggacaaccgcuggcaccuauuccucaccuccuccagcuuccuacucuacucugcaggccccggcucugagugugacgggccccaucacagccaauucagaacagguauucaugugcuucuagcccauaagcaaaccagcuaacugcccucgugugccuuuccaggggacagaacauacacagcacagaauaguagcauacuagggaacacccagugguccaucugcagaguggguugacauaggcugagugggaagaugagugacaggaagcaagguccaaaguaaaggagcauagcugagcugugaguagcuguuuacccuuggggagagcaugcaucccaugagcugugccagccauuacaguucaccuuuaaucaaugagguacccuggaggcaacagcuagaucaaggaagccucuucuccugucugaggguuacuuccugauaaguuacugauaguucuacuaaguuacauuuucaggggauuuauagagacuguuuuuaguuaaaucuacagaauuucuauuaguugagauuuuagaaugguugagacgugggaaaauauccuugguguuuucaguuccuauuguuauggugccaguacuauagaaccuuguuaaaauggguucaggcaauuguuuauagguugcaguacuguugugcuagagcucuguccuucugccaaugcuaagggagagcaugaagggaaagcaggaugcaggcaaggaggcacauaggcuugggugugagccacauucucuugcuucauguaacaucagcggaauagcuccuccugcuccuccuccucuuccucuugcucuuccuccuccuccucuuccuccucuuccucuuccucguccucauuuuccucuucuucuuccuccuccuccuucuuucauaaacuuuuauuuauuuauuuauuuauuuauuuaagauuuauuuauuuauguauaugaguacacuguagcugucuucagacacaccagaagagggcaucagaucucauuacagaugguugugagccaccaugugguugcugggaauugaacucaggaccucuggaagagcagucagagugcucuuaaccacugagucaucucuccagccugaaucuucuuaaccaagauguuaaggaggcucugggaccaccccugaagugaggcagaggguagccuuuuggagccuagucuaucuccuaggugaaaguugaggugggucucuuuccugaagaguuugcugagagacuccuauagcacaggagaggcugagggagaccgguagaagauguuuauacucagguaagccaggaaaaauggaaagaccuugcuaggagagauagguguggaucuggaauauaucucuugcaggaaaauuacccacuccauucagcucgggaucauuuuagaaacaggcauuccuauggucagcaguaugcauuguaccagguauacaggcacaaggcaggccccacagcaaccugugagguguugggguaucagucccuucccauaggugaggggaugagucucacuguggacagagauggccccugugguuuccaaagguuccuugaaaggauuagaguccucaggagguaacccaaaguucaggacugaaggacaaagggagacaguguacaguaugccagcugcaggaaaggaggcucaggguuuggagaugcugauggcugggcagggcgggcagcuuucagaagucugcuuccacuccucacccauucguuucuuauuagaagaacacauggaguacuggucagccuccguuaaggugugacacuggaagggacagagucuaugugcaugagggucacauagaagagggacuccacccuaaagggaucuuggagcaccugcacuaccauucucugauuuuagagagaagaaacagaagccccgucagguuaaaggcucugcaggguccugugggaggagggcaacaagugcucagcucccuccugcccuguguuccucccgugcugugacucagugaccagggcgcaccaugcuccagcccucgguaggcagagcaaggugggugagaggcuacuccugugguucagacugaucuaggugaucucauagugggcaggguuggcucaggccuugggcugccugguucugauccuguagcucacuaaccuucuuccuaccuucuccuugaccuacagauugccaggcugcgcagugagcuggacauuguucggggaaacacaaaagucaugucugagauguuaacagaaauggucccugggcaggaggauucuucugaucuggaacuacuacaggugaggcuaaccuuagcuuauguagcgugggcugagugccuggccgggcuuucaggggaagugccagugcugccuacugugguaccauggcggagaggguccaaggccaugcugguucacauucaaccuuacuucuuggagaggggcagaagccaguagcacucucuguccuguaauuuuuuaauaacuuuuuuaaaauauuuauuuauuuauuuauuuauuuuauguauaugagugcucuaugugcauguacuccugcaugccaaaagaggacaucagaacucauuauagaugguuguaagccacaaugugguugcugggaauugaacuccggaccuuuggaagagcagcugguguucuuaacugcugagucauuucucuagcccauauuuaauaacuuuuucccgacuuaaaguaccaguuauagaguaugugccuauaaaaaaauaauuuuccuuaguuuuuagccaucugcaauaaguggaguuuauauuuugauguauuuucaguuagacucuuuguuguauucaugcauuuugcauugaguugaaauuaugcuguguguacagucuugugcauggcuuugcucccuuguuacuguauauacuguauauauaaauguccuggaauaagaguucuugggccuuauuccagaagaagcagugcuagucucucauccuaaggcaggagauucugagguaaagucaaagccccuguucucugccucacugcugggaccacucaggcaugggaugaacacugugcuuccuaaaaggcugcugccccaccuccacccucugucucugaacacucuagauggugaugcuggaguugggacauagggcccugcacacuagacaaguuauuccacagcugaaccguaccuuagcccacccuacauaucuugaacauggcaggaaauggagacagcaggaagccaggcugcagucucagacuccaauugguugagggccugugaggcccagaggcagaggcagagcccugucacauuagccugcagugacuccuguacagaaaguggcuguggcacugcccuucgggguagugaccuucuggaagggcagagagggggaugcugugagcugcagguaccagaucccuccuccaagagauaggguauaugagugugcagaucaggaaucaugcuggcuuggugaccuaccuggccugagugccucaugauaccccugcuacugcugcugcuguuucugucuggcagucuugcacaccugaguucugcaucucccacuuugcugaauacacacacuggucacccaggaaacuuggcucugaugcuccugugcuuugguaauacacaugcccagugguucugcuacuuggaguucccacuccccacuccaagcucuuaguuccuauagagcaaggcaugguaaaacuuucuucugguccagcacugagcacagucuaagugucguggacaguaggagauacggcuucugcucuagggagcucccagcuaaguacaggagacaaacaaggaaacugcugacugcaagagaccugaacaucagacugcuccugaaacugagaugaauacccuuggccuaagucaguaggagcacugaguaucucugguucccagacuucacuccugacaccugcagcaaaccaagguccugauucuucagguggugaucguguguuaccuacucuguggacccaccuaccuugaauacaccaucauuggccccuaacguagccugcaggagggcucggcuaggcauccuagggcacacaggacucugaggccagucuaguaugauauggugacuauguuguaucaguguuggaauuccuuauauggggugggggcugucgcucugggcagagcugagcugacagaggaagguggguugaacacagcaagaugguucuagacaggcagaacagagagcagagauggucugugugugugugugcacaugugcauaugugcguguaugcauacaugugcgcgugaacguauugugugugugugugugugcauacuuaugugugugcucgaaugcauguacauguuuugcacgcaugugguucuaggguauuuuguuuguuuguuuaaacaagcucaucagccaagaauaacagaaccucgucuccuggcaucagcucaguuuucaaaaauagguugcuuccaaugacauuuuccuucacucuguuuuguuccaacucagagccuacuggcccccacugcugucauauaaaucaaacagaaaaagaccaugucugggagccugcggggggcugucauuucagaguagaagaggcagaaacggguagcugugugaacagacucacuuuuccuggcuggaggccaccgccuuaugucgcccuucuucugccccagcagucaacaaccagcaggcaggggcucucacagaauagugagccuuccauaugggaaaaugccgcuguccucuuggaacauggaggggucaaaaucugccccuaacauuccaugggcaauauggaagacagccagacuacucagggcagaaguaguccagagcucaggaugcuagccagggcacuagaaguaagcauauuugucaccagcccaaauguucccaccaacagacacaagcugcucuugacacaguguaaguugaugacgagaagguucagggaguuggaggagaggggauuggagguacugaccucaggauguaccuguggcuaguuguacucaugggcaguuggcaucuugguugcuuccuguuuacggcaaaggucuuccagguguguccuuccacagcccaugagagcaacagggaaacuugugaacuacuugucuggagauuccuggaaaagugacuuguaccugaggaaaggccaagaccaauaacacguagugcugucagcuuugcuggaggccccaaggagguaagauguuggaagaggacucucagcaccucccaggguagaugucagucagauccucuacuuucugaguugagcaauaucuuccagacagcuauuccaacucaacaccugugcccagagucccucuccagagucuuggaucaguuauuuuuucacagcccagugacaggcuguucuggcugucauaaaagcacuauuuguuuccagaagccaacuagguuagccucugagcacagcagggcagacaacguacaaauggccagaugcacaucuggaaggcugcggguaaggcacggcccuuccugugccuggaucuccuuccuuggugccuggagugauugcuuuuacugugaacuuggcugucacagggcauguccucugugaaucauagcuucuuaacuauuguuaaaaagccccucuggacacugaacccaagucuguucccuguagcuuuaauauggucugugcuagacaaaagcacaaagaaaaugccuuacccacguggguagagccuuggguauccaaggacugcuguaagcccuaccuacuggccgguguccaugcuggugacaugccucuuguauaguaacaggcagcccaccacaggaggcagguauugucaaacccgcugccauccaguaccuuuuguuuuguguuuuuuuauuuugagacagucuuaccacaacuauggcugcccuggaacucucuauguugaguaugcugaccucaaauucagagacaugccugacucuaccucccgagucuuaguauuaaaguguaugucaccccuggcauggcgugccaccugcaucucacauauacauacacgugguugagcccuggagugcaaagcugucguuuuccuuccuaaaguacaugcccucggccaaaacagacuauguuuuacugggaucuaauugagccuuugcagugauggauauuguauaggucucuaucagauggaaagagcccucucugugcuguuuuuugaguaccuuguggccaucccugcucacuuugugcaucucauuucaacaaagagaguggccaagauauucuucccagaaaaaaucuagcguaucccacaccucaugcucucccuucucucuuucaguggaccuucccuccuccccguccccuuugcugcugcaacaggacgagucuucaggacugaauucucuguuccuuugccuugaaaaggguuuagaggauaaaaagauuauguugugagguagggaugaaacugucucuugaagggaagauaacugcaucaggguuaacgaggcagcaaagaggguauuugauccaguguucugacugacggcaggcauuugcagaagugacuggcugcugagaaccagagauaggaggaugccagagcggaaggccuuggcacugaaggaauuccuggcccagagucugcaugguggaaagaaagaccugcacaaguugcuggccucuggcccaggagagaaucagucacugcuccucaugguuaagaauagagggggacugagguaucuccaacagccuucugugauggcgguagaugacaccagggaggccaugaggguggucggcuggcacagaguggcacaaaucccaagguuaugcuccaucucuuuuuccuuuucuuuuuaaacaugauuuuuuuaaacuuuuaaugaugugccugugugaggguaugugcauguaaguacagacgaagaccagaaggggacaccauaucuccuggaguugggaguuaugugguuuugagccacccuuugugugcuaagaacugaacucggguucccugcaacagcagugcacauuuuaaccacugagccaucucuaaagauguauuauuuuacguuaugcauauaaauguuuugucuguaugucuguuucucuugugugccugguaccagcagaggucaggagagggugucauguccccuggaccuggaguuacaggcaauugggagccauaaguaaaugcauguuguucuuuagaauuagaaugcaccacugaaucaugacacaugaauuuuagauugcuaauauauccuuuguaaugauuucauuuuacauauaugggauuucaucucuuuuuuacccuuuuuugagacacugguuuaaaaguugaagucaggaaaugugcagagaccaugagucagaaggcuggaaugugugagccugucccugggcagagugcuugugacagcccuggaggagucuuccacaguguggccugugagacucuggagagagguuucccuuccuauaacccuggcaggaggaguggugagagaggcagcaaaugcggucaaagcaggugcuucuuguguuagugucugagcgcacuugucuguucuuuccuucagcaggccucuagcauuuuccuaaugggcuugaaaguaauggaagucuuccuccaacucugcagaggucugggaucagaccuaugaguauggagaauaucucuagccauuccugcgugcgcugcugcugcugcugcuuaguccucagcauccuuucuggguggggcucugugguggaagccaucacagccuugcucucuuccuuuguaggugggacccugaugcuuuaagagcugcagccaugaguuuugguuaguugcuugguuuugauuuugccgagagacagcauugcauuaugcugucuuguauggccucucacuugcaacccaccugccucagccuccugagaucauaagcauauaccacaaugccuaacacugcagugucuaagacacucugcagugugccgcauggcucuucugugaaucuaggaucugaaucuaacagcuacucuuuggagcagagcaagcuagucguuacuugaaggcucugcuauaagagcuguacugacagugagaggcagcagaugcaguccaggucuggaaugcugugugagcucugugaagggagggucugccaggaucucuagaaaacauucugagugggcagggaggugaauaugugggaguuacauggcaaagcugacacuguaaaauuuaagugguuguacuuuuguuauauauauauccacauacauuuguauauauguauuuuuaaaauauaucuauuuuagguguaugagugcuuuguguguauuuauguguaccauaugaauaacuaaggaucuugagaauuaaagcugggcucuacaagaacagcuagugcucuuaacugcugauucaccucuccagcaccugcaugguguguuuguuuguuuguuuguuuguuuguuuugagauaaggucucuauauaucucuagcuguccuggaacuugcuauauagagcuugcugccuggccucaaacucggagagaucugccugccucccucccgagugcuggaaagguaugugccaugccuagcacuuugcuauauuuuugaaaauuuauaugauaacauacugggguagggacacauccuggggucuggaaggauacguuaggaguuuaaugaaaggaaaggacauuguuggcagagggccagccccuugccaucccugagcagugugguaaguucgugaggccaccucucauccaugucuaagacauguuuggagaugaccggugggcucuagaaggugaugcucuagaacuguuugcagcaacaugccaugugcccucugacuugcaggucuuccaccuugccauuggccuguaguuggaaugagaacugacugacuuuuuccuucucuuucuccaaccaagcccccaaggauugcugccuagccauaaguauuagaaaggguccugcuuuccugcccugggccuuugugguggacuuugccuuuguuggagagccucuuccagggaccauacuuccuucuccaaaucuaggguaggaauuuuuggagagccaagaggaggggucuguucuguucagagaagcaggcccagacacuggcguuccuuguguggugcuguucuggcagggcagacaggaugacaggcccugcaagggucagauccagggcggaaggaggcucaaaggaucuuuuguucagguaaauaccagacucucagcuaccuaagugcaagucucuccuggccuguguuugagugcuuccagggugauccauuuaggccagaccuugauccuuaguaggcguuauggaacucugaggcugagcacuaugggaagagagagcagucaggccuaggacacacaugucauagcauugagagcugaagcacugaguggguagagggccaccugccuuguguacucauucucuagggagcauuggaaaaugcugcuacauguuguccuugguggugagaagaugggaagagaggucuccuagccaggacaguaggaugaugagacaaaaagaggcaaagauugccugugcuugcugugacuagaucugguagucuauaagaccuaucugcagacugaggcggugcugagguggagcuaugagaaguuuggccagcuuuagugucuguucccauaucuaacuggauuauuagcuccccccaguguccaggaacaguauuucacuucugccucgacccugauggccuacaggaaggcugaggggccagccugaccagccugccauguuuccucuguaguauccuuaguuugacauacaacagggcaggucccuagcgagugcuuaaggcucucugcaaacaagauccuagcuaggagcuugcucuggggcaagagggcuccuauaaaccagcgugugagguacagggucugucuuaaggggaugcugcucugaagaguugagagagcuccugugguggcugaggguugcaggugcagcuuuggccaacagagaacucugugagaacuguggugcuucugagauccuagcaacuuaacagaugugccacuguaaauuacaugacgcugucauaagauccaguccugccauugcuggcaaugcaagcaaacugccccauucguggagggccuuuuauucugaccaccaaucuguguucuaaauguaauacuuucacuagagagauucuauuucuaaggagcucaugcuaugcaaguacuugcccaacuauguaagaauuggcauaaguaugaauuacauuguuuggguuggccaaagaaaaagauuaccacaagccacguacccaucaguagcagguagcaagcucuguacagugugagaugcaugugaagaagugaggcaggcuguacaaagucguaggcaaaggagccuaggagauuuuguugaagagaagcaagcacaaagcaucaugcuuuucuaucuuaaaaauaauuuguacugggccuaagagauagcucagcaguugggagcacugacuacucuugcagaggacucggguuugauugccagcacccacauugugcaguccacagcugccugugacucuaauucccggggaccugacacagucuuccagcuuccaccagcaccugcgugcagguggugcacaagcauccucucaggcacacacacauaaagagaacgcuuuuaaaaggauuuguaguuagcuguugaagucauccaaccccugugcagugacaguucuggaauuuuguuuucuuuaaaaacacagaggugauggagagauggcucagagguuaagagcacugacugcucuuccaaaggcccugaguucaguucccagcaaccacaugguggcucacaaccauccguggugauaucugaugcccucuucuggagugucuaaagaaagcaauaguguauuuacauauaaugaauaaauaaaacuuaaaaaaaaaacacagaaacauuauaagagaguauuuuuguuuuaaucccaggugugggauaugaggcugcuccacacugaccacagcagcugacuaugauuugucuugugcuccagcagaggggugguuuugacagcugcagaugauucugugacugugugauguuuggaauucugggaacuuuucagaggcucuauaaugauagagcccugagauguugguugguuguugguagucguucagggggauugguugcaggguuuuuuuuguuucuuuguuuuuuugguuuuugguggguuuuuuuuguuuuuuuguuuuuuguuuuuuagacaggguuucucuguguagcccuggcuguucuggaacucacucuguagaccagacuggccucgaacucagaaauccaccugccucugccucccaagugcugggauuaaaagugugugccaccacugcccagcuguguggugcaaccuuaacacuagagagugaugguuuaacuuuauaacucaaaucaaacacaggcgaaagcuuaacugacaaagacaaagcaaaaugguuguuaugguauuauuucagccauccaaagcuuuuuucuguaugugaugguuuaauuaauuguuuuguuuuuaguggaauuauaggaauauaucugcuuaaauagccuuacuaaauuguaucuuuauagguaucccauauugauuuccaaauuuauuugcauuaaauauucuuuuuaaaaaugacuuguacuaacauacuuguguaugcucagagguguguguguguaugugugugugugcacgugugagugugcaucucugugugugugucuggguaucugugugaaugcgugcauguguguguccgucauugugugugugugugugugugugugugugugugugguugcacaugcucgcaagccuacagaacuacuugcuuccucugaggcaggagaggaggaagcuguuaacuucacauucugcacacgccugauuuuaugaacaagcauguacuccuucugugacuuucaagaaacagugcaaauccuuucaaaggcaguggaaugugagaaaagcauucccagcaggcccugccagaagugcauauguucccuaggaauugaacaggaccugccgagccaugcagcaccgcauaguggagcucaucucccgaguguccaaugaggaggucaccgaggagcugcugcacgucaacgaugaccucaacaaugucuuccuccgcuaugagagguggggcaaaguccucggggucuucuccuugagaagaugauugguguaucagaggaaguucauucauaaacaaagcagggagaggagccugggagccugggagguguuagagguggggaguagucaucagagaugcucauuugcucuuggaugacagaaaaagugcuucuuguucuccagagaacagaagagcaggcagcugacugcagccuccaccucugcucccugugagucccagggagggcugagacaggguuugcaccugcuccuuugaugauccuuugaauuugaaaaggacugggggaggggaaccuuuacuaaagaacaggauuuccucuauuucuagucuugaaaaaagaucauucccuuuguaaaugucaguacuucugggguauugagugaaguaggcuggaugugagcacuguuucucuggggaaacacacuuuucuucacuucuuccugcagccaaaccacuuaaagugauaaacuugaacccucuuuuuucuucccgaagccucccacaggacaaaguugguuuuuuuuuuuugguuucuucuggaccuagcuuuacguggguaguguggaaaacugcucccaucuguaccgauuuaggcacuucccaauuggcccaggguuguggcuugcuuugacucuaggccagccuucuccauuaaaggagccugacagcagugugagccccuuggaggcuguagccacucacucugcugacuggcagguuucuguauaaguuugucagaggacagugcuaugacauaaguaagaacagaacacaggcacuguuugcuuuggaggcucucuaacccaguaguuccauguaacccuucacuggagauguacagcaggaaauaaugugugaugugugacugcugcccauaagcccauugggcugcauuacaaagaugucagaagcaccucugcaacacacacacacacacacacacacacacacacacacacacacgugucucagacuggccuugaacucuugaccuuccugccccagucucuccccaaaugcucagauuacaguuacccaccaccaugcccauguagucuuucuaguucucuuuuuguuuuguuuuuguuuuauuuauuuuuuucaauaccuccuuugacuccgcccaguccccacccccucucccucagauccauuccuuccuccucugucccuucagaaaagagcaggucucccagggauaucaacugaguucagcauauaaggugggauaagacucgacacaaacccucauaccaaggugaggaggaggagaggugucccaagagcaggccaaagagucagagacaccacccccuacuccuacuguuaggaguccagcuaaaacaccaaguuaacaccauaacauacagacagaggaccuagcacagacccacacagaggaccuagcacagacccacacagaggaccuagcacagacccacgcagaggaccuagcacagacacaugcagaggaccuagcacagacacacgcagaggaccuagcacagacccaugcagagaaccuagcacagauucacauagaggaccuagcacaggcccaugcagaggaccuagcacagacccacgcagaggaccuagcacagacacaugcagaggaccuagcacagacccacgcagaggaccuagcacagacccaugcagaggaccuagcacagacccacgcagaggaccuagcacagacccacgcagaggaccuagcacagacccacgcagaggaccuagcacagacccacgcagaggaccuagcacagacccaugcagaggaccuagcacagacucacauagaggaccugugggacuuguucugguguccuucacuccucuggcuccugcaaaucuugugggagguuuuguugauguuguuguuguguuuguuuauuuguuuguuuguuuuuaaaacaggaucucucuauguaguccuggcuguccuggcacaaacuuuguagaacaggcgggccuugaacucauaaagaucuccugccuguaccuccuaagugcuaggauuaaaggcaugugucacuaucccugaccuauaaaaacaaacaaacaaauaaauaaacaaacaaauaaaugaagggugcagucucggagcugccaugguucacuuaggucugcccaccuugagucaagccugucuucuuuuccguuuuuuuuuucuuucuuucuuucagaugcuggccagagccuaagcaugcuuucucugguacacugguguuuuccacucuuaccuaaagcaccccucuuugccacacaacucugcucuuuugagccccaccugugcaucuacaauaaacccucuaaaauucaaaccaaacaagccccucuguguacaccuagucagacuguuccuucugguccuuugucccagaugcugaucacaccuacugggcuggcagcauagagcagugccucucuggucucuaguuucccaggcuguggcuggagugagcugguuggcuuccccuuugucugugccauuuggagcuuuaaauaugaugcagaacagggucuguuauccucuauggacacuucacagcuucucccagguguaaggaugacuucuggcagagggggcugcuugucuucaguugcucucagcuaagcucccuuuguagccaucugcugccugggugugaagcagagugucccuggcagggccugcuucaucuuggcuuccuggcagcacuuagguagguggcacaaaacaucuuaugguuucuagcaaggccuuucuccagguucccccuucucuuccugagguugggcuggggguauuuuuagccacagcuuauuacccucaaacagaguucuguggaguagagggagcucugcacuucccugccaggcuucacaaaugaccauguggagaccuggugacccugucacaccuucagagacuggaggagcauuagggccagaugugugagaagaugacuagggaggcuucugguggccuccuagaaccagcuaauaaauacccucuuucugaugcccgcucagggugcuuaugggagagacaguggaccuaaccuguaagacaggagccuguguucaggaaagcaugacacauugaacaugugagguccccuccacuaacaguacuggccagucuccugccucugcugggucccaguguucucaggacuaugggcccagcccuuugggccucacucacuuccuccuaugucugcucucuuucccauuagguucgagagguacagguccggccgauccguucagaaugccagcaauggaguaaguguucuuggagcucccuugucuucugaggcgggcacucacucauacacaucagaguguguagagcuuggccuacuugggccucacuucuagcuuuccaacuggaaccaaauacaaaugcuuggguaagcacagagcaagcucuguuugaaaagaagcuggagagcuagcaggcauccugaugggaaaggcagaaggaauacagucuacggucauuagugaggcagcauuuuagugauucaguauaccuuccgugagggaggagggaagggcacgaggcucaccgcuaaccugaguccacagugaauccuuaagguagguaaggagacccauccuccauugguuggacagcuuugaugcccuuccucgugagugcaugcagaucuguaugggguugcuggagcguagccccagggcugaccucaugucaaucucauguccugacagguacuaagcgaaguuacugaagacaacuuaauagaccugggccccggcucccccgcugugguuagccccaugguggggagcacagcacccccaucuucucucuccucccaacucgcaggcuuggguaaguguccuaacguggagggaagggccuccucccucccucccucccucccucccucccucccuggaugucuuucucuuuguuggaaggucagagaaggccuuugcagugguccacaugaaggugugucucugagucccagccaguuauaccaccuucuuuuuauaaccuccuuccugaaaucugaaguuuaagccuuuguuggaaaguagaggugaggacguucuaacgauguagaaguuguuuccuuuucagaagaugaguaaucugccacguuguaucuggaguauuuauucuuugugccuguaaugauuuguucgucacuguuaaccaggcuaaagguggcaagugucuuaucucacuggcuggcugcucagaacauaggucugaagggcagcuacagccacacggucccaguuucauuuccguaacuguaauaauuacccugacaaaaaagcaacauaggagacugacguauauuuggcuuacacuuccaaguuacaguccauuguaggaaggucaaggcaggaacuugaagcagcuagucacauccacagcuaagagcagagagaaugaauacguacacuuauuuguacucagcccccaccucuauauuuuacaguccagaacccaaacucugggaaucuugcuauucaaaauggaugggucuccccacuucuguuaaugcaaucaaaacaacccccccaaauguguccacaguucuaaccugauuuaaagaguuccucaucgagauucucuucucaggugauucuagaguauaugaaguugacaauuaaagcuaacuguuauacaucaaucccuaaaagaugaaucugggauggauuggcaaugucugcacagggcuagcagucagaaagugguggugugauauauuugccuaccucaaacuguaccaucaaucuaaaguguucuaguguaugaaauuuaggagaaccgccucccuuuuccacagugacagugugugaaugacucuguauguuucauuuauaccaaauuauagaaaaugaaauucuaauauuggugaagcuaacagccauggccuucaaaauucucuccucuacuuugauuuuauguuuucuuuuucuaauaauucuauaauucauuucacuucaauuaaacuuuuauucaguggccugucaguuguuacaauuuuggcgucucaguuuucucuguagcuacaagguagaauagaugucuguccuuucaaucuaucuagcugaugacauauauuuauauguguuucacguguauguauguauauauaaauuuaaauuauaaugauuuauuuauuuaguguguguguauguaugagaaagauaguuuguguauaugcacauauggagauaaaaggacaacuugcgagaauugggucuuuccuucuaccauguagauuuuaaggauuaaaugccgagcauccaccuugguggcaagucucuuuauuugcugagcaaucucacugguccuauauuggccuggcuuuuugaauagccugccuggaacucaauauguagcccaggcuggucuugaauucacagcaaaccuccugucucagccucucaagugcugggagcuccaguguaagccaccacguuuaauaccuagaauucacaguguaucugccgcuuuuccauuugacgcuuuaccuuaugcucagcucugaucucccucuuuagucgugcauuccacccaagggcucacacuuccaaugcauggcucuggcucuguguaccuaggguguaacucccagacccugagacucugugucugaguggacgugguggggcagggccugaggaagcugcuccccugcucauccucucaccagcagcagucuccucucuguccuggacaccucucccuccuugagcaguuucagauucagggcaaagccugucucccaccuugcuugcccugguucuuguguaugcuguccugggagcugaggacaccuucucacacagugucguaacccacuagacuacuauccugacuuuugggggcacuccaucaaaaacucauauuuuggggccaacaagaugauggcucgguggauaaagauacuugguaugcaagucuuaugaguuacaugccuccagacacacagacacucagagacagccagccaggcaaugauaauaauacaauaauaaaacaauuuuuaccagcuuuuuauacaaccugcauuuguugucugguucuuguuuugcugucacagacuuggggacagagagugucaguggcacccucaguucacuucagcagugcaagccacaagaugguuuugacauguuugcccagaccagaggaaacuccuuggcugaacagcgaaaaacguauguggggcucuucccaguggcuuucugcagauauuagugggugaggggguguugucccagcauggucacauuaaaaggagaagcagcccuuucuuuaccagauuuaagacuucuagagacauaaaaauaucacagucaggaauuguuaacugcuaaaacugagugagugccagccucgucuccccuucuccucugccccaggguugucuguucuguuugucacagguuguuuuuuuuucuuuucuacagcccucuuagggcugaggagaaagcguacugaccuaacauggcugccucguucagccccuccacccaaagcaggcagccagaccugcucccagcauacaaccaauugaaggcaaaacacaaaacagaaaacuucagggcagaggcuucuccaagcaguucgggcaaggcaagccauacacaaaggggauacugacuccagaguggacagccccuccaucuggaaguagcacagugggggcuggugcuuguaacauaguuacuuagucuucugaagccccuuccuugaugaccagaauauuuuugacaucuuucucuugagcuucaauauuguuacucaaggcagggauguuugaaaagcauaguaucccaggucuuagaagaccgacucuaggugugagcuggugccaaaacuuaccuccaccuagcaucugcuggguccuuagccuuugcugcaggccaagaucacaccugacgcaagcaccaugagauaggaaaagauuacaggucacagcacagcucugcacccacugggagggaacucauuugcacugcuuuucuucagggucaccuaugaggauccccaggcuguuggaggacucgcuucugcacuugacaaucggaaacagaacucagaaaugguaggucuucacaccugugugcugcccacagucuucuggagaugaggagauaaagacaggcaguuugggaaaguuggcuggauaguucagcagaagaugacagagacagcccagggaaggucccacagagcaccucugggugguggguagugcacagauaaaauauugauccucacaaggacaguaagugcugaucugagccaccucacuccuggccaaucaaagugguaccgauuccaggggaggacaguugagggucaguacuugucugugagguggcuuggguaguguccugucacaugcuaggccuggaaagagucaagccaagagucagaagguuuugaaauaaaggaugaaauugccccaaaccacagccaguuccugugagcagucagaucccaggggaaaaggcucccaggggagaagacccuaugcacuugauacacagauauucucuuuugaguuugcccaggaaauguaugggaaugcaugccugucagccuggcaaggaagaagacggcucccaggacccccugggcuggaaugacaggggacugugcccacccauucacuggacaaggaagggcccuuugcuuccugcaaccagaucuuagccuccugugguccuuguguaaagggacugguggggacaguacauuaucccuggcauaauggaaaggcuuggucuugaggguggggacucugagcugguguauguaacucuguaguggcuuccaggaggugcagaagagcccacccacugccuugcucucggcauaccaccguugcauagugguggccaacugugacauugaucauauuacacaguagucuccauucuuucuccaauuacuuagacuaucucugccauugaacacagcaagaaaauuaaagaacuaggccaggguccugccaguguacugccuagugaagaugagggugacccccuccucugacucaccucaguuuggagcagccuuguucuccagcaggcucugugcucaucaccccaccaugccagauguguccugcuccgacccaggccauuaucagugcccaggccuggguccaaguccaggagacguggucuguuucucacccgucagccuuuaaaugcguggcuuggccuggcuccuuguuuacaaaggucuugcugauuucagcagauuuaccaaugauaguaggcagacugcuguuccuguuguuacuggggcaaggacuggccucagcaauaaagacuggcagcacaugggauagucauguguguaucuguaugugaacacaucugcaugcuacccugacccuuccuaggccaugcuguccuggcaucaagaacaaagcaaagaagagaaguuuguguagcaacacugcugcaaauaagacccccccaccucuagcuauacccuuuaaagaagcaggagagggcuggcaaaaugacuccguagguaaaggcacuuauugccagcuuuauacuugacuuacauccugagaaccacaaggugggaagaagcagcugacuccuacaaguuacccucugaccucugccugcagaguggcaugcaugcacagacaugcauguaugugugcacauacaaaaugaauagcuucuuuaaaaaaauuauauauaugaguacacuguagcugucuucagacgcaccagaagagggcaucagaucccacuacagaugguuaugagccaucaugugguugcugggaauugaacucaggaccucuggaagagcagucagugcucuuaaccacggauccaucucucuagcccaugaauaguuuuuuguuuuauuuugcuuuuuaaugcaggaggucuguggguguagcucacuuauuuaguguguacaauguucugggaucagcagcacaaauaaacaaacacauaaacauaagaaagcaaggaagaguaugcugaauucagcguucaagucgagaauuaaggaaaaaauacgugggcaaguaggaugcagaaaagaaaaaaaaaagcagagugaauuagaaaaggcuaguucucugaaagcugaccccuucagccaggcaacaaacguaauuccagaggacugagacauggggauugggaacaccaggucagccuagggaaagaaaggaagaaagaaagaaaggaaggaaggaaggaaggaaggaaggaaggaaggaaggaaggaagaaagaaagaaagaaagaaagaaagaaagaaagaaagaaagaaagaaagagaaagaaagaaaggaagggggagggaggaaggagagagagaggaaggaaggaaggaagggaaggaaggaaagaaaagaaaaaagaaaaagagaggaaggaaggaaggaaggaaggaagaaagaaagaaagaaagaaagaaagaaagaaagaaggaaagaaaaggaaaggaaaggaaaggaaaggaaaggaaaggaaagggaaagggaaagggaaagggaaagggaaaggaaaggaccuguccacucugguauucugaccucucagacuguuuggaagccuccaggcguuugagaacagucagcaugaacauuuuguuauccagccuagggcuaugaugguugaauuuuccuccucuucuuuuccaggcauguaggcagggugugugcuagggcaagggugggaagcaucagaucacauuuccuugugugacagaugaucaaaucugaacaaugacuuuucucuuuuacaauaugugguaugacuuuucuuuuugggacuuuucuguccuugguccaacagagagggagagguggggacucugaccugcagcccauagacagcuggcucaugacccaaggaauggugaggagccagagcugagugagcucgcugccuaccccagccccucacagugcaacagucagcaccucccucuugccaccugcccaguccuugugaccagacaggacacagaacacacacuuguucuggguaccaaaucucccccugugucuauguagaaucucuauaagggcccagacuuccagcucuggaaacaucuucccugguauuuuguugagccuaugccccugggucuucaugggcuaggauguuugcaggugugaggggguccuuucccuucuccagcagacucuggaguucucggcaguauucauuuuuccaggaugagcacaaguaaucauggcuugugcccaauuggaggggccauuguaagaggacuccacauauggccagucagagaagcucccucuugcccugugccugggaauuuggcaagccuaggcuuggugggcuucuauaguaugauagagucucacacguggccuggagaucucuugcagaaauguguagaugauaguaagagaggaaaaagaggauaaaucugggaaagcuuauaucacacgacaguguacucucauauagagcuuuugugaccaaggcuugggagggucguucccaccuuauccauucagauggcccugagcugggucccagguugugugccucaggcugaccacgucacccccagggacaaaaaucaaauuucuaggugcaugugcaggugagggaggauacaaagaaauaagcauguggaucuuugcccuccagacauaugugcuaagucagauacauaucuaggccuuggugucaggccaggagcgacccaggugugcugcuguccauguaggauuuuuaagugacaggcugcuugcagcacaggggucaccugcuuaagaaaggaguaggccccaggugcaaacagggucugcaggcuccuucaguggugccccagcucucccucucccaccacaguacacacccacccugaguaagaaagcagucguuucuucaacugaagggggcuacccugcaaguguggguugccuggacccuggccuuagggcaggcuucuuaaaacggaaucucaguuguccaaauugagaagaucuagcugugugcccuugugccuguuagcccugcaaaaaaggauacugcccugcaaacuaccugaugugaccugggcagcuggugauggugccugucuuuguccacgccagccaucucuacccuucccuuccuguauagagccccagccuucaacuuuccagaaacaagcccaacuaacagcuaacuuagugugucuccuuccugcccacaguuuucucccuguuaaaacaauguguguuaacugcuuugccuuauuuccuguaguauagaaauccuaccuuuccaaaccucucaaguacaaauucuucauauggaaacuuuguguacugcugagugacaccaggagcuuuagaacaucccucccuuuggguugggguagagugucacaaaguuucacgacuccucuagagauagcuccaaauauaaacuucaccacugagcagguaggcguccuuucaugcuuggagcugggaacaacuguggaagaguucuguccucuccuggaacuucaggagugaggacagcuuguacaguuaggucacuacacuaaguguagugcguuggcaggugaagguaggcaagaucuggcuugagccaggaucaguggccuuccuuguccucccuuccugccuuugaaucuuuucugcuacuucuggcuggugaucacuugggaucaucuccuacuuccaggguacaagcagggaaauccagagcaugaaugcugguaugguaaaacacaccucuggucucagcacuaggcaggcugagacgggaggcucguggugugagccagccugggcuacacagagaccaguccaaguugaauaaugggaccuugucauauacacacucauacaaguagaaguaaccauaacaacaacaauaauaaugucaaagcaagaacagaaguaguagacuauucccccgacacucauucaugguccuauguugcucccuaaccaaaggggcagggcaaggaagaccaaaaauaguggguucuaaaaagcagggcuggagagauggcucaacaguuaaaagcacccacugcuccuguauagaacccgaguucagcucccagcauucacacugggccacucacaguggcuaugacacagcuccagagacucugaugcccucuucuggguuccaugagcccauguacuuacaugcacauaccccacacagacacgcacaagcacacgcacacacaauuaaaaauaaaaacagugaugaaagccuauugcugugagaggcuagcacuagggauccccacucuguaaccuggcagacacccagacauaaaaccaaaggaaaaaccaaaacuaaacaaaccccagaaaaccaaaacugguuggauccagugacagcaccuccccuccucuguuccuaaguuggaguggcccugccugaugcuccugacuucugcccaccacccagaaccuaacuugccacccuagcaucagcgcugucugagucucuuuggacuccauaagauggacugguuguuguuacaaggguggacgccauguucacuuggaccagaauuugaccuuggucucugugggaggguauucuagguggaguccuuucucuucgccuccuccugucugucucucucaucucucuucaaccuccucuaacagccugcagcuuggaccaggcuccaagaagaugcuaaaaccauggcaugugaaaaccacagcuuccuaggggguugcaggaugagcccuucaugugaaggauaugaugcuaaggcacccaugggccuggugacuuacucaaagccacagggcagaagcacaccaagacuucugccaugucccugucccucuaucagccaggggugggguggaguaggggguguuucucccuuguucugggccuccaggggcuguguuuuccagugaguauacauguugggucuggaucugggugugccuauguggggaaagggauacucugccugcuucccagagcagguuccuagcucugcuccuguaucagcccccuaccuuauguuagccuagcugauaagcaacacccgccuccucagaaugcgcccugaggcccaagagacucaguuccagugaccagacucccuugaguuucuaccuuagagcacagaaacucaaaccuggaagaugggggauccugacucaggaguggaagacucagagaaccacauugcagucacccaguucccagaugaggaaguggaggccaacccuuggagggcccaggccaaauccuccacgucuacccacacagcugaggcuucugaagcagaagaggcuggcuuucuguauugaagaaauggcucaaagagccacgccuugcccccagccgacagcugugcacugugcccagguggaguccagcuguggugucccggaugcugccucugcagggcucccgucagcucuuugcuggcuuuuaugacaugcacuaaacccagaguugcaugcauggcaugcaagugcccugcuucugaauuacuccccagcccucuacuuuuucuauuucuuuuuuugaggcagggucucuauacauagugcuggcuguccuggaacucacuauguagaccagacuggcuuugaacucacagaguucucugccucccaagcucugggaucaaaggcccagccucucuacuuuguuguuguuguuuuuuaaagaguuauuuauuuauuuuauguauauguguacacuguagcugucgucggacacaccagaagagggcauuggaccccauuacagaugguugugagccaccaugugguugcugggaauugaacucaggaccucuggaagagcagucagugcucuuaaccacugagccaucucuccagccagcccugccucucuacuuuuuaacaauuuuuaaaaaauuauaagaaaaaccugaagcuuuaggccugugacccuugagaauuagcaacacagugaaaguguccagcccuccugccggagauccuguguucuacccaacaccaaacaaagcuugcagauauggcgucucaguuucuucuagguggacugagauggauaaagcagaaagggcacacgugcacuccagcagccgccacagcugucauuucuuguuggagaaaucguugacuaagcugcagacuaggccuagcacauguccucuguuagucagacauugugguucaaagauaccaagaucaugaaaacagcacaugugugucaagagugugucacgguagaaagccccccaccccacccaccccugcagucaugagauggcagauugcacccaccauguccugauguucucugauggggaaggcaggcaucugccgugggcacugcaggcacagcuauugagcauccgugcucucacccuaaguaaucauuugcuuugucaccaggacucgugucauggagugggagcucccugcaauauccaguucaacaguuugaagugucugaggguuaaaauggcagcacagagagacacugucuagugauuagugggccguuuugaaaaugcuugcccacggcagggugaagcuugggcacagagcacguuaucagagcugggguucaccagcuugcugagggggacgcugcaaaccucuguucagcaugugcaggggccacaccuuuuggccacagauuuuaaccugcaaaacaggagcugguaauaugaguucuuuguucucuuccuuuucagguuagaguuuggguuuuuuuuuaauuuaauuauuauuuaagaauuacuuacaccaagucuucuuauugccuauuuaaaguuuauugcuacccuagauuuugacauuagaauguagccaacuaugggcacagcaccaucuuuucuucuucuucuucgagaaauacugaacuacuaauaaggcucccgggugaggcaccucucagucccaggguaggaaaagaggcagguugccccgacuaaaggccaucaccucauugucuaggcugggagccaaccuuuuucagugaggcucuagaggucuaaaggccuucacuucuuauccugucauaucugauagcaacuuaaaugauuucaguugcaucuuuuccagaaucucugcuccagggcccuuggcucaggccaaagcaugacaccucccauacccagguuggaggggaaaucuugcugcccccuagguauucugcucgcagcucacaguggacuacuugcaucagccccugaagcuuagacaggagaaaagguagacaaaaggaagcugaggcguuugaggcuacugaguggugguuuuuuuuccucacaagagagaaagaagacuaaagcgcuccguccuuucuugucaucaaagcccucguuuuagcagccuuccccauagaggcggagugagcccgcuuuauggaagcagggcacucccagaccaagggagcauaugccagcuggcuccuucucccacucacagagccaccuccuggagcagacagggccccagggcuggacugcucggcccuccuaagaacccgcacccugccuaggcaggugcuacccugguuccccucuguucccuucgguccugaaagccccuuguccugggguggucugugcugagggcagcugauucuccugucauggcugcuacaugacuaguccuuucuaagauuagaaaguguuggcagcucuggccugaaaaggcaaacacgccuaagcaaaaaguuauccauaucaagaacccguacuuugccgccaccagccccugcuuauaauuuaccaccucauugcucuccucgccugccauuucacauguagcugccugugccgccugugcgugcuguguaguuguuuuguucuguguacauuuugguuuuguuuuggggguuacuuuugacgauuuacuuuguucugguguucugucuucuuuugccuggcugugugggggcugccugaccccgcugcuugccgccucugccuucauagauucccguugcgcagcccucugucauggacgacauugagguguggcucaggacagaccuggugagacuugacuuuuacauuugguguguggguuguggcaaggcaaguguucuucugaggacaggccuuggggcuuguagcaggggcuccaccuccacagcgguggguuggaggagggaggcgagggcagcucgcucacaaagcucaccuuucuuuccaacacauggaucugcuggugccagcucgggguacagccucagccacacagcuccauacagugugggcagguccugucucacacucguggacacuggaaagcccacuguaaccacuuguaacacacacugaguccucuccagcuucccuuaaguggcagagguguguguuugagugggccuucugcuuggcgguuuuuguuucacguugcuuuuuguuuugagggaggaggguauuuuuguguuuugguuuuuguuuccuuucuuuucccccaaguuggggauugaagucauggcgcugugcaugcgagugggguaggggggugcugcauuccagcccccauuucauuuuucuuucucuccccucccccacacaagugaguuaggugcuugguuuuaaguucacuaccauccccauccccaucuucucauuuuuguuuaugagcugugccccaaaugaaugucucuccaucuucugggauggcgagaagaugaggugucugcagauggccucaagucagcucccugccccuuacagagcagugcacucacagcagcugggguguaggugguggcuacaggcuuccuguggcaacucccacacacagagggcagcaagcuauagucaggagcaaacacugccucuucccccgggggccaggccuucuaaagauacagccccagggggcagccagcugggugucagggaagguugaaagguccugugaaauccaggagugcccugaaagaauuaugucccucaccgaggcaggaucggaaagucucaggacccgucccagacuagacaaagcgucacacaccuauaagcccaacauuugggaaauggaggcaggaggauuagaacuauaaggucaauuuucguuacucggugaauucaaggccaaucugggcaucaugagacccuaaagaaacaagauucagaaagaauuuguuagcaaggcucccagcgaggcagugauauaucaggagaagcccagguagcuccacccugcugcuggggccuuuguauaagcucuucucuguccaaguguaaacccacuuaaauaugcagagccuccauggccuccuuaggcagcaagagcaggagcuugggaaggcuggcccugcuccuuggagaccgagggcgugugucuagguggcagcuucuuggcuuuuacugcaggagucaggcauaggccaugcaggccccaagcugcucuggcuauuaguguggacggcaucuuuccagaaucccugugcuggcugcacugaugugccucagccucaugguaaccuggcaucucuccucagaaccugggugggguucaccccucuggccagguagggaccaaccugcacaaauuuuggauuuuucuuucuuguccuuuuaggagaucaaaaccuagaaucuuuuuuguuguuuugguuuuuuaaaaaaacaaaauuuuuuuuuccccaagauuacucucuaccucucuaguaggaagaagagaaaucuggaggcaggaaaaguagcagcucacuuggguagccaugggugggcauaggugguggggugggcagggcagggaugagcccuaaugccauucucuacuccauccacagaagggugacgaccuagaagagggugucacaagugaagguaggccugaccguccucuugcucuccuguucccaacucucagggcugcacaggggcuggccccauacccugaacaggcuagagccaugugacgcugggccugagcccuagccuuccuggggacuaaauugcccugaggcacagagugcagggccucuugggcaucugggccucaguugaugguuaggcgggaacaucccuaguucuccacagaggcuccugcccuguuccggucugaccucgcccccuuuccaccuuccuucuauaccguuucccaugcuuucccuccccuggauucuuccaaauccugugucuaagaccagucuaaggaccugccagccgcgcuccagccucuuccuuccuugagucagugagggugggccuguggugucucagcaggugcugccccauuuucgcagccccacccugugcugaucugggagauagagcccugggcuccugaaggggcagguacucugcacacaguguuuucuagagccuugcuaugaagggaccgagggcuacuggacccuuuccucagcacugggagccuccagaaauauauaggguccuccccucacuuccccuaauccagcuuuccccuauucuaugugcagagucaggaauaggugacuucccauaggccgguccucagacugggaauacuguaggaucuagcauaggaucuagcugguugcucucuucuagcgucccucucauccccacuccuguacacauguacuuccugccagagggcagccagaccaguguuguacucgcuggagcuggagaccaggguauggggcuucagcuaagcgacccccagcaagccuggcccucaauuugguuuguauugcagaguucgauaaguuccuggaagaaagagccaaagcugcagaaacaguuccagaccugcccucacccccgacagaggccccugcaccagccucaaacacuucaacccggaagaagccagagcgcuccgacgaugcgcucuuugcccugugagcgguccugagguuugccucacccuggcaggucacuacugacucucccaguggacacugggcacuggccacucccccagccugcauaccuguaucuccauggaaacgccacuguguuugcgcccaggccacccuggucaggaccggcuuugccaccuucucucuguguggcuggcgaaagcagcacugaccagaggucccgccuucccucuccccaagggcucucauggccuucagucuucccaggaagagccaguggccagcgccaggcagggaagucccuugacacuuauggacagcacuccuaaacugacccucucaucuccccuccuugcuucugccuagcuccauggcuuccuucaggcaaacacugcuccacuggacccuucuuccaucaaggacucugggaaagcagggcuugagcauuugucacugcaggcuuggguucccuccuuagacugugugguaccuguggcaccgagugucuguacuugagugggcucuguggguuacuaccuugaaggucccucacauccauuuccccaucagucagcugccaggccugggaccaagacagggaccuguggcucuuggugugacagcagcugugaggccagcaugugcccugcagaugguugacagccuaccccaagcagggcaugcacacucacauucacccugguccugguguccacagagggcuauguggcauuaaugcauccaugacuagaccucgccugcagcaguccccacagcuaucugcagcccagcagaagguagcugugugcugucccuggagguccccaggaccgggagccguacuccacuccucuccucucccugacacggccucagccuucguggcuguccccagcucacauaucccccagccaacaguuucauccugaagcuugcuaacagcuucagucugagcaaaggagagcuggggaugccugcuccuguccugugucuuugcugguuuguuuccuggcucugagcaaaugacucagugcuacuuuaaucuuagucuagcugcugcugcagcuauguuacuacauacugugcaggucaccacacauuccucacccauguguggccagccuuucccacuguuaggaggacucagcacuauaccuguugccauuugagcucccaccccaguagggagaggggaaugggcugcacuugcagucagaucaguguguggguucuaugcagcucggaggaugaaaacagaaguggccuuccccaggcccaacccagcaccucuccuucagcaaucuccggaaggucuggugaggccucaucuggcaggaccuguggaggaugucauucuggcucgugaaaggcacucaggaagccccuccugcaggaagcucaacugaccuguuaagugcccaguccucucugaccccugucucaccuccacccucuacuuagggcccuuggccaaccacagcuucucugucaguguuucucaagagcagagcccucaaaggcuagacugacugcuaaggccucugaaggcuugucacagcagaggaggcuggggguccaguacaccuggaagccuggccuuuggcacaguucuagaaggguugucugugagggucagcugcacacagccuacaagaguuagacguguggacaguagcaaucaagccagcaucucucucugaauuaggaggcugcccccuauuuaugggugauauagaaaggaagguaggcuuccaucagggagagagacugugugggcccaccuuggggaugggaggggucuccaacaaggcuguuucuagaaccaguguccagagcugucccuuaaccuccugacuguagcugcugggucuggcugaagccgggcugcuguggggacagcagguacucaaggacucccaccaggcaucaagaggcuaccuuucuggcugggaccagcccagcuggugguuugguuuguguucuacacgucaugucuggagguggucugccuuaucugugggcugaagugacaugugccugaggccuuuaccagaagcaagauugggcuuggggaccuggaggaccugaaggggguucaacucuugugaacuguccuguccugaggacucuuuccuaccuguuccccaccaucugugggcaaaguccuuagaagcuggguccccucaagccagcagccucuacaaguguuagaaaucacagauagaguguguacuuaauuacacuaaauuauugccgggacuccucauaagcacuaauuacaccugauuauagguuaaaauauuuauuuugucaaaauauuuucuugaggauguauuuaaccuuuucuuguucauuguaugcugaagugugaagacugcuccuuccuaccuuuuuggccaucaggcagcaguaaaagaaagucaccaggugcccuagagggaccucuacccagguaccaagaaggcaggcugggguuggguagagaguuuccaacuuguuuaucuguacaugggacaugggggguuggagcuaaaagggcuucuuaguagcuguggccagggcuggcucccacuuacucugucagccccucagugugagugacugugaccuggcucauuauccuuucuccccaccuggcccaugcuuccugccacagcacugcucagccaagaaagagguggcagguccuacuggcccaggggcaaugagcuccuuugucccaccacaaagcuucccugccuaccauccucugacugauggucucucagauggcucaggacaggccaugggcacucuuggggccaggucagcccuagguggcuggcagggcagagugagggccuuugucccugccuggcuagucugcagccucccuggggucugcuguugggaugccuggggucuuccugugggcucagccacacaggaggccaguaggggaacaugucuccacuuggagauccucccuuuguggcccucuggaaccuacuuagcccagugcccagccccagcccuuaccguucauggggucuaagcuaggcuuccccuggcucccaagaacaacuguggaccccauguccuuacugcuccugccacacucacacccuaggcucucugggagagccgggguagaauuuucuuccuuaggguuugcacuuccuuugugaggaucugaggaucuuuggagcugcugaaaagaugguauugaguuuguuauccuguugucucacgagucggguucuugucccugucuuauguuucuauggguagagcugguucuggagggugacucagagugacagcuaguguguuccccccaccccacuggcucugcuuccaaauacugucucaauuuguguucuugcaugugaaguacuccacaauaaauaguugaaccagccc

SEQ ID NO: 12182 - RNA, 20748 nt, Mus musculus
uguggcuuuggcgccgcccgccucggacgcuuggaaccgucgcgucugugucgccugucgcccaucgccugccgccgcugccagccaccagcagccaugagcgcgcccggccccgguguagucugcuguccucuagauuagugcucuccgccgcgacgguccgcagcauggagucgcccgccgcgagcccgccggccagcuugccucagaccaaagguaggcucucccgcccuguugcgcggcccgugccacauucaauuugaguccgcccgugauccugggcucccuuccgggcugggcacagacgucugcacuccaacccaggacuggguccagcccaagcccgggaccucacgggaccuuauuggaauccggaucuuaggccgugggacuucacccaggcaggaccuaguucucgcuccacucccaagucuguagccucaccgugagcuccucauuuaggcuuccgggcuucauccuggacucagggauuucagugaucccugcuagagggucuuugggcugcucuagcccucucaggccaggcucuuggauuuuguccaggcuggaauuuacucugggccccagggcuguguucccaaugccggaaaccugucuacucagagcuccuccacucuuccaacuccuuccauccuugugaauccuccuuugccccaugucuugcuggccugcucacuggcugccugcacuccucccuaaggcugucccuguagaacuuccuggcgucuccacuucgcagcucugcccaugcuaccugcuacucaguugcagucuucucacugaguuucccgagcugaccgauucuugcaccuaguguuucuuagucugcucuuagacgugcuguuugguccuugggcuagcagcaggccaggggcuggcugugcaaagcuuguccuucuccaauuaacugucuuuccuggaaauuucugugagguggcaguggugcugcgugggcugcagcagcagcauuugucaugggaagugagggggacaagauuuggaggucagaaugcuuuuuuuuuuucuccaggaagagagaaggauguuuuuuuuugacaugucagagacucaguaggguugaucugcagaaaagauuuccaagcuggaccuggagauaugaauggguugacccucugaauucugaacugcuucaccuggcuagucucugggcaugucuaggacuuauuaaugaaauggauauuaggggcgugaugugagauugaauguagagugguuugaagcaagcacgucugagaugaucgagaacccagcauagcgcccagcacauaguagguacccaggggcaaauaguuguugcacuuccuugacuaucuccagcuuuccugcugcaacgcugggcccaguuuuggauugcagcugcagagcacagaggacagggauggcgggcaccuaagaggguacuugugcagugguggccuucucuccuucugaccuaggaaaccucaaccucaggaguccugguccuggucagguuguccugagcaggcgggggccuuuuggguccccuacagcuggcuuccauggcccugcaggagccuaguggacgggguaauugcaucuuacauaagugggaggccagaucccugaccauugcccaacuucugugaguaacuagggaggcacuuauugggggagguggcuggggaggaccuugcagugcagaccucguggaacuugagaaccaggaaauuagaugcugcuccacucaggaaggguuuggaagcaguguuuguuuuggaggcauuucagcucuuccaggcaagagaugccucaccaaaauaaaaguugcaguugcagaucacagccggagagauugugagugauagggagagaccaugggcuuucaugugcuuggugacuugaggccuggcacuggacguuccgggccucucuucugagugugaguuugcagauuguagguuagguaacaugguauuggaugguuuggguggaggcuuuuuccugggccagaaucccuguagccuuuuaggggucuggagauagcuguagugggaaacugacaauauccauucaccaaaacucuaagagguuuuuuuuuuucuuuuuuccacguguuauacauugcuuuauuacucaucaccccauuugcccauaaacagaggcuggggaacacuuaccauucacagaggcugcacagcuauguuggcagagcacagcuacagcagguucuaugaugaucuccuuccaucccguucccaugugaggugcuuaggggagccaugggacccugggacccuggcuaucacccccauguucacuggagcgugaggucugcugaagcagaggaccaccuaucaugcacgcagucuuuacaguggaugcuucccucagugugacccugcaacuggugcaaaguggagaccuuggcgaggccauaccaauguggacccugacaggaacucuuuuucaccuuugcaggagacuuaaaaauuacacacacaaccaggcagugguggugcacgccuuuaaucccagcacuugggaggcagcagagucaggcggauuucugaguuugaggucagccuggucuacagagugaguucuaggacagccagagcuacacggagaaacccugucuugaaaagccaaaaccaaaaaaaaaaauauacacaugauauauauauauauauauauauauauauauauauauauauauauaugcaugccacauguaguauacuaguauacuuuguggguaucaguucuuucaguucagucuuguggaucaaccuuccaccauguggguuucaggcauggaccuuagauuauuagacuugauaguaaguacucuuaccugcugggcuaucuugcuagccuguuugcagaggacuuugaacacagcggggagugguagcaccugaccuuugguggggacugcaacuuuaucuaugaacuucccacuggacgguuggcagccuaguucuuugugcccaagcuuaggaaguucucuccacauguguaaggcauguaggucccacaacuuuguugacaucuccugucuccuugcucauuagugggucacugccugccaucugaggccaagggcagcugguacaggggcacaugucaggguggucuggguuugcaugucuuguuuguccuugugcauauugucagggauggccuuugacacucuguuggagguguugucauuggaguucaucaguggcugguggcucuggcagcccagugagacuaaggagcacugaaugucuuguccugguccugucugcuaugguuauaagcuuuccuccugucccaggaguuggaaagacuagaggguggcaccuuggggacuuccccccguccuggugugacgcacaggaaacucucuaucagccagccuguggcucagggccugaaggcaguaaaguucccagucagccuguguggggagaggcagccaggcuuccggugggugagucagcagacacugggugcugacucaccacaggcaugccagucacugccuauagcuuaaaggggcaaugccaggcagggguuacauaccuguaggcugccccugguccugggcuggacaucacaggugacggucugcuuuggacuuuucaguugagcugggauucugggcagauccuccuguccuguccaggaacuuccucuguuagguaaaugacucuugcuuccucuugcucaccacagacgaguagauggcagcuguuguugacggucccuggcccagggagcaaggucuaguaagagccaggagcaguggccuugcagggacagccagcuugaacugccucggucagaucccuacucugcccauuuugcaauguaacauugaacacauuguauccaguacauucuugauacuuugauuagguuuuaguccagugaguaggggacaucuuucagagaagaagccggagugcuccucucccccccuucccaggaaguacaggagccuugccuguauggaugcagauggcauuauccagcagcauugcagcuauguuauaaugggccuaggaucccaaccugacucuuacuuccucaucagggcaaauggcauauccucuuugacucucaguccgcuucugggcagugggaggaaguaccucuccccugcagggugguaguaaagaugggagauagaguuucccaaacaaacggcaucugucauuauuuaauuguugggacucuggcugcuucucauugggaggugaauacauggcuucugaugauguauucauaggguuugugacacgaggcuucuuuggucaggaagccagaguuugccaagcucuagggcaaccuuccuaaugcuacgacccuuuacuauaguuccuuauguuguggugaccccugccauacaaucauuugcauuguuauuucauaacugcaguuuugcuacuauuaugaguuguaguguaaauauuugugguuuccaauggucuuagccgacccuugugaaaagguuguuugauccccaaagggaucuugacccacagguugagaaccccgagcucucggcucuuuuucuccucugcuuccuaagccguaagcuaccauugcuccugaacugccugagacaaucaggaaggggaguagagaacugaguuagucuguccuuucuguagaucugucccugucacucagccuuguugaccaguggccgccuugaaagcauaggugagggaagcucaggaggugcaaggccggccucaggguacaaccuccugggcuaguuucucaggugggagaauuucauccaugucagaccuggugcuagccuggggagugagggagggagugagugggcagcaggacucaggugugcauucucucacaccuccccuugguuguuuguccauguugcccauaucugucaggccugugugcccagcagccccuauagauuuuucuucccccauugcagguaaagagcagagacaauggcagcuugcccuaucucacuggggcacguacuacaggccuagugauaccuggccuuggcagggucaguggcuuucuagcccucccuacuucuuagcccugccugcaggguuaugguaguagugccuccgcugagcuggaguccagggcugccuuggcugcuucucuggaugcucucugugaucagcucaacggggcccuccuugcauguaugggcccauagugaagccugcuccugcuuucccuucccuccaacuuccucccucccccuuugcucccuauugucuuuccuccuccuccuccuccuccuccuccuccucucucuccuuuucuuuuugagaccuaauuacaaaugugccccaccccaugguuuuaugugcuguugaggaucaagcucaggaucucugaggauucaagucagggccucaugcacacuagguaagcauucuaccaguugaguuauagcgccaguuuuucaaguugagcuuauuagcaaucaguugguggaggcaagaggagcagaaguucaaugucgugguucaauagcugugguggcgcauaccuuuaaucucugcacuuagcaggaagaggccaucgugagacucugucucaaaaugaaaaauucaaugucauccucagcuguauacuauacaaugaggucuaacgugacacugccuuaaaauauacagauaaauaaaauugaacuuuggugugcccaaaguguguuuaucccccuguccuacagaggcccaggcuguuccacacugucaacuacaggauaucccugggaugagaagaggaaggagcuggagucugaugucuaggaccaccgugccucuucucucuugguuuugguuucauuuguggugggacuuuguggaguggaaggaaaguucuguguguggcuugaugaggugcugguuuaggacaguucagagucuauguggguggguguuucucuugcugcuccaaccuguguggcugugugaacagccuugguuuuggucaccuacaucacugcaggugccaccaaguucagguguuugucuugagucagcaagugugcaaugacaggccaggcuccuuggacacagggcugaaaaggcuccuggauauuagcagcaggguuugggcauaguaaaaauguagauggguggugucggggcugggggcgggguguccaagggucaguacuuuggccuggcacaugauaacguucugaauugccaugggagugggcuaccagaggaacgauuuuuagcagaagggaaaugagcguuuugaaagcccucaagaugaagguuuagugaggucuggcccaaggagaagaacucuugcuuauguugaccugugaggccaguacuggguccuggaauugguuggggcucugccccuggaagaagacucggcccuuuuccaucugugcuuggccccuugccauggccagggggcucaguccuccaugcuuacccuauccccuaucaagugcucaccugacuuccaggcacucgaagcuggcacaguuuaucuaccuagggguagcugcucaccagaaaagcuugcccuucuuuuuggugcucaguuuaucccgcucagauguggauggccuagcauguucucugaaagacugcugcaugcagacagccagcugagugggcagaugggacauuuugcuucugacacuuaaguggcaguauuagcuucuuccaauucgguugcccaggcccaggggccagggguggggaucauaaacaagguaugggugccauuuuagucauuggauaccaugggauggaacuuacugucuuauggcaacuguuccccguggccugcucucagacuauccuugcugaugguuggauguuagaacaagugggucuguucagggucauauccuuaccccaccagaugcccacaaugcccuuuguuaagccaucucuccucucugaccgacuuguacagugaaaaacuuugcugcauggagcuguaacauggagguggccucagauagcaaccccaucccccacccccaccccgauccucuguugggaggucugccauuccucuacacauacacugaggcccuguugcccagagagguauaaucaugugucugagagcgcagaacaaagaaggggcugagugaggguugagcccagccacuuggcuccagaguggccugucagggaaaguaacugcaagaauugacaguagaggcugggaagacucaggaacagcagaggacuaagaugcagcaucaaggguagagagaaugguaugugcaaagcagauacagugggaaacaagguggcucacccagggaagugugaggggacgauggugcaagggcagcagagggggccagaauuucacccuaucuguggguacuucauuaucauggcuggaaccucagguuagugguugaaccccucucagcuucaguguccccacuuucugccuggggagcugcugugaggagugagcuauuuugacaccuagcucuaggcuggccugcacaaaggacccugcgauccuggcgggcuugugguuugcucaugguggccaagagccucuguuuguuguggugacagucaccaccuugggccacaccuggguagccccaggcugccugaccaucugggccaagcccugacauuggcauugaauagugccagcaguggcugguggcucgaggccucucucuggguuguccccaauguggccuugcccauccccucugacaguuggcauagcuguucugguagcucaggucacuccuaacauaggcugguggcccuguuaggguaguuggcugugugcugcccaggcugggacaauaagaagaccucaccaccauauccagcaggcagguaugggcauggccuugacagauggggcaauugaggccuggcaaaaggcagagcuuauaacaucucccaacccacugccagagacacaggagagcagaaaguggaggugauguggguggguagcaguauaagcucucuuagacuggcuugucagggcugggggucaggcugugacucuagauauucuaagcagagcuguguauuuuauuacagaauauuuuauauuuugguuacagagaaccucaugucaggaaugcaaacuagauaucacaggccaaagugcagagaaauagcuugcacgcuaugccauucuggguccaugcagaguuucuguagcugucuaccucuacuccuagcacguguagccagacgugguaccuggcaaagacuuggacccacaggugcaugagacucaggaccugucccuccagcacagggacaaacccccugcucccgaaggggucugcagugagcccagcugccucccucgaucuucuggucaguacuuuugaaagccacucugggcuggcccgaauacacaggccuuacugccuuagucacaccccaagcucuauauugugcguagcuauggcuggaucugccagaaacugguuuagauguggcuucaggagcuagguggccagagugagcugguggcaguuugcaggaugcaguguaagccucugggaagggcaggcacuuggucacugcuuuccugcucugugugauaccgaggagacuugucacaucuaccucucucauccugcuucucucucacauuuucuccccuggugggggucagagccccugcuuccuggagaagccgagacugaaagagucagugccugcugccaguggugggcgcugagccacauggcccuacaaauaggagguggaaguccguucaugccgguugugcaccaggccaugucuucauugccccagugggugucuaugcucugguuugaccagugggcaaacugaggcucugaguguggaaauacagugagcagggauuagaacucagucucaggcacucccccacgaacguugacccucguggaaggacacagugcggcuaggguuauugucauaaagucccacggccacagaguggacggcuuccgcagcagguaucggagaggaggguaggcagcucucauaggccacccaggaaggcucugccugugcuugcuuucaagccucucuuuggcuaagggguggcaucucccauggcuccacuuaucuuccuuuucuguacccguuuccucuauuauaaggauaccagugggguugggagaacacuuaccugggauucuuccccuauaugugcacaugcacaaaugcaaacacacccaccagccuugucacaggauuagggccaacccuaaugauaucauuuugauuuaauuggccacaaaaaaacccuaccauuuuccaaauaaggucacauucuuggguacuggggggucaagacuucaguauauaaguuuugaaagacacagcucagcccaaaacaagagacguaggacacaagcuuuugugugguugggaacacugguacugggcagacgacauuccauuccuggcaguaagaggccuggaaacucaugcauagcugagcauuugagugugugugugugcgcgcgcgcgugcuauaggcacagcugucugaugccucccagcugcagggcagcucccaggaggguggggcuugucucugcuauugugggaggaggacugaaccugcuccccagacugagugggaccaugcucugccuaccccaaagcccugaggcucucuggguacugaucauacugacucucggacguguguguguguguguguguguguguguguguguguguguguguguguguguguaccagagaucugagugaccucugucccuagcuuugcacagcccagggcugaauguugaucagauccccgucuuuucuccacuucaggaaaauccaaaaggaaaaaggacuuacggauauccugcguguccaagccaccuguguccaaccccacgugagucugccuuaaguuucucacuuuguugagacuuggagaggccucuuaguggaggccagggguaugaguaagaagcaggaauacgggggucagaggugggugagagagcauucucuucucaucccgcccuggguggcuccagagggucucaggagcauuggcuguuugucccaugccuucccaguccuugucuuggggucucugucagggcugcaccguuacacuuuaccuuguggaugccuaacagucacuggacugaggugacuguaagcugcccccauggccaguguguuucacccucaccccccuauagcuccuucucucagagaagcuuguggaucugcuuucuccacagacccccccggaaccuggacucccggaccuucaucacuaucggagacagaguaggugguaacuagacacugagaggccuccauagggccacugagagguagcuggagcugggccucagggaggagcuuaccguagcuuaucaugcugguggcuguggcccugggcuaucugcccuuagaccuccucucuggaagaaguacauuccaccugccuuauagggaggggugugaggagcgcagagcugccacacugccuaccucagagugugggcuaugaaucccacaugaaaucuguaccaccuggaagcaccaugugggacauguagacuccugggcuccccagaccccaggucagacccuagacuccauacuguccauaccccugagugccuuggaaggccaccuacuauugagaagccugauuuggggauguguaccaggcagaguaggccgagagccucuucuuggaagauccucccuccccaagccuuugucacugccugguguucuguuaguccaguuguguaaucccaugucucucacucaggggagggaacucccacaaagggucaguagaugauugacuaauagcucccuuugcugagauguguguggaagacgucucccauagucuccgaguuuuugguuuugcacccauuuuauagagaucagcgguagggucagauuggcucaguucuuuccacugggucacaaagcguauaguacauggcguauaguagcugcgagcucaaaucugacaagcuggcccucugcuuuucucugggugagggacaagagccaguuuccagcuuggugccuaccaaucaccucucccuuugccucuuaagaacuucgaaguggaggcugaugacuuggugaccaucucagagcugggucguggagccuauggggugguagagaaagugcggcaugcucagagugguaccaucauggcugucaagguaagcagggcuucacccuaccuggaguagcacuggaggaggcacuggcugagcuucagagugacugucuacuuguggcucugucccucacugucaucaccagcguugaggcagaacuucucagacaagucagggccauggauuccccaagguuccuggcccucauggacuggguuaggggaacagccuaauccguggcccugacauguggcucuccuauagcgcauccgggccacagugaacacacaggagcagaaacgucugcuuauggaccuagacaucaacaugcgcacggucgacugcuucuacacugucaccuucuauggugcccucuucagagagguaggcucugucucugcccaccucuugccaaucacgacugccauuucaguccuauuguguggaguucccgggaccuuuggguauaggggaguuauacucaagguauagggagcacccuucaccugaugcagcuuggcugggcucuucuugagaggcaggcuuuccuguuccugacccgcucugccucagguucccugucugaagauuaaacaggugucugagcaguucucuucagguugugcucaggggccuggagcuccggggcagcugagauuucuguuuguggucguuugcuuucuguuagccccguaguggccauucagggcaagcccccaggggagaagcacugugaaggggugaggaucugggcuagagucuagguguauguuaggguagaggaauggaggguaaagcagggugcagggucuaggagcaagagcacagagcugccguuggaagcauauaguacgcaccagagucaggauggaacugggacuucccaugaugaccugccaucuuggaguucuugagugguccgugauguuucucugcccuggcuuuccuuugggucccucucaagucccagugguggcucagaccccacuuuaugcaucucaugugguggacugagcaacuuguguaagugucagccagcucaucccaaggcuaugcggguuugcuggggagaagaaaggucauuuuccagugaagaaauucgguucuugucccuuuauguccugacuuaaaagucucaggacacacuagguucccgauugcuugggaacacuguuauacuagggcacagagcggggagacuagggcgggggagcaugaacugcauggugaggugccagagaggccgaucugaaaggcagacggcgauggcgaggggugagaaguguggugagaagggucaucgugucccuucccagguggaggcuggaccuggugcucacagcgaggcuguuaagaugaaggcuggagaagccugggagucuguagacugcccagggcugggcagcacugggggaccagcuaagcacuggauguucucacagggggauguauggaucugcauggagcucauggacacuucccuggauaaguucuaccggaaggugcuggagaagaacaugaaaauuccggaagacauccugggggagaucgcugugucugugaguggccucgcucuacccagcaugcacaggaccugcuguguggcugaauuuuggcagaguagcuguccccucuaagacucaguacuucugaagccugagagcaguaccuugcugaagaggccccagggauggggcucuucagacuggacugcucccugcuuccaaggucgugagugcggcucucacguucccacccacuuugaagaaagugccgugugucccacugccuuguacucagaugccgccugacagcuauuggagguccaggcugcuuuggggagauguuugcuuucugagccugcuguuucuagaggagggcagcaacucugguuugaguauugaaacagggcgggcagucguaucaaggaugcccuuuaauccuauuugcaucuggaagcguuuaaaccacccugugccucaggcucuuuuuuuuuuuuuuuuuuuuuuuuuuuugucuaaucucuuagagguggcucaugggggagugagagaaacuugggggccugguaggucuugguaaaagcccuuaggaggcacugcuugggauuuguggagcaggaggaaggcaggaagcugacauguuuguccuaggacagccaggaugagggacagauuuggggcguaggcaggagcugggguguguuuagaggagaugggguucuacugcuguguuaugauuucuguuaccuggaauaauagcagcccugccucuccugccccauucagaucgugcgggcccuggagcaccugcauagcaagcugucugugauccacagaggucaguguccuccaucagccacagaggcucagggaggggcagacugugauauaccugcuggggaauaggccgcuuucugcauuugugccuuuggcucugccugcugcacucugaauaggaggaacuaaguggaucccagcuuuuucugagcuccauggcccgcuucucucucucucucucucucuucauaaagauguauuuauuuauuauauguaagugcaucagaucucauuauggaugguugugagccaccaugugguugcuggaacuugaacucaggaccuucugaagagcagucagugcuuuaaccacugagccaucucuccagccccauggcccgcuucucauucauauuuacauuuccugugccguggagcaccuagguuguggcaugucacacuaggacucugauacaagcccccuuaccccacacaugacuauccuggacucuucugggauuccuuugcccccauggccacuagucugggcuucccccuccaggguuauacuuaauuaaguaucagccucccauuaacuugguugcacuguaccuagaaaacgaaggaggcuaaguggacuucgaugaccagcacccaucccauucuguccacgggucaucauuguugacucuuuggcauggaaccuucccgucuuuucuggggcaucuuugucuuuuucacauccauguggcccuuugcuuggaggcuccugccuccugugagacagggauggguggggcuccucauuugcaugcacagacccauccgcauaccuucacuccaccucauuguucacccacuaccuucugcuugcuggauuuguguccauagcaggugacgugcuuagguagccucaagguagagucuccagagcucagauguuucucuuugguugggauaggcugaaguucauuuugauuugucauccagccgagcgauggggccuggugcugcagaucucacugccgcuguuuccuuggcuaauccuuggggcauuggguagcaugcugcuggcccacagggcacuggagaagguagcaucccauuuggcauggacugagaaaggucugcucuucuuguagaugugaagccauccaauguccucaucaacaaggaagggcaugugaagaugugcgacuuuggcaucaguggcuaccugguggacucuguggcaaagacaauggaugcuggcugcaagccuuacauggccgugagucagggcauccccgcaagguggagaccaggacaagauuuugccucugugcagugggcuggcuauuuccagccguaccuccagucuuagagacccugccaccauuuaccuauacuccaugaucccuguuuggaugaacuuguguucucuguuguuaggaacauggggauccuuaagacugguggccuggggggaaggcagggguuggcucucgcucuugcuggccuauaucaugcaggcaggagaaccuaaugguauucuguuuugguguagaagagaaaaggucuaauugagggagccuuguuggguguucaagccuucuggucuuucuugcagccugagaggaucaacccugaacugaaucagaagggcuacaaugucaagucugaugucuggagccucggcaucaccaugguacgucuggggcugggcucagcacuugcuggccuguugggauggaugucugucuguauagggucuguggguuccaucaaacauuucuauaugaguacaaggauaucugggaguuguaggacccuuuccugaccaucaugauuguucucuguauccugugauuucagccuuuucucuagagccacugguguagaucaggaaaucccaggcaaugcuaagcuuaguuguugccgugcaaguaaaucaagaaggcaaacucuuagcugggcaugauggcaccuuccugugauaugauuccuaugguagcauccuuuuuaaaugguuauccucagcuucauaauaaauuagaggguagcuuggccuucaugagaccuugucucaauauccuucccaacacucaaaaacaaaacaaaaaaaaccaaaacagugccuggucccccccuaaauaggaaccuauugcuguagguuccuuuuguguuucucuagguucaguagcaugaggcuguagauccuggcuuguggaggcugaaaggacccuugguuuggagggaggagcagggcccagaccauuaggauugaguuggaucagacaaagcuaaguccagguguggggauggacuuuuuugccuucuagaacugccuggccgagagcuccgaugcaccuauuaaugugauaaaacaauaaccaaugaccaaaagggacuuggggaggaaaggguuuauuuuggcuuacagcuuuccaguugcaccccuuuacuaaggggaauccgggcaagaacugaagcagaagccacgaggagugcuacuuccuggcuugcucagccugcuuuguuacauuacccaagaucaccagcccaaagguuggguugagugucuauggugagcugggguauccuacaucaauugagagaaugcacaggcuugcccacaggccagucuguggggggggggggggaacgacacacgggacacaccuguuuucaguugaggcucccuuuucccaaaugacuuuagcuuguguagcguugacacaaaacuagccagcaaaauguuacagucaaguuaaacucuuugaagauggggacacuucuguacugaacacaugugagaaaaugauauagcaagaauagucuaucuuccguugcaaagauauuuaacagaaagggacauucugaccgucaggagucacaguuaccaagauaugcuguccacuuucuucguuccuccugccuaaauguuuugagacuguccaaguucccaugauugaucucaugacuauuggggaagacauuuuguuauuuuuaaagaggcuuuaucuugaaggcaggguuuuacaguaggguuuucaggccccaggaacaggagcaaggcuuggacugucuucuaggaccucuuccuccagguucaccacuuauguuuauccuuggcccaacauuuccacuuaaaaugcugcaacgguacgguucagugcaucccucuugcccugggagcucugggcacacaaauuuccugugucucagaauacaagggaguuaccuugcacagacacaggucacacucugaaccaagaaggcccugaguggugucaccaucuccacugcugucucugacgcucagucauuauagggggcuggcucccgggggguccugugauagguaaacugucuuauaugucuuuguguugaguuaguuuuuauuuaucuuuuucuaaacucuuuaaaaaaaaucaucaggcugagcaggguaauguauaccuuuaauaccaagaggcagagacagaggcagguagaucucugaguucaaggccagccuggucuacagagucaguuccaggacagccagagcuacacagagaaacccugucuggaaaagccaaaaacagacaagauguuugagguccauacucuggugcuuuuugguuagguauaugggugcuacugagcuuucucuugcagucugcagaaagguccugcaguagauucuggaaaugcugcaugcaguucuguccugugggcgggcacacaugugacacacacugucuucccauucaugcuguucccacguugguuggaaaggcauggaaccugacaggaaagucccucaucagaauaguuucuagugcucuauguagggccaguugcaguugcuauagaggucuccuccauuccuuaugguggucacagccugucacugaggccuuccacugcacccgucaggagguauccaugcaggaguccgccacucccuguuggccuaacuaguaaaaacaacagcuggauagguggcccuggauauugaagucuguguuggggagguacugaagaggaaguagcugggccaacaggggcuuaggacuggacccagugagguacuuugauuacugccaccuuaugggaaagguguauguggcugccacuccucauguuugacacgcugucuggaacccaaguuguuaaauacaaaucauccaauuuuagaguguuugaaaaaaaaauuuaaaaaaccaguaaggguuaaacccagcccagggugagccuuagucugagcuaggucugccaguccagucagaggagcuucaguaguuaguuggccugcugcuugguaugagggcagucagugucagcccucauaccaaggccuggccuggggugcuggggaauuauggguaaaaucccuuccucaucaugcuucuggguaccaaaugaaccugcugacugcugucccuacuucagaucgagauggccauucugcgauucccuuaugagucuuggggcacaccguuccagcagcugaagcaggugguggaggagccauccccacagcucccagcggaccaguucuccccugaguuuguggacuucacuagccaguggugaguaucugggcuguguccccuccuucugcagcaagauaacccuugagccaccugguaucagaaggcaggagguaaagcuaguuccagcacgaguaaaagguuuuagucccagugguagcuuuuaguucuagucuuugcagaaaaggaugaaucagguagccccaaagaguagagggauuuuguguguguauguguguguguguguguguguguguguguguguguguguguguuuguguguaguaacauauauuauggaacauuaaaaugcauaaugaaguugcuuuuuuguuguuuagaaguuuuuacugaauuacagaaaguucauagagguuuuagaaaagucauguuuuugauccaggcagugguggugcacaucuuuaaucccagcgcuugagaggcagagaaaggaucucuguaaguuagaggacagccagggcuauacagagaaacccugucucaaaaaaaaaaaaaaaaaaaaaaagauguuugaaguuacaaaagaguaagaaaagcaguuauacagacgagcucucuaaccauaauuaaauaacugcauggaaaguaaaaguauucuuauaacucuuggguuauaagagagauuuagaaaauacauuuuuaagaggaaacuagugagagcaaaccaauguuuugcauguuuggcccagagaugcucagaggacaagucaaagccucucagcagaaaacaagaaaagcugcaggcccaggagaccaguaacaaagucauugauuaguuugccucuuguugguuggacuuuauguuccggaaccaaugacuggaguccucccuucugauaaaggauaaucuagucugugguuuuggcagagcauguugggguuggugccacagaccuagccugggucacuauagagaccacuggucuccaagaggcagggaaaguugcugcaagacuauagaguuaguacccacggaccccaagccacuuggcgagacucccagacaguuugcuccaucucugagccccaggagugugcugcucaaugggggcaagcccagccugucuggauucgcuuccuccgugugagccugucuucacugcccucuuuccuagccuaaggaagaacccugcagagcgcaugagcuaccuggagcugauggugagugugcacgagaaguaccugcccuguccccugugcuguguaguggcuggguggggcugggugggacugucuggaagaggguugcacuccaggguagagagguagcucuucugccuggcccuugcaugugcuuguguaguuucaccuucacccaugccuguaccccaggccuuguggaaaggugcacggggcugugacaguggggcacaggagucacuguggcaucagggaaggcuuccuagaggagaugccauuugagcugagccuggaaggauggguaugggcucuuugcuaaugaaggaaggguagagggucugguagggcagaggucugguacccuugaggaaagagauguuuguguggcaggagggacucuuguaggagggugaggcagagucacaagcuuugaugguuuuggagggcuucgaggggcagcgguccuggauggaccagcaggaguuggccagguaggaggggcaugaaaagagggaaccucuccuuuauacuuucuccugugccccuucaccccuagaaauuguaccucucuuuccuaccaggaacacccauucuucaccuugcacaaaacuaagaagacagacauugcugccuuugugaaggagauccugggagaggauucauagggacuggcccaggaccccacuggucugccagcauccauacauccgugcuggggcagcacuuaccuacagccauaagcuacugccauucuguuccugggcauuugagaaauuaagggguuguuccugucggucucugcaacuagcugucccaagugccaaagaaccagaccucaggggcucccagccaggccauaugugccccacagugccucugcuguugcugcucccagggucucaggccucuacccaagggaugaaucugacagggccuguguaccccggcaaacgcugucgcuucugaagagcaggcagcuggugucucucuggacaggccauagccuugguacuguccuggaugccaugcagguuguauauauauuuuaaaucacaacugaaugaauggacuucguacacuguggccuggaucagggacaucucuauccugucucaggugcugaggacacacuauggggaugaaucuccuaagacuuuccugagagacguacugagcuucccaaggccuuccccccagcacuggccaauggucucugagggacacacuguccucagacagccucugguuaccaccuuuagugguaucugccuuucccuuugaacuauuauuccuguugccuuuugcuuuguggguauugcuggguuuucuugcaugguuuggagcugaccacuuaacccugggugccagcaggcucacagccgcccagugcucggacuggagucugcaaggauggcucaagcucuuggcucaaagccacgagggagcuguaacaacucuccaggugugaccagcucuuggaagcuaauagguuuacuuuggugguguuuuuaaaaaaaaagaagaaaaucuauuuuugugaagaaaggccugccucuuccagccuuuuccugggcaggaaccuauugcuguuuuaauuaaaaaaaaaaaaaaaaaucgugug

SEQ ID NO: 12183 - RNA, 17146 nt, Mus musculus
gcucgagccugugaagauggcggcggccguucuuaguggggccucugcgggcuccccagcuggggcuccuggcgggcccgggggucucucugcggugggauccggcccgcgucugcgucugcugcuguuagagagcauuuccggguuguuacagccgcgaacggcgucccccguggccccugugcaucccccaauccagugggccccgcauuugcccgggcucaugugcuuauugaggcugcaugggacggcagguggggcgcagguaagucuguggcucccgcggucaccguggaaaggcuggugaggcggcugggcaccguggucccgccuuccugaagcugacacuggagcugugagcucgaggagagccgagaguggagaauagagccacuuaaccauugaggacgcgauccacagacuucauuaccugcgcguuccccagagcaguauuaggccccuuuucuguuaggucauugauaagcacaaagcaaugaaggggcucgguuccaucccagguccccugacuaguucaguccucagcgaaacuucuuuuggcggcguuuucccaggguaauugaacacaaacauuuacuagcucucagccaagggccuaccccuuccuacucggcgcuccaauuccagucauaguggcgaugagcaaaaugccauaacacgaaacuaaaucugguaugaguuuccuaaaccgguguagagagaguauuuagagauuucuccaaaagaccuggaguuuaagaugaacagggguuagguagugaaagaaaauuagaagggguaguugaaacguuagaggaacacucguguaggacggguuggaaaaugagggcaauguuuggguucgggguuuaggugguuaaagagaguggguagaguugaggcuggugagguaggcgguagacaauauguugucuaccugguuaggagccugugcacaaaauauucacaugcguucaguuccuacaagcuagaaacccaagugccauccucgauaugugguuucuuacacacuuccauaagcagucugugaaguucugccuuuuuuuuuuuuuuuuuuuuuuucuuauggaggcaaagucucacuauguggcucuggcuggucuggaacuauguagaccaggcuggccuagaacuccccgagauccagcugccuguggcugggcauccgccaucuuguucagcuguauguguguuuauguuagugguuaugggccaaggguagcaacggugcacacaucaaagucauaggaacguuuagguccuaagguuccugugucaagacaaggucucuugccagugguggacugucuagcccgaguguuuauguugaugcucuuugguuuuaccuuguguuucucaguaggggacgcugcgauuauagaugcuuauacuacuauggcuggcuuucggaugggcucuggaaggcaggauuggguggcuuauauucauuguacuccucagacaguugggaauacuacaguuaaaucugcccuccuaauggucuuuuguuuguuuuguguguuuuagaaaucucucugauuuuuuuucagugaccugaguuuuuguugugaugcacuuuuacuucaguaagcccugcacacaugugcacacguguuccccaauaggcaguuggcacguuucuauaauguuauguccucuucacgacugcugugaucuacuguggcuaucaccugggcuuugggcagccacuugugcugcuuucuuccugguguuaccuuagaggugucugcggccucucugucucucugucucuuucucucugacauacauuuaugccgcaaagcagagaaaaggggaaaaaagcaauuccuagugaauaaugcacuuagauuuaugugaugcauuaugggggaguagcuguugaccacucuggccguugaacgugcguuuuauuauccuuuguguguagagaucguggaaaagcuguaucacuaaggagcugagugggucuuuuuguuuccccuggcaaaugcugaauaaaugugaaccugugggguuuuuuuguuucuauuucuauuuuuuuagguuuauucauuuuauguauauuuugccugaauguaguacacgcacaaacguguguguuuguauacuuggugcccauggaggucagaagggcaucagauccacuggaacuggaguugcagauaaguuugaaccacuaccugggagcuggcaauugaaccuguguccuuugcaagagcaacaaguguucuagccuuuguuuauguauuccuggcugggauuaucugugcagcccuggcuguccuggaacuugcuguguagaucaggcuggccccugccucugccucccaaaugcuagaauuaaaggcuugugcuauuaccagcaccugacuucaccuguguuuuaauguccagucaggugagucaggugugggguucccacuugagucuggucccuagaacucacucgugucuugguuuaggagcauuuggguugucuagcuauggaugcucagcccguguugaccguauggauuguuuguguccacuuuccuccgucugggagguaggcugccagcaccuaaagcaaugcuucuccuggaguagccgacuacauguguacuggacagauggauggacacucucuacauguguacuggacagauggauggacacucucugccaccugacuaaggacuuucuuucuuuucuucuguuuugguuuuucaagacaggguuucuuuguguuaacagagcccugguuaucugggacuugcuuuguggaccaggcuggccucgaacucauagagaucuuccugucuuugcuucuggauacugagauuaaaggcaugcggcaccacaagcaggcuuuuuuuuuuuuuuuuuaaauuuagaagucacauuuauuuuguauacguacagguguaugcaugccuucgugcacaaguggaggucagaggacaccuuugggagucgauuauccuaggauguggguucuaggaaucacgugcagguugucaggcuugguggcaugugucuuuaugugcugacccaugccacugguuguggacucuuguuuuauucaguugugccuuccuuuaucugagcgguacugaugugggauuagaaaggagggaugauuuguggccuuuggagauguaggucuccugaguggagucuggugcuuggguuauguguaaaggggcugacgaaggaacuugcuucugugugagggagggcuuggaaggaggauagguugagucuguguugguguguucuugccucuacggaaggcagaaccaggaggaagagacuuguuucuucuaagugacuaaagaaggguuaugaaugaucuguguucauucagccgguauuccuggaagucuuuaugcuaaggaaggucugcugaggugagcaagcuuuauuguugaaaucuaguagaugaguugggguguccucuuguuagcccugaagucccccucccccuuacaccuguggggcaugagggaggaggccagcaagauagaauuugagaaaacagacugacagacagacagcugauggccuuuuuguacugagaaggugcgccuugagaaaaucuucucgggcguggggguuggggggggcaaugagggauuggugaauuucuugugcaucuuuagugaccuuugccucauucgcuccugguuuuucccuuccacaucuagaaucuuucagcucuuggggcauuggugaaucucaguaaugcacaucuuggcuccaucaaaacucgguaagucauuauucuuuaauccccuuucuucagggcgaugugccuuuagaaaguggguugagucgggcaguggugaugcacgccuuuaauccuagcacuugggaggcagaggcagguggauuucugaauucaaggccaaccuggucuacagagugaguuccaggacagccaggggcagugugugugugggguggguugagcguguauuugccuauccuuuguccccacuccauggauucaagagauuuuuuuccauuccaggagcugcagggaguuuucuuuuugugagcucagcauuuccaucuccuaggucuccuguuccuacaugagauuggcccugccuccuucuuugcuugcuacucuaccucucucugagucuuccaugucuugugagguagaaaaaaauaggaaaucuggggauggagucuuaugaacaacaauaaaaauacaaggaaaguaaaaggacagucaggaggcuucugaagucuagcccacauccucgucacccucuucuugcuugucagguuugaaggccugugucugcuguccuuguugauaggggagagccccacagaguuauuccagcaacauuguguuucuuggcuucggagcauccagcaggugcugcagguaaggcuuugcuguccucuguccugccuagugugggucaggcauggacauuuagcguggacacgagcuccggggcagaaugguugaacacaguuuucugcuuuguggacagaggagguuaagcuuccaauagagaucuuauaguuuuaccuguuagcuuacuuuacuucguuugcccuuucacucucagcuucaccuggcuuccuuacccaaggagugacagcucugaaguuccuucuguaaggguguguguguguguauugcuuuguuaaucuuuucaaguuuuagucucucucgaauaucugcugugcuuucugugcuuagcuauugcauaagcacuuucugagcacauuggcaagcuguguacuaaacucagaggggcuuggaguccacuuggaugacucuuaagucuaauacaggggcugggauauuuucuuaugagcuaggacuuugcagauaucaauuuagagucaugagccauauggcuuccauuaaaugcuauuuuuauaucuuuaaaagugggggaaaaaccauucuuaguuuaugggcaaaaccagauauucacauuacaguugguaaauucuguucuaauggaagucacuugaacugaucaugauguaaccaacuguggagugacaccuguuacaguaaauagagacugagacucugacccuauccaggguagugugaguuagugauuagagccaucaguuuacaaaaugcauuucuauucugaucaauacuuacuuuggcuguaaaguauucuaagaguguaaaagccccacaggggaggaagcugaucauuggaagagcugcaaacauggcagauuggggagguaaaggugggguugggaagcuggcuggagaagagccaagccauggauuuuuuuuuuuuuuaauaagaauuuuggcuuuuauucuuuaaguagugggaguucauuagagguucuaaguagauuuuuuuuccugcgauaacacagugccacagauugagcagugcauaaagaacaguuuugucugagucacggcucuggaagcugggagugaaaguuaaaggggaggcaucucuugagggucugcuugcuccauuauaacaugguggaugacaucagugggaaauggggcuggggugggaaugagugugugcuaagccuccuucuuuagcagaccuacuccugcaguaacugucucucugacuuaggggauuaagaguccaguagagggaauuuggagauugugcaaaccauaguggugacagugaagcaguagugaugacauuaucacauuugagaauuucucucuggguucuggguaaagaaccggaauggagaggccugaagcagagggaccagauaggugguauaagagagcacuggcaguggccugcaggagaacugauggguagguggguuugagggagccaagugagcagucucaugauugauuggcuuuugggagaagauaugaccagcgugaucuguggucuucagaacauuggaaggcagccaaggcucagggaauaaaggaaaacacugaguguggccuggaguguagaguagcaacccuuucaguagaccugaagaggacuucuguugguauauuuuacuagggaauugauuaccagugcuuagccagcagugaggauggggguggguuuuaguguguguccuggccagaacugggcucuaagcgcaaacugugcugaagcacucugugggaggaggaguuuucugcagagucugagucugacacagagcaagccaagaagauaaccaggauugagaguuggauggaaucuaaaggaagagggaggagugaguuagauugugggguuggauggacuccagggagaguacagaaggaacgagggaggggugacuuguguuuauacucaguagagcuggaauaagacugacuuggagucauuuucuguaaaagcaaacuuaggagccaagcuagacuggauugggagcagagggauggacaugguuaacagcaguucuugggauuugggggguggaguuuguaucggcucaagaaaagaauuucuaagaugggagcaaaguaagcuugugcccaugccagugagaagagaagaaaggauaguauuaagcccagugaaggggucaguuauggacaggaggagggguuuguaagccaggaagaagggagacuaaugagaaagaaugagggagaauggggguacuuaaagaucucagggcuuuguuuugcuuuguuuuuuaccuacauuuucagguuugggaguuauaaccuaaaguagccccugucuuuggcuucaguuuucucugccauaauaaaggcaagaccaugcaagguggcacugguuggggaaguugggauuugcaaguucauuggagaaagcuagcuaaaaagaaauguaggauugcuggacagugucaaaagcuuguuuguaguccauggccccaacuauucuuucauuguaaaauuaacggauugguuaagaugacucaguggguaaagccacuugcugccaagccuggcaaccuuaguucaguccuggacaugauaggaggaaaaacuggcuccugaaagauguccucugacuucugugcuucugccuucauaaacaaacaaacaaacaaacaaacaaacaaauggggaggagaagaagaaaaaaaaguaagugauuucugagauagcccaggcuguccucaaaguccugugcacaagccacccucuugccuuagcccuuuugauagcuaggacuacaggcaugacaauaugcucggcuguucaccuuucuuagugaacauuccuguauguguuguuggcacauggcuuccucuggcuuagaaguagguauaugccaaauuauuuuuuuuuucccuuagguucuucugaauuuuccagaaaguccugaaaccccugaguuccaggguggguguauaucaaacuuggagagaugaggcagagaaaugcaguaugggagaauaaagauuauuguaaucuccuaagcacucagaucuuuuaaguguggcuuuguuauuuuuuuuucuucaaacaaauuccugggacccaaauacauucuuauuuuauaauuuauucuuaauuuuugagguucuggggauggagcccaguggcuccugugugccaggcgcuggguacuaggauauaaauacguccuuucuauagacaccuagguucccuuuguagccuccuuauccucuuuccugucugugguaaugugaugguaacagugacauuugcugugguguuuccauuuaucuucucugucuguccguccauccauccauccgauuaaugugcauugguguuuugcuuacauguaugucugugugaggcugucugaucuccuggaacuggauuuauagacaguugugagcuuccaugugagugcagagaauugaacccucuagaagagcagccagugcucuuaaucacugagccguuucucuaccaagcugugguauuucuuaaaagcccugugcuauuguuaccuccugucccucuucuggugacagugaagguaagguuugcagcaugggugcuguuuuuagucucaggacucaccguccaccauggagcuggcuguggcuguccugagggaucugcuccgacaugcaucccagcuuccuacccuguuucgggacaucuccaccaaccaccuuccugggcuucuuacuuccuugcugggccucagaccagaggugagacuuugcaguucugguucuugcuuauacuguuuggauuaaaaaauguuaugggaacugcuuagggaguagguguaaggauaagaggauagugacugccuggagaaggggccuuaugggcugaggaugggauagaaguauaugggcuauuggugcuuggccucuccagacggaauucuguuuuuccuacagugugaacaaucagcuuuggagggaaugaaggcuugugugaccuauuuuccucgggccuguggcucucuaaaaguaaguacuucugaaacuuuuaaaacucucaaccuuagaguccaucccuggcauuucuaaguucuuaucacaacaagcaugguauaacaauacuaccauggaauaguaucauuuaguccucacagugaagauauugacuuaaauuaccuacucaagaugaagagggcuggagcuuugucugucugaugccagaccuuuugucuaacccguaaacuucuuuccucaucucucccucccuucuggcacagcccauucauucauucacucauucauucauuuguuuauuuacuuauuuauuuugguuuuucgagacaggguuucucuguguagcccuggcuguccuggagcucacuuuguagaccaggcuggccucgaacucagaaauccgccugccucugccucccgagugcugggauuaaaggcgugcgccaccacacccggcuccuuuuauuuauuuuuaaauuuagauuuuuuuaaguuauguguguaaguguuuugccugcauauaucucuuugagccuugugugccccuggugccugcagaggucaaagguguuggauuccucuggaacugaagcuaacagaugguugguuugugagcugccaugugggugcugggaaucaaacuugaggccucugcaagggcagccagugugcuuauggaggaaccaucuauccagccgcuaccaccuuugcucccucuuuuuaaugacccccacugagcuacccucaggccccaccccucagccccuuucucuuucggucuugccuauuuuggcucucuagaucugacuuuguuccugaagcaccaggaguuuccuucaggaagaacgugcuacagaggcucauuaccuccucaccccaauuucugguuuuguuuuucgugauuuuagcugucuuuguucaggcagcaaaaauagcauggauuugucauggguaagagacuugccaccaagccugacuugucucucccugccaauccuacugauagaagauuuguucuuacacuggcuaaccugcacucuuuuccuguccucauugagucaaaaacuuuuucaccuuuucacuuaaagggaguacuuuauggcuucucuuuagccugccugaauugacaucacuugagaucaccguaaaguaaaguaaagguugugugaguacaggcccugugcugcuguaacuguuugcuaauggagggagcagcuaagcugcugagagggaguggucucacucgaaaagucgucagucuguuauaauuguucugcuuuauuauuaaguuguuaaauucuuuccguacccagauugugagguaaacuuuaugauaggucaguguguacacgaaaaguauaggcugggguggugguacacucucauggcugaagcaagaguuuggaguuaguguaaauuguauagugagauuaaaaaaaaaacccaaaacaaaauaaacauaaaaucuauuaguauuugggauuauuuaugauuucaaccauuugcuggagauguugauacauauuccuuguggauacggguguuugugucacuguugccuccaguaugugacgccucaaagcagguaauuuuagugaaccuauguguacugagucuucauuugcauauggcugcucuuauccacagcuaauagaaguuauaaguggagcugaguguggcggcacacaccuuuaaucccagcacacgggagcccauggcaggcagauuucugaguuuaaggccagccuggucuacagagugaguuccaggauagccagggcuacacagagaaacccugucucgaaaaacaaaacaaaauaaaacaaaaaguuguaagugggcaggacaggauuucuguuuuuuguuuuguacuguggagugaacucaguccaaucacugaguucuauccuuggcucccucagaguuaaaauuuaauuuuauaaaacaaaaauaucuggaaucacaaacuuucuguuuguauuaaguucuguuucaauuaaaguguuccaaaacaguuuauaaaguauugauagggcuggcgagaugcuuaguagauaaggcguaagcccgaugacuugaguuugauucccuagaacuucugcauaguggaaguugcagaugaucagucacuguggcagaucugcuccaucugcuugugaggucagcagggucuugggucaagcaagcuagaucuagggagcuggucucuaguaagaaguuauggaaagcaaguaucaggcuugcucacaucaaggaacuagaacggaagggagaccuggaaacucgggguggcugaacccugcuucugguaggagcaagucuaacauauuuacaauggcaccauuacgguauagaguuagaauucacuauagagcuaggugguguuaauucuuugauuugaauuuguggugcguguagcugguaggguaagguguucccuuuagacuuggaaaggaacagugagcucaucacugacagccacaguccucucaugagcauagcuguuugcaguuaaaaugagagauacacuacauuuuacuuacaggucacugaaacuaaugguggccuuuucccuauuacuauucacacguucaugagcuccuuuuauucuaccccaaauaaauuguggaccuuagguugaacacuuacucuaggcucucucguaucaggcagagguuugcugauagacaguggaaacucugagauugauugccuucguuuugcugucuagccuguccuugugacccaguccucuauccaucccccuggguagugcauucauuuuagcugggccucauuuaugcucaucaugcagaguuagucuguaggcaguucuguuuuucagaacugucauuuugacuucagaaagaaaggugacugucacuugcaaaaacuagcagagggagcccaguuguuuuuauggcaggaaggagguucuuucucccaguaaggaggcuuagaaccagagcucaugugcugggucucuaccccagaaacauacuguuaauggcugucaucaccccauggaugcaucaugucuauaggaaagucaaaccucagguagaaggacugcuauggacacucggcauuguuccauggccucuuccuuucuccccuccuccagggaaagcuggcuuccuuuuuccugucucgauuggauucccugaacccucagcuccaacagguaaagggaagggagaggcacuaaguacggggaucuggucugaggcaucguuuacagcuuauucuuagcuguuaauugcacagcauuuggacccucuuuucaauuucuuccuccuaacacacacaauuacuggcuuucguacucuuagggauucugccucacuguuacuugaacuuguugagcuuuguuuucugggccauuaguggggugggagacccauggccaagcuagucccucucugaccagcuuucugcccuucugcagcuggccugcgaguguuacuccagguugcccucguuaggugcuggcuuuucccagggacugaagcacacagagaacugggaacaggagcugcacagccugcugaccucacugcacagcuuacuggggucccuguuugaggaaacagagccugguagggaacagggcuguagucuggagauggguuggagagcguggcaggagggaacaagugugguccacagaggccgggcaguggguuucugggugacauggaugagaacauaaguggguaaucuagcauaaaugaaagagugggggcuggagagggguucaguggugaaggacacuggcuguucuuccagaggacugggaauugauucucagcacccacauggcagcucguacaaagggaaaaggagggaugggagaaaggcagaguguauaggugguuguauugcugcccagcuccugugcagagugaaggcccuggaauagagaugcugcuuucccacucagaagaugguaacacccauguccuccuccagcuucggcagagguuuucaggccuggcccguugccuggggcucaugcucagguguguggcuauugaagggaacgggcuuggggcuggaaggugcgguggguguguggagucagcuagggugacugcucugagggucucuuuguucugguucucuagcucugaguuuggggcuccuguguccguuccugugcaggaaauccuggaccucaucugccggauccuugguaucaguagcaagaauauugugaguggauuuugccuuccuuugcauuguagucuugcuuaagacccuggccacuuggacaauacccagcugucaucucugaaagugucccugaggcauaugcaagugucguggacucccucacacaggguagagccaccuguggucagggcagacagugcugguuggggaugagccaaggcgucguuaaagggcucacucauggucaagcucuccuacaggaugggagaugggagaugggcuuggguugagcugggccagggaguugguucauguuauauaaucugauauaccugcuauguuucugucuuucuuuuccaucuuacuguugcugaauuuccuccagaacuugcuuggagaugguccccucagguugcugcugcugccuucucugcaccuugaggccuuggacuugcucucugcccugauccuugcguaaguaaacuuggucaugguguggagaagggaacgaacauacuggaaaugaaggccaccguuccguccucugccccuagguguggaagucgacuuuugcguuuuggugcccugaucagccggcugcuuccccagguucucaaugccuggagcacugggagggauacucuagcuccaggccaggagaggccuuacaggugauuguccacgagggcggauagaguggagaggguggaugagaacaucaggggccccggggcucuggcaugucagcucucguucauacccugcuuuccuuauuccuucuccagcaccauucggaccaaaguguaugcuaucuuagagcuaugggugcagguuuguggggccucagcagguaugcuucagggaggagccucuggagaagccuugcucacccaccugcucagugacaucuccccuccagcugaugcucuuaagguuagugagaccuuggcuccuguuccccuggcuccugugccuauuuccugacugacuguccugacuuccuguuugccuguacaugugacuguguuuccuuuuaccacaagcuaugcaguaccaggggaagcucugauggagguuugcaaagugggaagccaagugcuccuaagaagcucaagcucgauaugggggaagcuuuggcuccacccagccaaaggaaaggagauaggaaugccaacagugacgugugcgcagcugcacugagagguggguuggugugagcuggucagccagucggcagaguagagcacauaggcgcagaggcagccgugcaaccuugagagcauucugcccugcuuuuaguuuggggaucugguaguuucuucugaucuuccaagaucucaguuuaauuuagucaagcacuuuacauaugcgcuguguguggcagggacaguaugagcacuugugggugggaauccagggauccaugccagugggguucaugugcaggguagagcaggaugcugguggggauucccugcaucuaaugcaucugcgaauggagccagaguuaguggaugccgugauguuaggugacucuccuucggguagucuuacuaccugcuaucucucucauuguccaaggugaggccaguccuccucaguguauacauguaguaaauuaccagcauuaucuaucauccccauuuuauacugggggaagaaacugaggguaaaugccuugcccaggguagacaguaacagaacuggaugcucccugcuaggcugugugcccuugccuuccugucugccuuugacacaccauucucuucucaggccucagucggaccauccuuaugugcgggccucucaucaaggaggagacucacaggguuaguuaguagggaccgauccugauggaggggaggggccacuguucugugcauugggaguguuuaccccaaagguggauccacugaaagcugggaacgaggcacuggcuuugaaggugauguuucuagacucacacuauuuucuuuucagagacuucaugaucuaguccugccccuggucaugaguguccagcagggugagguccugggcagcucuccuuacaacaguuccugcugucgccucgggcucuaccgccugcugcuggcuuuauugcuggcaccuuccccucggugcccuccuccucuugccugugcccugaaagcuuucucucuuggccaaugggaagauagucuugagguaauugcugacuugagucagaucugauccuggguucucuuguucugaugcuugcuucgugagacccuguguuccugacauucuugccucuccuuccuuccuuucucaggucuccucuuuuugcucagaagcucuggugaccugugcugcucugacacacccccgaguaccuccucuacagagcucaggcccugccugccccacuccugcccccgucccuccuccugaggccccaucuucauucagggccccggccuuccauccuccaggccccaugcccuccauaggugcugugccauccacaggcccauuacccucagcaggccccauucccacaguaggcucuauggcguccacaggccaagugcccucucgcccuggaccuccagcaacagccaaccauuuaggccucucugucccaggccugguaucuguuccacccaggcuccuuccuggcccugaaaaccaccgugcaggcuccggugaggauccuguccuugcuccuagugggaccccuccgccuagcauaccuccagaugaaacuuuuggggggagaguaccuaggccagccuuuguccacuacgauaaggaggaggcaucugauguagagaucuccuuggaaagcgacucugaugacaguguggugauuguaccugaggggcuucccucccugccaccugcaccacccucaggcacuccucccccugcggcuccugccggcccaccaacagccucaccuccugugccagcuaaggaggauucugaagaacugccugcaaccccagggccuccacccccacccccacccccacccccaccggccucugguccugugacacuuccuccaccccagcuggucccugaagggacuccuggagggggaggacccacagccauggaagaagauuugacaguuauuaauaucaacagcagugaugaagaggaggaggaggaagaggaagaggaggaagaagaugaagaugaggaagaagaagacuuugaggaagaggaagaagaugaagaagaauauuuugaagaggaagaagaggaagaagaguuugaggaggaauuugaggaggaagaaggugaauuagaagaggaagaagaagaggaggaagaagaguuagaugagguagaagauguggaguuugguucagcaggggagguggaagaagguggaccuccacccccaacacugccaccugcucugccaccuucagacucgcccaaaguacagccugaggcagaaccugaaccugggcucuuauuggaaguugaggagccagggccagaggaggugccugggccugagacugcuccuacccuggccccugaagugcuccccucccaggaggagggggagcaggaagugggaagcccugcagcagggccaccucaggagcuuguugaagaguccucugcucccccugcccugcuggaagaggggacugaggguggaggugacaaagugccacccccaccggagacaccugcagaagaaauggagacagaagcagaaguuccagcuccucaggaaaaggugagaggauuagcuguggaggacccugcgugaggaguggagcuggcaaggcagcucugcuggggaaccgguacuacagucaggcuguguguguguauagauacauacauaucuaucagguucuguguguguguauagauauauagauaucuaucagguucuguguguguguauagauacauagauaucuaucagguucuguguguguguguauagauacauagauaucuaucagguucuguguguguguauagauacauagauaacuaucagguucuguguguguguguauagauacauagauaucuaucagguucuguguguguguguguguauguguauagauacauagauaucuaucagguucuguguguguguguguguauguguauagauacauagauaucuaucagguucucuguguguguguauagauacauagauaucuaucagguucucugucuguguguguguauauagauacauagauaucuaucagguucucuguguguguguguguguagauacauagaugaaaucuaucuccaguuguuggggacccacauggagacugagcugcaaguuuguuaugggggcagggcacaaaggagaaugugauggggagggacucugggagggauagaaauaaauaaauguaaagggucauggugagggcuggggguugcuccagucugacuucugugugugacuuugaauuuugugccuuugucccuaaaaggagcaagaugauacagcugccaugcuggcugauuucaucgauugucccccugacgaugagaagccaccaccugcuacagagccugacucguagccccuucugcaccccgucacuuuguauccaauaaaguucugucugua

SEQ ID NO: 12184 - RNA, 26904 nt, Mus musculus
aauccugagcuguuaguucaagauggcggcugccguggggcccuugggcgauggggagcuguggcagagcuggcuuccuaaccacgucguguucuugcggcuccgcgagggcguaagaaaccagaguccagccgaagcggagaagccagcggcuucgacuucacccucgugcccgucucugccgccgcauuugccgacgagaaaccuggucuucggccucggaggggaacuguuucugugggacgcagaaggcagcgccuucuuggugguucgccuucgaggccccagcggugguggcguggagccuccucucucccaguaucaggugcgccgguccaucgugaaagcaaucagccuuuugguucguuggcggaccugggcuggcgucuuuugggaacgccccacuucgaguggaaugaccccgcuuuguagcucaaucuggucuggaaucacuauguagcccaggcuagccaggaacuccugccccagucucugaguguugagauuacgggucuaagucauuuauaaacaccaaaacagaggcuaggccuguguguguguccagcaccugacauaaaccuagagcaugcacaagcuccguaauaucugugauuugcuucgguggggguggagggguuuguugagacaggguuaacagcccugguuguucuggaacgcacucuguagagcaggcugaccucauuaacagagaucuggaggauccugaucagagcuaggauuaagccaugugcugccacugcccaguucuacaacaggcauuuaaagacaugggccuacagauuuaaaagcaauuagaaauauuauuauauucaaaagaaauccuuauuuaaaaggauuuuuggcuuaguauaauucuccauacuaagguaaauaauauauugauggucucaucauuauuuacgaauaauaaaaagaaauuagaaaucuaaaauggucaugagaaaagaaauaggaaguaccagggugagaguauuuuugaggcuauaugaugcuaugacaaauuauugaaacucccuuaaacuaucacucuuuuauauuaaguccacguagaugaagcaguacugcuugcugcaaggcgcuugaagguaaucuagggccuuaccugugaccuugggugaccuggagcucaaacagagccaccugcaccuuaucuggugcugggaauaaaggcgugaaccuuuacacuuggccugaagcucuuccuuucucuacaguacaguuauaagaugguaaucuguugauacuuccgaguuuauguauuuacuggguaucaagagucugcuugaggccaggaacacagaagaaaaaucucaaguagcgccuacuggguuaugucagggaaaguuuagaauguuuaagaccugugguauuacccagagcugugguguggaacuacagaaaacaugccuuuguucccuggccgcaagaucagggguaauuucucccuuuuuuuuuuuuuuuuuuuaaguuuuuguuuuuaaauuuucuggguauguauguuuuccugcaaaugagugcugcauauaacaucuaugugccuggugcacacagaugcuacagagccaccgugcgggggcugggaauugaacccagguccucuggaagaguagcccugugguuuuuauuuucaguuuguguguguguuuggugagagagagagagagagagaauaugaauaugaaugagccccaagaauaugggugcugggaaccaaacucaggucuuuugcaagggcagcaagugcuuuuagguguugucaucuaucaagaaccuagagauuauuucuuggggaauaaucagcuaaugacacaguuaguacaugcucagaaugcuauuuauaacuuuagaaauuuaaaacgugauuaugguuucaagcaacucugaaauaaauuuauauuaaaauuaacuauuuuuacuaaaugguuuuacuuucagagauuacucugcauuaauccacccuuguuugaaauccaucaagucuuguugaguccaacccaacaucauguagcacuuaucggaaguaaaggacuuauggcauuagaauuaccucagaggugggggaaggacucugaauuugaagguggaaaagcaacugugaauuguagguaaguuguauuuucauuuaguauuuaucuguguaaguugcuaagacccaaaaugguugaaauguauuuaggggccacuauugaaacauuugagcauuuguaugguccugcacacugacuuccugugguacuauuguuguccguucuuuuuuaaacauguaugagugguuugccuucauuuaguaagugcagugcuugugugccuggacagcaagaagagagugucaaaucuccuaaacuggaguuagaguuuagcugcuacgagguugcuaggagccaauguuggauccucugcaaaagcggcaggugcucuaaacuccugagccaccuucccagucccugcuguuauuuuugaagaauacuguguuaauuuuuuuuuuggauuuuaaauuuuuuuuaauuagguauuuuccucaauuacauuuccgaugcuaucccaaaagucccccauacccucccccccaacuccccuacccacccauucccacuuuuuggcccugguguuccccuguacuggggcauauaaaguuugcauguccaaugggccucucuuuccagugauggccgacuaggccaucuuuugauacauaugcagcuagagucaagagcuccgggguacuuguuaguucauaauguuguuccaccuauaggguugcagaucccuuuagcuccuuggguauuuucucuagcuccuccauugggggcccugugauccauccaauagcugacugugagcauccacuucuguguuugcuaggccccggccuagucucacaagagacagcuauaucaggguccuuucagcaaacucuugcuaguguaugcaauggugucaucguuuggaggcugauuaugggauggaucccuggauauggcagucucuagaugguccaaccuuuugucucagcuccaaacuuugucucuguaacuccugaauauuuuuaauuaagagaaacaaucucacucucuuauuuuuacaaaaauagcugcaaguuuggaguuagguucacaagcuuaagaacuaugcacaaaaugaaccaaaacacauggauuaaugguauugucuacugguuaacaagacaccauuuauauauguugggccauuuucuggucauugcaauuugugcuaugauaucauaaauguaccaugaacuacucaugcccucaaagguauagauagcaguuggacagacuuccagguauucaaucacagaaagaagacaaauaacuacauuaauacuuaugcuacuucaaaguuuaaaaaaaacaaugugugggacuuaauacuuaguguaacaaagugugccaguuacaucccuucccugcuuccuccagcacaggagugaaccugugacuugcaggcugaaagugcugagacugcagaaguguguccauagcccagcuuucagucuuauuuuuaugcacacauacacauauuaaaaaguaaauaaaauccaggcaggugggaaucgagacagucuacugcaaaggauagaggguaggagcccagaccccaccuuaccucuguaucuuacagagaguccgcuuaaauugcuuacuacuauucagaucacuguuucuauuuucagaauaaucaucauagcaucugcccuuauaguugccuuacuucauuaauuaguaaaaggaccaaacaagaggcaauaucaaaauacaucuguaauuguauaaacugggugugguaauacacaaauguaaucucagcccucaggaugcugagccggaaggcugugaguucaaggcuggccucugcuacauugugagggccaggccucagcuaggcuguauaccaagauacugucugaaccagcaaaaccaaaauguauaaaauauauuacuauaguauagaaaauauuugcacuuugauuccuuggauagguucuuagaaugcucucagaaugucuuaagagaaggaacgaaacaguguuaaaguagguuugaacauguuuuaaccaagcucuacaaacaaauguucuuaaagauugucuuuauuuuagcaccaucccgauugcugagagauuuuucaccagcucuaccucucugacucugaagcaugcugcaugguauccaagugagaugcuggauccccacauagugcuguugacaucagacaacgugauaagguaaccuuucccuugccuaguuacaccuugugaauggaaaggcuuauuuacugagucauugcucaggauaacacaauuaagucacugaauguugugaugucuuuaucucagugccuauuauaaaccauucuuucccuacccuccuugagauauugucucacugugugcacaaggcuggccuucacuuauagagaucccugccucugcuuaccuagugcuggcaucacagcuuuuaauagcacuucucucccugcugaaugaugaaggcugauuguagaacuuuuaauggcaucuuaaagagauuucauagcuuucagcuuacucuuaguuauuaaaacuaguguuaaaagccaguguggcggcacacgccuuuaaucccagcacucuggaggcagaggcagguggauuucugaguuugaggccagccuggucuacaaagugaguuccaggacagccagggcuauacagagaaacccugucuugaaaaaccaaaaccaaaaaaacuaguguuguugaugggcggcagugguggcacaugccugaggcagguggauuuccgagaguucuccacuagccugggcuacauaaugagacccuaucucaaacaaagcaaaaaaaauaaguguauccagcuuagaacucugaucugaaaauauuuuuaaaauuauauauaugaccguuucauggucaaaacugggucuuaaggaaacuggagaguggagaggcaagcugaguuuuuccucuuuuucaacacuguaaguacuguacugcacauuaauguacaguacaguacauucugaggcgcauaguaaaguguaaggacuggggcugcucucuuccucuuagcuccuuccagaugagcagggauaacaggcaagugaggcacaaagacccuaccuguuagcagugaguacaauaucugaccuugguuuaacccaguuccaugcauugcuaaugaucucugaauguggugucugugcacagaugguguguguuagggcacauuguuuaacuucccaacucccucgucauugaggacaucuguaccccacuguuuucuuuguugucagucaucuagacucaagguggaagauucccagacuuacuauauccuguguccuuuuuuuuuaaaauugcauuuaaaaauaagggcauguguaugugugugcacacacaugcucacaugugcgcuugcaugcacaucuacggcccacauaugaaggucaaaggacaacuugcuuacagaacuugauucuauccuuucaccaugugggucuuaaggauugaacucagguugccauggugacaggagccuuuaucugcugagucauucugacaguccuuuuauccuuuuaaccuaaguuuuaugaguuuucauauggacccauaccagugcccuguuuuccuccaagagcugcagaaaauagauguaguccuuucaagcuuucuuccuaguuucccuuuuaucuuuuuuuuuaaaagauauauuuauuuuauguauaugaguacacuacagcugucuugagacacagcagaagagggcaucagauucccuuaugguugugagccacuaugugggugcugggaauugaacucaggaccucuggaagagcaguuauuuguuuguagccaucaucucuccagcccccuuucaagcuuuaguauaucccuuuuagaauuucuagaagaguagacaccuuaagcccucagcucugacauaucagguucaccuaagaauuucuuugauggcugauagguuucuccugcuuauuuagcuagaacuuaaauaccagguuuucuuaugacagguacugcugcaucuucucgcucuuccuucuagaaccuuuuccugucaccuacuuagcuuuguaauuggaguuaacaaagaggaaacaaaauuaucccaugucagaccuuacucuguacuaccaaggaccccuugauaaucuauuauuuuagcaucuuuuguauaugcuagaaaaggaagugggggauguagccuaaagcuauaaaggugucuggcaacaaauagcaaggguuuuguguaaaauaugggucuuaauccucucauucugagccuugggccuugccggcauugguugcuuagcugcacuuaugucccuuaguauuugccaacacgguguuuaugugucaacaguauuugcaugugccuaaagagaccacggugaauauauuuauuuagaucaaauuauuauuaagagcacgugcuaaagaaauauuuaugugacuuuuggguuguuuuuguuuaugugagacaggguuucacuauuuuuagccuuggcuguccuguaacucacuguauagaccaggcuggccccuaacucacugagauugaccugccucugccucuugacuucugggguuaaaagcaugggccaucaugccuggccaugaaaguaaaauuuuacugauaauggaauaaaaguuuaaacauuauuaguggaaagagacaaguggcugacuuagguaaaacuuagugaugagugauggacaucggauuuucuaguaaugacagugcuaguauuuauuuugaauauucuuucaucuuuaacaagagcaauauaugcuaugaaauaaaagauguuuuaggagauggaggauuggcuuagugguucuaagagcgugcuuauuucucagcacccauauugagcagcucacacugccugaagcuccagcuccaggaaaucagauuccccuagcuuccaagagcacauaccuguacguaauuuaaaauaaguuguuuuaaauuaaaauuauuuugguaaaacaguucacucucuuuugggagcaugggggcggguauugaaacaggguuucucugugcaguuuuggcuguccuugaacuuguucuguagaccaagcuggccuagaacugaggacugccugcuucugccaggcuaacaguucacgcuuaugcugcucuuugagaaaacagggaugacacaauauugagucuuuuuguaauaagcaucuuauagauuucagguuaaauaccacucagucuucugaauauuugauauauaaauacauuuuaaccacuucuggucuuagcaagauaugguugcugcuuugugugguuuugugucuagcagacaaagacacaugguaugauuaaagggaagcuggccagccaggagccacagugagaugacuacacaaagcucuccagacagaaaggguagaggugcagucacaugcaguagcugccauagaauugugauaaaugugggaaauguaguucaguggucaaauaccuaugguugaggccuuggguuccaccccuaacacuauuaccucucuuccucccccuucccccaaaauauguuguuauagauagcauuucuucagcucauaaaccucccucuuauguaguuaagcagaggaaauaggcaguauugccaggaauagcaagauguuugacaaagagcugauuuaagaacuggugauuugcugggugugguggcgcacgccuuuaaucccagcacucaggaggcagaggcaggcggauuucugucucgaaaaacagaaaaaccaaacaaacaaaaaaaaaaagaacuggugauuugagauuuuaaaaauucucuuaaaauuuacuuuagguuuauuuuaugugugugggugucuugccagccuguguguauguauacuguaucuaugucugauacccaaggaugucagaagaggagggauccucuuuaccuggaguuacaaacgaugugugccuccauggaggugauagggaccaaacccaguuccucugcaagagcaucaagcgcccuuaacugcugaugguaggaaaauccuuaagaacugaguaugugggggaaggggcuccuuuucuuggaaaugaaagaaaacuuguauuuuguugaaacaguaucuuacucuguaacccaugcugcucuguaaccgguguagcuuguaacuugguguccucuugccucagugucccaaaugauagaauuuuagugugagcuacucuugccuggcuucaaagagaacuuuuuuuuuuccuagaauuuauucucuccgugagccccagacacccacuaaggugauuguacuuucagaagcagaagaggaaaguuuaauacucaauaaaggguaaguuuuuauuugugucacaaaauacugaguuuauagagacuauaaaugcaguuuuaccagaacuacaaagaauuuccagaguuaaguuuuagaauacuugugguauuauaacaagaagucacaagucugaaugucacuguaacuaacagcaugaucucuuuuugagauaauucuaaaauacaguuggcaggaacaaugcauaauaaaauuugaacaguucuaaaaauggcacaguguugggcuggagacuuaagcagugugcucugugugggugaagcucacugcugaacucccagcucugugacagaauagacucagucauucugauuaacagguguuuugucuuuuguuuucuuuucucuucuuuucuuuuguugagacagagucucucuacauagccuuggcuguccugaaacucgccuuguagaccaggcuagccucaaacucacagagauccaccugccucugccccccaagugcugggauuaaggguguguaccucuacgccugacuuuuuuuugguuaucuugugcuccuggcuucuuucuuuuuuuuuuuuucuuaucuacuacacaaccuggcuuaagcuuaccacaaauggaaucacccugugaacuuccaaaccaaacccucuggccucccgaugagucuuugugauucgcacagcacauggucacguggacuacacaugcuuagaaugaaaacuagugccaagauuucuggauuuuucauuuaguuaucuucauguuuagucuuuguucuaaacauagucuugaguauuuugugcaucuuuauccuguuuuugaucauuucaguacuggcaguccucgugggauggcgcugauauacuuaaaucuguguugguuucuuccuguccugcagucuugcuuuucucauuguugaugaucgcuuacuguaaacuuacauuuacuugcucuucaaguguguggauauugagagccugagugggauauaaugcauuuaucucuucuacugcugggagccagggguugcuauagccuggaacuguuuacucccuggcugucccagcacugaaaguuuacuuaaaugauaugaagaaauagggcaccagcuuaaauuccaaugcaucauuuccauaacagggcaggaccuagcucagaggucauccuauucuagagucaaggcauuuucuguucugugguauauuucuggggcuaaccuaguugggugguagguggguuuuguuuguuuuugauaggcacaguauguauauaagaggcaguagagcaaauauagugauaagaacucugcucuaaaaaaaaaaacucugcucuagcugggugguaauggugccuuuguucccagcauucugagggagagauggguggaucucugaggacagccuggucuacagagcaaguccaggacagccagggcucuguuacacagagaaacacugucucaaaaaacaaacaaacaaacaaacaaacaaaaccagaucucugcucugguaucagucacccaaccugguugcaaucaagccucaaccacuugccuacuuuggcaucuggaaaaguuuucuaguuguacuaagcuuaauuucuguaacuauauuccaugaauauaaaaaauuggcagagcucauuucuuaggauuauuucacagagugaaaugaaucauucauuagaaagugcucagcaggggcuggaaaaauggcucagcaguuaagagcacugacugcucuuccagagauccugaguucaauucccagcaaccacaugguggcucacagccaucuguaaugggaucugaugcccucuucuggugugucugaagacagcugcaguauacuuaacuuauauaaauaaaauaaauaaaucuuuaaacaaaagaaacuguccagcaaccuugaauauagcuuaauauauauaguuauagacuauauuuagguagaguacuuaccuaaagggcacuaggcccuggguaugugauuguaucaaccauuucuaugcccacagauccccagauaaugacacggaggcuuauauuuacuaaugaaugccuaggccuuaugccaggcucguuucccacuagcuugugacucaauuauccccuuuauacuaaucuaaguucugccauuuggcugguuuguuaccucuccucaguuucauucaucugacuucugaguccaugugacuucucucugaccagaagucccaccuuacuauucugccuuuugcuauaggcuguaggcuuuuuauuuuaaccagucagaaagugccauaggcaggcaaggaaggacagggacacaucuucacacaggguacaaaaacgucacuccaacacucguaccaggaaaaggagauugcuuaguauguuguaagccagaguaagcauucauaccuaauuuccagucagucggucugucugucucuuuauguuuguuuguuuauuguguguguacauaaauaagcucauguugcauacauguguguguucaucccuccuucaagaagucaguucucaaccucugccaugaguaucacaaggauccaacagacugucagucuuggagucaaguaccuuuccccacugaguuccugcucugauuuuugagacagguucucacaguagcuccucuggagacacucggauuacuuuaaauagugcucccaccaacacccuucggcccuccuuucucuaacaccacguucuuucaggaaaaaugacacaggucuauaauguuagcacucggaaggccaaggcagaaagauuguuacagguuaagucagucuguaagagugugugaccugucucaaugaaaccaaaaauagcaacaacaacaaaaaaaucauuuucugaacuauuauuuuuuaucuucacucaagagcagagccuuucuuuaauuugcugauauauuuuaugaaccuagaacaguacauagcacauaguaaaugguaaguguuuauggaaugaauaaauuuguauuuaucagguuuucauguuuucuuccauuucuuauacuucuauauauguguuguuuguaucuccauguuuaaacuauuucaaaauuaaaaauuuucacaaauuuuauaagaauuuguuuauucauaauaauuuuuguuuucaacauuuuuuuuuucaacucuguuugcagaagagcauauacagcgucucuaggagagacugcaguggcguuugacuucgggccccugguaaccgucucaaagaauauauuugaacagaaagacagagaugugguggcguauccacuguacauccuguaugagaauggggagaccuuccuuaccuacgugagccuguuacacagguaaggaaggcagcagccacuguugcugucugcaucgccacucugcugaaggaagauccacaucucuguaucugagggauagaugagaaauggcacacuuuauuugauuaccuacuuccuuguuuauuuaaggaaguuguaagguuaggaugaacugaaaaggcauugcuucucuuauguaaacaagcaucgugaguggguaugauuagauguaaucugacauugaacuccuggagaaacaggcauguauacucacagacauaggauucacuccccaguagugggaugcaguaagugcucaaaggaaggagacauuacagacauuauuuugaguauaggagcuagggggauuuuuguaguaugggacuuaacaagucucaagcaggcauaaaugaaacaucaaggaacaguuagagcaguuuagucacaaagguauccuagaguagagcaugcaaaagcacagaugccagucaagguuucagugacucgacaucuugaucucaagcagugaauucagguaaaaaacaacaaauauugaaguugccgugcagguaaaaauugauggaguuacugccucaguaaggaagaugcugaggucuguucuaaaagagcagagugguuucugagcagaguagaaggcuggugagggacucgaguggcgaauguuuauaccugggacaccugagggauuuuagcauuguuuuuguggugguggugguggugguggugguggugguggugguggugguguuuaaauaugaguuuugcuuuuuugguguugggguuucuuuuuugguuuugguguuuuauuuuuuggcuuggucuuagguuuauucauugagcccagaaaacaagagaaaaaaaugagacagcacucugcaaggacgugaugaaagaggcagagagcacaucagaaacaaaauugucgggagcauuaacaggguuaggcagcugcauauggggucauguguuuuucauuccagcacuuaggaggcagagacagguagguagauuucuugugacuuugaaucuagccuagucuauacagguuauagagcaaguugcaggauagccaaggcuauguagagagacccugucuaaaaaaaagaauaucagacaacaacaguuaaccaguggugauacagcaggucagguuaaaccuuuggauucagcaacuagaaucauaggugaucuuugcuagaguacuaccaguggaguguugcaaaugggaaccagacugcaugugcugguacaugccaguaauuccaucccaccaaaggcugacacagcaguccugaguuuaaggcuagccuggacuguguaauggcaacuugucuuuuuuuauuuuuuuuaauuuaucuauauuugauguauauguguguuuugccuaaauguauguauguguaugcagugcuggcagaggccagaaguagacaucagauccccuggaacuggagcuacaaacauuuaugagccacauguggguguuaggaguggaacccagguccucaagaguagccagugcucuuaaccacugggccgucuaugcagcccucugucccucuguuuugucuggugguguaguaauuacagggauggaaccuccagucuuaccacuaacaauagauaccagucuugccccgagccucacagacaaucuagugucuucuaaggcauaauggauucucuuggaauccuagcucuggaagcuguaacgggggucaggaauuaaggcaaccuagacuacuuuguacuuugucuggaaggaaaaaagaaacuaaacaaaacaaaaaccuggaaucucuucaggcacugcaguuuuccuuucaaggagaugaucucagaccaagagucaccaccguuggaaugugauugggaaaggagaguagggacagucuccuucugugagcauuuuccugauagugcuuuuauucuuccuuuagcccagggaauauugggaagcuguugggcccacugccuaugcauccugcagcugaagauaacuacgguuacgaugccugugcuauacucuguuugcccuguguuccaaauaucuuaguaauugcgacugagucaggaaugcuguaccacuguguuguacuagagggagaagaagaagaugaccaaacgguaaguaacaggcuaguguugcuauauuucauaucuaauagcagguauaguucaugggccacuuugacugcuuaaucaugagaaauucuagcuuacauaugguacuuuugauauuuugguaauuauauguuuuauauaagaauaauugagaguccaaguagaaagaagaaauuugccuaauuuagaguccaugaaacuguauuuguuucugaccuuuguauuaaggguuuauaccuugcaccaguaaguugacuccucuaaacauaagauugcucuuggggcuggagagggggcucaggagauaagaacacuggccacucucuuaagacccagguucaauuccuaacaccuacagcucagcuguuuguaaucccaguaccaggauaucuuaacacacucuucuggccucuguggguaccagguaugggagugguacacagacauacuugcagauaaagcacauggguagguuauuguguauauggauacaugauaaauaaaagguuagaccaugcuuguuuguaagcuuucaagguuuuuuuauuuuguuuuguuuuuuuaauuuaucagaaaaagggcaucucugcuggaacuggaguuaguugucaugugggugcugggaacugaaaguggcuggucuacaagagcagacagugcacuuugccucugagccaucauuucucuuacaccuguucuuugacuuuuuuuuuuuaagauuuauuuauuuauuauauguaaguacauuauagcugucuucagacacuccagaagagggcaucagauuucguuaccgaugguugugagccaccuugugguugcugggauuugaacucaggaccuugagaaaagcaguuggcucccuuaaccacugagccaucuagccagcccuguucuuugacuuuugagacagaguuucacuaagugucuaaugcuggccuuaagcuugcuguacagaccaagguggucugugacugaaacccuccugcuuuaauguucccacuuagugcugagguuacaguguuuaacaccacugucgauggugauucugggccucuauagucuuauuuaaauuuugguuucuugagauagggucucucuauguagcccuguccguuuuggaacuugcuacguagaccaagcuggccuggaccucacagagaucagucagccucugccuccuguguauuaaaggcaugcaccacacccagcuugauuucuauagucuaguccuugguaacaaagguuuugaccuuugggccaaaucuuuggaccacuaggccagcuuuuccccaggcuccugauguuuuuguuauugcugucuaagguuaacaggggagagagauguuuaaggauaggguacgacuaucugaucaaacuuuugaaaggacuaugugaccugucuuuuuuuguuucuguguuuguguacauuuucaaauucaugagaggucuaaauuucggucuuuguuuccccuuuguguuuuuaacaguuagaaaaguccugggaucccagggcugacuucaucccuucucuguacguguuugaguguguugaguuagagcuugcccugaagcuggcaucuggagaggacgaucccuuugccucugacuuuuccugcccaauuaaacugcacagagguaagguguucacccgguguacuuacacuaacucagcacugugguuacuuacucuaugguuauuccugugcucucaaauuuugaaaaguuaauuggauucuuuuuggacuuuuaguuacuauacaguacagucuuuccuaggcaaacucauuuuaacacucguuguggcuccacacacauaauuaauuuuauuuauuacucugugugugugugugugugugugugugugugugugugugugugugugugugugaaguuuggguaccagaggacagcucuuugauucuuuccauuuuacauggauucugaggaucaggccuggauggugggcacuuuacccacuggugccacccauuuguuugaugaugacuuuuuccugauccuaacauaguuggcauaguggucauaucuuuaaucucaacagaaggccaaaucagaagguucaaggcccucucggauaauauaucagagcaauauuccuuauauaauacaacugcaaagagaaaucacuaagcaucucuacaaaaucaaaauguuuaaucucuuugaaaauuuuuuaauuagauuuagccauuuuauuuacguguuuggguguuuugcuugcaugugugucugugcaccacauacauggagaccugaagagggugucagaucccuuugaaacaucaugugggugcugagaauugaacgagggccugugaaagagcagcugcugcucagccucugagccacgucuccagcuccuuuuaaagucuuagcuuugcugaagauguggcuaaggacaaguauugcuaacacugacaaggcuuagaaagggcucaauccccagcaccaccgcaugucuguaaucccagcacuuggggucagaaguuaaaggccauuuucagcuaaguuuguggccagcaugggcuacaugagacccugucucaaaaagaaaagaggagggcugcaaaguggcugagaggauuggggugcuugucaccaagccuggcaaccugaguuagaucccccgcacccauauagugaagcaagaaacggcugucugaaagguguucuccacaugcaugcccuguuacucucucucucucacacguacacacacacacacacacaccuggaugcauacacuauaaauauaauuuucaaagagaucuuaaccauagagauaaaucuuuauaaguagcauuagaaauucaagagaggugaacaugguaguauagucauagucacagccccuugaggcuaaaguaaccuagguucuagcuguaaaggacgugauaucuuauuucacaccugcuuauuguuugauggugggacugugugcugagcacugugcugaugucuucugcguuaccuguccuacauguacuacacucguuacauguacuacacucguuaugugccagugggugugugcaagcuacccuuuuguuuguuuuuuuguuuuguuuuguuuuugugguguuuuuuuuuuuuucaagacagaguuucuuugaguaucccuggcuguccuggaccucacuuuguagaccaggcuggccuugaauucacagagaucugccugccucugccuccaaaaaggcauaugccaccacuguccagcuuuuguuuuguuuuguuuuaaacaaaugaaaacuccuuuaguaauaacauguaaugguucuggcugauguacaagugggaacuggccccaaacagaaaauuccccucaacuuucauagauccacaacagcaaauuacacuuggaacaguuaaacguguuuugcagaaacagaaauuccaagauuugguuuuggacaaaugacgagcucuacaacauaaaauacugucaaaaguucuccccacgaagaccaggcccacucugcucagcagcuguuaaccaaggcugucuucucuaaacugccuagcagaggcaguaagcuuuacuuuugugugacuuaaugucuucuaaguaaguuuauugguaaauccuuucuaaggucaguucacggcuuccauuuucuuuauagggugcugguguaacaggcuugcaccaccacacacagcccucuuguauguucuccacuugcacuuagacacuucucuguuguauuucuaccuuuuuacaaaaccacuggcauauccauucuugcaccuuggggaguuuuccuaacuugaacuuggccagacaggguggacaagggauuugcuggcugauguuuucuugggacauugcuccaccuuuucuugcucugcuugguucuuugguaucuccuuugguuucuuucuguccucuuuccucuaccucuguucuuccuuugcuccaucuuuaugaugauuucuauaggacucuucuggguauuguucccaauguauaacuaguuucuuuuaacaaaauuccaaguuuaugauuuuuguaaaguugucaucagcauacagcuuuugguucugagaaggucucauucucagagauuaaaacaaaaaucuuuagccauacaggauuauauccaagaaagucaaucccagacgucagaggaccccagugggauaauggcccucuuucuacuaagucccgagcuguagaaucuuaauacgauguguagggucccguucuuuuuuugauuuuuuuuuuaagauuuauuuauuauauguaaguacacuguagcuggcuucagacacccuggaagagggcacuagaucucauuagagaugguuaggagccaccaugugguugcugggaauugaacuuaaaaccuucagaagagcagccagugcucuuaaccucugagacaucucuccagaccaugucuguuguuuuuaauuugaaaauggaauucaagccagguacugauggcacacaccuuuaaucccagcacuugggaggcagaggcaggcagauuucugaguucgaggccagccuggucuacaaagugaguuccaggacagccagggcuacacagagaaacccuuucucggaaaaccaagagaggaagagagaaugaauggaauucagauuaaaaacuuucaagucccugacaacagugcacaacugugaaaauccuguagacaguggguuucaucaccauguguuuguaagccacugggguaaauucuucuuguuuccuaguugcuaucuuuguaucuuugauggucucacuugcagaucccaaguguccuucgagauaccacugcagccaugaagcuggcgugcacaguguggggcugacuuggauucacaaacugcacaaauuucuuggaucgggugaguuacuaaguuucuguauuucccaguaaguuucagagauucugacaaaguguaguuuggagaagcaaacauuagaaucagugaaccuaagcguucuuuagaaggcucauuuucagagcugaugaaccuuuagccagacagaccaaauacuagaacaaaaaaacccuaaaauuacuauagucagaaaacauaggcagauuacuauuaagccuauagaaauuaggaggccuagguaaaauggauggacuucagaacugacuggaaugcccuaaaccaagugacuuuacauuuaaaauguugauucuccaugagcuucucccaaaaaaacaguacuguuaaccucaaccugugauaccaaagccaagcaaaauaaucaaacuauagucaguguuaagaacaaucaaagagccugaauauggcucaaugguaggucauucgccuacaugaagacugacugauccuccacacuacguaaaacaacaaaaucaacaaacuaguuuuagaaaggaauuuugucaggcaaauaaagagcacuuaugcaaaccugacagcgaacaccugaauggcaggcugaaauguuuuccguuuugaauauauuuauuuuuugagacucguccaugcagguguauuuugaucauauccacucccucacacacacgguuuccuuaacucuucucagauccauuucucaagcccuaagcccccucccaacugucuuuuuuuuuuuuuuuuuuuuuuaauggccuaaguucacauugugcugccuguauucucauguauaugguaccaugcauagggcaugcucaucucccgggagccacacacuaugaaaacuggcucacccucucccaguaaccagcagcucucaauaacuguucagcugggcuuugucugagaagggcgcccucugugaaaaguagugacuugagacaagaacuuaaauacauuuaacaaaugacaagugcuugaacuuggagcuuugucuaaguacauuaauuucuauaaugcauucuuuuguagaugaagaagauaaggauaguuuacaagaacucacugcugagcagaaaugcuuuguggagcacauucuuuguacaaagccauugccgugcaggugaggaagaaccuucuuuacuuguaggagcaucaugguuaccagguguuuguuuaucuaaagccuucgugugcuucacagcuaccucaccacguccugugugcccaacuacagcuugccaucuucucuuagauaauuuuuauuuucuugucuuaaauuacuucuucagagaagggucccuuaauucuccaggcuaauuuggggcuuucuuuguagcauauccccucacacacacaccacaccccacccccuucucaugugugggugugcacuacaaaggcagucucuuacuuuuuaugaggauucuguuggcuuugugccuucauacucagaauguaagagugccuaguggauauucaguuacugugacgaguaaagaaaggugcauggaaugguccccaggucccuugucugugugaaugaacagauguucauuccccuuugggggggaaaaaaaagaugcagaagagcagauuugggaagaugucccucuagaauguuuaaaguagaagagccuaauacacauuuauguguaugggucuaaaguuuguaaauugccuggaaauaauaaaaaugucagcauugaaccugugauucugacagauguugacuaagaaaagaucuggagucagaaaaagagacuugagauaaacaagcaacacauaauuaauugugagcacugaguggagcagaagagccaggaaggcaagggguucagagaacggaggagaacccagagcggggcugugaugaacgccaaggagcgacuauugacaagaagacgaaguaguauuggauaagcacugccaggccggagaguagagacuccccacucuacuggaaggauugaggaaugacagcaaaaugugccagguuaaaaaguggacagggaacuauagccauauuuggcuagagagauggcuuugcaguuaagagcacccagcuucauuuccaaccacagcucacacccaccaugcaagaaaaacacccaugcacaugaauaacuacauaaaaugaaagugaggcaaccgcgacacggcagugugagauggggcuagugguuuaccuuuaugaaggauggacauguaggcuucgauggcugcgacugcugccuccuccccuuuugucuucaagguacuaaaaucgaaccuuggaccuugcuaggcaggcauucuaucacuaagcuguagccuugguuuucuuuuuaguacugguuacauguuguauaugcacauuuuuauauauggauuacauacugacaacuguaugacaaaguuuauugagaaguauagacuuugguuaauuuuagugugugauguuuauuugcaagguuuuuuuuuuuucuuucuucuuaaaguuuauuuuaaaaagagaaaaaagagauggggaggugugucuguggauaacagcacuugcugagcaagcuuuaagaucugagcucaaacuucuaaauagauuaaaaaaaagcuagguauggccaaguacugguuccccgucuccaguagggacagaaacaggaugauaacugggacuugcugguugccagccuggcucagugaaacccuggcucaagggaccaaacugaagcugugccuacacacaggugugccaauaggcacuuguauauacacuguauacucauacaugguugcuguuacaaaauaaagaacaagucaaaggaagccagacugggcacaaugaagcuucccgucaagccacaguggggaaugucucaugaacaaaacuaaacacaagcuugucuauaagcaugucuaacaugcauaaugggacacuuugaaacuaugcaguugauggcacaaggugcagaaaugugguuaggcacaaguaggacaggcauguagacauaaagcacauugguggggacagcaauucccauuugagacccuuguuuucuccccaccucuggugaaagaaguaggaaggaaacaaaggaaacaauguugugcacacuaaaugaagugaauucuuguggcagguauugggucacuggguauguaagauuccaaagcucucuucauuuaggucucugagcagcuuguagacacugaacuaggcucacugagauagaugggccuuagauguuacuggggagaaaaacauauaagcuguguaucccuagauaauugguaaauagcuuguagauugcuacuaagugggagcuuuguuuaaacugaucaagguauguuuccaaauaaccauguuuggggugguuacugcauugacagucaggaugucacaggccccaaaaggccuggaccagucauauaguugcuauugguucugguuaacugcugcuuuguaacuuuguaaccucuuugcaggcagccagcuccaauucgaggauucuggaucgucccagacauccuggggcccacaaugaucugcaucaccaguaccuaugaaugucucauacggccuuuauuguaagucccauucuguaucugccacauaacucucuaauucugccaaaucaacgcuggagagaaugcccuuaguaacuaguuugaggcugugugguuuaaguuuuggcuucugaauucagucaauauuucuguuuucuuuacuaucucugaaaaaguuucauuuuagacaucaugggauuuuuuuuggcucguaauugagaaucauagcuuuucuguucuguuuugagauagggucucagccugcaguccugcuggccuagaacaggcuuuaccucaucugagauuacuacugugauuuucuacacccagcuagagauuuucucccaaguacagaggauugagacacuggacuacauuguugugauuggauuuaguugacuguugcaugucaggcucagguauaagauauucuccuguauguccuccuggacacauuagagaagccccaaggaaucuucuaaucuccauguaauagaaaaaggcuuaaacaagucaaggguugcacauacauauagcucuggugcacaugagggucugcguggucccucucucugccagccucagagggacauugcacuauguaaacucugaggaaacaguauaaagcugaguuuauguauuaaguuguaaucaccaguucccuuggaaggucuuauaaacguagaaauagacaugcaaaccaagucacugggguguuaaaacaugagacuuugcgaucucuugguguccauucagaacagguacuucugacagaagugugacagaagugugaaggguuugcauucaguuacuauccuuacaugccuuugguuuugguuuugguuuugguuuuuugagacaggguuucucuguguagcccuggcuguccuggaacucacuuuguagaccaggcuggccucgaauucagaaauccaccugccucugcuuccugagugcugggauuaaaggcgugcccaccacacaccuggcuuccuuacaugcuuuuuaaagauugaccaguuacacugcuugauaagaaaaaaaaaaaauuacaaguauaaauuuuauguugcuuuauauaaaaaagacauuaaaauucuaacaacuuuaaacaaaagaaauacuaggaaaauauuugccugagagcugccucagcagguuaagagugcuugucacugacucugacaaccugaguugaauucccagaaccaugugacauagagaaacucuccuuuauacuauccucugaccuuguacgugugcugugccaugcugugcacaugcacaugaagcaaauaauagguaaaaauaaaacaaaucuuccagggauuaauuuuuuuaauccauuauauaccuaccuuuuuuuuuuccaauuuguuauuagauauuuucuucauuuacauuucaaaugcuaucccgaaaguccccuauacgcucccccugcccugcuccccaaaccaccugcuuccuggcccuggcauuccccuguacuggggcauauaaucuuugcaagaccaagggccucuccucccagugauggccgacuaggucaucuucugcuacauaugcaacuagagacacagcucuggggguacuggucaguucauauuguuguuccuccuauaggguugcagaccccuucagcuccuugggugcuuucucuagcuucuccauugggggcccuguguuccaucuuauagaugacugugagcauccacuucuguauuugccaguguuuuuuuaaaaagccagucaugcuauuuggauaauaaaaacaucaaucccaaagugaaaccuuuuuaucuggguaauuuuuaaucauauuucuaccaacugccugaaauaccaguugucuacuaacugguauaguaacacuguuacuuauaaagccccuccaacuaggaauugaauuggugccuucaaaguaaguuacuuacaugcugccaaagaccacagaccuuugagcuuucuuggaaauugucuuuggaaauguuugcucuuggauguaauuuuuagaaagcaaauucugaggaaguaaauucuguacacagcagucaucuggucccacagccagcuuuccucaaaucucaacuaugcccgaaaaaggagugguuagcauugugcugcugacucaaguccuuugcaagaaaagggaugugugaguugccuugaucuuuucaaaaagaauuuucagucuaaaaugcauuuugagucaaaauguucaaauaacaagaucagaguuccccaagaugaccuuucaggccagaacacacauucuugucauauuccucuuuuagguucuuagguuuuggguaguguggcuaauaacuccauaguggaccugacuuguuuauuuugcagaaguacaguccacccagcaucuccuccccugcucuguacccaagaagaugcugaaguugcagagucuccacugcgcauucuggcugaaacuccagacuccuuugagaagcauauuaaaagaaucuugcagcguagugcugccaacccagcauuucucaaguaggaaauuuagggcauaugaauuuuaagaugggcuuuuugguuaaaauggggauugaacuuauggcuuugugcuuacuagcaaguguuuauuguugcuuuugguccuuuuucuguccuuacuguggugcagugggaggggacuuggcacaucucuucagcuagucuaggacuugucuauuugguuguuuuauuugacuaaugagaauaaugacagaaacuguucugcaagaucaucugaaaaggauuuggcucccccucccgaggagugucuucagcuuaucagcagagccacccagguguuccgagaacaguacauucucaagcaggaccuggccaaggaggagauucagcggagguagaguccugugaugaacagccacuaguccuugcuagggguugcucaauaacugucuauggaagccuggccuuccuuuuaacuuuacuacugcuucuuuuugaagggucaaauuauuaugugaccaaaagaggaaacaacucgaagaucucaauuacugucgagaggaaagguagguaucaaacccagaggggagagaacaauggugaguaguggacugcauucucacuuaggaugcugugccacaucauacggacccccaaggguuucucaucucuucaggaaaagucuccgggaaauggcugagcgcuuagcugacaaauaugaggaagccaaagaaaaacaagaagauaucaugaacaggucaggggccaugaagcauccaguuuccugcccacacaggguuaaugaugccacaaguauuuggguacugccaguguucacacaccuauagaguaaaauggaucccccaacccuuugaaguacuaugaaagaggacacuguccccugaccccuucucuauugucuccucaccaaauucuugagcuacaaacuuuguuucucuuguaauuagcacuuuacucacauuuccuuccuuuucuuaaggaugaaaaaagugcuucacaguuuucaugcucagcucccaguucucucugacagugagagagacaugaagaaagaguuacagcugauaccugaucaacugcgacaucuaggcaacgccaucaaacagguaagaaugggugcaguaaucuagggaauaguuuuauaaagugugaacaguaaaauacuguaaaaaugugugcaaaccauagucaaaauaucuguguucuguuugguacuugagguuacuaugaaaaaagauuaucaacagcggaagauggaaaaagugcugaguccucagaaacccaccauuacucucagugccuaccagcgaaagugcauucaguccauccugaaagaagaguacguuuacuguugugcgacagguuucccuuggcgguauaccaaaagcugccggucugccuggauaagaauccggaguccaggcauuugcuugcagaauggggcacaaaagacagaguauaugguggaauggaaaguaguggcuuccuauaauauaauuuuguugaauaaucaaaagaacaucccaguuaugguuggcaauguuccugggcuggggcucaguggcugauguccuggguuuagaccccagcacuacacagaaaaccacugcuguccaacugaaaccuuuugagguuauucagucuuagcaaagccauucuuaggucuauugcaacacuuaagaguuugaagucuuacaacucacugggcaugguggagcacaccuuuaaucccagcauucggaauuagcauguggaucuccgaguucaaggccagccuggucuacagagcaaguuccaggacagccagggcuacacagagagacccugucuaggauggugggaguccuuacaacucagcaaugacagcucaucuuauucauuugaugauuuugcaggggugaacacauaagggaaauggugaagcaaaucaaugacauccgaaaucaugucaccuucugacaccaccuggaaugaacauaacuugaaggcuguaaaacaaacagggagcacuguuuaauuuauaaaggagcauuuuggauaagauuuggugugguuauucuuuuguuauuccuuuuuguuauuauuucuguuaaauaaauuuauuuauucaaauaaaguuugaauaaauuuuuauucaaaaauuugacu

SEQ ID NO: 12185 - RNA, 3356 nt, Mus musculus
caccggucgagggcgucggcaguugcugccccugcgcaaagugaccccguguggcggggcggccccgagcccccccaggccucucuguuaugguagggccaucccagccccgaguugucgucgggucuccgcggccccggguuaucguaggggcuauccgaccccgugucauuguaggauccgcgcgggcccgggcuccccgggacgcgacuccccgcccacaacuagcggccgggggaucuccccgcccccgaguggucuucgggacgccccgggcucgggugauugugggcucucccagacccggggugauugucucguccccuuggcccgcgguggucguagcgucuccaaggccgagggcucccacaggcucuccguggccccgggugauugucgguaccccgcggccgcggauaaucgucgggucuccacgggucccggccgccggggcggaucaggccucugcgccuucccggggagccccgcaaggccgcagacaagaugaacauucuggcgcccgugcggagggaccgcguccuggcggagcugccccagguaggcaccagggccacgucgggccucuggcugucgcugagugugggcggggagaagguggcccagccccgucgcccugcaaggcccgcugcuccugggugguccgcuucccaccccacccccagcccagggcugcuuggcuauggcacaaaagcuccauucucacaauguuccucucagugccugaagaaagaggccgcuuugcacgugcgcaaagacuuccacccccgcgucacuugcgccugccaggagcaccggacaggcaccguggggugaguuagggacacuccuagcuaaaaaauuacucaagaaacuuugaagucauucaccccuuugugguuacaagguuaugccucaguucugauguucucccaguuuccucccauugagguugugagccuauggaaaagacauccaacagggagagucacaccacccauagaaccucuagucgggggcgggguaucugagagcggggaggagugacagacagacagagacagagugaacgaucacacuauucuaacaugugcagagcccuccuaggcuacccccagcacuacacgacuuccucccccaucacuccagaaaaacaggucugaaagucccuaauguugaacacugcuccacagcacaucugugcaggacuuucugggcuuccagggagaccugccuaucuaugguaauguaccuuaguugauauggauuuucucuguccauccacucuucuguccaacagauuuaagauauccaaggucaucguugugggagaccuaucuguggggaagaccugucucauuaauagguaacaggguacuggagcuuggccgggcaaagacucagcuggauccaguuuaacaggguaggcggggcuacaggcuacuuggugucuccuuagguucugcaaagacaccuucgauaagaauuacaaggcuaccaucggaguggauuuugagauggaacgauuugaagucuuggguguccccuucagucuccaacugugagugucucuuccacuccuuccagauagccuugucaucccauuuugcacacccuauuaucuggguucugcucuccuuucuuccaguugggacacggcuggucaggaaagguucaagugcauugcuuccaccuacuaccguggagcucaagguagggauuuggcucuggaaugcaggaagucuaagagcacaucagucaguguucugaggagaggugauggacagggaaaaggcaaagacauccauccauucaucuuccugucagucugcagcuguuucugucacucuuucagccaucaucauugucuucaaccugaaugacguggcaucccuggaacacaccaaguaugugaggaugccagaacaggaugggaaaguccagggagguuuuagaaaaggggaucaaagccaggcaugguggugcacgccuuuaaucccagcacucaggaagcagaggcaggcggauuucugaguuugaggccagccuggucuacagagugaguuccaggacagccagggcuauacagagaaacccugucucgaaaaaccaaaaaaaaaaaaaaaaaaaagaaagaaagaaagaaagaaguugggaucaauugggaaaagagaauguaucuaagugcugucucuagcucagcgguagggacuugccaacaaugcauagaaaucugggauggguccuuuggaguaacagaggugggggcugggguggagagaaaagccagagcucguaacuggacaugggaaaguggauggacggggccugccaggcucacucagucuuuaaugcuauccaccauccgucuguggcaggcaguggcucacugaugcccucaaggagaacgacccuuccaacgugcuccucuuccuuguggguuccaagaaggaccugagugugagugugccaguggaggaccuucccaccuuggugaggggacccacccccggucugacucugauuuucccacagacuccugcucaguauucccuaauggagaaggaugcccucaagguggcccaagagauuaaggccgaguacugggcgguguccucccucacuggugaguuggggcuccagccuucugcugugcauaccugccuaccucuccucucccuccugcaucuaagccugguccaguguucuauaguguuccccugagguuucugcuccucaugucaggugagaauguccgggaauucuucuuccguguggcagcacuaaccuuugaggccaauguccuggcggagcuggagaaauccggggcucggcacauugcagauguuguucguaaguuaaccaccugguuaacaguggcagagagcggagguggggugguuaccuucaauccaugguucauauauuucccaucccuuuucaggcaucaacagcgaugacaaaaaccuguaccuaacugccagcaagaaaaaggccacauguugucccugagcagugaggacuguccagagacuucccauuuccgggguaccgugcuaccugcaacugcuccagaacucaaccccuggacauuugcacugacuuuuuccagaccaaagagcuauccauugaugucagugccccccagaaggugacagggaccaugcuagucauuugcugcccccaggcaccaugccaaagacuggaugacccucuguuccucuggggcucuccagggugccuggugaggggcaguguucuugcugcuuuugcucagccugcugggccuuucauguauaaaaaugcuuaaugauuuuagccuuacacugugccuuaugcauuaaaguccauuauuagca

SEQ ID NO: 12186 - RNA, 35814 nt, Mus musculus
gcgcagcugcucggcuccucucgcccgcgacucgaccggcccagcucucgcggacaagucccgacaucacgcgcccccccccaccgccgcggggaccgccuccucuucacucucggcuucgucgaagauaaacaauaguuggccggcgagcggcgagugugucucccgccucggaauucggcgggcugcgugggaacggcgggaucccgggcagccggccauggcggggcuguacucgcugggagugagcgucuucucggaccagggcgggaggaaguacauggaggacguaacucagaucgugguggagcccgagccggcugcggaggacaagccggcgccgguaccgcggcgggcgcucggguugccggcgacccccacucucgccggcgucgggccaucggaaaaaggcccggcggcggcccgcgacccugccccggacgccgcggccucgcuacccgcuggccgcugcugucgccgccgcucuucgguggccuucuuugcagugugcgacgggcacggcggucgggaggcggcacaguuugcccgggagcacuugugggguuucaucaagaagcagaaaggcuucaccucguccgagcccgccaaggugugcgcugccauccgcaaagguuuccucgccugucaccucgccauguggaagaaacuggguaaguuccccgcccgccucuuuuuuucuuuucuccccuuaucccccugggcuuuuuauagcaucagcaccgcgugggccuccccgguaccaagagcgcuauccaucaagcgacgcuguccaacaagggaugcgagugaagacugucaugguuggaguucuaggcacaccgaguggccucggaaacgcuaggauggcuugucucccagcaaccgcuccuugcauuaucuccucccuccuacgaucagggggcaacagucuccccucucccuucgcuaauucacuuugguagcagcacgcucagaaguguuugaaugccggcgccagauuguaaccgagggauaaauuuaagaaacguuucuacacgggcuaggugaaagaagcaggagguggcaagaauuggagcguucccuuagcaucugucauaauuuuguucuuguugggcuuguuccucuugguugccuccuaccgguggugucacuucuucagauugaccugaauggcucuggcucgauguaagucaauuuagaagggcugaaguguaacauaggcaacuuacuuuugugauaguguuuugggguaaucccuugaauuguuuaugagaaaggugugcaacguguuaaauauuaaauuggcuccauguuaggggcauguguuaacuucuuggugugugugugugggauacuuagaauugcauucaguuuuccaaaaguucauacugaaaagcacucaugucacuacucaucaaaguaguuuuugguaacagguauuuuaauuccuaaaaguuaagugugauuguagucccaucuaaauuuugaaucucucugagacagacaguacuucuguagauaacagaaaugcccgaggguuauauggcugcuuauuuugcccuggguauauggugcauauuuuuguuacagaaaagaauuuauguuccugccacuaaaaacccuucguuuauagugguguaagaaagucacucuauuuucauuaaagagacagagacucagugcuguuacagauuuguaaaauacacaguauuuuuagaaaggcauugucauacaguauaggcuagcugguuucaaaucuguuuuccaucuguugggccuuuugccaaguauuugauugacuugaagaccagccacugaggguuuuggaggcaggucccagcaaaucccuugggccccuaucauggauuuauuuuguuuucgugugggcugaguagagcuugaaagcauuguaguuuauucuagaaaugcauuauauuauuggcugaagaggaauuaaaaguggauagggagacaaagaagauuaagauuagacacaaagaccuauuacagaguucauuuauuuugcaguacacuuggggcauaugaauuucccauaugcuuuaaaaaucaaaagccuuuaauaguugaacuuuagcuagguguggugguacaugccuuuaauacuaguccuugagaggccaagguaggcagauaucucugaguuugaggccagccuggucuacucuacagagagaguuucaaggacagccaugccuaguaaagagacccuuucuuuaaagggggggaaaaaaaagauugacccuucauauugaagugugguagcuaaugcugguaauccuagcacuuggguggcaggccaggaggaccggugcaaguucagggccaggacagcaagguagacuaucacaaagggaagcagcaguuugaacuuuauauuugguuuauuuuaaccugacuugugcugguguugaauugaacacagggucucucacauaagcacaagcccuaccucugugaugcccgagcgucccuuuaauaaagcaggggucaugcuguuaauuuaaauguguuuuuauacaugcacauacuucaaaagcuucaaaagacauuuguauuuuuaaauuauguguggauguaugcaugugagugcagaugcccccccccccaaaaaaaaaucagagacgugagcucuccugaaggcuaagguuacaauacaggugguugugggaugugggcuguggugucuggggacugagcucuuggcacuuggguacuuuagaagagaccaugcucuaacccugugugccaccucuccagcccuacauacaaauacuuuuugagucaugcuuuuuuuuuuuuacugagugaaaccuuaaaugaacgccauauucaaaacuuagauuuaaaagaauuaaaguauuuugagaaccaugauauaggaaauacaaauuaaaaaaauugcagcucuuaauuuuuguucagcucuugauuuucuaccaauuaaacagaguuagcguuugcagccugucauccauccucaggccaagguccuuucagucccuguucacccucccucugcacuuguguuaauuagcauuuuuuuuucugucaucuuugacaagacaccuuuuccaaggcacauuaacauauuucacuuuugauuggcaugguggcucaugucuuuaauacuaaccaaugggaggcagaaacuggcgaaucucugaguucaaggccagccugguguacagagcgaguuucuggucagucaggguuucauaaugagaccuguguaaaacaaagcaaagcaaagcaaaacaaaacauauauauacaucuagaaaacaccacacauauauuucagggauuagggcaacugcacagaugggucagugguuaaaagcgcuugcugcugcuucagaagaccugggcucuguucccagcacccacauagcagcucccaggcaucuguaacuucauucccaguggauucagcacccucuucugaucuuccugggcaccaggcacacacaugaugcacaaauguacaugcaaagaaaacucaaacaaacauauaaauaaauaaaacauuuuucauuuuuaggcuuauugcccccccccccaacuaaaacuauauugaucauauagacugccagacaguauuuucuuaugugacacuacaguuucuuuugaaaucgagcauucuccuuucucuguuauacucacuggauuaauagcaguucuuaacuuuuuuuuuuuuuuuuuuugguuuuugagacaggguuucucuguguagcccuggcuauccuggaauucacucuguagaccagguuggccucgaacucagaaauccaccugccucugccucccaaguccugggauuaaaggugugcgucaccccccccccccccagcaacuauuuugcuuuuuagacagcuauuucuuugugcuggggauuaaacucagagccucaugcguuauguauggcucuagugcugagcuauuacuccaggcuccuguacuguuaagucacuagugacccaagagcuacuguucaugugggcagcaucuaucaguguagauaaaaguccuacuuaaaaaggaaagcaaugcaugucguuaguuccagugcuugggaugcaguuggaucuuugucaguuugagguagucuggucuuccuuacuaguucugggccacuccagguuacacagugagaaccugucucaauaaagugauacuaaccaggcuuggggagagagcagaggcccagaguuggauucccagcacccacauuggucaacuuacaaccacuuguuacuucagcucugggaggauccaauaccuccaacccucacaggcaccaguacucguauguacacauccacacagccuagacacauauguacuuaguuacgguuaauucagucuucuuuaaaaaguaaaaaaauaagaacaauauuccaaaguauauauuauuuccaaauaagaauuccuaauguaaagaauggcauugcauauauauauuuuuuucaaaucucuuaauguaugucuuaauagaagacaucuuaguuccuaucuguuucugcacuuaguuucuuuuacuaguugguugaaguagauuuaaaaaaaaaaaggggccuuuuauauacagguguaguaggaaaaggaauauuuuauuaguguuuucagaucauugaguagucugugucaaguguuugcauuuuaaguuuaguugaacuguggucugaaaccucaguaaugaaaacuuuguagucuuguauuaagauccuaacucguugaguuugagggugugugugugugcaugggagguuuuggaggaaggaagggggaagggagagaugauguaauuaaacuauaaucuaaaaaugaaaauaaaaaaguuacugaaagaaugacuccuccugcaauaugucuuguuuauagcuccucaugaagugaccccuggaaaucaucugucccaucuucuaaaaccaaaauaaacaaaacauucuuuccccuuaucagacuuggggucuuguauaugguaggcaagucugcuacuggguucgaggccccagccuucucuccugggguuugaaucaauuuuugccuaugugugaguuuuaacaggguguaaugguaccgugaguuaauaucuucugaauauugguacauuucagcaugugauacaaaaaaauaaguaagacuauuuuuauugaugucaugagaaaagauuuuauuggaagcugaaggcuacccugcuagauaugcauuugagucuuccaaauggcaauuagaaauccaucaugcuuuucuuugaagacaauacauaucaaauaaccaagcuuucuguuuucugcuaggaucuuaucugccauagagcccaggggccuugacuuugcucuuccuuucuaaggcucuggggugcugagauuucaggcaugaaucaccaccaccauuggucuguucaucuuuucugucuuguuuuccuuuuuccuccugagccaugguuucaaauaguugggggagugggugguggguaucucaaauuugcugcacaugaauuucugguccucuugucuucccaaaguugggauuacagcccugugcuaccacguaaguuuuuuuuuuuucuuuguuuuucaagacaggguuuuucuguguagcccuggcugucccagaacucacucuguagaccaggcuggccucgaacucagaauuucgccugccucugcuucccaagugcugggauuaaaugcgggugccaccacgccugacauuuuuuuuuuuuuuaaacaaaguaaaaggagauagggcuacaguauguagccuaggcuaccuuugaaaucugcauguguggacuagaggauaaccuuugguaucauuccucagguguacaagagacagggucucuugcuaugguaaagcucacuaauuaggcuagagcuaccauagacccuaggcaucuuuuucugucucucuaggaaugggaucacaagcucuuagugcaccugaccuuuuuuuuuuaauuuauuuacuuauuuuauguauauaugaguacacuguagcuguaccgaugguuaugagccaucaugugcuugaugggaauuugaauucaggaccucuucucauuccauuuggccccauuggacccugcucacucuguucuaaagauuuauuauaucuaaguacacuguagcuguuuccagacgcaccagaagaaggugucagaucucauuacagaugguugugagccaccaugugguugcugggauuugaacucaggacuuuggaagagcagucaguguucuuaaccacugagccaucucucuagccccacaccugacuuuuuuuguuuguuuguuuuuuucuuucuuuuuuuuuauuaauuuacuuaaaucuuuuuuuaauuagguauuuuccucauuuacauuuccaaugcuaucccaaaaguccuccauacccucccccccacccccguacccacccacuccuacuuuuuggcccugguguuccccuguacugggggauauaaaguuugcaaguccaaugggccucucuuuccagugauggccaacuaggccaucuuuugauacauaugcagcuagagucaagagcuccgggguacugguuaguucauaauguuauuccaccuauauuguuuguuuuuucgagacaggguuucacuuuguagaccaggcuggccucgaacucagaaauccgccugcuccugccucccaagugcucggauuaaaggcgugcgccacuacugccuggcgacucuuuuuuuuuuuuuaaaugaaaagguuuucauguuuaugagcacucugucugcguaggucuugcauuacuuuaccaacugacugucuucccagucccuucguuaugaaauauuuuuuuaaagauuuauuuauuuauuuacuuacuuauuauauguguguacacuguagcugucuucagacacuccagaagagggcaucagauuuuuguuauuuguuacggaugguugugagccaccaugugguugcugggauuugaacucaggacuuuuggaagaacagucggugcucuuaaccgccgagccaucucuccagcccccugguuaugagauuuuaauacuguuguuuuaccuuuucuaugcuagguuuacagguaugccuuaccaagucuuccccuaugcccagcuuauaaggguguagcuaugaagaauacaguggcaacuagcuuacuuugaggcuucugccaugaccacugaucgaucaggcacuccaaguuuuaccaagcauugcuuuguacaugugcaugggucaacacagcccagagggcagcugagcucuuagaauuauuaggaggagcugcuggaaagaucaguugaccacugagagaccagcacguccuucugucugccucuuagcugaagcuugagguuuuuggcugcaaagguaauugccuuacuuguaacuaagacuaggguuguccauguagcacaugaaguaauguguaaugaacggucagcagaauaguuguuucuguccaguauagugaugaaauaaaucagcuccuuuauauuuuaauaaacacauggauccguuuguuacuuuauuauuauguguggggggugggcauaggucagaggacagacaauugguaggaauggguucuuguuccucaguguuaucugagcccugacgauaguucagguugucaggguugucagaaagcaccucugccuguggaacagguucacugugcuggggaggaaagccggggaguguuagcagcggcuuccuaggcugcuagggaccaguccugucuccuacauauguucguguguacgcacacaugccuguguacugcacauguguaccuagacauacaaaacuaauugugaauuggggcagcaagaugacucaguggauagcguugcuugcugggaaaccuaauuacuuggguuugaucccuuucuaggaaucaaacacuugguggaaugagagaacugacuccuuccaaguugucuuaagaccuguaaacuguggcucacaucuccuccugcccacaaaauaaauaagcaagcauaaaaaacaaaacucauuagugaaaauuuaugcaacagaguuauguuagcuuccuaggaaugcucucucaaauaaccaauaacugggugguuugaaacaauagagacuuaggcuuuuaugccuuuggaugucaaaaguuggaaaucaagcagucaugagaguggguggguuccuuggggaaucaagcgucaugagaguggguuccuuggggaaucaagcgucaugagaguggguuccuuggggagaaucuguucugcgccugccucugguagcugucagccaucuuuugccuuuuuuuggcuugaagauggaugcaucucuguaucucagccuuuucuuuuucuauccccuucuugcauugucuucacuucucucuucuaagugcccacucuaauccaggaugaucucuuuuuaaggaucuuaaccuacauucaucugcaaagaccccuuucugaaaaaaaagccguugucacagguuucagaaggauaacagcccacuaaaaauguauuuuuaucuccucagauaccuuccccccaaauaguuaauuccaaaggaaauagacuacaauggaaaacuugacaaauaccucuuaaguuaucaaauauagcaaugguuuaaauuuuuuaaaguggauuuauuuuuuuaaauagggccucacuguguggcuguguuuguuggugaaugccuguaauccuagcucaagggucacuagacguuugagccacuuuugggguaaggagugacaccuuguuucaaaaugaaauaaauaacaaauuacccagucuuaaguacuuuuuauagcaguggaaaccaguuuaagauuagugauguagaagucuccuguuuguaggaauuagguacuaugaguaauagcucaguauuaguucaagaaaauaaguuagcuuuuugcuggagcagaaaggaaaaugcaaaaccuaagcacagcucucaggaaggucaaacccggggcucggccagauucuaggagaguuuucuuaaggucucuuugcuguaauagucuguauuuauuucaauaaagaauaggaaucagaaauugcagccucguuucauuuucuaaguaucauuugauuuauaauugugucauuuuccaaggguuuucagacuuucuuuuuucuuuuugagacaagcauucacucuggaguuugggcuggccuggaccucacuauacauccuaggcuagccuugaauucacauggucaucuuucugccucagacucccaagugcuggacuacacaguugagcugcuaugcuuggcuaccucucucauauuguugcaaugaauaaacuuuauacaaauauauaugcuuaucugcucugcucuuuuguguuuuacuaucugugccagucuuuaugauuucuagggaaauugcaauaauugcuauguuuuuuggaggugaguuacuuucaccaugccccaaagaccuauacacaaucuauucuccccauaauaggcuuccaaacauggcaagagcuagggagggauuuucggcuuguuuugaauccagcuuuucuuacuugugcugugacuuugcauaagacuauugugccagaguguccuuaucuguaagguggagcugaugacaguacugcccaccuccuaagauggaaugaguauauuggcagcagguauacaauaugugccccaaguuuuauauuugccacaaaguacacauacacaauuacaauuuuugcuuaccuguaauuuuuuuuuuuuuuuugugauuuuuuugagacagaguuucucuguauagcucuggcuguccuggaacucacucuguagaccaggcuagccuugaacuaagaaauccaccugccucugccucccgagugcuggaauugaaggcgugugccacuacgcccggcuaauuuuuucuuuauuaaaaucauucucuucccccuuuccucucuugcccgcuuccuuucauuuaucucacauaacucagacccugcuugaacaugaaugauuccuugacucuacuucccaggagcuuagauuacagguguaugucaccauuccaaauucaaaaaauuauuaauuuuuuuuagaagacugaguuuuagcugagcaagauggcuugggaauguaaucccagcaacuccaaaggcugagacaguaagauugcuacuaugaguucaggguugguuugaguugcauagccagccagugcuauauaaugaaauccaaucucaaaaauuggggcuagaaugaugguucagcaguuaaguguauucacugcuccugcaggggacccagguuuccaguucuagggaauccaaaggcccuuuuuuucugcccgcacaggcaugaggcauacauguaauucacagacaugcaugcagacacccacacauacauaaaaaugaaaaacccuuagaaaacaaacaaaaagacacuggagguggcucgcuugccuaggaugcguaagaucuuggguucauucuccagcaacaccaaaacaaacaaauauuuaaaaauaaaugaauaaaaacaagagagguaaugagucuuaccugguucaggguaagacugaaguuccaguuugcagggagguugaggcaagaugauuugguggugguuccccgucugguuaauaaaacaauagcaacaacaccccacccccgcccccaugccucauuccugugauacucgaacugaaggacaggguucuuugcaagugcacacacuuggucagcauagcauaguacagccuugaacucagggacucuggugaucuuccugccuuagccacccauauaggugugaagcuaguuauguuaaauauuuauccugggucuggugcaguggugcauagcccaugauucuauuucauuuguuuggaagauguagaacgauuguguguucccucuagccugaaaaacagugagaaacuucaccuuacaaacaacaaaaccuucacaaaacacuaaaaaacaaguuuauagguuuguuuguuuguuuuaaacauauguaagagaauauuaacgaacagguguaggauugcuuuaacucaguuaucaaaugcuauaaauagauuaguuuaaauucaguacuacaucugagacaaauuauaacaugauaaaaguggcauuucaagugaauuacauuauuuuuaguccauugcagaauaucuauuuguucauacaauuugcucaugggguucuuugacauuuaucuguguauguauuuuguguacguguauggauacaugugguacagcagcuuaugaaguucagagggcgcuuuguaggagcuggugcucuuggccucauggauuccagggacuugggggcaaguaccuuuguucacugagccaucuuuuuaaaaauuucucuucucucucucucucucucucucucucucucucucuuucuuucuuucuuucuuucuuucuuucuuggagauauggucucccuacauaccuacauagcccugguugaccugguacucucaccaugucaaccagagauccaccugcuuuucucuucuagacuaaaggcauucaccacuaugccagacuuuaaauuuucuuuuuugaaucagagguccauauagcccagguugcccuggaagucuguauguagcugaagauaaucuugaacucuugauccuccuucuuuuaccucccaagugcugauauuacagguguguuccgucagaucagguucagagaugugauauuaaauaauauuguugcuuugacugucuuauuugcgcgcacacacacccauuuuauuuuaggugaauuuugaacaugacucaauuacuuguaugcuuuuaguaaauuuuuguuuuucugaauuugccuuuuguuauuauuuauuuauuuauuuagacacacagggucuuuuuguguagcccugguuggcuuaggauaugauauguagaccaggcugguugugaacucaucaacucucugucucugucucccuagagcuagaacuaggugucuagcaucacagauaacuaaaugucaauaacaaauaaguguauauacuguccagauagagaagaggacauugccuguauugcacacguaccugaauaucuaugcuggucuuacuuguguugucccuguguggugcuggguuuugaauauggaagucaguguauucuagauaggcuuuccuuuuuacuuucuagagauagucucaugaaguugcccacacuugcuuuggacugguuuguguuuuuuuuuaaaaacaaaucuaugguuuguguuuuuuuuuaaaacaaaucuacuuuuuuuuaaaaagguuuauuuuauguaugugugaguacacuguagcugucucagacacaccagaagagggcaucagaccccauuaccgaugguugugagccaccaugugguugcugggaauugaacucaggaccucuggaagagcagucagugcucuuaaccucugagccaucucuccagcccuugccuugaacuguuguugguccuuccacuucggccuucuaguagguaggauuaguuuccugccacuguggcuucauguuucuccuuccaaggaguaaccaucucuugagccuccauucuguacugcuugcugaugauuuuagucgucugaccagguaaguucuguacaugauguccuuuaucuccggaguuucugagauucuuaggcauuguguagaaugaggagcgccucaggguuucuucacucugugagcagugcuacucuggccauguguuucugcagugaugugugguacuccuggggugguugaggagguccugucuuccucccacaugauacccaagugucccugcaguguucaugcuguccucaguagcugacugaaguguguguugcuuccgcauuuccgaccacaugugcugugucauccuuuaagcacuuguucucaugcuguguucucuugugguuuuuaauuacuauuuaccggaugacugaagaaaacuugaaugccuuugcgugcuuuuugucugaguuuucucuuugguucaaggccuauuuaggccuuucuuuuuuccuucagguggccugucugacugauuucaguuguggggacauuuuguagacuuuguauacgucagugaaguagucugauucugcuccugguaacuuacuaaguaaacuuguggguacacaaggaggccagaagguguuggguuccuuagggcuggaguuagaggugugggugcugcugugaccucaugauugagcagcaggggcuugucacuacugagccucaguuuaccacccauugccuaauuaaggagaaccaauuuauucccucuuacuagcuuuucuugcuuaucauuugacugcccucugcaguuauccuaguauaacuguuugcucaaacuuacaggacucccucauuuugcugugaccuuuacugugcuauggggugacuuuuauauuuuguccuuucaguagaguuccagugggcagaguauguaaguaagugauucaaucugcuaucaugaauuuacaguuggaguuuaguauuacagaguuguuguaauacuaaauuguuguugucacugaauuuaacuagacaguauaugguuuggaauugauuugagaguucuguuauuuaauuuuuaaguuaucuuaagcaagcuucuuaaccaugcaaaguauuuauuucuucauuuguaagaugaaaauaggaauaauuuguuuuucuuuuuguuuuucaagacaggguuucucuauauaguuuuggcugucuggaacuuaacuuuguagaccaggcuggccucaaacucagacaucuaccugccucugccuucuuagugcugagauuaaaggugcacaccaccacugccuggcuagggaagaauuuuaugucuuauuggcuuacuguaaauauuauuugaaguaguacgugcaagcuucuuuguauaggacuuuggugaugaguaaauguuguuggguggguggggagaugguuuagcaguuaagagcacauccugcuuuugcagaggaccugccucaguucucagcacccaucaggagacuaacaacugccuguaacuccagcuccagggaauuugauggccucuuuuggccuguuugggcucuguacacaugguauacauaauugucaaccacauacauaugcacauguauacacacacacacacacacacacauacacacacacaaaugaaaauaugggaggcagaggcagagaggccgagguagagucucugaguucaagauuagguuagcaugaucuacauagcaaguuccaagccagucagggcuacauagugauaucuuguuuccacccccccccccccaaacaacaacaacaacucaagucaaaacuaaguaaauaaauuaaaauuacuaaaauuagaauauuuaaaaguuguuuaaaaauaaaaccaaguggcuauuucuggaaagauacaagugcuggaauuugacgaaaugguauuauaaccaacuguacugcaaagcuugguuguugcuuaaugguaaacuugaauggcauguaggaggccuuggguuugguuccuaacaaagaaaacuuaguauaccuuugcuucucuauguaguacauggaaauagaaaaucuauccuguaauuuuuuucucucucaguauugguuuauaguuuuauuauaguuauuuauaaauuuauugauuagaggaauuaauuuaaauucucagguaguguucuaguuaguuuuaugucaucuuggcacaaaauagaaucauuuuggaagagggaaucucaacugagaaaaaaccugaccagauagaccuggacaagccuguagugcauuuucuugcuugauggucaaugugguagggcccaguucacuaggcaguaccaccccugggcugguaguccaggguuagcuaagaagguagggugggaaagccaagaggagcaagaccuccuccauggucucugccaucaguucuuaccugcccuggcuuugaugauagaauauaauguggaaauguaagaugaaauaagcccuuucuuggggcuggagagauggcucagugguugagagcauugacugcucuuccaaagguucugaggucaauucccagcaaccacaugguggcucacaaccaucuauaaugagaucugguacccucuucuggugugcagacagaacacuguacacaauaaauaaauaaaucauuuuuuuuuaaagccuguucuuuucuacuaaugcuuguuuuggucauuuuuuuuccccuuaagacaggguuguaugucguccuggcuguccuggaacucacucuguagaccaggcuggccuugaacucagaaaucugccugccucugccucccaagugcuaggauuauaggcgugcgccaccgcuggucaugguguuuuaucauagcaacagaaacccuaccucagccaagucgauucuaagccuucucccucccucccuucaccucccuccaguucaagauguuuuucuuaaauuuuuugcuguucaaacucaaguguuaacaugcuaauucaagauaaguugcuuuuuauauuccgauaacuguucuaauguggagaaguaaaauauaaaauguuuucuuccuuauuacagcagaauggccaaagacuaugacaggucuucccagcacguccgggacaacugccagugugguuauaauacggggcaugaagauguauguagcgcauguaggugacucuggggugguccuuggaauucaggaugacccaaaggaugauuuugugagagcuguggaggugacacaagaucacaagccagaacuucccaaggaaagagaaagaaucgaaggacuuggcggcaggugaucauuuguuuugucugucuuauuuugguucugguuagcuaacugugucuacucugucuuuugucuuucuacaucucccccacuacucccuuuuaauugaggcaagguaguuguguaggccagccuggucuguaacucacuguguagccuaggcuggucuucagcuuguugcccuuugcuguaguuuccgcaggucugggauuauacaugaauccuuccucuugccuuccacucucuuuuugagauagaaucuuuuuuuuuuuuuuuuuuugguguuuuugagaaaggguuugucugaguagcucuggcugucuuggaacucaacuuuguagaccaggcuggccucgaacucagaaauccgccugccucugccucccaagugcugggauuaaaggcgugcaucaccacgccuggcugagauagaaucuuauauagcugagccugaccuggaacucugaucuuccugccucuuccucccaagugcuuugcugggauuacaugcaugggcaacuauacuugcucuguuuuccuuuuuaaagcaguuaaucuucuaguauuaugcgguuuuauuugcuuguuguaaaaauaucacauuuacauuauuauuuugaauugcuuuauugaugaaaauggcucuaaaugagaaguaauaucucaaguaacaauagguaaaauuuuauugaaagccuuucaaauaaauacugacauaagaccuucagaaucugcauggagcagaacaguuagaguaugccaugugccuggcagauacuauucuuacagcuuaucauaauccuagauauuuagaaaagcauucuucuuuuuaagucucuugggacauguauguauguauguauguauguauguauguauauauguauguauguaugugucuacagugagagaaaaugcuucauugacagaacugguaugcuuuggcauuuuugcagaacucgcaguguuuaguaggugacagcuagucuuucauaucuucugucuuuagacugucauggaauguuaccuuugguugcaauagcugguuacacacacauuucaaugcaauuguuuguuuguuuauuuauuuauuuugagacacaguaugggccagccucaaacucacagagguccuccuacuuguacugggacuaaaguaugugccaccaagcuccucccucucuuucuuuuuucuuucuuuuuuuuuuuuuuuuaaagauuuauuuauuauauguaaguacacuguagcugucuucagacacuccagaagagggagucagaucuuguuacagaugguugugagccaccauaugguugcugggauuugaacuccagaccuuuggaagagcagucgggugcucuuacccacugagccaucucaccagcccaucucccucucuuucuuugugguagauuguguguguguuacuugggauugaacugagagucuuaugcaagcuaagcaagcaccuccugcugacuuggauucccaguuccccauaaucaaucaaucuaucaaucuaucuaucuaucuaucuaucuaucuaucuaucuaucuaucuaucuaucuaucagucaaucauauguaaguauacuguagcuguuuucagaugcaccagaagagggcgucagaucucguuauggaugguugugagccaccaugugguugcugggauuugaacucaggaccuucaaaauagcagucagugcucuuacccgcugaaccaucucuccaaccuacuuauuauuuuuugagacagggucucacuauguagcucuggcgguagaccagguuggcucugaucucacagagauuguaugugaaugcuuccugauugggccaccauacuuggcccucacaaucuuuuaaauugaggcauuuuuuuuuuuuuuuugacauuucuggagaucaaacccaguccuugcacauguaggcaaucucugccauuuaauugugccacuggucuuuuccuguacauguuuaauauuggaaggccuuuugcuuuuucauuauauuaagaagauuuuuuuuucuugaguauuuucuuauuuuuuuaacuugaauuuuuaaaguuauuugauuugauuuuuuuuucuuuuuucuuugauuuuuaaucucauuaaaaagaaagaguuuauaguuuuugccuuuucacuuaaaaauaccaucuggacaguuggauacaugccuuuugccauuugggagcagguguauuuuugcaaaaauugagccauuuuaugauaaguuauuuccugucuucccucagucccagccuaggcuguuggccagcacucuuguuuuuguagccuucuguugaugcgcagucagcucucugcauggcaggcuguuccucuccauuugccuuuuaauacagagcaacaacagagugugcgggaaaaguaguaucuuguaacauugcuuugguuuuagacuuuuucuuaagcaaacaguaccauuauuugucuuguuucucagacacacaaagaccauaauauccuugccaauaaaguaucaggggaccucucaguacauuuguauuggggacagcuccuggaauugcucugugcugaggcucaccugucauguuagauguuuagagagaacacuugggcuuuaaggcgguuggaagacagaaugcuggcauucauccucagugcgaucuccugugugacgauguucuugugaguggccaguuuacuucauucuacccacugagcuucagcuuugaagaaaaguaagaaagcaaccgccguuugucuuccaccucuccuugguguuagaacugaaagaugaacuuagucuccaaaaggaaggugaacaagggacuuucugcaacucugcuuuauauugacauuuuuggauacucuguuuuaauguguuucagcucaacugucaccguaucagugauaaccacuggccacaugugacugcuuaaguuuaauaaaaauuaagccauagaaccaguucccuuguccuacucacaguguuuucuagcccuguguuaacggaggacagggcagauugaccauuuccuacagcugcucggcucuccugguguggccuuugauuuuauugcguucucucuuuaggugaacuugucuacggauucucucccugucagucuugucugggaguguguguacccggcuaaguguggaggucagaggacaacuaggacauugcucccugccuuguaacacaggguuucuuugcuguuuuccugcugaauuccccaugcuagaugaccagaaagcuuccaaggauucccccuucucugucuucuaucucccuggaggaggagugcggggauuacagacgucccugcauuuaugucuggcuuuacauaaguccuggaggucucaguucagguggacagguuugcaccgucaaaggccucaguguauccagccaucacuacuauccuguccucggggauagguuuuuguuuuuucuuuuauucugcaguacuggguauugaaccuaagggcucauguauguuagccaagugcucuacaacugagcuguaucccuaaucuaguuuuccaggcugugaagccaguuaauguucauuuuguuuagggagauagaguccugcugcucacauacaguaaacuuauaagaaggugacacauguagcagugugucagauuucuuaugaacagugagacuaucuggcaaaucuguauguugggcuagaggcaagucaggugggugccaugcccaaggcucaguguucaguucccagcaauggggacgggaaaggcuucauaucaucugguuuacauaucuucugucuauguauaguuuuuuuuauuacauuuauuuguguguuuaggcaugcauaaaggucagagaacaccuugcagaaccagcuuuuuccuucuaauauguggacccaguggauugagcuuaagucuucaggcuugguggcaagcagaauaucuugcugcucccuuugguuauaguugaagaugggguucucauuauguuguccaggugaccugaaauuucaugauccucccacccaggcacccaugucaccacuccucgggaacugguugguucaccuggugguugagaugucucugucuuuggccuggccuugcugccuuguguaggcugaccuccagggauccugcugccugccuccccagccugcauucaucuuaagcacguaccagcagcaccagcaugcccaaagaucuccuguuuucauggcaggcacuuuacagacucagccaucucucuagcaccucuauugacauuaaaaaaaaaaacaaacaaacaaaaaaaaaaaccagagaagcagcuguguggguguguguguguguguguguguguguguguuggagggcaugacacagagaaaccaugguuacuuugaaauaagggucaguuucuuuuaaguaagucccauucagucacaccaaacacagaauuagcaaucaucuucauuuuacuuugauuuaaaaaaaaauaaccauauuuacaaaaguuuuagguacucugaggugacuaacuccuuuauaaagauuuuuauugcuucuuuggcaaaguuguaggagaauuuuccuauccugugacucccagauauguaucuacaaagcuguuguguucuccacgucuaguuucaugcuuugaauuacagaaccaucuacauauauaggaaucuguacuccaaagaggugcugagccuucuaccacaaccuuccaggggcccagaugucagauuccgcaugcccggcuccuguugcuucaaaccagaaacagugcagcugacuucuucuguuucccucaucccccaacgaaaccagaaaacccuuuuaaauuuguuguauauaaguguuguucacuuaucaaggcucuuucacccgccuuauugucugaguccugucauccuguguuuuucuuugaccugucucuucauuuucauguuauuugcaguugguucuguuuggccuaagcuagucaaauuccucucauauaaaucuuauccugcuuugucugucuuuuuauagcaagaaccuuggcuuaugauaucuuuguacuugaauaggugucauuauuuugugauacuauagucucauuguaugaauuccuaacaugucaggcuuaguuguauuuuaaucauuuacacugcuuacgacucuguucacuuucuagugugaugaacaagucuggagugaaccgaguaguuuggaaaaggccccggcucacucacaguggaccugucagaaggagcacagucauugaccagauuccuuuucuggcuguagcaagagcgcuugguaagauggacuuacauuugguaaaaucauguuguauuuauuucugcucuauacaguggugagaggaaagaugcuauggagagaugagaccuuacauggugagauuagagaugaugaaacugcaugacaguauuuuaaaugcgagggaagagguaaagccuguauuucagcacugcuugcucuuucuuaagauuaaugucugcggucuuacuuguuuuccucuguacuuaggaauacucagagaucucagaaucugccaguacucaucagauaccuauauaccugcaugccuguccaggcuucaugcuaugauuauaaaccauuuucaauauucuuguucaugucagcccuuaguguuccuuuuuuuuuuccgagacaggguuucucuguguuucccuggcuguacuagaacucacucuguagaccaggcuggccuugaacucagaaaucugccugccucugccuuccaagugcugggauuaaaggcaugugccaccacugccuggcuagcccuuaguauucuuaagcuucagaaguuuuuuguuuguuaguuugcuuguuugucuguuuuucuuuagcaaaauaaauuguucaugccaaaaugaaaauaauuuuuuccuagucuucugguuuuagaaugaagacuagauuuuuuuuuuuuuuuuuugaacaggaugaacauugauuuuuuuauggaaaauugagagagaacuccuaagaguaggggggacugcaugggagaaguauucuuguuuuguuuuauucuugagaucucauuguagcccaggcuggccugauauaaauguacggcccccauagccuuguucucauaaugaacauccuuucucucuuucccaacugccuggaacuacagguguuaucacgauguguagcugagacuccugagucagaacuaaugaaauaccugcuuugccucuucuacauagggguaguuuuucuaaagaaaacucuuggggcugggauacggcuuagcaguuaagagcauugccugcucuuccaaaaaacccuauuucaauucccagaaucuauacgacagcucacaacugucuguaauuccaguuacaggggauauuacauccucauacagauauauauggaggcaaaacaccaaugcacauaaaauaaaaaugaauaaaaaaaauucuaugaggaaauaaguuuguuuucuuuaaguagauagcugaguccccuagugucagguguuuugguaagccuuggauguguaaugcagaagacugcugucauggaacaaugccuugcagcugggagugaagacagugaagaaguaaaugaaguaauuuuacaccaggaaaucccuugaaagaaagagacagugcugauuuuuuuaaaaaacuuuuuuagaaagaaaaaaauacuuuauacauugugauagaaaugccacuuuuaggaaguauuguguuagcuccaucuggaaaguggagaguggacuaguuuugugaaaaauauuucagaaguggaucccgaugugggaaagaugauauaguguuaucagaaauuaucacagugcuggaauuaggcugggcauguggcucagaugcuagaguaccugccuagcaucacacagccuguguuacaucccaguacugaauaaacgagcugucagagugcacacaugcaaucccaggacuugggagguggaggcagaaggaucagaaguuuaaggucuucuucagcuacauaaugacucugagucaagaucuauuggcauacaagacacccugucucaaaaauaagcaaaaaggcuugaguuggugagguagccaugaugaguuucaagacacagguguacuaagaguaucauggucuuuaggcugggaaugaaaauuaugcagcuauacgcaugccacagugcucuuaaggagguuugagaccaucuucaagaauuuuuuuuuccaucauuugugugcuggggauuuauuuuaggaugucaggcuuggugcaaguccuuuuacccaccaaaucacucacugacccauucucucuagucauuuuauaaaaaauuaaaaaaaaauuuuuuuagauggggucucuuauagcacaggcugacgugaagaauuggguauguaguugagcuugcucucuccucucuuccuuccuuccuuccuuccuuccuuccuuccuuccuuccuuccuucuauaugaguacaccauugcucucuucauacauaccagaagagggcauuggaucccauuacaggugguugugagccacccucugguugcugggauuugaacucagaaccccuggaagagcagucggugcuuuuaaccacugagccaucucuccagccccugagcugucuuuaaacuccugauucuccugccucuaccucacaagugcugcuauuauagucagugacuacucaccaugacucaccucaacauuuaugucauaaaagguuauuuugauuauaguuuugauacuagaucacugaagcagguauugggaauccuugugguaggucagccacaggggggaggccaguggccacagaguugaugaccguuuggggaaguugguuaguggucugacaguugcugauacuuggacuugugagcugucagguguucugggagcaagcccuggaaccagaggagcgcuccugguguccuuucagcacccucuacugaugcaaaggggcaugaccgccagcaggcaagcagcugccaguucccaaggcuuccccuuugaucuacagaaaagacauccugugaugcuauuagggagcuggcuauaaguaugucgugaugaauuaaaauuuuuagacucuagggauuuuuacuaaugaauucaaagcaauuucaaaccccaaucucaaguacuuuucagauaacucucuuagcuugucaucuguaucuugggaauguguguucugcccuuuuccuaagugccucuucuuuagccugcuuuaaauuucuuucuuuuuaacaaauuuuauguguauggcuauuuuccuuacacauaugugucugcaacauguauaugugcagugugcccuuagaggccagaagaggguuucagaucccaugagacuagaguuauuguuggcugugagccaucauguggauacugggacuugaacuaugauccucuggaagaacagccaguguguucuuaacuacugagccaacucuccaaccccucugucuucuuaaugccuguucuuuauaauuuuuucauuuauuuaugcauuugugugugugcauucaugccaccgcauacaugcagaggucagaggacaacuuuugagagacaguucuguccuucuaguauguggguccagaggaucaagcucaggaugucagucacccuuagcuacugaaccuucucacuggcccagugccuauuaaaucuauauucucuauauuuaauuaagaaagaaaaaggcauucucuagggguggaagugggcugagaagaugauagucauucaaaagcaaaugucaaccaugcuucauuuuaaaauauuuauucuaaacuuguugguguguguacuugggagggagaggcaaggcaaaucucugaguuugaugucaucuuggucugcaaagugaguuccaggacagccaggcuauacagagagacccugucucaaaaaccauauauguauauauguauauauugacuucucucuguuggguuuaacaagcuugcagggcuguuuguggugcugggguuugaacccagggccucauaugcuagcaagcauucugcugcugagcugcacugugaguccuuuuuaauuucauaaugggguccuacugaguugccauggcuggcucaaacuuggaaucaacccuccucccccauuccucagaagagugggauucggugugugugcuauuauacuuagcuuuaauaacuuauuugguuuucuuugugcaaugaaauuacccaugaauaauuuccuccuauucaauucaucuguguuuuuaaucauccuacugggcugagaaagaacuccagcguaguauugggagaaagguggcagucaagacauaguauucuuuuguuguuguucaagaaguuauguccuuaauuauuuuccugauucuggggcucaaaccuacgucuuuguacguucuaugcaaguacacuuauuucugaugcauaucucuaccccacggcauaguuuugauuuauauuuuuucauugguauuuaaauuguacaggguuacaagcccugaccuuaaccuacagcaggucauuuuuauuuaaguguuuuuguacuuuggguauauuguucagcacguccuccuaucucauuccugacaucccucuuucacuaguccccaauguuuccccuagauaguuucauuucuaacuucauucuauaaauacaugaacuuauauaucugcuuaaaaucucagaaccacaaaugagagaaaacacggguauucugagagugcuuaguucgcuuugcaguuuucuuuagcccuacuugaagguuacggagggcguuugcugcaaauccccaugcugguucuugagcaugucgagggaauucucuugucccuagugugauuguauggguuuuaaauauugucaguuguugugcaccuauaggaacagacuagggacuguccuuuagucagugaugugccucucuugaaaguaauagugcuucuucugcccccuuucccuaggugacuuguggagcuaugauuucuucagugguaaguuuguggugucaccugaaccagacaccaguguccacacucuugacccccggaagcacaaguauauuauccugggaagugauggacuuuggaauaugguuccaccucaagaugccaucuccaugugccaagaccaagaggagaaaaaauacuugauggugagaagugguuugacguugucuggaguguuguggucuuguuguccauggcugugagucuagcuaaggagguuugucuugugucguaucauugcucugaauaaauucauaaccauucccagugacuuuucuccuuuccuauaugccuugcaaccucugggcuuuucuguuuuuauggacuugccuacuuuggauuuuuccuauacauaugaucauauaccaaauggccuuuuaaaucuagcauucacuuagcauaacaugugaaguaauguuuguuuucuggcacugagcauugaacucagaauuuaacagaugcuaggcaaauacauaagcucugagcuauauauaccuuuagucuuuucuuuuuccucccuuuaagacugcaugucuucuagauugcauaggcugaccuaaauuuugggauuaauucuccugucuuacuucccgauaguagagaugacagacaugcaucaccuugccucacgcuccguccucagcaccuaaucugaaaacaagacuauaaauggcaaucccaucaaacuaagaguuuguuaaagcuaagaguuguuauuucaacauucagucuuauuuauuacccagacuuaauguuuugcaguuagugauuaucagauaauaacagagaugaaauaacuugcuggguggugguggcgcauaccuuugaucccagcacuccggaggcagagagagguagaucucuugaguuggagaccagccugaucuacauagugaauuucaggagaaccagagcuauauauguauauaguaagacucugucucaagaaacaagaaaaacaaaaagaacaaaugaaagaaauagcuuguauggaauuauuuuucuccauagagcuuugcugagaaacaaagcagauaugcugaaaaagagaaggccaaaggagugcuucacacugaguccugauggcuggugcugcugugugaaccauguacccagaagagguuucgagagagagucaguaauuagcagggaacauggacccugcccucagucaguuuagaugcauacuuuccaccuuuuguuauguuuagguuuuuugagacaggcucucaugaagcccucugguuuuauacuuaggcagcugaggcuagccuugaacucuugauccuugugucuaaacuucacaagugguaggauuauaggugugcauccucguguauggcucuucuuuuaacaucacuaaaauuagaauccuuuuuccaaaugcuguauuauaauuugacagugauuuuucuuuuauggcacacaaaauguuauuucuauaacucagagcucaugauaguccauaucugaaauuauaguaccugggaugugaggcaggaggaccaccaguuguuccagaccagccugggcuacacagugagcucuaggauguucuaggcuaucucuguguauugucagugugguucccuguucuugggcaccagugaacuuccuuaugguaucccggguagcuggcacuacuggaccaggucacuguggugggcuccucaguuguguggaagucagcccugcaguggguuuuuuuuuuuccuaccaugacuaauugucuuauuuguuaauuauauaauaaauaaccaaaaauuuuagaaaaaagacuucucuguaccuuucuuuaggguagaccaaauuucuugauuaagaaauaaaaacacacccuuuauauuccauacugguugauccuccugcuucagccucuaucuaucuuccucccuccgucccuccgucccuccgucccuccgucccucccucccucccgaggcagggucuguaagugcuggcugugcuggaacucgagauguaggcuuugaacucacagaaaugcaucucccucugucuuggaaugcuugaauuaaaggcuugcaccaccaugcccugccccaaacuguauuuuuaaaauaaauuuagaggugcauuaguuuaaugugauuauaaacauuuuagaucaugcuugagaaucugaauuuuauuaacuuauuuggccauacuguagcuuuuuuauuuuuaaauuuuuguuuuauuguguuuaugcaugcauaugguguguaugcguauguguuggucagagggcaguuugaagaggagcuggugacuccuaucauguaagucuaguggauugaacuggagaccuugagucaucaggcuuggcagcacccuuaccuacugagccaucucaccagaucuaccaggucuuuaauuugaaucauaugcaaugguaaguaauugagaguuaauguucuuccuucuuguucuuuuaaauauagggugagcaaggacaguccugugccaaaaugcuugugaaucgagcacuuggccgcuggaggcagcguaugcuucgggcagauaacacaagugccaucguaaucugcaucucuccagaaguagacaaccaagggaacuucaccaaugaagaugagcucuuucugaaccugacugauagcccuacuuacaacagccaggagaccugugugaugacuucuucuccaaguucuacaccaccaaucaagguacaaaguacuacagggguaggggugugugugugugugugugugugugugugugugugugugugcguaugugugugguuuauuuuucuauuccugauaaagcaccaugaccaagacuaacuuauacaagaaaguguuuacuuuguuaaucuggcuugugguuucagagggucagagucuaugaggacagugaaagaacagcugagauauuucucucucucucucucucucucucucucucucucucucucucucucuaagauuucauuuuauguguaugaguguuuugcuugaauguaagccugcuuaccaugugcaugccuggugcugguugagguuaggagugaauccccuggagcuggaaauauggacgguugugaacugccaugugguauugggucgugaaccugguuccucugcaagcacaaguacucuuaacugcugagccauuuugccagcccugagagcucauaucuugauccaaaacugagagagagagaagggggggaggggagagagagcgagcgagugugcacugagagaggggggagagagagagagcaagcgagagcgagcgugcacugggagucucaagucuuuugaaaccucaaagccuacucucagauacacaccucccucaacaaaggccacuccuccuaauucuuugccaacaguuguaccaguuagggagcaaguguucagaugucuggggagcaggguuguucucauucaucccagcacaucuuguuugcuuuugagaugaggucucauggugugguccauggugacaaggaugaucuugaauuccugaucuuucuacuuuuaucucccacauguugagauuacaguguuuacagucauaauugguuaauuaagacagaauuuuggauuugaauuaaguucaagaaaaugauggaucuuugcucuauaauucauugcuggaaagaauccuuuuccccucugcccagauaaaccauauucucaguucuucaaagauccaucuucacacgggaccuaucugaagucagguguauggauauaacuuaauagaaaaauuauuuuggccacugaaaacuguuaauaugugaaacuuauugaucccuuuuaugaaucuauggacauuuguaaaacauuuauaagucugugaaccacguguauacauaauaguucauuuaaaccuauaaaacagagcuauccugauaggauccauguuaucaauaacgacacugaaagauuaaauauuuugagccaagucauacagaauuaagauugaacuggcccuuaggauauuggaacuuagacauguuuuuuuuuuuuuuuuuuuuuuuuuuuaauuagcauggguaagaaacagcauuaucuucuuauuugacacacgauuucaggccuccaaccugauccuccuaucagagugccaggauuacagaagcaugccaccaugccugacuauucaauuucuuaguguaaaugaaaauggaauguguuugaguugugcuagagagagacagcucacugguuacaaguacuuaucugaaaaacuucagaggacuugaguuugguucccagcauccauaccaggcagcacaaaaccaugugugacucuagcacaagugggucugauucccucuucuggauuccuaggguauccccacacacauagacacacauauauacaaacaaauuaaaucuuuuauaaaaaauguaagcugaggaacacacuuaagugaguacagcauuucuguuuccugauuuauuuagaacucaguuaaccuggcuuuguuaagaguuuauuuuuuaggagacuggcaauuaaaguaggaaauaaagcauuaugcuacaucaucaauuaagcaaauuuucaaagggccagugaacuguuuugcuuuuagacaggcugucauguagcccaggcaagccuugacucccgggauacaggccuguucuagacaaaggcuuuggaaggacuuuuauuuuggauacugugguuguguaaggcaaugacuggaauuuaucauuacuaugccaucucuuaauucacauaaauggcaaaaauagacaugcaaggaagagaaguguagucugugagcaguaauugacagguuuuuuuuuccuuucuucaccccuugguuuaguuugcuuguuuuuguacuacgauagaccucagggucuaaugaaugaagcauaaacacucuacuaaguuauauacuaguucauuacuuuugguuagccuugaacuuaauguauagccuagguucacauugacuuugugguucucuugccuuagacaccugaguagcuaugaucacaggcuuguuucauaguuugagcugauucauagcauuaaaguuuucuguguugguuaucaaacccagaaaguuuggucaagccacagaguuacacccucuuccccuauucuaauuuuauuuucuuuuuguuuuuuugagacagugacuuucuauauauaguucuggcuguccugaaacuuacaaugucgaccaagcuggccuugaacucacggagaugucucugccucugccuccaaauguugauuagacauguguagcaccaugaacucccagcuaugugagugugggugugcacgccacagcguucacauggaggucagaggaggacguuaggcuguuuucuccucuugcuuuuaugugggugcuggggauugagcuccauuugccagacucauguuggaagcaucuuuaucuuacagauugaacgucucaacagcccacaggacuuaaaauaaaauuuuuguuuauuugauguuaguguuuugaaauagggucuucuguaccacaggcuggcuucaaacucuuuauauaucagaagcuggccgugaccucaugauuguuuugccuucaucuuccaagugcugaaguuacagguaugcacuuguacacuuggcuuucuuaaaagaaacuuuauguuagacguuucuuuucaagccaggcaugguugugugugccucucugacagcugggguagaaggacccuggauucaaggcuaccuugagcuaauagcaagacucuuccucaggaagauugccaugagccuggcuuaauuagagcaugcaaagcuaacagauuaauauggguagcuacauaugaaguuauagcucagaaaaaaaagacuuuucacugaaaaguuuaaaauaauaguacagaaugguaccuguuacaguuucauuuauuuaaggcuucgaagcucuguaccuauuugugacuagugacuaugugaauuacuuacuuguucccuagugugcuuauggaguugccacuuaggcaaauagagaggaucucuuaggguuagggauccaggcacgaagugauuccugcuguaaucucaagaucuaggaggcuuagacaggaggaucacugcaagucuuagagcagccuggacuacagagugagauacuggguaauauuaucaagacccuguccuagaaagagaagggaggggcugcauauaugucugauggguaaugggugauguguaagcaggcucacucaucuccuaauccccagaauccaugugugagccgggcauacaucaggagcauuuguaauccuagcacaccugugggagauggcaucuagagaaaggggaauucauggaagaucaugggcagcuuagccggcauacaccacagacaacaaaaacaaagugaccuugucucaaacaagacuaggacuaacacccuagguuauccucugaccuucauccauguuauggcauucuaauaccugcuuucacacauauuuguuacauacacacauacccacucagaaguguugugcaccuguaauccuagugcuugggaagcugagauaguaggaaucucaaguucaagggcaauauggagagucugagauaauuguaggcuacauggugaaacccugucucaaaaaaagaaggggaucuauuacuauucuuacugaagucccucaguagcccguuuucccaguugaugucuggugucuaauguucaugggguggggaauuacaucugucuuuccauuaugacauaauugcuuuacuguuguacuucacaguuccuagauguauaauagucacaaauuagaaucuaggaaagugacauuuuuuaaaagaacacucuucacuuacaguuuuaauuaguuuuugucaagaagccauuuauaggacuggagaucuagaguucaggugauagagagcuugcuugcccagcaugcacgaagcccugggcuugauucccugucuauauaagcugaguauuggccucggucuguaaucuagcacuauaaaguagaggcaggagagucaaagcugugaucaucccuaguuauauagcaaguucaaagccagccuggguuacaugaucaaauguuuuucuaaaaaggccauugagaggcaucgagauaguuugcuugcugccugauucauuccuaggaucuucaugaugugaggagaggucauauguaacuugcccccugaccucugcauaugcauauuguugugugugcacucucacauagacguuuuugaaaauuguuaauuaacaauuuugaauugcauuuauuuugugugucuguauuuguuuucccacacacaugccauggcaggacaauaauauaagccugugguucuuaaugcauugaagaggaauuuacucuuuuucacccuaauuaugucaucauuuugucacaugucauauuucaguuaaaauugaaaacgaguuuauguagguaggcauuauuugauuuaccagaaaguugguaugucagcuuguuuuucaugggcuuaugucaaaaaauagggauuuuauguaaaauaauuagugcuaguucaucaguaguauauuauuacacauaaaauuaaaacacagaauuucagcuggcagugguuauauauaacuuuaauuuuagcacuggggagacagaagcaggcagaucuuagaguuugaaaccagccuggucuacauagccagauucaggacagccagggcuauagugaaaaauucugucucauuaaaaacaaauaaugaugggcuggugagauggcucaguggguaagagcacccaacugcuuuccgaaggucuggaguucaaaucccagcaaccacaugguggcucacaaccauccguaaugagaucugacucccucuucuggagugucugaagacagcuacaguguacuuacauauauauaaauaaaucuaaaaaaaaaaccaaaaaagcaaacaaugagugagugaaaaaaaacaauguagaguuuugauaaagaaauuaaaauaucaaaagcaguaauuuugccuuauucugcaucugggcacagagugaaugucuugauagagugugugcuuguggcuauuuuaauaggucuuuuuugaagccuuaaaguauuuuccuuggucccagcugugguugggaaaugccuaugagcccauggucuucuccccuugggugugugaugcccucucuugugaugagauggguuccuucugugaauccuuuguaccgacugccuucuuugcaaucccccaaaccccaacuuagggugaggaagugaguucgugccaugcuuuugccaucuguuuguuuguguuugagauaagguuuuucucuggagcccuggcuguccugaacuugcuuuguauaccaggcuggccucagacucacagagauccacuugccucugucuccugagugcugggacuacaggagugugccaccacugcccagcugguuuuacuaucuuaacaaugucuuaaaaagaacuuacugucugugucaguuuauugugcauagaauaaauauuuauuuuuccuucccucccacuccccagucaccggaagaagaugcauggccaaggcugagcucuaaggaccauauaccugcccuuguucgcaguaaugccuucucagagaaguuuuuagaggucccagcugagauagcuagagggaauauccagacuguagugaugaccucaaaagacucagagacacuugaagaaaauugccccaaagcccugacuuuaaggauucaugauucuuugaauaauacucugucaguuggccucauuccaaccaauucaacaaauacuaucauggaccaaaaaaacuuaaagaugucaacuccaggucaaaugaaagcucaagaaguugaaagaaccccuccagccaauuuuaaaaggacauuagaagaauccaacucuggcccccuuaugaagaagcaccgacgaaauggcuuaagucgaaguagcggggcccaggcuuccagucucccuacagcaucccagcgcaggcacucugucaaacugacccugaggcgcagacucaggggccagaggaagaugggaaauccucuucuccaccagcaccggaaaacagugugugugugcugagaugggccugggaagugggggucucccuaccuacgacugagggcuuuuuaaacuuggugcgaaguugaacuuuuuuaaggggauaaaauaaagagaauacaguuugacuuuuuggaauuuaacaguuuuauuuuggccuuguacuugccuguauuauaaugugaauuuuguagauguagggaauaaguugcuguaaaauguguguaaauuuguauccuuuacacaaguuuagucucuuacucugacacauaguaauugugacagcagggcuaauguugaagaaaagucagaagaaucuuuaagauuuuaaaaaugucuuuaaaguuuuuaaaaugcuuacuacauacuuauauacaccccuugugaagaacacaugacuuuuuaaagaaaauuacuaagcaaacuggaaaagugaaguauuuucauagugaucugugcuccacuuaauguuucccagggaccauuagugucuuuuuaaaauuacauuuuauuucacauuucauaauucagaaguaaaccuuucauaggaaaaauacugagcugugcuaauguagcugauuuuagucuccuugucccacuuacacuaugcaguaucuccuaacuucagugcacucugcuagaacaguacauuugcuguauuuacugaaaucucuggcacagaaggaaguguguuugccucacacaccauuugucccagaccaguggcauuaggccauauauucucuucuaguguuugcuuaaaauaugugaaguuuuucuugcuauuucaauaacaaauggugcugcuaacacccaacauuuccuaaauuauuuucuaucauacaguuuucauugguuauaugaguaugucuacccaauaaaucacugaauuua

SEQ ID NO: 12187 - RNA, 129993 nt, Mus musculus
caguuggugcagcggcgguuggggcgagugcgcucaccccaccccuccccuccuuggccagggcuccggcccccaccccgcggggcccagccccagccccagccuccgccgggcccgucccgugcgggcccgugccaccccucagccggcgacgcccggggccgcccgcccgcccgccaccauggagcuggaggacggugugguauaccaggaggagcccggaggcuccggggccgugaugucagagcggguguccggccuggccggcuccaucuaccgcgaguucgagcggcucaucgggcgcuacgaugaggagguggucaaggagcugaugccacuggugguggccgugcuggagaaccuggacucgguguucgcgcaggaccaggagcaccagguggagcuggagcugcugcgggacgacaacgagcagcucaucacccaguacgagcgggagaaggcgcugcgcaagcacgccgaggaggugagggccggcgggggcgggggucgcagccgggcuggggacgcugggcgcgccaggcgcaccaacgcgccaggguggacuccugaagggcaggcccgaauccagggcccgggacagugcuccgcagcgucucgggaccccgggacacuggccggugcuggaagccuaggcaggccagcgaguguccaggagaggggugaagugggaggaaggccgggggaggaagcgacacucuggcaucugagggcaccugggacugcccgagggcggagacuugagggugucugguugcuucuuguuuagggaaguuuccgaccaccguaggauagucgggugcggguucaaacuuuuagcauggggaggggcagugcuguccugcccgugucaguuccgcuggcuucgguaccuuuccagggggggcugcugcugcuuugggaaguuagagaucucccucuuucggucaguuucuucuugacauuuagauccucuugagaaggaagucuaccuauguacccuuuuuuuuuuuuuccauuuaauuuuaacacuuagucaaccacuuagaagucgacuagcagaguccaguaaguacauacaguacauucauuuacuuuauuaauguuccucacagaggaauguuccuccuucgugucaggugguaaccuuggacaguucccugacagccuccucuauuuauaaagacuggggggcgggguugagaaggugugggugaguguuacaacacuuguccugucugcguuugcuuugcauccugcaguuucuaagugcacuuggcuggcucuuugcucgaacaccugagcggugaccuuuguacucgucaccugagugugugagccuuuuuggauccugggcuguaaaugauccucuagcuuuuugagcgaguucaggauuuuagccugcaggcugagcgcccuggcauuguuucugaagaaccuuucuucggcagucaaaaugcucuccuuguuuuugugccagacaucuacuguaccuagcuaaauacauggugauugaaggagacuaauuaucgaaggaaccacguguuguuuuucaaaacuacaugacgcgguagaagaaugugacauuuguuuggcagcucaguuccuagcauuaaauaggcaguuuauuuuguuauuugugccucugcauucagguaaaugauucuuuuuuuuuuuuuuuaaagucaugauuauaguggcgcuuuguaauugagauuuugcaguccaccuaucuuaaagaaaggcauugaauuugccaaacaaaauugacuuuauuucaagaguauguuuacaaauaaacacggagggaggguugaaaagaagacaaggccacagccccguuaguuucuugguuuauaaaacagaucaaggccuuuaagguggcgugccacuugggugccacuugccacugauacagacuuuugucaugauguggaugcaguuggaagagaguggggccaaauauacacagauuaggagcaaguucaauguaaccuauuaccucugguuaaaaaaaaaaaggaaauguucccuccagccuuagccugcggacaggaugaagugccgagguuacacaguccaagaaaaccagcuguuacagguuacagaaucagaaaauaaaacugcuaggcuuuguuuucuuuauuuuucuuuauuuguucauuuauuuugguuuuucaagacaggguuucaguguguggcccuggcuggcuauccuggagcuugcucuguagaccaggcuggccugggacucacagagaucccccugucacugccuaccuaaugcugggaucaaaggcaugcaccaccucuguccggcuuauauuuauuuaaguaaaugacuuuaaaaacagucuguucacuagguuucuuuaacauuuauacuucuuaguuaaaucugucacaucuccauaaugaaauguuuggguagacuccugaccugagaauuaacagcacugaugagaugcuagacgaacccugcccuaaccacaaacauaaaaccccagcagcagcagcaacagcagcagcagcagcagcagcagcagcacuacucauggaagaugcuaagcgguuuugccuauaccuaggaguucagucuuccaggccaguguacagaguggauccuguuuaauucucucccugaaugcucagugccuuuaacccagagauuaagagcaugugcuuauagcagaagugcuccagggaggguauuuacaaaguaauuugaaagcaugguaauuguucaucucuagagcauaaaguaaauuuuggguaucuuugugggaacuuaagaaggccugggaauggugaagguguuaaggaaccuaugaggugcuguaaucucuugcuugcagaaauugccagagagggggcaggaauguaauuucuauuauaaugguuguacuuaauuugaauguacuccacuuuuuuuugcuuuuauuugaauuguguauguguguaguugguuuguuguuuuagugacuccuuuuagaacugcuuuuuggaggucggguggaguggaaagguggcucagcaguuaagagcccugacuucucuuccugagguccugaguuuaauucccaacaaacacauagugguuuauaaccaucuguaauggaauuggaugcccucuucuggugugucugaagagaaccacaguguacucacaugcuguuuugggaacuggaguauagcuuagugguagagugccugccuagcauucugucugggcucaguccacagcacuguaaaaaguuaccuccagcaccaaacaucagcaaauaaaauacauagagaaaggcagaguuuuacauaguuuugggccagugucaaaugguaauaaaugcuuucacuggacacucuugcccuugguucccugccaugcagcuuuccuuuaacccaggccuggcagauacuuuugcucuuguuacacccuugccacacaaugucuuccccagaguuuaaccuggugagcucuuuucuuccucccuuuuucccucccuuuuucuuccuuccuucccuccuccucacccucauccuucuuucuuuagucuuagccugugcuuucuuucuauauaaaccugcucuguacccacaucagccuugaacuugaaauuuguuugcuucagccuuccaagucuugagguuacaggcuuauacugccauucucagccaguuccugucaauuauaugcucaguuuaaauaccuuucuuguccauuguguaaugaaauauuggguggcccuccugaauccauuuauuugcuuuuuugaaggguguggggagagacuggguuacucucuuuccaaggcuggucuagaacuuagaauuucuggcugcagauuccugacaauugugucucagcuuucuaggaucugaguauaggugauuauaguaauuugcuaccauggcuggcucaucccuuuaacaaaauuuauuuauuuauuuauuuaagcaugcuuaaggaugaguuugccauggcucaugggcagaggugagaggagaacuuaggucaguucuuuuauucuaccaaauuauucuuggggauuaaacuuaggucagcaggggcugaugagaugguucaguagcaguuaaagggcugguccuggucuugcaagggagccaaguucuguucccaaaacccacaucaucaaacagcucacauuuggcuguaccuccagcuccagagggcucugaggccuaagggcucuguguacaccugcacuuguguguauacucacaagcaaacacacacacacacacuaaaauagagaaauaauucuuaggagcuggagagauggcucaguggucaagagcacauacugcucuuccagaggacugaguucaguuccuaguaccuauauaggcagcugacaauuguuuguaauuccagcuccaggaucuaucuucuagagcacugcacuuacguguacagaccuacauucagacaguacauagacaggucaugauuaaaaccuuaaaaacugggucuggagagauagcucagugguuuaguguacacacacacacacacacacacacacacacaaaauaccaaugacacaaaaaacauaaaaucucaaaaaauuuuaauaaauacaucuaacacaccccagauaaccucagggcaucaggcuuggagacaagugccuucagcagcuauauugucucacuaacccaagucuggucuuuucauagucuuuuguuuauuuguuuugaggaggauuucacgauuuuucugccucucaagugcuggguuuacaggucuguaccacuacuguuaauuagucauaaaaaaaaauugggggcuagagagauggcucagugguuaagagcacugacuacucuucugaagguccugaguucaaauccuagcaaccacaugguggcucacaaccauccguaaugagaucugaugcccucuucuggagugucugaagauacaauguacuuacauauaauaaauaaauaaaucuuaaaaaaauaaaaauaaaaagucggagcaaggcaugguaguacuuaccuuuaaucccagcacucuggaggacagccagcgcagcacaguaagaccuagucuuaaaacaaaacaaaaacucuaaaacaugcuuuuaauuuuuuaaaaugugguauuuguuacauauauguguaucauuuccauguuaauucggggguguauucacaugugugugugguuuccguguucauuaggguguguucacaugugugugugguuuccauguucauuaggguguguucacaugugugugugguuuccauguuaauucgagguauauucacaugugugugugguuuccguguucauuaggguguguucacaugugugugugguuuccauguuaauucaggguguauucacaugugugugugguuuccguguucauuaggguguguucacaugugugugugguuucuguguucauuaggguguguucacaugugugugugugugguuuccguauucauuaggguguguucacaugugugugugugugguuuccguauucauuaggguguguucacaugugugugugguuucuguguucauuaggguguguucacaugugugugugguuuccauguuaauucaggguguauucacaugugugugugguuuccguauucauuaggguguauucacaugugugugugguuuccguguucauuaggguguguucacaugugugugugguuuccauguuaauucaggguguauucacaugugugugugguuuccguguucauuaggguguguucacauguaugugugguuucuguguucauuaggguguguucacaugugugugugugugguuuccguguucauuaggguguguucacaugugugugugguuuccauguuaauucaggguguauucacaugugugugugguuuccguguucauuaggguguguucacaugugugugugguuuccauguuaauucaggguguauucacaugugugugugguuuccguguucauuaggguguguucacaugugugugugguuuccguguucauuaggguguguucacaugugugugugugguuuccguguucauuaggguguguucacaugugugugugguuuccguguucauuaggguguguucacaugugugugugguuucuguguucauuaggguguguucacaugugugugugugugguuuccguguucauuaggguguguucacaugugugugugguuucuguguucauuaggguguguucacaugugugugugugugguuuccguguucauuaggguguguucgcaggugugugcaaguaaagaggucagaguugaugcuagaugucauccucagcugcucccucucaccugguuuauuugugacgagaguuugagugacccgggaauguuucuuuucuugcuuaucagugugauagauaacacucugauaaaagcaaccuuaggggguuggaaagauaggucagcagguaagaacuguguugcucuuacaugggacccagauuugguucccagcacccacaugauggcucguaacugucuguaacuccaguuccagggaaucugaugcuuucugcuagccuccaugaauaccagguacacacacacaugcacacauauaugcaggcaaaacacucauacauaaaaaauaaguacaucuuuaaaaagaaaagcaacccaagggagaaagggcuuaucguagcucacaauucaaagcccagucugucauggccgggaagucaaggcaggaguuugaagcagcuggucacauugcaugcacagucagaaacagaaggauggaugcaugcuuguaaguuucaguuuauucuauauaguuuaggaaccuugccuggagaauguucuugccaccaguaaaaugggucuuccuauauaaauuaacaauguagucuaaauaaucccccagaggaaugcucagagguccaucucucagaugauucuaaguuuccucaauuucauaaauuccugacacacacaaggcagcuuauaacauccuguaacuccaguuuuggaagauaugacaaccccuucugacaucgucaggcucuugcaugcaugugaugcauguacagacacucaggcacacauacaaauagaaauacauaaauuaaaaaaacaaaucuuguaucuggguacgucuuucuugaggagccuguaccuaugguugggucuguagcacuugcuaugacugucuuagagaagcccacacugugcuccuggguguauauuacuuucucacauaugucuuuaucucuuuaccaucaugcauaagauuguguuaaaauaucuuuauuaaaccugagcuuugcuucauagaauaaaaugcugugguuuguuucuucaguggaacgaugacuucucucuuuuccaauagucagcucagccacugaccucuuagggaaaaggucggcagucuggccaugguagcacaugacuuugaucccagcacuugggaggaacuggcagguggaucucugaauucaaggccaaccuggucuauagaacuaguuucaggacagccagggccacacagaaaaaaccuguggagaaaagaaaaagcaaaaagaugagcauuauucuggaggaacagcuuuguaguccaggcuagccuaggaacucacuguguagucaggaauaaccuugaguuacucaucguccugccucaaggauuauaggcauauaccaccauucagacuuggcugguuuuuugguuuuguuuuuaaagauugaucuauguauuugugugugucaauaugugugagugaaugugccagugcaugaauggggagacuagaagguacugacuggccucugucacuuucuuuuuuauuuguauuuuauuuuuauuuuugagacgagguuuaucuguguaacagcccuggcugcucugcacuggagcucacucuguaccccaggcuggccucaagcucacagagauccaccugccucugccucccaugcaucaucaccauuugcuagacugagugaauuuagaggucaaggcugguaagccuuuuuuuuuuuuuuuuuuuuuuuuuuuuuuugguuuuuucgagacaggguuucucuguguagcucuggcuguccuggaacucacucuguagaccagguuggccucgaacucagaaaucugccugccucugccucccgagugcugggauuaaaggugugcgccggcucucucuuuuuuuuuuuuaaagcaaaaacaaaaccaaaaaaccuucuuugaaaugucuuugcuugucugcauuuagugcuugaaccacuuagaugcuugaugcccaaagauggcaguagaagguccucugguacuggaguugugggugguggguucugggaaccaaaccuggguccucugcaaaagcagcaagcgcacuuaucuacugaacuaucuauccagucccuacuacuuauaguuuuuaagauuuaauuuuuuaacuuuuuguuuguuuaauuuuuuuauguaugcacauaaacugucgcucucuucagacacaccagaagagggcaucagaucccauuacagaugguugugagcuaccauuuuugguugcuagggauugacucaagaucuuuggaagagcagucaguccucuuaaccacugagccaucuccacagcuccaagauuuaauuuuuaccuaguaugugugugucauaugugggaauguacacggugcccuuggaguccagaagaggguauuggauccccuggugcuggaguuaacauguggcugugagcugccugccauggguggcugagaacaggaguagcaguacauguacguucucuccagccccauagucaguacaguguuaugaucaacuagcccacuuguuuauuauuaggaaaaaguacacacacagacacacagacacacaaguugcaaagccacucacugaauaucuguauacucacuaucagauucaguaguuugauucaucaguguaugaguguaucagggugugaguguugauguguaugugcacuucuuguuuuguuuuguuuuuuggguuuuuuuauuuuuuugguuuuucgagacaggguuucucuguguagcccuggcuguccuggaacucacuuuguagaccaggcuggccucgaacucagaaaucagccugccucugccucccaagugcugcgguuaaaggcgugcgccacaacugcccagccagaaggcagcuuuugggaaucuguucucucuccuuccaccacauacauuccugggauuagacucaguuaggcuuagagcagcaggcaacuuuacccacugagauauucugccaacccaauuuuaccuauggacugauuuguuguuuaagaugcaauucuggauugccuuuuaugaacaccuaaguauggauuaugguguuucauucccucccacaaacaaauguccuuuccuuuucuucacaccucaccuauuauaucagauuaaucuguugcuuuuauucuuccacuaagcugggcauucagugggcacuuaauaagugucuguuggcuaaauggauaaauaucuaaaggucaaauugcuaagccuaagcucauuuacaguucucuuugugcauucaaauuuuugucacuaacuguuggugccaaguuaugcuaaaacuuccaaaaaguuuuuccagaagucuuuugacuuuuucucucuccuguaacuccaauucuaaggguaucuaacauucuuugucaucagacacacagugcaaaaacauacauguaugcaaaacacccacccacauaauacaaacauuugaaaaaaguuuaaucgaguucucauuucccuccacuuugucaccauuugucacucucagacuuugguuucuguugcugucugcuguauguuaaguacuucuugcuuugaugugcuuucccuaagucccuacuuuaguugaauauguuuucucacauuuacugauuaauuccauuuucagugaauuuuuuauucaguuuuauaugcucaguugguagcagccauaccugaauguacauggcuaguuuugaauuucagagauuguuuuuggugguggguuuggggguugagauagggucucucuauguuagccuaggcuugcuugaagcuagugauguagaccaggcugaucuugaacucacagagauccaccugccucugagugcuuagacuaaagcugcaugaugauauuccugacuguuuuguuuaagcuaguaaucaaauguuccauucuuuuaugucuuuaucucucucucugugucucugucugccucucucucucucucucugucuuuuugaacagccugaauuaugcucuuugaugaccuuuauaaugguccauuaagaucaucauucaggugaaaagcauuggaaagucugguuuagaagacugacugugaagguuucaugagacagccagcaaagucugaacaguaacugaguauuuacuauuaguuuauugagaguugggaagugguacuauuucuaauuuauuuuccuucagcuagguuuucuuacagaggaguguuuccuuuuaucuauugguuacccuaagguauaguuuuuuaaaaagaaaguguuugguacuucuuuauacuuuuagauuuuuggaaccucauacuuaguuuuguuuucuuucuccuucucucuuuuaaaaauagcccacuguggcucuaugggagcagugacuuuucucuuucucugacaaguauaaauuauaguuuucauucucuccugcuuugucuguuuuccucagaaucuccucugcccccuucuaaucguuuuuuugcgcucuccucucucucucucucucucucucucucucucucucucucucacuugcuagcucccucccucccucuuuuuugagacagcguaucucuguguagccccagcuguccuggaacucacucuguagaccaggauggccuugaacucagaaaucugccugccucugccucccaagugcugggauuaaaggugugggccaccaugcccggcuaguuuugcucucucuuuuuuuuuuuuuuuagguuauaguuucaagugucugauaaucuuuuuuuaaaaaagauuuauuuauguauaugaguacaccauuguucagacauaccagaagaggacaucagauuccauuacagauguuugugagccaccauguggucaugugguugcugggaauugaacucaggaccucuggaagagcaguuggugcucuuaaccacugagccaucucccuagcccuggcuuugguuuuucaagauaaggggucuugguguagcccuggcugucauagaacuuacucuauagaccaggcuggucugaaauucagagauccaucugccucugccuucugaaugcugggacugaaggugugcauuaccaccaccugcuuuauuuaauuuguuauugcauuuauaaugacauguguaugggugugcacaugccaaguacaaauguagugguuagggcacaacucucgggcugcuuuucacuuuguggguccuagggauugggauuccauuguuaggguuuagaacauaugacucuccugucucugucuccuaaguccugggauugcagguguauagcaccacagcuauuuugacauuguguguguguguguguggucagggucaggggagagggagagauagauagauagauaggauguccuaguguggaaaguacuuuguagcugagaaugacuuugaauuucuaaucuucuguuagaauuauagacauaaaccaccaugccugauauaaaccucauuuuuuuacacuaauuuuugagguaaguaacuuauuaacaauuuuuuuuuuacauuuagauuuggggguguccucccuauguuacuuuuaugaccuugaguucuuucuuauuucauaaaacaagcuucauugaaaaguaaguacauuuaacuaaaaauaaauaaugauuauauaauggaaauaauuucuuuucccuucagaauaaguaaggguguuuaucuuggaggaugucuggcagcaagaaagccuguuauuugguggugcuaaguuuuuagacaauugcuauauucaaaauucuauuuaaagggcucuccaaccuuuguuggccuccugugucuuacuccagagagcagcagucucugaggaguuugccuuuucaaagaacccauuuguuuuuaucuagaacaguagagcaaagcagucccuauaagccauguggacguagaggcaucuugcuucaucagagagcugauucuuuuugagauccugacauaaguugguauugucuacuacuuuuuuuuuuuaagcagugucuaguugcucccaggagauuucugucugaaguuccaucaauauuguugcuggccugguagcuguuaagaugaagaagaguaucuagugagaauuuauuuauuacauauugagaauucccauucacaggcuuuuacugucugcuuaaaagaguguaugagaaaaauggagggagagaggaauagggagagggauuuaugcuauaacauuuuggaaguauucaaccaacucuauuuauggugggggugaauagccacaauuuccagaggugaagucauuuagaauuaggaaaacugcaucuuuuaaaaucuuauuguuuugauaaaaaaaaaaaaagacccaccauaauuuuguuaguucucuaacuucaccaugauuguucugaugcuacuagcuaaguauacuucagggugaccaacucuauaaacaugccaguaugacgauaguaagucauguuaaaucaguuaugaaggcccuuuauauaaguauccauuuaggguuguuucuuuuuaaaaauagcucugguugccagguaagguagcauauaccuauaaugccaagaguccaaaggugcacacaggcagaucaggacggccugagcuacuacauagugagcuccuauuucuaaacaacaaacaacaacaaaagcauggauuacaguaacggugcuaaaaucuuacuuugcacauaaaugcuguuauauacaaauuauaauaaacagaaccacaggauuggugagauggcuuaucacuuucugcauaagucuuguaaccugaauuugaucucuauaaucuaugaaaagguagaaggaaagaauugauuccacaacauuuuuuggccucugcauuuugugacauaucugaacucccucuccaacacaucacacacaugugcauguacacacaugcacacacaccaccaccaccaccaccaccaccaccaauaauguuuuaaaaaacaaagcagguaguauuuuuccuaaugauugaccauuaucccagaaaggacucugaacagucugguucaucucucccuagggagauuaagucaccacccaucagauuacauagacugaagagaauuagcaugaaauagggagagaaauuuucccacaggaaaacuuuguguauagacagaaacaguguuuucuguagugauuggaaagcuugaguuaggugugguaguuuguguuuaaaguccuggcacuugcaaugcuaaaguaauaaaacugccucaaauuugaggccagcuugaacuauacaguaguucugugucaucaagggcuacacaaugagucuugucucaaacaaacaaaauaaaaaagaagaaaagaagaacuuuaaggauuaauaaauaguaaaggauuaaaaaauugcacuuuaaaacuagugaauguuuuuuauugugcuuguugugcuaguuauaauaaccaagauauagaaucagccaagaugccucuucagcaguugaaacaauaaagaaaauguauauauaaugcauauuauuauauuuaauauauauuaugcauauaauauauggguauauuuuguaguuuuauucagccauaaagaagaauaaguuuaugucauuugcaauaaauuguguagaagugaaaaucauguuaaguguaguaagauaggcucacagagacaaauaccuuguuauacaugaaaauauaagggggacuaugagggaagaggaagagauucagagggagaggagauggggaaaggagggaugguaaugggaggaagaaacuuagaaucccacauucucugugcagcagaauguggacugaccugcacaucugcuguuguggcaggaaagcgggagggaagagcuggggaauuagugggaggacagagaaggccguauugggugaaacgucauucucccaagccccaauuuugugguucuuuggcauuuuuguuuuugguuaguucuguggaaagugcucuaccauugaacuauacuccucagcuaguaaaucauaaggcaucucuuuguagcguauaaaguguucuacguaaauuucagcuuuuacuuugaaacguuaguuacugauuuauuuguauuacaaacauuuuagaaccugucaucacuuuuucuacuaggguuacauaauaaguacauaaaacaaugcccuuaugaugccugcauuguggcaaggacaggcacauaguaaaugugauaaauuauuaaaauaguuaguauuuuaauaugacuauuaaaauacuggguuauggggauaauuacucugaaaaagaguaaggagggaagauaggagaauaaggaaggucucacuaggaaggugauguuugaacaaaggcaugagggcaagugaagagggagcaagccaaugguuacccaggggagagaauuucaaauagcaggaaauaagugccaaggauuaguccuuaagucucagaguacuauggucucucaaaaggagcuugauaucaaacaaguaguaggauggugggaaaagauuguguggguuccagcacauccauuguaagggcugugguagauaaaguaucuggucuugagaagaagagaaaaucugaauauucuuugaaaggauuuucuuaacucuuuugcauuuuagaggaucagggugaaagggaagaucauuuaggaggugaauucuauaacaagaauucauacaguagauauugguggcacagaucagguugugguagagagaaugaaagguggucagauaugagauagauuugcugauagaugugauaagagccauuagagaagagucaaaguugauuccaaaguuuuagacuuggauacagucauuuagugaaccagagaccuggagaggaucagguuucaacaagcucaguuuaagguguuuauuagaauccaaauuauguugcccagaaaguagacuguggacaugcaaauuugaaguucagguuuggacuagagauagaaaauuggaaguugucagcauaguuauuaucucaaguaauggaaauaguugaguucauaaagagugaaugagggguggggagauggcugccugguaaagaggcugcugcaugaggguaaggaucugaguuugaauccuaggagcccauguaagacccagguaaggaguacagguuggcaauuccaguguuccuauagugagauggguucccacacaggagacucacuggagacuugugggccagcucgauggucacaagcaguagugaacaacaaaaagacauccugacaauaccugaaguuguccucugacuuacacagguacacaugcccucacacgugauggacacaaacacacacaagcacaccccuacagagugaacaaggaggaagccaguugcuauggcauugaaauuuuaccuauuugugggggaggcugaggcagggggauugugagcuuuacgcuacuuugacaacauaguaaggucuuccuucaaaaaauaauuuaaagggcuauuaagauagcuaaguguguaugggauuggguggagggcagagacuggagagaaagauggcucagugguuaagagcacuggcugcucuuccaaaggcccuggcuucaauucccagcacacacauggcaggccauagcugucucuuaacuccaauuccaggagaucugacacccucacacacacauacaagcaggcagaacaccaaugaacauaaacuaaaaauaaaucaugaaaaaaagagagugaagagcauaaaggcagcuggguaucuaaauuccaugucuaaaacccaucuaauuccaugucuaaaacccaucuaauuccaugucuaaaacccaucuaauuccaugucuaaaacccaucuaaaguguaaggagagaacagaugcugcaagauugucuucagaccuccaacaugcaugcagugagugacacgcgugugcacauacaugaauacauuuuuaaaaauuuaacaaagaaacaaacauuaagaacugaaaauguguucaaugaaggagcacuucggugugaaaacugagggccagcuaguaaagagcgccaagaaagagcaaccagaacuaggagggaaagccagagagaaaagagaacgcaguugguagaugcagcugauguaaugauuaacauggagacuaagaguuaaugguuucauuuaaccagcuuuuuaaaaaaguauauuuggccagccuggccuacacagagugaguuccaggacagccagggcuauacagagaaacccugccucaaaaauaaauauauauauauuugguugguagaaauauuccuagcccagguucuuuuuugaauuuaaaccuacaccauuagguaaugcacacaauuacaucuugcugaucuuauuuauuuauuuaucuauuuggcagcacuggaaauagaaccccugccuccuacaugcuaggcaggcacaagcccauugagccgcauacacccugacuccaguaucacuuguuaaauaaucacucagcaaauacuauuuuguuauucucuugucucuucugcacauacuauagauuaaagauuuguuuucaacucaaaaugaauaugcaaguaugcuaaaagauuuaauuguagugggauauauauauucucuuuggagaauguaaagugauaacaacuuacuacuaaauucuguauuugaggguuucguuauaauauuagagaagcuuaaauuaacccaauuucaugauuuuuaagaucuguuagauacuacuauauauuuaauauguguuuaauauuuaauguuuaauauuuaaauguauauaauuaaaauuuuuuaauuuuauauaugauggcaugcauggacagggcaaaggaguuuuaguuucaggagucaguuuucuccuucuaccuuguggauccugauaaucaaauucaggucauuaggcuugguggcagauuccuuuacugagccauauugucagcuccugcuuguugucaguucuguugagaguuuugcaugcaagugugucuguauagcacaugugugccugcuaucuuuggagucuagaagaggaugucagcucuccaggacugaaguuacagaaggauguaagcuaccauguggauacuagaacuagaaccagaacugggucuucucgaagaacagccagugcucuuaaccuugaggcaucucuccagccccuguuuauuauuuuugaaaaacagguauugaaaaaauauauaaacuagaguucauuucaauagugaaaauguauauucuucuuuauuagaaauucauugaauuugaagacucucaagaacaggaaaaaaaggauuuacagacgcgaguggagucucuagaaucucaaacaagacaacuugaacucaaagcaaaaaacuaugcugaccagaguaaguaaaaugcuuuucuccucauaauaaagugaacuccuacagggagugauuagcccugucauuugacaggucuccaaauaaugcgcuuggauuuguuaucacagaaucgagugugagaucugggugcuuggaguaauauuaauuccuuuuugcuccuauuguacaugacacccccacacacauacagaaauggcugagccagagauacgugcuagacuuaguucuuuaguugagcugucagccuguuuguaguuauguaugcugccuuuguuacacagauauauguauguggagcacuucugacauugaugaaguacacacaguuccauuguuucuguauugcuuugaaauuuaccaauauaagaaacuagacuugaaguguguauaagaagugacauuguguaacuuuuugaugaaaagguauagguaauuuaggguaacaaaaguucauuuuucagauuuguuuuuaaaacucuuugaaaaaguuuuuagguuuauuuuuuaugugugccaguguuugccuguuucucuguguguguguguguguguguguguguguguguguguguguguguguguguguguauguguguguguauguauguguguguguguguguguguguauguguguguguguguguauguguguguguauguguguguguauguauguguguguguguguguguauguguguguguguguguauguguguguguauguauguguguguguguguguguguauguguguguguguguguauguguguguguguguauguguguguguauguguguguguguguguguguauguauguguguguguguguguguauguguguguguguguguauguguguguguauguguguguguauguauguguguguguguguguguauguguguguguguguguauguguguguguauguauguguguguguguguguguguauguguguguguguguguauguguguguguguguauguguguguguauguguguguguguguguguauguauguguguguguguguguguauguguguguguauguguguguguauguguguguguguguguguguguauguguguguauguguguguguguauguauguguguguguguguguguauguguguguguguguguauguguguguguguguguguguauguguguguguguguguguguguguauguguguguguguguguguauguguguguguguguguguguguguguguguguguguacuauaugccuggugcccuucauugcuggucagacuagagggcaucagauccuuggaacuggaguuagagaagcuguaagguaucaggugggcgcugggaaugcaacucuggcgagagcagcaagggcucugaauuguugucauuuccucaacccccuuucccagguucauuuuuaaugcaauuacauguuauuucugacuuuuaaaauuauuuaaaaucucauggauaauuuugccuuuugguaaugaaaauucuaaaaagugaaauuuauaaaaagaacuguuaaagaauaaagaauaaaaagaauugaugagaaacuucaugaccucuuuucucuuuaaauuuagauuaacuuuauuauuuggggggcagggcauauguggcauggcguccauguggaugccagaggacaacucggaggaauacaguauuaacuuuuccuaccacguguccuagcgaucgcacuuggcuugucagccacgucccauguuauguuacgcuucuuacgucacucacugguuaggggguuauaccaacaccugcuguuggguuuugggguuuuuuuuuuuuuuuuugagauggggucucauuauguauauugcuagucugguagcaagcaucguccuucauagugcuggauuuuagcuguaugccuccuuacccagaugggauagcugcuguuaaagaacugcuaguugucaggcauaacuaccaacauuggaaagugaaguguguuugagaaugcaacuaagugcauccucuagaacucuagaagguccaacuugagcuaaaugcaaaacaguaggaauuuggagcucaaacacuagaauucaagaauucacaggcuguuuagcagauagggauuuucaguagauuuuugguuacagaagcuaaugagcaaaacaaugagcuauaucccaugacuuuguuuuuaugcuugaugauacauaagaguuaugcagcuucuuuuugcuaauuaagaagugggugguuucucuaauuuuugcuguagacuguccuauaaaagccugagcacuuagagagcuugugagggagaugcuuguaaguugagcaucuuauaaucaaguaagaaaauuuagccuuuuuuugagacauucuuacuuuguagcccagguuucuggaacucauguaguucaugcuggccuugaacucacagcagcccuuucagccucccaagugcugagaauacagauguaaacuaugcucaagaaaaugugguuauugaagauaauauuuuaauucuaaauugauaauacuuuuguaucaaggauuauauagugucuuaguuuggguuuuauugcuuugaagauacaccaugacuaaggcaacucuuacaaucuuacaaggacacuggcuuacaguuccagagauucaguccauuaucaucauggcaggaaguguggcgacguccuggcguauauggugcuggagaaggagcugacaguucugcaucuggaucccgcugcagccaggagagacugucucuucugugcugggcagagcuuuagcacuaggagcccuccgagcccgccuacaacagugacacacuuccuccaacaaggacacaccuaacagugccacuucucaugggccaagcauauucaaaccaccacacacauaaagaaagacauaucagaaacaaacaaauguucauuauuuugcugaguagugcuggugcacacuuuuaauccuagcacucaggagucagaggccagccuagucuacagagcaagugccagggcuguuacacagaaaaauucugucucaaaaaaucaaaaagcaacaacaacauuuuuuaaaaaaauuuuaaugacccuuuuuccuuuacaaaguacuguuuucaguaaaauuuucuuuuugacuugaaaaagaauugcuuaucuaaaaaucuuuuuagacauaaaguggucuguuucuguuguaagaaacuugagcaaagcucguuuuauacuuaaaguugcauuaacugucuauuuuuaugugugucccugaguaccuacauauguguaugugcaccgccuuuguuccuggugccugaggagggugucagauaauugcagccauguagguccuaagcaccagccuuacuccucuacaagagcagcaggugcucuuaaccuuugaacugaaaucaaauuuuuuauuugauaauuuguuucacauugagaggagcuacuguugcuuuuccugcaaaagguagcuccaguggguaacuccccugccucccccccacuuagguacauuauuagccuuuuuaaucacuaaaaacaaacaaacaaaaaaacuguuuuucuucuuuauaaugaauggaaacagagcauacuuuguuugguuuuuugguuuucaagacaggguuucucuauguagcucuggcuguccuggaacucucuuuguagaguagguuggccucaaacucagaaauauaccugcuucugacucccaagugcuaggacuaaacaugugugccaccacugccugguguagguuuguuuucuagguuagugaaucacacucagugaauugucauguucuaugaaaucuauucucauuucucuuuucaggaguauugauuaucuauuuucauuuuaauuccaaaguuuuguuuucuuuuuuuuuuuugagacaggguuucucuguguagcccuagcuguccuggaacucacuuuguagacuaggcuggccuugaacucacagauacuccugccuguaccuccagaguggugggauuaaaggcaugggccacuaugccuggcuagcuauuuuuauuuuuucagacauaucuugaccuuuuuuuuuugggcggggggggggggguggagggggggaggggaacuuuauuggcuuuaccuccuccagauuuccugaaugaauuaaugaauuuccugucaauuuuuuuuuaaucuacuuacacaugucucuggagacugaaggauuaucuugggcgacauccugcugcucaucucauuugagacagaguuauugacuuggagcugacuaauuauccagagagccccaaggagccuccuguuuccgccucuccagugcuggaauuauaagcauaucuucaugcccagcacuugaacucaggcauucaaguuugcaaagcacggacuuuacugaguugucuccccagccuuuauuuaguuccuuaauuaaaaugaggcggggggggggggggggggggaggggagggagagagagggaggaggagaaagaaagguguuuguugcacauguguggaagucagaggacaaguuuguggagucagaucucucuuuccaccuauggaugcugaagaucaaacucacaucgucagguguggguggcaaguacuuaaauauguguauaugugugggugugacuaugcccauaugcugugacaugcauguggaagucagagauaacuuccuggaguugguacucuccugccauguggacccuaggaauugacucagacucggcagcauacaucuuuaccugcuaaacugucacuagcuccagaccccuuaauuaaaaaaaaaaugguggcaagaagucauuauuaguaucauuggucccuauauuuuugggaauccaggccuggaaacaagagaguuugguuugguuugguuugguuuuguuguuguauuguuguuauauuguuguuauuguuguuguuugguuuuuaguuugguggggccuuuuugguuuuggcuuguuuuguuuucaauuuuguuuuuucaagacaggguuucucuguguaguccuagcugucuuggaacucacucuguagaccaggcuggccaauaaauaacagagaucaacccgccucugccucccaguugcugggauuagaggcguggaccaccacugguggaauaagagcuuuauaagagaugaaguuaaauuucugcagacuaugucagacuuuguuuuauuuuauuuauuugcacaggcucuggagagauaaucagugcuggccucagccuccugaaugcuuagaucagagcugugcagugcuacauugguuuccauuucuaagguuuuggucuguacaguggagagucucuaguuguaaauuacugacuuugucagucuugguugauucguuucaaaguauacauucuuuuuaaagcagucuuuagaaguccaaguucuucuuugaagaccauuucuuauuuuaaaaggggaaauuuugguugugguuuucuacaugaaagcaagaaaagguaaagaaauaggaaccgaauuuaaagaguauucuucacagcuuaaugguuuuuuuaaacaguuauuuggguugagcggguggggugugcaugugugcugcagggcguaugagguaaccaggagaaagcauacauggacgcucacucucuccaucuuaccuugugaguccugggaauugaaagcaggccaucaggaaaugguggaaaucaguugugccaacugagcuaccucaccagccccuucccagcuuuugguagugaguagguuuuaucagauagcaauaugacuuaacuauguugagaagcuaagucuauuaaaaauuuugucacaauuuugugguaauguuugaguuuagagauuucugguuguucuucucucagacuuugaacuaacaugaaauaucuuugauuuauucaauguaaguaaagcauuuaaaaaaacuuuucguucuuuuccaaaugaaacagugauaguccugcuaauuaauaucucaugauucuuuaagaagaaucuaaaauagauaugcuguuugguaagaaauauguaaauugaagaaguccaauuuggaacuuuacagcuaaucaauuuugccaaucauauugugguaguaacuuuuucuaaaucagaaaauaccuucuacguucauuauuucuguuuuauuuuguuuuauauucauauucuguuucuauuuuaucuuauaagccacauauugaaugagucaaguaaauauagauaauuaagcauaguuaaauaugaacugugguuauguucuaguuauagcacagaagaguaagauaaggccuuugugaucaaauaaaucauacuauugagaagguaggaggaaagaagguuaggucauagccgacuaguuauuucauuuguuuuuacaacacuuagcuuuguaccuuacguauuucuccauuguauaaccuuuauuuauuuuauauguauuauauuauacauuauauauauauauauauauauauauauauauauauauauauauguacacacguguauuuaucuuaauuuguauuugcuauugggcaaacagcauacauuugguuguuagaggacaacuguguuaaaugaguucucuccuugcaaccuuuacaugaguccugggaaucuaacucagugucuaggcuaaccaaggagauaucuuuacccucaagauauuuuggcaauccugaucgguuuuuaaaaguuuuaaaaauuauauuuauuuagcaugugugcauguggaggucauagaacaacuuggaagaguuacuucuuccuuccacacuggggcuccagggauuuaacucagaggucaucaggcuuggcaaagccagcgccuuuacccacugagccaucucacuucgcaccucauuaauuguucaaaugcguggauacuuugaacggcuagaagcugugccaucuauuaguaauucuuguuucuccuaaagagcuaugcgucuccccucuauugagaauuauuuaauagccauuucuuuuuucuuuuaucuuuuuugagacauggucuuuuauguaguccaggcugguuucagacuuagaaauuugccuuucuaagugcugucaaugggcuuucucucucucucucccucucucucucucucucucuucccccuuccucucccuuccucccccucccucucucccucccuuucuuccuuccuucuuuccuaaacuuuggcuguucagaggcaaauguuauaauaauauuuugacuugauuaucacauuuauauuuuguagaccaaaucuaguaacaauauugaauacuacuucaaauccuucauugaauaaaaggaagacucaaggugcaaauaggcugguauaaaguaagagcaugaaaaucaggaguucaggacuagucuggucuacagagagaguucaaggccauucugggcucugugaaacacuguugagaaagaagggggaggaggggagggagggagggagggagagagggagggaaggagagacagagagagagagaaagagaauaugagaaugagaauaugaaugagaaugaauauaaauacaacaaucaagguaaagguaaaugugagcccgguaggacuuuuaguucacugguugggagccuuacagggacaucagaacaacaaagcccaaagcuuccuuuaucaccuggcuggcugauugguuggacuuuuuuuucuaguauaaugaagcauauuauacuaaauucuguuucaugucuauaguuuccccucuugucauaaucuucuuagaauauauuuaaggaagcuggucaaggaauaugaacauuuuuuuaguacuucauaguauuugauuuuggacauuuguuaacaacauauuagcacucagaguagaugcaaacuucuuguuaggcugccugcucaggaacugauugcccuccacucagcuccugaguuuacaggacuucccuaagguaggcuguuaauuccuuugggaugacaaaaacagagauuuagugugccuugauaucuaucuaucuaucuaucuaucuaucuaucuaucuaucuaucuaucuaucuaaucuaguuggauaucuauuuaucuacauugguguuuugcaugcauguaugccuuugugaggguguuggauucccuagaacuggaguuacagauauuugugagcugcuaugugguugcuggaaauugaaccaggguccucugaaagagcagccagugcucuuaaccuuugaaccaucucacuagcuccaagauggcauuuguuagcauugguuuuuaagcuguuugaaaaacuauaacuuuaccuugcuuugaguggaaauccuuuguuuuguuuaauauuaauuccaaguugguggauguuugccugcauguaugccuauuaccacuugugugccuagugccagaggaggucauaagagauuaucagaucuccuggaacuggaguuacagaugguugugagcugccauguauccauuagaacagucaguguuuuauuugcugaaccaucucuccagcuuuauuuuuugagacagaauauccccuaugugaaccauauuagacuugaacucagagagaucugucugcuucuaccucccgagugcugggauaaagggcuuaugcuaccaugcuugccuugaaaauucauuuuuaaaaauuaaguggaaaauguugaagacuaaaaacauguauuagaaacuguuuugaucuuucuacccuuucuauaccucacugagacauucauuuaccuuuucaauuugauaaaaagaucuuagucuaguaaaaugcucuaagccuucaucuugaaacuuuguuauuagaagaaaaauaccucacuucuuuuucaaaggaauaguuaacuuauuaguuggaaacucuguaaagguaguauagucauuagcacacuguguuuuaaaagaauaaauggggcuugagagauggcucagcaguuaagagcacugacugcucuucugaagguccugaguucaaaucccagcaaccacacgguuucucacaaccguccauaaugagauccgacgcccucuucuggugcgucugaagacagcuacaguguacucagauaugaaauaauaaauaaaucuuuaggcuagaaugaguaggguugacugaagugagcagaauucaaauucccagcaaccacaugauggcucacaaccaucaguacagcuacaguguacucauauauacauaaaauaaauaaauaaaauaaaucuuuuuaaaaauaaaauaauaaauggcagaccuuccaacgcaagaccuauuaaucaguugauugaugguugagaauuuucacaccucagaaggaagagagauaguuuuaaguuuaccgggucuguuuucaugcuuaaaccuucuuugguguuuugcuguguuuuucaguaaauguuaauauuuugagaggagggcagggacguugcuggaugguaacuugcuuacacgauguaagacagacagcuucagucuccagcacugcaaagaaaucugaaaaagcuugaauacuacuguaauaaaucaauuacccauuuuaguucuaucuugucaauagaaaaaucucuucuacauaauuuuuuagagcaguaaaguuagauaucugaugauuuguggauuuuuuuuuaaaccuauggguuuuuuuuuuaaagguuacuuuaaaaguuucagauuuguauuuucuuuuuuugggguuuuuuuuuuuuuugguuuuuugagacaggguuucucuguguagcccuggcuguccuggaacucacuuuguagaccaggcuggccucgaacucagaaauccgccugccucugccucccgauugcugggauuaagggugugcgccaccacgcccggcucagauuuguauuuucuuacugaaaaaaaaaaaaaaaggaccuuggaauuaacugcacagaagguuauuuuuaauucauuuaaauuugagucuaguucuuuuagguuaggaaaucuguguauuuaauaaacuuuucuugagggauucuuuuuuuuuuuuuaaagccuguauauaaaaagcaaugcaaagggcuggagagauggcucaguggcuaagagcacugacugcucuuccggagguccugaguucaauucccagcaaccacauggggucuuacaaccaucugucaugggaucugaugcccucuucuggcaugcagguguacaugcagacagagcacucaaacacauaaaauaaaucuuuaaaaacaaacaaaacaaaaaacaaaaagcaaagcagaaaaucaguauaguagaauuaugcaaauggugguggucaguauuucuguaucauuugauaacacugucuucugcugucuuguuuauugucuguauuugggcuuuucuacuuucauagccuaguguuuucuauugagaguauuaauggugcagcuuauaauuaauaucuagaacuacagguacuuaauuuuuaugaguaaagaucaaagaauuucuggccauuuaauuuaguaaacaaaaaauuaacugauuagccccucaacuauauaaaggggugaauggauaaggcagauaccaagcugucuuccuauaaguucagaagauuaaauuaaaggaagucguuuuguugguuuuggaacauuaugaguauucuguggucaugugaugacaaagguauacgugcugagguagaacauggccccucuuuauagagagagacucuagauuggaaagaagcaaacuuucuguuaugggcgacgucuugaaggaagugacauagauuguuagaagucucugacacuggaaguuguugaaguuaucacccuccccuuuuaaggauucaugagaguuuuaagauaucauugaacaucuuuuugauuaaugacauguaauaucuuccugaaaaucuuuugacagauguggcgaaggccuuggucaaggacagguuucuaucacuguugugagguauugucugagaugguuugcucuuaagucagcacuugguucguguuuacuuuuugggcuuuugaugcuaaauuguugaaggagaaucucugaaaggccaauguuaauccucugagguccaguaacaauuagauucucugccuuccaagaacaguaagaacuaaugauuccuuuugagaaggcacauaauaguuggauauggcauucuagcgggucuguuucucuuucuuccccccauaggccuaucagcagucugauggggcagaagacaacagagauggaagguguuccaaacuuggcaaaggccaccaaucucaggagguaagcucuaauuuugagccggcagagcagguggcucuuccugccucaaucauauccuugugcucuuugaaaagcuggaaagaaagaaaagaaagaaagaaagaaagaaagaaagaaagaaagaaagaaagaaagaaagaaagaaagagagaaagaaagaaagaaaagaaaagaaaggagagagaaaagaaagagcgagugagcaugcaaaaggaccuaaagcagcuccaucagcuuuuguuagaggggaaaguuguagauuuuuuuuuugaaugcucuauuucuuccucuuucuccccuuucccuuuuagaccccgugguuuuauuuuguuuuucuucccagaaaauuagcaguuaaauauaggcagauuggcuaucuguuguuuggggauaaucauaaacagauucuuguuuauuuccaguuaaugcuagccuugaugauauaauaaucacaagaguuuaagguuuuuccugaagucuuuuuaaaguuuggguuuacucauuaacaagaaacgaucuuuuacuauaucuuagauguacugcagcauagguguugguuaaugcuaaggaacugaggcugugggauguggacaguuguugcugagcugggauuauccuuccuacuuuuccuuugcuucuucucuauuuuuucacccuuuaaugguuccuuaguggcauucaggacucucaagguggcuuuuccuguguugauaguuuuuuucagaaaugguuaugcuauaccguuacuuaguccuuaacuuaugcuuacuggguauguuguuguauggaauaauauuuuucagaaaagagugaguacuucugaaguugcaguauuggucuuggcacauauuggagcauauguauagaguacauaauuacuguauuuauuugauauuguaugauauuuuuaugauuugggguguacgaaccuaaaaagauaauauugguauuuaaauuauaguacaaguaaagaaaacaugaaacacagaaaguuaucaacuguuucugucuagauauuuuuguaggcauuaggaaggggaaaauaacugccagaggcacauucccaguaacaaaggcauacacgacucuuagagcauggcucuaugaucuaggaugccuuuuaugaggauuucaauacauguuuauaagcuaaaguacauuuuaaacuuaacuuugguuacuacagugcauaagccauggaaauuauuauagcuaaagacugaauaauaagccgggcgugguggcgcacaccuucaaucccagcacucgggaggcagaggaaggcagauuucugaguucgaggccagccuggucuacaaagugagugccaggacagccagggcuacacagagaaacccugucucgaaaaacaaacaaaaaaaaaacaagacugaauaauaaaguuccagccugguggccuacauuuaucacagauuccuguguaguuuugucaccuagugccaucguagcugagcguguguguauguacauuguguguuugcacagugauggauuggguagugaggcaauucugaggacauaucccuacuguuaaaacacaugaguguauaaugacuuauguuuuuucuuguuuguauacauuuuuauuuauuuaacuuuuuuguuugagacaggguuuuuauuguguggccuugacuguccuagaacuagcucuguaaaccaggcuggccucaaagucacagaaauucaccucucuccgccuccugaguacuggaacuaaaagcuggcuuuauguaaaaauuuaaaaauuaaguguuucugauaaaucaguagcuucuuuggaaacagacauuuuacaaguuauugcuucuaaguuuauuauauucauaugcauuaaguuggaagacuagcagcagagauggaggauugguugggaccauuuauaaugggucaggcauagggguaggggauauaacuagggugguggcaugcaauagggaacuacuuugggucacaucuaggggccuuugucucagcuuagcuuucauuagguggcacuuuugguuauguguugaggcuaaauggauuuagagcuuagcaacuaucuguguauucuuucuauugugaauuacuugggaaagagaagaggauguuuguuuguuuguuuguuuuguuuuguuuauuuuggggacagaaucaaaaguaucccagguaggccuugaacuugguauguaccugaggauggccuccuaauucuccuaccuuugucucccaaaugucaccaaguucaacguaggugaaaauguauuaaaacacauaaguuaagaaaaugaacuuuugagcuuaauggaaaugguauuuauggcauugagcucuuacaaaaauaacugacaaaauaaacuggcaaucuauguaguggacauaauccagccacaaaguuagggaguggccuuuaaauauauauuccuaagugaaaaagguaguuugaaaagacugcacacugugugaucccaauucuaggacacucuggaaaagacaaaacuaugaagacaacacagacaucaaagacaaugugccgcucuuagcaugggugaugagauugggaguguuguguuuguguugaggcaagagauagggcucaauuucauaucuauuuuuaaaaguccauuaaaacaccagaugcacccauacacacuuacaaucuugcuccucgagauucugaggauuauugugaguuuuaaggcuagccugcacuuccaguggguaagacccugccucaaaaacaaaagaaacagaagacaacaacaaaaaacuuaacacauaauuggcuccaagucagcugcuaagaccacacagugagaucuugucuccaaacaaagagacuaacacauaaggaacaaguagucuguaaugaccacuuauuuaacacccaugucuaucugugucuaucuauguaucuaucuaucugcuugucuaaucaauauaucuauccauccuuuccauccauccauccaccuagccacccacccauuagucaaucagcaaagucuucuugucaggcugaugucaggcugaccugucuuccuuuucgaagugcugguuauagggauugguaucucaccuagcuucaaguguuguuuuaggaaaaaauaagaaaauggugccacauggaaauaauugaagcagaaaguaaucuuauugucuagaaagcugugaauagaagcuaaaggaauuauaaguagugauacucagaaauauuuagaaaaacaacagccggauggugguaccccuuuaaucccagcacuugggaggcauaggcagguguauggaucucugaguuugaggccagacugaucuacagaaugaauuccaggucagccaagucuacacaaagaaacccugucuagaaaaacaaaacaaaacaaaacaaaacaaaaaaggaauauuuguggauaaauuuaagccaauccuagugaugauaaauauuaauuuagaaaaauuuggaaacacagaaaucagucauauacuaggguuauaauggcuaauuucucacaguuuugcaaggugguacauuucagugaagcuauucaagccaaaugcaauuagcaagcuaauauaaaaucagucaggaccuauuucuguaagcuauagauucugggcaacucuuuuuuuuuuucaagacagaguuucucuguguagcccuggcuguccuggcacucacuuuguagaccaggcuggccuugaacucagaaaucugccugccucugccucccgagugcugguguuaaaggugugugccaccacugccuggcgauucugggcaacucuuaggaaauaccuuggauaucuaagcauuucuuuucuuuucuuuuuuuuuuuguuuguuuguuuguuuguuuguuucgagacaggguuuuucuguauagcccuggcuguccuggaacucacuuuguagaccaggcuggucuugaacucagaaauccgccugccucugccucccaagugcugggcuuaaaggugugugccaccaccgcccggcaagcauuucuaagguaugcuuacucauauuuaguuguuuuaguuuaugaacacugucaaaauacuacaauuuaaauauuauugucacagucuggaaguuaggggucaaagucaagcaauagccagguugcuuuuuuauuuuauuuuuucuguccugaagcccuucuucuuggcuugcaggucaucuuuuuuuuuuuaugcauggcuauugcuaugugugucuagaguaagagcuuuagugucccuuacaaggauacuaguccuggugaggcagugcucugcugccugcuaauuauacuccuaaagacuauugccaaacacaauugcauugggaguuagagaccuuggucuuugaguuuguaagaugaggacccaauuuaguccuugacaagacaucagcguucuucaugggguuugggaaugaaagguggugugacuugacacauuggauccuguaaaguuuuguggaccauuguaagaauguuucuuuguuuuaaacaaaacagaucaccuaagaauuucaagcaugguauuuuacccagacuauagaucaaaagcuaaauagauacacuggucaggagauaauuguaauaguaguauaagcauuagaugaucugcuagaauaaaauuugauggcacagauggaaaaauuagucagagucuagauuuauuuauuauuauuuucguuauuguaguuuuugagacaggaucuuacgaaguaacucucauuggcuagaacucacuauguagacuagcuggccuuaaacucacagagauccuccugucucugccucccaacuacugagauuaaagccaccacuaggacaccuggcuuagauuuauuuuuaaaauuagauacauugaauuuacugauagaugguguacuaagccuuuucacugauuugacauaguaacuugaauggacaacuugagggaggaaagauauauuuuggcucauuguaucagagauuuuaauccuuccuguagggaggauaugacaggaaacagggaccaaguguagggcagguguaacauucagaguuauagccgagaaaaugaccucuucuggcuagucccugucauaccacuuccaccaccucccaaaauagaacuaccuuuugagcuugugggagauauuucagccuuaaccuaacaguugggguuaugguguggaaggagugaugaagagagauaagggguuuggggagaagggaggaugguuaaaggaguuuugccugaguaagguuauaggaaugaacuguuuugggagacaguuuuuuguuuaguaaauaccuuacaguucacacuguuuguuuuuaguauauuuuucuauauuuauguugguuuuuuuguuugguuuuuuugagauagggucuuacuccguagcauugguuagccugggacucuacuacauagacuaucuggccucaaauucauggagauacaucuaccucugccucccuaguacuagaauuaaaggcauguaucaucaugcuugguuauagaaucauucuaugucugucugucugucugcuuaucuaucuaucuaucuaucuaucuaucuaucuaucuaucuaucuaucuaucuaucuaucuaccuauccauccaccuaucuaucucuaccuaccuaccuaccuaccuauuuauuuauuuagagacagaguuucucuauguagccuagucuguccuggaacuuauucuguagaccaggcuaguuuugaacucaaaaauuccucuuccuuuccuucugagugcuggaaugaaaaaugugcaccaccacugccuggcuuuuauuuuuacuuuuaauguguguguuugugugugaguguguaugucugucuguuuauaccugcaugcauguggaggccagaauaggacaucaguucucuuggagcugggguuacaagcacucgugagguacccaguguugguauuauggugcaaauuugggugauucagccuguuuguuuguugagauaagagucucauuauauaucucuggcuggcacagaacucacuauuauuuagaacuugugaucuucaugccuucaccaugauuauacauaccaccauucuuggccuagccuuguauuuuuauuuuauuuuauuuagcuaagguuuuuuuauauauauauauaguuuguuugugagccaccaugugguugcugggaauugaacucaugaccucuggaagagcagucagugcucuuaaccacugagcccagacuuguauuuucuaugauauauguuccgcaccuguccacuuacauaggcacaguuguguguugguguuuucagauagacagcauuccuuuuaagaaacaccuuuaaauacuguauuuuguuugguaauuguauuuguaccagcuuuguccuuugcaaauauucacuaguccuagugugaacuaugauuacuaaacaaggaaauaaguccagcgagguuaauuuacugaagucaugugacaguaagaaagcaaagcauuguauucugugauaggacuuucauuucaucauuuccucuauuucuccacuauggcagcauacuugcauuuuuacugugaauucugaggaguuuauuuaaaucuucugcuauaucuaugcacauagcaauuauuagaggguguacuaagugaauugaguauucaagcuaaagggagucccuaggugaaccgauagauacaaguuguguuugaaauggagcgggaugguuaauaggcaacuuaauccaucucaaaggcaauuacuguaauuucuuuaacacuuuauguguuauuuuuguauuuuuuaguuucugcucuuucuugcuaucuuucuugugacauuuauccaugaugaguuugaaaauaauuuauucauucuuguauaguauuccugauuugggaaugugaauauuuucuccacuuugcuguggguugacaaguaaacucuuuucagcuuuggaugauuaaacacuauuuuaaugccucuaggugugugguaguaagcuuuucaucacugacaaaaaacacccaauaaaagcaguucagugaagcugggugugguggcacacaucuucaaucccagcacucgggaggcagagguaggugaauuucugagcucgaggccagccuggucuacagagugaguuccaggacagccagggcuacacagagaaacccugucuggaaaaacaaaacaaaacaaaaaacaaaaaaaacaaaaaaacaaaaaaaccgguucaguggagguuaggucuguaucguaucaucauagcagaggcuuggguuuggcuggagggugugguguguugguguguguauugcuccuauugauuaucugaucagucguuuuuucagaaagccuauagcacacaggccuuaagguacauuucauauucaaacuauaauauugggcaccuauauguauuucuuagcaauaaaauauuuuuguuguaggguuggcaagcauucagccuuguuaauucuugccaaacuguuuucaauuugauuuuuuuguuuguuuguuuuguuuuuugauacaugacuuuucuguccuggaacucacuucuucagccaggccggccucaaacucacauagauagauccaccugccucugccucccucccucguucugggauuaaaaaugugcacaaccaccacuuagcuugcuuuaaaauugaauguaacauuuuacuucuaccagcaaugcaugaaaguucuauuuguuuccauuuucaggaaguauuuguugucuuauauuucuuauuuuagccaccuuggucuauaguauguugauuauucauuuuaaugcauguaucaaugggguuuucauuacuauuaacaaaauaccugaagcaggccauaaagaaagauuuauuuaguucauaguucuuagagguccaaaguggaagagaaggauuugggacuuaccgggccucuggccuaggccuggugaccaauggcaacacaguguugggaacauugucaaacagcaagcuagagggcaguuagggaugagguucguuuuuucaacaacuugcucuuaugagaauucagaaaucugaugagauuuaaucucucccaaggacauucuucaaucacuagggcucucaccaggccuuaucucuugauggcuucaucccuccuuccaacacugucaccauagggaccaagccugcaacacacuaacccucggggacaaaccauaucuaaacaaaaacagucucccagaugauucauacagccaaguaugcauuuucacuuggcaauuugaugcuuccuuaaguuucugagacuggguuauccuauaagaaaaaggaauuguuugaaucucauccccuggcagugaaaacuuuuuaaugauuuuuuuguucucuguguaugagugucaugccugcauugugugucuguguacaaagccugugccuggugacuguggaggccugaagagagcacuggaucuccaagaacuggaguuacagaugguugugagcuaccuuguggauguuggggacugaaccuugguccuucacaagagcagugaaugcucuuaaccaugagccauuucuugaggcccccccccccccacacacacucaguguggguagauucuaucaauaaaacagauuucucuuuugcuuuuuuggagauuggauuuauagcccuggcuggccuggaauucacuguagccagaggcugaugugaaacuuacagcaaacauccugccucaaugcccaaaagcuaggguuccaggugugaucuaacaugcuuggcuaaaagugcauuucuugaggcagauagcauggcaccaagacaccuccauuaggaaagaaccaucuuugugaccuuuaguaaguuagccacagugccaaguagucuucucucuacauugaauauaaaaugauguuucugucauaauaugauaauaaaaucaguuuauauccaguuuguagggcaguucauacuaugcaauaagcaguaugucaguuugguauuaauauaaauuuuaugaauugauuucaaguggguugacagaaucauggggcucuaaucuguaauacauuugaaguugaaguuuaugaaugauauuggcguuuauuuuagccguagucuuuuuucuucuuucuuucuuucuuuuuuuuuuuuacacauuauugaaagaacauuuauuauuagagcuagugagauagcuuaguaaaggcacuugcuaccaauccugagauuucauagaacccauaugguggaaggagagaaccagccacagcacacaguacuguggcauacaugccaacccucccaguauacacagaacauaaauaaguguaauaaaaauuauaaaaauaugaauugacaaagaugaauaauuuuaaauguuugucugguagucucgggauuuccuuaacuuuuauuauauuuuauuagauuuuuuuaaauuuacauuucauauguuauucccuuuccuaguuuuuccuccaaaaaccuccuauccauucuccccuccccaugcucaccaacccaccuacuccugcuuccuggcccuggcaguccccuauacuggggcauagaaccuucacaggaccaagggccucuccucccauugaugacuggcuaggccauccauccucagcuacauaugcaguaagagccaugagucccaaccaaguguuuucuuugguugguguuuuagucccagggagaugcugguuaguuuauuguuguuccuccuauggggcugcuucaaaccccuucagcuccuuggguacuuucucuagcuccuucauuggggacccuguuuccucauccaauggaugacugugagcauccaccuucuguauuugucaggcacuggcagaaccucucaggagacagcuauaucaggcuccugucuuccuuaacuuuuaaauaaguuuaguuaauaaguaguaagcaauguuuaucaccuaguuaagguuuaauuuuauucacuuauuuauuuauauaucuguguauauguccaugugugcguguguguguauguccgugugugcgugcgugcgugcgugcguguguguguguguguguguguguguaugugcgugcguguguguguguguacauacacaugugugugagcuccugagugcaucccauuccuucaagugucuuuggaggccagcagcagcucagaucccuggagcuggacuuacugccugguguggggcaccauggguccucugcaaaagaagcaagugauuuugucugcggaguggucuucaucauauaaauaaaugacauuguacuuuuuucuugcuaaucauucaaaaauuuuuauuuugaaauugucacuaaauauccacaguuugcauagauuuccugagguuuuuuucuuuauguauuuuugcuuuaaaugagcagcaccacaaauuuucagauuucagcaucuguuguguuauccuagugcaucuauauuauuaauggcuuauuauugcuuugggucacagcauaaaguaaaaagcagaugugcuuauuuacauauuuauguaagaaagugcacuccacaucuauuguggaccauggcguaaauuuaaugagccaaagacguacaggcuugaguuacgaacaaauuauaacaaaaagaauuugaguucuccuaaauaaugacauauuucuaagacauuccaacaaauucugguaggcaaauguauauaaaucccaaauugggcagcacauuuauguucucgguguuucacauguaaacagcauauaaaaauguauaugugcuuuuggaguugauaguaguuguguuugcagcucauugguugacuuuacacagagaguguuuccaauuaaucaugacuuuccagaagacuuaaaugauucucuugacaaugccacuagcacuguggcuguucugcugcccuucgccauggugggcuucuucagcugccuacccagucugccucguaguagcucaugguuuacuguaauaaguguauauggaauuugcucauucaaggucagcccaguauuguuuauuucuucauggguuuccuggaacaccucugauaaugaaucacucuauuuuucugucagucuccuuuaaaauuuuauccugacauuuugugucucagaaucuaaauuuuucuccccauuuugugagccagaucccuaucaguacacuucacaaaauccaccugcagagggagcuaaauaaaagaagaugagacccugaacccaagaagacucaaagcagagaauguuuauagcaagauguugucauccugcuaguacugaaaaaagaacuugauacucgaaaugguugcauugaagucaaccaucugggaucugacacaaggauaagacuugugugauuuuuguuuuuggauucucugucguauaaaaagcuauaaaaggaugaucuuauagacacguauauguuagagaaccaaucugacauuuuacucucuucucugaagaugguguuuaaggauagugaaaugaggucacuuugugcagaauuucacauggagugcugggcuaaggcuaaaguagugaaagcuuuggauaacauacaauauuuuaaagacagacuuuauaaguaagucucucgauuuguuugauuaaguauauguaucuugauugcagucagcagacuugaagagagagaagcagaacugaagaaggaauauaaugcacugcaucagagacacacugaggugggugucuguccuuccuagguuaguacuggagcacagggauggccugcauaauucuacauaagcaucauuuccagaaagugugucacguggcauuuaccaaaauugacauuuauucuuuuuaaaucuggaauuaaauuuuucuguagaaaauuuauaugccucagaauaauuuuaguuauuuaagacaguuacuuagucggcuaucaaaccuuuaugcauauaauaaaauguugacacgaugcugagaaaauugauuugcuaccaguuaggaaaaugcugcauugguaagauagugguauagaucuugacaucuauaauuuaguuguaaaggccuuauauuauuuauaguuuauauuauguuauguuuuauauuaaauuauaucaaauuuauaauacauuaaaauguguuuaaaugauuccaauuuucagcauuuuaguuuuuugagauuuauuuauuaacuuuuauuuuguuuuuuuuuuuguuuuuuuuuuuuuugacacuuguauuuuuuuuuaauuuuuaaugaccaaaacaaaaauauaccuaaaagcgaagcuucuggaaaaaccauuuguucuucccugucuuguaucgcuccucaaacuugaccuuggccucccgccuggccuugcgcuucaaagcugggucccugaacacauccuuguugacaacagucuuguccaaggggauauccacagaguaccuugugggcaugaggugguuguaguuauaaacuuucacaaaggacuugaucuuggaucgcuuggcgaucuucuucuugcccauggcagcugucacuuuccggggauagcggucaauuccagccaccagggcauggcuguaagggcgguccgaggugccaucgucaauguucuucacgaugacggcuuugcguccggaguagcguccggccaggaccagcaccacuuucccggguuucaugaacuugcccaucucgacagcaggcagccggcacccagcagaaaggaaaggagggcacuuccuauuuauuaacuuuuagauuuuuuauuuuuuguguaugaauguccuaucugcuuguaagugccgugacuacagaggccagaagagggcaucggcuccucuagaacugaauuacagaugguuguuagcuuccucaugaaugcuggcaacugaaccuagguccaggguuuuuaacugcugagccaagccuccagcccucuuuaguauuuuaaauuaguauuuguagcauauaaucccuuuguaacccuuguuuuuaagagucuguuagucuuuaacauacuguauuuguuucugucuugucaaugugucguuugucccuguguguuauggucagucugggauucacauaccuuagugaauuuuacaguccuccccucuucccucuccuucuuucuuuagcccuggcuugccuggaauacacuaugcaaaccaggcuggccuugagaauaauaugauuuuaccucugccuccaauucugggauuaaaggugugugccaccucccuuggccauuuucucucuucucauccugucuuauguuauaccuaauuuuagcuuuguuugguuuuuuuggauuggguuuuuaagacagguucucucuguguagcccuagcuguccuggaauuccucuguagaccaggcaggucuagaauucagagaucugccuuccucugccuccugggugccaagaucaaaggugugcacuaccacugccuggcuugauucuaguuuuuuugucuaccuauuuauuuaggugauggugacuugagucuggggccuugcucaugcucccacaguccuauuuguagacuucaguuccuguuuuucuuccauugcuguauaaccuauccugccuaugguagagaccaaaagugcugcuuuaagcaucauaaaaucauauuauacucaauuucauuugcuuugaauaguagagaaauccguucccauucuugggauuggguuuagcauuacuaccaagaacacaaauuuuucacagaauugauacaguaggaggaaaaguuugaucauaaagggucauaugguccuggaaagauggaaguagguuaaauaauagauauuacuagauauuaaggguauuuuuaaaaacuugguaguuaaaagccuauuguugaugcuuuuuauaccacugauuuccauaucagaguaagguucuguauguauguaguauuuacuugcauugcuuauuuauuaaugaugauaauuacaaaauuuauuuggagaaguauguuuaaauguaauaaguaauuaauaguaaugaaugauuuuaaaauaaaguuauaacuuauauuaauuagagauuuuuaaauugugauauaguauuaaaguauauuuaaauuauauucuuuuaaaauauauacauucuuuuuuccuuuguauuuuuuauuuuauuucuuaugcuccauguuuuauuucccccauaaauauauacauucuuuaaagaacaaauauaaaugaaaugagauuuuauuuuccuaauaucuauuuaauaaaaaugaagauauaugucuauagaaauuuaaaaaccugccaucuguuuccuguaagaagguauuauaaguuuucuguuaucaugccuucagagcuguaagcuauuggaaaagaaaauggucuuaagaaagcuuaauuaccaagccagagaccucagccugaacagucaucgggcaacuuuucgucugcugacugucagcucuuucauaggauccucuccugcaguuagaagaggcuucugucuuuugcccugauagacucuauuugcuucaaaguaggcuuauguaacacagauaaagcugcuuuaaaaugugagucuggucacuauaaccuaaaaauuucuauuuaucuauuuggucuagaaacuccauucaauuagcaagaauaaauagcuuuguaaucccuuagaguaccuuuuagagguaaauuccagagaaagggacuuuguagccuauuuauuguuacuuucaaggaggguagcauuuuuuuuuuuuuuuuuguaguucucuauuuuaaugucaaguuaaaaaaaaaucugauaaccauucaaacaaguaccuccacuaguggaaggauguauggcugcauggcccggagccuagggcaggcaaccggcacccugcaggcucagcagaccuaggcuggugucuagacuaccucacuagcccuggggcagacaggauuugcccugagcuucccagagcaaaaugcagaccagccugguggucauaggaaggagggaagguagcauuuuuuuacagacacagaauuauuuaaauauuacuuugacaaaacacauuguuuacugcuaacaguggaaaauuauucuacuuuuugaaaaugugaaugaccauucuuuaaucaaauaauaaauuuguguguauuauugauuuuacuuaaagguauaucuaucuugcuauaugugguauauucuuauaagcuauguuaucagcauauagagauugaggagccagccuggaguaguuaguucuaagucagucuagauauucaacaagacccuuuaucauaaaacuaacuagcuagcuagcuaacuaacuaacuaacuaacguguuucuuuuggcucgcuguugagguuguagucuaucacggcaggaagggcaugguggccggcucaugaagcagcuggucauuuguacgcggucaggaagcacaagcacgcauaggcucaggaagcuuucgcauuuaugcagugugagacccacacccauggaauggugcaccugcauugaggguaguuauuccaucucaguucaucugcauaguccuucacagagaugccaguggcuugcuuacacaggacuacacgugugaacucugugcagggcugggcgaguuucauauugagacgguuuaagcacauucuuaguguuuucuuaggccaacuuaucauuucucccuauuguacacuuugaaauuuuuagaacgauauucuagggugauguacccaaaauccuaugccaguuuaguaacuucuuguuaaaucuggucuuucugauucuaugauuuuaggguuuuuuucuaugccguguguguauguaccugugauaugugguguguguaugggcauuuuugucugcauguauuucuguauaccauuuguauaucuaguguccauggaggcuagaaaauggugucagauccccuggaacugagagugccuugugagugcugggaauuaaaccaggucuucuggaagagccuccagcacucuuaacuacugaguuaucuuugccauuguuugaaacaggaugucauauaguucaggcuggacucaaacuugcuuuguaggugaggauggaccuuuaaacuacucauucuuaccaccaaugccaagugcugaaugcucuagauguuuuucugagauguuuuucucaugaaaucucacugguuuuaagacaauaguuuugagaacuguauguagaaagauucaaggugacuacagagucugugcuccaguccaguuguuuugcuuuuugguuuugucagugcggaguuggucuuugcugugaagacaacucaaccaagggcagucugugccuguccuaaacaacaguuuuucagacaauacaguugaauccuugaugaguccagcucuuacagaauuuacuucuagcuacgugaauuaauuugcuuacuggggaauuaguagcuuaucugagauggaggaggacuaaaacuaguagacuugguagaaccucguauaaaauaggcccuggucuacucucacaucuuuucucuaucugaauguuggucuuuccccucccuccaucacuccccccauuuuuaaaaucauaaggauaaugugaauuauuuaaaaauuuuuacgugcaauguauuuuuuauucuguuugugauauauagcuuguuauuuuaaauauaucaggaaaugccuuagggugugggauuuucuugugggugugaggaagaaaggacaaugaguucauugcuugccuggagaguuaacuaaaaggccagaugcauccugccuggguccuacagcauuuaacuacucaaguagcugcugcaucaaucagauuugagucccagcuuuaaagcuaaugauggaaaacauuuuauuguuagcuauuuuacucaggcaaguuauuuucuccuguaccuggggauuaucuguaaaauugugauauagugaggguuaaauaaagaauauuucuguuaaagugguuggcauucaguaugauagcugcuguuuuuccuguuccucaguccuaguaagggcuacuguaguguggucuguguuuucauauuagacuauuuuggaaugccaggauauuaucucuguaaucaguccuuugaaggucucaaauauaguuuuuuucugaauuuuaaauaagcauuuaaaauaauagagaaucuauuuggauguaaaauugguucuaucuauacauuuugcuuauuaaugaauuacuuauaaaggcaaucugaaggagguuuccuuuuuaacacucuuccauuugaacaaaucaccucuauuugauuacucuauggaugugagaacucagcuaaugcuuucuaaggccuuucugacaucuguauuugcauauguuagguccagcauucguuuugcuguauuagucucaguuuauuauuuucuugauacaagaagaaagcagcucauuauuccugauuugcugacacaaccaaaaucuuuuuaaugcaaaauucuuaaauuaguauggaagagaaaauagacauuuaaauaaaacuuguaaauauccuugugauucuguauucauuucucuuuacuguuaacaguucucauuuugacuuuugacuagccuuuuuuuuuuuuuuuuuuuuuuuuuuuuuuuuuuuuugguuuucuuuguguagcccuggcuguccuggaacucacuuuguagaccaggcuggccuugaacucaggaauccuccugccacugccucccgagugcugggauuaaaggugugugccaccaugcccugcuuauuuuuuuuuuuuaaguuuuauuuuuauuugugugguguguguguguggaggccaggugugaguucccauggacgucaccuagauuugaacuaauguuuuuuaaagauuauuuuuaacaacccccuucucuuucuguguguguguguguuauaugucaaggucagaguacaacuuguaacuuuuccuuuaccacgcacaagagcccuaaagaugaagcucccaucauagucagcuuuuccagcauaugauccuuaucuaggacucagaaucaaagacauuucuaauuuuuauuuucucauuuuaauuuuuauuucuauuaauuuguuauuauuauagcugauuauauuaaauauugauuuuaguaaauuagcacaggagaaaguaguuugaaauucuuucaacuauaaaucuacagaaaaaaauuagaaauacuaucuuucaauugaaauuuauuuuuauucugguaauuacuauuaguauggaaagaugaauauacagaauuuuucucaaguuuagcauuaauuuuguuguuuuccacuuaaguucacagguuucucaaaugcuauuauuguuaaucagcagucucuuagaaccuccuaccaaagucuauauacuaauuuguauuuauaccaauauuuuucauuuaauaauaucacauauuuuacaaaauugcuaugcaauacaaaggaagauagauauuagcuacauuuacugaugugucuuaacugugagcauuugcuauuucuuugcuaccacaagucuuucauccuuaggauuuauuucuuuacaugaaauaauaaucuuguaagaaaguugugucaaaauguuuccauuguuauaauucuuuguuuuauuuuaggugauagucuuaaauuuucuauuuuuucuuccuuaaaauagaugauccauaauuauauggaacacuuagaaagaaccaaacuucaucagcucucagggagugaucaacuagaggcuacagcucauaguagaauuagguaagcuuuguuauauacacuuuugccuaagaaaauguggaaucaauaauccgucuuuuuguuucuauuuuuccuguuuuuccaucugagaacaauauuuagucugcuuccccaaaaucuguacaggaaaggaaaagaauaguuugcaaaaauagaaauaccauuuaaaaaguuaaauuaugagcuuuauaaauuauaagcaacauagugcaggguuuuaauuauuuucuugauacuugaugggcauucagaguagguuugaaauuuuccaguuuguggguaugcugaaauguuucauuucucccauauaauugguccuuuuuguugcacagaggcauguuuaaaaggguuagccagccaucuguuugauguaggagugugaauaaauuauguagaucgcuagguauuguagccaaugggcuaagccaagacucuuaguggcgaggaacguaguuaauaggcuggcucucuucuggguugcugcauaaaugcuaggagcugcagcucuaugguuaugagguggggggagcggaaugacgucaucgcuugggagccgcugcaggauggaguggaaagcugcugcugcuggcauuguuuuuguggcagcagcugaaugacagauccucacuacaaagauacccuuuuggccccuguguaggccuccugguucggacauuucaccaugccagcacagcgccaugaauccuggaugcaugcugcuguuuguguuuggcuuuguuggcggggcgguggucauuaauucugcgaucuuaguaucucucucuguuuugcugcuugugcacuuuucuauuucuaccggggugccagcgcugacgcagaaccuaccaaggauacucagguacucuguccacucucucggaagcuccugcuucacugggguuuuuuuguuuguuuguuuguuuguuuuuuauaauucuuaggaccaugagucugcuuuguaaccauuucugcugcagauucaaacaauggaaaacggccucgagcuaggaugucuauuaauuuguagguuccuaaauggaacuauguuuuguguuuggaaaucacagaccaaaaaaaaaaaaggauucucuguuguacaaauauaaggucagcguggucacaaugcugaagaguaaggaagcacaagagcccaguaccaggucgaagucuguauagagcucuggauuuagcuuccgaguaucgagggacaaauggcuuuuaugcuuuguauugcaaaugguuggccacagaauguagguuuauuuauuuauuuauuuuucuuugaguuauccuuugccuaauguaagguuugaugucaguuuuauaguuugaguaacagcuauggaaacugauauuuuccugcuacuauaaaauauauuuuaaacuaaaaaaaaaaaaaaaaaucgaaaaucuuaagacaagacuagaaugccuuccccuccguuauuugcacaucaaaguugugaaagcuucacaaagccuauucacuauuguuuggucagacggugcccuuucuuuucuuuguacuccugggugacaaaugcccauuccugcuuguggggguggucaccaggcugcaugcuuagcugcuguucucugcgugcagccagugugaaccacuuuccaaugccuagggauuugcugucuugucuucuaacucauaaacucaaagaaucugaucugcucagauuucucuuuuguacaugacuugaaauuaagauucauagacuauaacuaauuaguaucuaagugaugauaaaauauguuuuaaugguaauucugauuuaggcaagaagaauggaaguagcuccuuucuuucaugugauucuuuuuauucauaggccagcucauguuuaauuuuuaacacucagaaauuaguuuucucguauagucuaaaacuagguacuugaucauuuauuuucuuuccuaauuauauuuguuuuuucaaacaagucauguagccuaagcuaaccuugaaccccacaggaagucuccuucucagugcuggaauuacauacaguucucugcuggguucuuuccugauguauaaaauugagaaacagucugacuauuuuguauauguuaguaccugaaagaguuguauacaaaucuauguauauuuaggauauaaggaaacuaaaacuuguaggcuuaaaaauauguauaauauuaauaugacuaauauuaagggcuggcuuaggcuaugcuggagaaguauugccauacaguaacuaagacuuuggaguuaccuugucccauauaugcagccuuuggugauuuguuuaaucucuuagguuccuucucuuaagguauuuuaccucagugacugauuuuaaaaaaucaagcgagcuauuuuuugcacuucauuacaguugcaaaauauaugauccauuauauaaguaagucauuuguguaccucacauuuuuaguagaagugacuuuuaaucuuaguccugcugguuacuaauauauaaagccuuagaacaucaucuucccuauuguaaaaucuggaaaagcaguccuguuuccugguugguuagaccagauaaagcacaucaguuuaucuggcucaguucuuucagguauagccaaaaggcuaucugaaauacauauuuucaaaaaucauuaguacacauaagcugguauuuaaauaaccaacuaaaaaucaauauauacaacugaagcuacuagcuagagacuauaacaagauucagacacuugucagccuugcuucuguuagggagucaguggcuggacagcgagagcaggugcuucaguguagggacugaaaucugccacuugguauuuuucuacagguucuccuuuuuuuuuuuuuuuuuuuugguuaacuuuucugugauuuuuauugaagcauauaauacaaacagcaucaaacaugcaugacaacaaagcucaagacuaguguuugccuuucacgaacuuuguuuugagaguagaauauugucagacuuauguaacugcaucucuugcccccaucagcuaucuaauuggucaguccgcagaggaagaagcacauggugaugcuaauuuucuagaucuggagcagagaaacuccaagcauauuugacccccuccuagagaucuguuuuucucaaaaaagugauaaaagcaaaauagagaguugggcguauagauggaauaggaaaggaagcuuggguuuaaagaagacugcgcacuccauauguguggaaaggaguuuaugugggaagauggugccagugaugggcuuguaucucaggaaaucugcgcuaucuuccuagcuuuauauuagauagacucugauuaaauuccuacuugcuucucccuuaaggcaugaaggcuuguuagauaaaagucagauaguaguuugggaauuucuguucccaaaguaaguuuuucaaaauugggaauagacagcaggcuagcaacuuuucauucuguuaacuaaaggaaaccaaaacacuuggcuaucauuuaaugagaaaaaaagaggauugcaguuuaagaacaaagaagcagaaaugauguaguuuaaaguaaaagcuaauaagucucaagaagaaacaaguucuauugccuggaaauagaaacguguaaugugcaguauacucucuauuaggaaaaauaaaacucuuugucacugacuugugaaauagcugacuaguguuuacuuguuucagauuuagauuuauuuacuacuuauuggaguaugaauguggaggucagaagacagccuguaggagcugguucucuccuucugccaugaggguccuagagacugaacgcaggugucaggcuuggugccaauugccuuuauccacugagucaucccuccaccuucuuuguaauguuuuggagacaggcucuaauguaaacaggcugggcucuauugugcuuuguguacaaggaugaccuugaacuccuccuccugucuaucuccuacgugcuaggacuccaucacucccaguaaagaaagacuuggaaaagagcugcucuuuuuuccuaacagaaguuuucucaucugcacucugccuaaaagaacuacuguaauaugauuuguagaaaaccagaacuuaaauaaaaauguuuuggauuuuuacuguugaauaguaucccuguuucaaagaguauauucauuuuccucuaggcagaaaaggccuacuguaaaaacacuguagcuugaggaaguggaaaacuaggaacagggacuggggaggccuuugccuguuccuuaugaccacuaaccuccauggcuaacacucagcagcucuucuccauguuuaccacaccagaccaccaucaaguucuuggcagaggcagcugugguaaugcaugccuguacucucaacauacagcgggcuaaggcagaggaucuccaguucagggucaggcuaggcuaaguucugagaccucaccuaugaacagcuccaaacuuggcaggugaaaacagugucuaaacaguuuuuccacacuuuucuuaacuuguggagccaauguaaagcuuugaggcuguuuuuucucuuugguauauacuuauuuaggugugcguauaggauuauguaggagagcugauugcagauugagaauaagcuuucuacagccaggggagacccugaccuuguuauccccuugccucaucuuccaaagagcugggauuuuucuauccacagcccaggcuuaaaaucacgacaaauaaaaaacuaaugagaauguuucauuuuuuucuccccucuucaaauagaaaagaacguccuauaucauuagggauuuucccucuaccugcuggagauggauugcuuacaccugacacucagaaaggaggcgagaccccaggaucagagcaauggaaauuucaagaauuaagucaaccacguucucauaccagccugaagguaagcuuuauuuuaacaguacauuuuauaagcauucuuauucaaauagaagucccagaaaaccaaaggauaaucuaauaguuuagggcugcccagauaguuuacugggugaaagugcuuaucaccaacucugacaguccccauccucaggaccuacaugauagaagagagaaccaacucccgauuauccucugaccucuacagaaccacagugacuguaguucacaccuuguucaaccgcacacaaauaaguaaauaaaucuaaauuuaaaaaauaguuuauauauuuuuuaguuugaaaguaucuuaaaaacaaaucgagaugggcuuuucccaggguauguucuugcuaguuaauuugaaauuacauaggaaaacaaagccaaauaguguuacaucuuuacuuuaguuagaguuaucggugcugcggugaagcaccagcugggaaggaaagguuuauuugccuuaugcaucacuguucauaaucgaaggaagucagcgcaggaaccuggagguaggagcugaugcagaggccaugguggggugcugcuuacaggcuugcuucauauggcuuguucaaccugcuuucuuauagaacccaggaccaccagcccagggguagcaccacccucaagggccugggcccucccccauccaucacuaauuaagaaaaugcccuacaggauugccuacagcccaaucuuaauggaagcauuuucucaauuuagucuaccuccuuucugaugacucuaacuuugucaaguugauauaaaacuagccaauauaaucuugcuuaguagucuaaugacaaggauuucuuuuauauuuaguguaccugauaugaaucuagaauuuagggucuagugaugugaggaacuaauugggauuuuguuuuguuuguguuugguuuuuuauuuuuguuuuuaugguuacuggggaucaacuuagggucuugugacuacuuuuggaacccuauauucagaaauucuaacuauuuauuuuuagugugacuguugcugguggagcacacuuguggaagucaggaaacaacuuuugggaguuguucuuccacuguagguucuaggacuagaauuuagguagucaggcuuguguugaaaggacuucugccuauugagccaucuugccaguccucagcucugggccaugagugugacaagcaagcacucuguuacugagacauauuccuuuuaaguuugaaauaguguguaccugcuuguugccuauauauguaccaccugggugcagugccugaggaggcuagaagagggcacugaauucccuguagggcuucacuucauuauauuucuuauuaauuugacucaaggucucacuaugaagcccagauuggccuugaacucaagguaguucuccugccucagccuuccaaguguuaggauugcagguauacucagcaugcucaauuauaauuccacuugaaagacacagugcauuuuuccuuccuuaaaacuacuuuaugaaagagauauauaaaauguauucuguuuagcccaaaagaccugauguuaauucucuaaagaauauauuuugaucuagaaaaauuuaguaaauaauugauacauguaauuauaagguauucuaagaagagauacauuaauaauccuuaaaaauguuuuaaaguuagucaugguuucaugcaacuguuauuucuauuaagaaagcugaaucaggagguuugcaaucaguauagcauaggcuccauauugaguaucauaacaaccaaugguacagaguaagauccuaucucaacacaagagagacaaggggagaggaagagagcugucaccugaacucaaccugggcaacauagaccuuaccugaagaaacaaacacaaauguaaaguuauguucuauauaguauaaaauagaauauuuaauaagggacuauugauuauuaaaaugaaagccagccagucacagggaguacacucuuaauccaaucccagcauucuguaauagaagagacaggcagaucucuuugaguccgagauaagccuggucuacauaguaaguuucaggacagaaagagccauauacugagacccugucuccagaaaaaaaaaaaaaaaaaagcccuaguauauuguaaaaucuacuguaucauuauauaaauaaauucuuucuccucuuucuuggugaaacauggucucagauaucccaggcuaacuuccaauuuacuauguaguaaaggaugaccuugaacuucucaugugagucuaccuccugagugcuaggguuaaguaggcaugugugaauacaccugguaaugugguucugggaauugacaaagcccuuacuaauccuagguuagcacucugccaacugagcuauagucuuaacuccuuauaucuuuucuugccuauaauaugugucacuaucuaaauaccuguuauaggaacucaguacuuguguuguuguuguuguuguugagagaguucacacuaugugucccaguuuggaguaacacuuguaauccuccugccucaaccuccuaggugcuaggauuaugaacauguagcagcauacucggcuagaacauuuguucuaaguccaccugucccacuuccuguauaguuucucagaagcuacuugugcucaaauaugucaguggggauggcacugugacguguuuguucuuuauucuguguccacacugacuuuuuuuaaauguacuuguagcuuuaauagaucuuccaaaauaccucuuaguggcucacuuccuguguucucuuuucuaaaacaaacuuagguaggaaggauacuuauaacguaucaaaaauguauaccauauggcagccaugcuuuaauuacuauccagacugaacaguaaggaaagauuaucauaguucuuuuauuuaauccaguaauaagcuaugacaaaacuuuacuggcaaguuauaaacuaauuaagaaaugauuaauaaugauggguuuugucuacucuggaaauucaaagauaacauuacuccccaaagaguuuauaaagcaaaauccagucuguuucuugauguguggaaagucucagcagguacaguuuuaaggaacaccuaaguccuugcaaucaaccaggugccucucuaacuuggucaagaguugggagucagggcuugauuucccacaaggaccauguccugggcaugucacauagccucucaucuuggguuuucaucugggacaggaauugaaauaggcuggagugugugucugugugcuugugugcugugugcaugugugcacguguuuauacacuggauguuacugguacacaccacucacuguucccaacuuuuacaugguugcuacaacucucauuuuuccugagaacuuugauaaagaccuagcuauguuuaggacaugguuugacuucauuaugaaaagaaauaucaaaggucacgauuauaggugacuuuaauuuuccuagcacaacuuuuuuugaaguaagauuaauaugagaauauuccaugagaaaaauugcaugaugaguuuuaaacaguguaacaggaggaaauagaaagcuuugaugcaagaaugcuacaaaggagauuugcugaugaugguaaaguuaugaaucgucuuuuuugauuuguugaaaauuuccuggugugcgaucuguuagugauguuacaagaauugcaaggguuucugagagugguguaccuaacaacuguucaagccuuuucuuuacauauugccuaauacaaguagauaagcaauagaauuucaaguauuauuaugcgcuauuaagaaugcaaaauaaaacugggguaugguggugcuugccuuugauccuagcacucaggaggcagaggcaugugggucucugugaguucaaggccaggcugauuguagaggguuugccuuuaaaaaaaaaaaaaaaagcacccaauauuguggugcaugucuuuugaucccaggacucaggaggcagaagcagguggaucaaugugaauaugaggcuaccugguuuacauggaauuugaggacuaccacagagaagucugucugaaaaaaaacaaacaaaagcaaagugagggucaggaagauagacuaucagguaaaggcaccuuccaccaagcaugacagugggagaaaccugagacccauguugugcaggagagaauagacuccuccugcaaguugucuuccgacugcuacaugccugcauuugccagacaugcacacacauacagaaauuuaauaggaaaaaaaaaagcaaaguaagaaacuuuugagcaugauccauacaagauauauacacacauaaagauguuacugugaaaucuucaauauuauuaauaugugauaaucaugauaaauaauagacagaaagcaagguaagccagagaauaauuuguagggaaagaugcuauuuugggauaacugugagaauggcaaguggaaauauuuuacaggaauaguuuugugaugaagacacaguagcaacaccuaggcucuguacugggccacacuuggggauaaaugaggagcaguuucucuucagccuguaccucucaucccuuccuaagagcagugacauaccuuugguugagcuggcccgaacauccuucuuugcaaaccgguugggaaggucugaguccucaccuugccuuuuuucaucauuucccaagcugagugcaggcaggauggccucaccucccgcuugcucuuucuucucuggugguuuuacuucuuaguccucuaaauccugauugccaauacuuaagcuccugcacuucuccuagucuaguugguucaaguuccaugucugcacauguugucugaacauugcuguucacaaguuuaucuccagccaugacuccuuucuuaaacucuagguuucugcgaccaguugcauuucuuccagauuucccuguauuggaguuuugcccugcuuuaguuacacacacaagcacagccuuucuagacccaucccaggcacuacaguuauaugaaaccguacucuugacucuucccuuauccccugccccuuuucuuucuuaucuucagccugggucuugcccaggcuagucuugaguucagcccuucugcuucaguaucccuccacaccacaaaucaaaauuuagacaccaguucaagaagggaaauuaaaauuuauauuuuucauuaacugaaaucucuuacuguagaaguucaaaugaauugcuaaaaauaaaccaaauggguaaagcugaccuaccuuccuucccuucccuucccucccuccuuccuuccuuccuuccuuccuuccuuaaaugugccauagaagugccaaguaugagaaugaaugagaaaguucaagugagaacccuccuaccccgaauaguucuggggcuugaaccaggcucucguuuauguuaagcaaauucuuuaccacugaccuauaucucaaaccaauaaguaagcaagugaaugaaugaaugaaugaaugagccggguaugguggcacaugccuuuaaucccagcacuugggaggcagagacaggcgaauuucugcguucaaggccagccuggucuacagagugaguuccaggacagccagggauacacagagaaacccugucuuuggggaaaaaaaaaaaaucaaacccaaggucagccuuuucagcuaacugaaugauauuaagaccaaguaaaggaggaauguguauacaaaaggcagucccuagaugguaaccauagucucagcacuauaguggagcacuguucucucuugccuuccuuucucugcacaggucagucacuagugacggcagagcaggccgacuuagacuucugaguggugauagucugguacaguguuggagcugcagcagcauaagggcugccugacuugcaugucaauuccuaaaacaauaacaaaugcuuacccaaguagagauagcagacgugggggucugagccagugaggagaacaugaagggccaauuuggaaauguauagguguagauucaaggaauuugaguuguagagcuaauaauaggaguacaugugacuuaaaaaggugaguagcuuguucaagaaagguagugugguggcagaaguagauaaaaggauggagguggguuuggcagggaggaggaaaagcaaaccccaaagacuaguucuauugcaugcuuagaaaacuaaaguagaauugacaggcaaaagagaaaaauggauacacuggaguccuagcaaaugggcaggggaagggaauuacauucucaacugcaauuccaaucuuccuugaaugggacaccuuaguuuuccuagguuuugcuguuauaagcaaugcuguagugaguaaucagccgaggucuaaaaaugagcauuuagaacugagaaaaacaauuuuaaguaauugaaaggacaggguuguacuuacuuaguaauuuuuugaagaguccuuuauaaaacuauaaugugaauacuauagaaacacugcaagaagcucacauuggcagguucugguauguaaaggcaguggugagugugcgcuguauucuccaggggaugugcuuagcauacagagcaggaaacuagacagagccagcauucuugcugagaguucuccguccucuucugugugugguaaaguucaggaauuguuccuguuuccuuggucuuuauaaguagucaaucucaauaguugagucucugcaucauauuuuugcugucuguuccuccuaggaaauaaaauauuaaguuuuaaaauaacgaaguguuuugaaacuuuugaacuaauuuuauucuauagcagaaauuaaaaaugaaaaugggauuuuaacagaaaguggauuguauauugugacuccguuauucuucgugcuugugacagaacauaugaaauuuguccuguuugcagauuuugucguacauuucccccacacacauagccucauuugauagagucagaaaaaagaaaaaccauagucuggguuagugugaaaucauaaaaggguaggcuuggucuugucacucauuguaaacuuuuggggaaaagaagauagaacuauuucuuuguggaaauuuauuuccuuuuguuuuggagacaggucuuacucuaguccaggcuggucuagaacucacucuguauccaagacugaccuugaacuuaaagcaguccucccaccuaccaacaugagaccccaggccuggcuuuguugcacauucauuguguuguacguugcuaagaugcuuacauauggugagaauuaaaauuaauaaaaacccaaauaacaaauaccauuugaaaauggugguguuuaaagcauaucuauauagauaucuucuuuuuuaaguuauguacacauagguguuuauuaaaucucucugauacuuaaauauucaaauaagcuuucagaauaaggaaaaaguaaggaccuugccuuagccuccuguguagauagaaugacaagcugugccaucaagccaagacagaccuuacgcuuuuacuggugcauauugauagcucucuguguguguguauguguguguguguguguguguguguguguguguguguguguguguuucuuuacgauaaauaagcuugagcugggcagugguggcgcacgccuuuaggccuuuaaucccagcacuugagaggcagaggcaggcgaauuucuguguucgaggccagccuggucuacagagagaguuccaggauauccagggauacccugucucgaaaaacaaacaaacaaacaaaaagauaaauaggccugugcucuagaugauuucuuugcagccugcuuuguuucauuuaacacuauuuuaauuuaauuuaauauauaugaaugcuuugucuacucauauguaugucuacuaucagugugccuggugccugcagaggucagaagaggaugauacuggaucccacaaaacuggaguauagacuguuugugucaccauguggaugcugggaaccaaauccugguccucuggaagagcagccaggcagccaggucucuuaauaacugaaccaucucuucagcccuuaaacguauuuguugauaguguuugucguuuaguuauuuuuaaaugggaguuucacugugcugcucuagccagucuuuaguuaacuauguagauucgguuggucuugaacucagauagauuugcuagauucugcuuccugagagauggcauuaaaggugugugccaccaugcccagccacauuuauacuuauguagagagaacacuuccccccuccuuuuuaaaaaugaguguagagauaacuauuaaacaagugcaagcaguggguucacugcccacaucaaugguuuauguucccgaaugaaagacacacagacacacacacacacacagacacacacacacacagccuuuauauaguaauaugccuuaagcagcucaauagcuggccacugccuaaccuccauacaguuagucucaaauuauuacuuacuaauucuguguucuaucuugacuucucuagacccaguugggcagcuagcucucugggccacacucucccggcucuuucacaugguggcuuuaucucuguguccugcacucuucucaggcauaguggaucucuuccuccuccuccuccucuucaggucccaagccugggaauccuaaaaucccacuucugucuguccucccuaacuguuggcuguugacgucuuuauuuaccaaucaaaacccaccagggcagauuaccauaagcuacguacaguucuucucauguaaacaguuuuuuggggaacauaauuagcauuuguaauacaauaggcucuaauuggauagaugagauauguaugguuuuguaugugugagugagaguguacuacagcaugaggguugaggguguuuguccuugacuucuauccugcuugagacagucucuguuuaucuuuauuguucacugcuagucuucaaguuucccaguacccuccccuucugcuuuacaagcacugggacuacagacaugugcugccccaucuggcuuuauauggguucuaggaugcaaaccuagacccucacaugugcauggugagcacucaccuuauccagugacuguauucccaucccucgguugcucuuuuuucccuugaggaguaugcuucacauuucccuucucccucugggguugaacaccccgauuggcucgacagcuauugagaauagugcugcagugcugcaauaggcacugauguucagaugucucuguggugucucaucucggaagucuuuguguauauacccaugaaugguagaguugguuuauaugguagauggauuuuaguuuuuuagaaaucuccuguuuuuuacaguggcugggcuaguaggauaccagggguuucuuuuguucacauucucaccagcaugugauacuuguuuucuugaugauugccauggaaacaggagcaagaugaaaucucaaugaauuuuuguuguuguccuauuuuuuaauuacauuaacuuuucuuuuauuugagacagugccccuggcuguccuggaacuuauuggguagaccaggauggcuucagaacucaaacuugcuugcuucugccucuuacuggggauaaaggucugcaccaccugcauggccucaaugaguuuugcuuugcauuucucuaauacuuaguacuguuuguuuauuuucuacacagcuuaauuauucuuuaaagauuuacuuauuauguauaaauuacuguguucugccugcauguaugcuuacacgucaaaagaggacaccagaucuuguuauagaugguuaugagacaccaugugguugcugggaacugaacccaggaccucuagaagaacagccagugcucuugaccucugagccaucucuccaguccaaaacuuaauauuuuuaauaaaauuuugccaacuuuuauauuuucgggagagaagaauaauaugcacgcacacacauauacauaauuuuuuuuguaucauucaguuucguguauaaaaaaauuaaauguaggaauguaggggcuaacaauuauagauaauuaauaaaaacacuguaaauaagaaaucuuccccuaccagaucuuucuuuuucuuucuuuuuuuuuuuuuuuuuuuuuuuaagauuuuuuuauuuauuauuauauguaaguacacuguagcugucuucagacacaccagaagagggagucagaucuuguuacggaugguugugagccaccaugugguugcugggauuugaacucuggaccuuuggaagagcagucgggugcucuuacccacugagccaucucaccagccccuuuuucuuucuuuuucuugaacucuugauccucugccuccaccuuccaaauguuaggauuauagacaaauaucccauaccuagcuaagaauuaaagcagguggcagggggauuuugauaaauuuccauaccaagacuauuuaaaguucaagauugcuuuaaguugaagagagucuguuugcucuuuuguuucugguuugagaaagaaaauuauagauagaauaaauaggaaaaaaaagccacccuuuuauccuugguguuaaugaacaguuucaauaaugcugagggaauggcuggcacacauugucaagugugccacauuggaauauuuguauguuaaauguucacgugaccaguacagauguuggggagauugcuguuauagaaauaguaaaggaccugucauaagcauuucaucaaaaaauauauauauauauauauaaggucacaggcaagugagauggcucagcagguuagaguguuacugugcaggccugauaacccucaguucaguccccagaacccacguaaacuaucucagucacagcaguccuacguuaggaggagaggugaagaggagaguuguuuggaagcuugggguccagcuaaccuggaguaugcagcauagugccaccgaaacccggccuuaacacagcgacaccaggagccauuguaaaagcugucuucugacaaacacagagaaaauaggagguacgguccuguuccauguaauugccuggagaauagcaucacuucauuauagcauugaacugaauguuaacaguagugggcuguuuaguuuaguuuuguuuguuuugguuuuuugagacaggguuucucuguguggcccuggauguccuggaacucacucuguagaccagguuucccuugaacuuacagagaucugucugcuucugucucccaagugcugggauuaaauguguacaccaccacugcuuggcuauaauuuuuguuuuuugagauaaagucuuaaugucuuuuauauuuaaaaagugugucuguguguaagugugcacgugggagucagaggcaacuuucgggagcugguucuauccuucuaacgcgugaauucugaggaucgaacucagauugucagacuuggcagcacgcaccuuuucuugguaaaccauuccaccuuaggacucacugugcuccaaugcuggaccagaaaucaccaugaaggccaaucaccaauuagccuucagucuuccugccuuagcuuucuagagcugagaucacaggcaagagucacuguacgugacuuucaaaacucucauuuuaaacccaggagguaauagauggaguuauagccuaagaaguagcauaugaaccaaaaauauagauuuguuaacaccgaguaaauacauauuuuuucuucuuuuauaaucuuucccucuacccaggucagccauagcccugaaccucugaaggcuguagagcaggaggugagaauggugauucagaacauuuugccaaaaguaaagagaagagauuaacuauugguuacuuucucaaacugcuauucuccagauaucacaugcucuguuuggaagauuauugauacuauucucugaaauacagaagaaacuaauuuacagugguugccagggcuuuacuaugacuauaauuugcuccuccuucagaguaagcauuugaaacuuaaaauguaagugcauccugugaaaagucugucugcuuccauuuauccaacucuggguaggaaauuuugcacacauucuuugccuagggcagaguauauguagucauauagccuugcuuggggauaccagggugucauuuuucagaaaaaaaucuuuuuuuuuuccauuuuuuauuagguauuuagcucauuuacauuuccaaugcuauaccaaaggucccccauacccacccacccccacuccccuacccacccacucccccuuuuuggcccuggcguuccccuguacuggggcauauaaaguuugcguguccaaugggccucucuuuccagugauggccgacuaggccaacuuuugauacauaugcagcuagagucaagagcuccgggguacuggguaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuugucuuuguaacuccuuccauggguguuuuguucccaauucuaaggaggggcauagucccaauucuaaggaggggcauagucagaaaaauucuugagguuagacccuuccuaucuuuccuuuaaucaccuaaauuuauaccagauauauuuuaccuaccugugucuaaaguuuucauguuccuuugagucacagauucuugugggagucuuguuacaaaaaaaccucuuucuuaaaagaaaaacugcauguacucucagaaccuugucacugugugcuguagugaaccaaaagagucuauaccagucgcuuucaaggcugaguuuuauuuggggagaaaguaacauuagcauaaaauuacaagguaauauguguuauagcugggggcuuuguauaugggacugguuucauguuugccuucaucugauuuaaaguuuuaaaucuaaaaggcggauagauugguggauauuuguaauucuaguucugggagguguaggcagacagauccuugccuagggcucguuggccagcuagaccagcuuauuugauguagaucagaccaaugagcuacucugucuuuaaggaaacaaaaacaaacggugaaugaugcagccacugagcuugcucucugcacacauacacaaaugcaugcaucuauacuuuuacagagaauaaaaggcagacaaaagcuauguuuuccccuugguuaguuucucuuguagaaauuauuucaucccaaccugggauucuaccccaccuuaaccauuuaguucuggauaaaaaccacacacaaccuuuauauuuacaguaagccuuaaacagcacaagaacuaggcaaauaccuacccccuaugcuauuaaaaucuaguucccuacagauaacccugaauuauuacuuaccauguuucaucugggcugcucuuaacuccaauuggccagcccucagggccacauuuucaugacucaccuaaccaauggcagcuucuccuuccucuucaccaccaccuucuccugguccuuugaucucaaaccugggaagccuaaaucccacccauaucucuucugcccagcuauuggcuguugacaucguuauuuaccaaucaauaacuuggagguagggucacuugagucuacuugcagacuccaggucuuuuggggggggggcuacacuuggcauuacaauagacagcaagaccaaacuucaacacucucucucucucucucucucucucucuucuucuucuucuucuucuucuucuucuucuucuucuucuucuucuucuucuucuucuucuucuucuuucuucuuucuucuuucuucuuucuucuuucuucuuccuucuuucuuccucuuccuccuccuccuucuccucuccucccccuuccucauuuguuugaucuuguuuuuugagacagcgucucuagguaacccuaccuguccaggaacuugcuauguagaccaggcuguacuaccacugcugggauuaaagguggggacuacuaugccugaccucagguaguuucuuucaaaugaaguuaggcaaaucacuuguggggauacuacauuggagcauguagcaauuauaaauugucuuuaaugggauuauuuauucucuauaguuguuaaccagaguuuguagacuauuuagauaguucugauauaguggcagauuacaguauauacauguucuauacagcaccagguaugugacacauuuaugaaugaaacugaagauguucugaaaggcuucuaggguuuuuuuuuuguuuuuguuuuuguuuuuguuuuguuuugcccccuuugguuuuuuugagacagggcuuuucuauguagccugggcuauccuggaaagcuccguagaccaggcuagucuugaaauuagagauauaccugccuuugcuucccaagcacugagcacugggaguaaauguguguaccacuacacccagcuuaagauuuauguauuuuuauuuuauauguauuuugcuuguaugcauaucagugcagcacauguggucuggugcccauggaggccaugauaaguacauuggagccucuggagcuagacuuauagaugacuguuaccugccauguaggugcugggaauugaaccuguauccccuggaagaauagacaguaccacugagccaucacucuaguuucuaggaguuuauuaaucugauuaaaaaaaaaauccaguaagaaaugucacagaaaucagauuacuuuuacucugauacccuaaaugggaccaacaguagugaccaauuuuuugacuucaugauaaaaauaauauaauauaacauaacauaauauauauuuguuuguuuguuuguugguugguugguugguugguugguugguuggugcaaggucucauuguauagcucuuccuggucccuaagugagaccaacaguaaugaccauuuuuggcuucaugauaaaaauaaaauaacauuuguuuguuuguuuguuuguuuauugaggcaaggucucauuuauuugcaaggucucauucccagccuggaacuugcuuuguugaccaauuugaccucaaacacaaggguaucugccugcuuuguauuuuuaguuuugaggcaaggucuuucucgguaguucaagcugaccuuaagcucauacucauccugccucagcuuucuaguaugaaccaccaucccaacuuucauguuaaguaugugacuuuguguauauuguuagauauguuuauauuaauauaaagcuucucagaauuuugucuugccaauggaaagcucuaggguuggacaugaucgcucuccugugaucccaguucuccaucacagagagcaggaggcucucucucugcugcaucauccaaguacugaagcccaagaaaaauaggucccuuugaaaauguuuccccucagauuuauagcaaaagccuuacuggagcucaugcugcgucucugagaugcagcgacagagaagcaaagcccacacaaugagcuauuuuaaagaguguaaaauauucuucuguggcaaaaguaugaaguggaaguuacagaucucagguuauuggguagcccagggcaacuuggugugguuuucuucucaggugguuuaauccguuacucuccugcacccugacgugucaugcuccuuccuuuuagauuugccucuucccuaguucuuugaauccaugcuuucaggugcacaaauguauuuugaagguggauuuuugccaaacugcuuauauugugaacucuuauuaaguagagaaaucuuaaaugaaaauaaucagacauuugagcuggugguuuuaguagcuagaugaauaagagagggaaaaauccaaccccucaccuugauuuucuuuucucaaauaacuugaacuauuuaaucuuuuuuucugaugaacuugguuaagacuucucuagagcagugauucuugaucuuggucacaaccccuuuagggucaaaugacucuuucacaggagucacagaucagauauccugcaucucaaauauuacaauucaaaacauuaguagcaaaauuauaguaacuaaauaucaaugaaaauaauuuaauggcugggagucaccacagcaugaggaacuguauuagagggucacagcauuuggaagguugaaaaccacagcuguagagcuuuuugaaucuauugucuuaguuugagggccuccauuaggaacacagauuauuacauuuuuaaaagauguauauuuuaaaccuuuaacauaaguuaaauagauauuuuuuuggauggaguguacaucaaagcgaagacaaagacuucaugcugagaugacgguaguucauauuuuuugugcugugucuuaguuuggguuuccauugcugugaagagacacuauggccaaggcaacucuuauaaagguaaacaucuaauuggggcaggcuugcaguuucagagguucaguucauuaucaucauagcaagaagcauagcacugugcagacaggcauggugcuggaguaagagcuguacaucuucauccaaaggcaacagaaggagacugucuuuucugcagucagccaggaggaaaaucucuucagcacugggcagagcuugaacauaggaccccaaagccaaccccuacagugauauacaaccuucaacaagaccacaccuauuuaaacaagaggauaccuccuaguagugucauucuuugugggccaagcauucaaacacaggagucuauggggccaaacguguucaaaccaccacgugcuguaccugggucccgacacaugacagucaguuuuccugacuccuuccaaccagcuaacgcgcuugacuuaguaaacugucagaugcuuucaugucaggugccagucaccaucccaaggaauuagggauuuuuuuauuuuggguaggugggagguaauggggagaauuuauuuguuccuuucauuuguuucauuggaaaugaguccugcacuugagauccacagaagaaaauuauuagcacaauuuagcuaauuuuauuacaugugauuuguauuacacugggucauauccaacaguuuaauaaagugugcauagucuagaguuauuaagaagaaggagugguuuacauuugcuuagaauuuaacccuccgucccuuuccuuugucauaaaaguaacauucaucauuaagaaauuuggaaggaauaacaagguaucauaagcaaggaaaauuauaugccaccuuaagucuuucuacaugcuuuuaaaaaaaucuugaggguuggguaucaucccuuauucuuagaauaacagcauucugguggcugaguuaagaggacuaucccaaguuugaggccugccuaagugauacagaaucaggcagcuggcauuauauagugaauccaugucucaaaaaacuaaaaugaaaaaucaagcaaugaagagaacacacacaccuaaaauaacaagacaaccuucagacuuaauaugugcacuauuuuuaacuuuguuuuugguguugcugggaauugaauugaaaauauuauacaucuuaggcaagcuuucuggcaccaagcuauacuccagcccuacagcacagggcucucccccucccuuuuucucuuucucuuucuacucccccucuucccucuccuuucuucuccccucucuauuugagacauguauggcuuaggcccagucucuugaguugcaugauugcaggcaugagccauacuauacuuagauacuacaacacaauuuuuguuuuguucugauuugguuuuguuuuacuuuuuuuguaauaguauagaguagaguuuauucagggaaaggggaguggaguuaagaggguaguagaggcagagaaaggcagagagaggaagagaguagagaaguagaggccggccggccaugaacauguggaaagaggaggaagacguuuuuuuguuuuucaagacaggguuucucuguguagcccuggcuguccuggaacucacucuguagaccaggcuggccuugaacucagaaauccaccugccucugccuccugagugcugggauuaaaggcgugcaccacuacugccuggcuacaacacaauuuuuaaguguugcauaguauuuuguuauaugaauuuaauagaaguagcuuguucucucucauuuuggugcacccaaauuauguguggugcuagggaguaaacguaggguuucauguguuuuacccaagcacugauauacacacccuauaaauaauuuccuuauuucaaauuuucuaucuagaaaaaucucagcugggcaguagugccacacaccuuuaauuccagcacuuggguggcagaggcaggggauucugccucauuuauaagugaguuccaggacagccaagguuaaacagagagacccugucucuaaaaacuaagaagaaaagcaaauuuucaugcuugucugagaaaaaaguguacaugaugucugugcggagguacacacaugccacaguguauaugcgguguugaaagauaacuuuagagucaguucuguuucucuaccuuggcuuuuguaccaaagguggaacugagguggucaagcuuauuuacacaguaagcacuuaaguccacugagccaaugguucucaacuucuuaauccuguggcccuuuaauacaguuucucauguuguagugacccccaaucauaaaauuauuuuuguugcugcuucauaaguaugacuuugcugcuauuaagaaucauaauguagggcuagagagaugacuuagcaguuaagagcacugacugcucuuccagagguccugaguuuaauucccagcaaccacaugguggcucacaaccaucuguaaugggauccgaugcccucuucugguauaucugaagaaagcuagaguguacucauaaaauaaauaaaucuuaaaaaaaugaaucauaauauauaaugcaaggucuuggauaugugaccccugugaaacgauccuuugaccgcagagggguuguggcccauagauugagaagaacugcacuaagccgucucauuggcuuaggaggacugauuuacauaguacuugcuaauguacagucuacugucagugauucuuccuuucuuucucugacucuuaauacacccuggacacguuuauuucuuaauucauauuugcgcuaucauagaauaaauuacuugcuuuaaaauuuucuuaauuacuuuuuguuuguaggaugaacuuucugauauuagucaagguggaucuaaagcuaccacuccagcuucaacagcaaauucagacguaucagcaauuccuccugauacuccgucaaaggaagauaaugaaggauuuguaaaaggcacagauacaucaaauaagucagagauaagcaaacacauagaaguccagguugcccaagagacuaggaaugugucuacagguaagugacuccgaguucuuacuagcaaaauauucagucaacccacauaauauaggugugagaaaauacaucucuagagguguuaccugcucuaaauauauauauagaugcucuacuguguauaauuuuuaaauaaauuuaaaagaaguaaugcuuacacaaaguuuuggagagagucccuuagaggcuaagaagagagccuaaagacaguaagguagccauuuucugaacuuuaccuuaauauaauaggcuauuguguuccauccccuuauguagguuuguuugcuuaugauagggucucacuauguuguagcuuugagcuaagugguccucaugccuuagcugaauaucuggggcuauacgcauauacaaccaugccaguaccacacacuuuuuuuuuuuuuuuuugagauaguaucaaauauccuaggcuggcuucaagcucacuguguggccacaugugaccuucagcuccugaacccucuugccucuacuucccaacuuuccaugugcugagauuacaggcaguaaucuauccuggacaguuagcaucccccuuagauaggaauaaaauccgucccugugauauguuguacuaugugucccacauuuaaauacacaugaaaacacguacuuacuaguaagguuacucacaaguucuggagauuggcuguuaaacucagugugugacauugucuaaccucauauuuccuagaacacagccacgagaguuucuaaaaauguucacucaguagcuguuuuaaaaccuaauuaggcaagaguuuucauagauacauauaauguaugcauuuauuucaccauauucuacccuuagaaucuggugaaaaugaagagaaaucagaaguucaagcaaucauugaauccacuccugaauuggauauggacaaagaccucaguggauauaaagguucaagguacuaagaauaucacauuccguaauuaucuuccuuuuucucauucucauuaacuuuuauccuguuuauaaauaaguaagaucaguucauguugugcuacagaaauacuguuaauguaauucagauuuuuuaccuuagaaucugcucauuacuuguauuuuaaauuuuggaggacauucuucuggcaggauuagggauugggacauaagggcagaugggguuuuugucuauguugcuguaacaguaacuaauauugcauuguuuauaaagaagagagauuuguuuucucagaauucucaagcuaggccauucaagaugaagaccccggcuaguucaguuguccaguguaggcuauucuuuguuucaaagauaaugccuucuugccgcguccuuuacggaagaggaugcaguauccucucaugggagaaggcagaagaacaaacuagcuuagugcuguaugacaagugucucuuccaaggaccuuaccuuagucucacaaggaaggagcccuuaaugcagagcccagcacuugaugguugucaccuggcucuggagcagacucagucacugagaguagcuggaggaggagacagccagggcugcuucucccgccugaggagaccaggaaguggaguggaggaaguaaaaauuugaacaaacuuuauuuuuuucacaaaagagggagaagagaacauguucugucuagaaugaucucauuaguagggaauuuagucucaucuuacauggaaagcuugauuaaugagagcagaagaguggcuugguauuguuuuaaucaagguuauccaaaaacauauugauuagaauugagcuuuguguuuccucaacagauuuaccuuuaaauaacgguuaugagcacguaucauuuauuaagcccuacugaguagucaguaauggaguaaugguaaaauacuuggguauuuuacccaggauaagcauagccucuaacagaguaagacuuauauggguucaaaucuugcuucucuggucuuuucuguuacaacagggcuggggauuauaccuggcaacauccaucuuuucauucucuaauuucauuauaucuuaauuuuaguucaauuagaauauauuacugcauuaguaugucuauacaaauucucaaacuuagccguaaauuuucuuuugaugcuuuguguuuuccuggaauuggugaaucuuaagucaugaaacauguuuccuuuuuucaguguuccaugcacuuagcacuaacauuaacagaccugaguuuccuaaguguaugauuuuuaggaugaccagaccccaaaucuagcuauuuucaggacucugccuuggccuucuaguuccuuccucauguagagugguguuuaccuugcucugcuguuucaggucuucucuacagagaaacaggacaccgaggcucuuuauuauaugcuaugacauggcucugugggaguuuccuaaaggcagagucccaaguacaauggcuuugagucuuuuaaucaguuuuggaagaggaacaaagagauccagagagcccccaaaaccuucuuuguaguccugaagugagaucacaguuuaaauagaggaacaagugugguuuggcccacugucgacccaucauuaucugggugucagucucauccuguaaggugcuuagaauugugcgaagucucuuucaggaaagcaaguugcccuucugcuguuaucucuuccuuuucucagaaugagauuccugugaaaauucccauuucucuggggucuguuguuucaauagucugauacauacagugucucuguagagugucuuaaucuuugucaaguucacaagccugucccuggaggaucagaaguccaaggucauccucaacuauguagcaaauuugggaacaaccugagugacaugaaacccugaagcccuguaaaauaaaauaagacaagaaaaggucauguauccugaaacaagauugcuuuaguuugaauucuuuuucaccuaauugcugaaugauuuuugucaagauccuuaagcuguuugguuuccuuauuuguaaaauugggguaacacagagucuguuuugcggucuguagcuguguacugcacagaccagaguagcugccguuauucuguggguuugcugggacuucacagaagaggcgcuguguacucucugugggaaauucuuggaaauucaccaagaaaucuuuucauauugauauuuuauagucaauauaaauuuaaguaagaaauuccaaugcugcuuaaucauuauauuaaaaauacacugucaaggucuagcugaggaguccgugaagagcuacuuggggugaccaugugggacagaagguaucauggccauuuguuuggggauggaaggaagaagcaaccaaacgugaacuugauucuguguuuuuaaccaggaaauacccugguuagauuuguuuuuaaauaaacauacauuuuuguuaaaaaaaaaaauacacugucagaaagucuugguaauuugucguuuuggcuuuauuguuuuuguugccuagcacucccaccaaaggcauagagaacaaagcuuuugaucgcaauacagaaucucucuuugaagagcuguccucagcuggcucgggccuuauuggagauguggaugaaggagcggauuuacuagguaugacagcuccccuagagaagugccauacacacuguuuaaaacuagaugccauuaaugaccugacugaacaaucauuuaaaaugucccugacugccugacgguacaagguuauuaugcuucagggauugcuuagaacauuauuugacaucauaagaguuuuaaugaaaaacgucuuucuauauggaaaugacaaaaaaugaauucacauuuaaauuuauacuuuaauucacaguuuauugauuugcuauauuucuaaaaauagauauugaacauaaauaaauaaagaacucggugcaggguguguguguuuguguguaugauugguagucagauaguaacuggcuuauauaaaucuuacagaguucuguugaccuuaauuaauuaggcaauuuuaacacuugaaauuuauaauuuaccucugugggaaauagucauuuuaaaguuuguguugaauuaggguuauauucuaauuucuagccacugcugcuguguuguuccccuguccaauaaacaaaaacacacaaaaaagguugugucauugagcacauaccuggcccggggugggggugggguggggagcuggaguacugugugcaacucuuucugagugaucagcccuuuugugugguuuuauugcagaaggaguuggccucuggccuggggucugcuagauggguuaguagaguaaagcugccucuucaguguucaguuagguuugacugaaacagccuuccuuagcugggggggcagggggugcgcccauaccuuuaaucucugcucuugggaggcagaggcagguaggucuuugugaagccaaccuggucuacagagccaggacagccaaagcugcaauauagaaaccgugucucaaaaaacagaacaaacaaacaaacaaacaagcacaagaaggaaaaggaaagaaagaaaaagaaaggaagguagaaaagaaggaagaaaggaaggaaggaaggaaaagagaaaaagaaagaaaaacacgaaaaaaccucagucuccucuaauuuuguguguuugcuugcuuucuuugauggccuguacucaacauuauuagagaugaauaguuucuagaagauaugauauaguacacaaaaucauaaacuaaucaacauugcuuccaaccuguccucuguaaaugucuuacguuccuuucaguaagaagucugugacucuaguucaugagaauuagcuuuaacuucuuguuuguaguugaggucuguguagaaauuaaagccauagaauauucaacaauaauaaagguucucuuacugucauuauauuaaaugauuacacuguucucaaaaaucuaugcuucuugggugugguaaauaugguaugcagugaauugauuacauuaauuuaugcuaaauuuauugauuaccaaugaugugcuugccauugugaagauuguguuuugguuuuaguuuguuauaaguuuagccaggcauaguagcacauacuucuaauuccagcccucagaguguagagagagggaaacugugaaaggcagccugagcaacauaggagacccuacuucaaaaaguuaaaaacagugugauagugcaugccuuuaauucugauacccaggaggcagagguagggggaucucugugaguugaaggucagccuacaguacaucgcuaguuccagacuagucagagaucuacagugagacccugcgucaaacaaacuacauagcuggagaaaugauccaguggguaccagaaauggcugcucuuagagcaccuacaaggcagcucacagucaucuggaacuccacuuccacaggaucuaaugcccccuccuggccuccaugggcauuagccacacacauaaugaugaugaugaugauauaccuaaacuaugccuccccacauaaaaguccuauguaaacauauaccuaguaaccgagguguaaaaaucugucgauuuaacuguuuauaaacauagacucccaccuuuaaaauuuuaguaaaacuuuaggugaauuaaacgaauucauucucugagcaagauucagaaagacuaguucuugaggaaacguuauauuuaaguuuauaccuuuguuuucaguuucacauaggaaaguucuuugaaaguuuggcugauugggcuggcaagauggcucagugagcagagacacucagcaccaagcuugcccaaaacuugaguucaauuucagggccuguaugauggaaggagagaguggacuccugcaaggugucgccugauuucacugccacaccauggcauguacacagaugugcaugugcacacacacacacacauauauacaagacaaauguaauaaaaaguugauuggcuuagaaaacuugacuccucaggaaauuuaaggacaaauucaaaaaaugcuagggaaaauuuaaaauuuauuuuuaaaaauucauauugagauuuauacauaguaaaauucacuguauuuugaguauaagccuuuuuaaaaauaauuuccuugagccuuuuauuuuugaaaguuucauagauguauauauuuugacaacuucuacuucauuacccuucuucauguccccucuccuuucaacugaaacccuucuucuuucuaagaagcucuucuuuuggcuugcaugucuuuugugaguugcuugucugagcaugggcugucuuucaguagauauaccacugacaaaaugaccccgcacagccagcaacuauuaccugccaguaauucuucugggcuggaaggucucacucaggcaaccacagcugcagugaguucaugagggaaauggcauggcgcguccaggcaacaucuuuuugcagcagaucccuugucuucuagcccuuacauucuugccauccucugccuccuuguucccagccuuagaggggugauaaaaguguuuaaggcggagcauuccaccauuccuucuuauaacuuugacagguuaggauccuucccuccugcagcuauuagagguuagggcccuucccuccugcagcuauuagagguuaggauccuccccuccugcagcuauuagagguuaggauccuccccuccugcagcuauuagagguuaggauccuccccuccugcagcuauuagagguuaggauccuccccuccugcagcuauuagagguuaggauccuccccuccugcagcuauuagagguuaggauccuccccuccugcagcuauuagagguuaggguccuucccuccugcagcuauuagagguuaggguccuucccuccugcagcuauuagagguuaggguccuccccuccugcagcuauagaggcuggaacugggagggcugauccagugaacucugaauacauucuucccucuugaaguugccuuugucaaguauuaauuugaggcuguaauccaucauugcaggcaggucccagguggcaagagcuugaggccacuaacuauggcauccacauucaguaaacagaaggagauaaaugcacgcuugcugagcacaacaucuuaaguuuugacagauacuuaaaauuauguaacaggcacaagaaucacuuaucacuaugucuuugcuguugccuuuugaaugaaguaccuagaaggaugaaugguguacauucauugccuuauaaagcccagcaaugaguauggcaaaauuugaagucacugacgacauaacuuucuuuuccugucaaggauuaagccacauagaagguagaaauaaugguggucuuuuaguugagucagguauuuucugaaagucagaauuauaguuaaaagcaaaauucuuuguuuuccuuuccgugcugacaaauaagggauuaccuuacacuauucuuuccugcuuugcagauauuggcauauauagcucuagaacauuccaaaucauaacguuuaaauauauuaaaaugaaugacuuaacaccuacauaaauucuguuuguuuguuuguuuguguguguguguguguguuuguuuuuugagacaggguuucucuguauagcccuggcaguccuggaacucacucuauagaccaggcuggccucgaagucagaaauccuccugccucugccucucaggugcugggauuaaaggcgugcgccaccacuacccagccuacagaaauucuuuaaucaaagaugauaaaugagggccagggauggaguccagucagcagaguguuucccuagcauaaagaagccugggcucaucccuacacugcuaaaccagcuguaguagcacacauaaucccagcacuugggagguaaagacagaacgaccagaguucaaguuugucuucaggguacaugaaaucccacuuuaaagcaugguaagugugcaguucaaggauccuaauaaagcucacacagcaggguguguuugugccagccaaaaagcucccuaauucugucugggccgaggagcaagugcauccucuguuucuuuagauucauuuugauaaguuuuguucucaagcuuuuguucgagaauuaaguuuccuuuaaucacuguucaacaugcagauuaccuuuauuagcauuuuaacaauugaaagagauaaccucaauuguuuuccuuccuuuuuuguuuuuguuuuuuugggguuuuuuuuguuguuguuguuuuugagacugguuucucuguguaaccuuggcuguccuagaacucacucuguaauccacacuggccuugaacucauagaccugccugccucugcuaggauuaaaggcguaugccaccaccaccuggcuucguuuuccuuucuuuuuauugauaucaucuuauuuaacuuucuuauuuuggauaacacuuuuaaaauugcuuucuuugcucucuauuacuuggaaaucauacacuugauuauccaucucccaagauguucuuucucuuuauucauguggauuucuucaacuucacuaucaucuuuuacuaagauacccuccaccccaaucccaauccucagaucuguuggaaugcuuuugcuucagccucuuacugcauggguugugggugugcaucaccaugcccagcuuuaggucccuuccccuccccuccucccccccucuuccuccuccucccccccucuuccuccuccucccuccuccucuuccuccuccuccucuucuucuucuucuucuucuucuucuucuucuucuucuucuucuucuucuucuucuucuucuucuuccuccuccuccuccuccuccuccuccucuucuucuucuuuuuucuuucuucuuucuucuucuuccuucuuucuucuucuuucuuucuucuucuucuucuccuuaucuuccuccuccuccuccuccuccuccuucuucuccuuucuucuucuucuucuuucuucuucuuucuucuuucuucuucuuucuucuucuucuuuucuucuucuugguuuauuuauuuuauauaugugaguauaguauugcuguuuucagccacaccagaagagggcaucagaucccauuacagaugguugugagccaccaugugggugguggaaauuuaauuuggcaguuaagagcugagcaaucuuuccaacccaggucccuuccuuucuacuuuuuuuuuuuuuuuuaaguaaaacaaggcagguuucuugggaaacuguucacaugcaaguucaauggucucaaggacagaagucaccaugggggcguggggagagagaacaagggaauacaugcagacagagaagaggaggaagagaggagagagucgucccuuccuuuuuaaaauuagaaacuauuuucugccaauccauaagcuuccuguugcucacuguccucccaguucguguccuacuuuucuacucuuguaugagacauaccuguuacgugcugcaaccuuuucuggauacuggauacagcagggcagcgcgcagaccucuccacucugcucgcuguugugcugccacugccauucuccacaccugccugguuccuuuccagucuuccagugugcucagggguugcuucugacauuucacaugacuucuacaaaacuggugacuuaaacuauccuuguuggguucccauacuaucagacuugccuuuuacuguggugcacuuccucugcucuucuuucacacgucuguagguuugcuuggguugguuuuuuugggggggccggugugugugagaugggggggagugguuggggggguggaacgauguauuuacuccuguuacuagauuuuuugagacaggguuuuacauguauauguauauaaauuaauuuuauguucacugguguuuugauugcauguaugucuuugugaggauguaaacuucaucccacuucaguccaggacucuagacucuuauuucuaaacugaucacuagacccccccuaagauaugaguagucuugagggguguggaggagaaagaaagggcauacaugcagaguucagacaucccuugcauauaucugccugcaucugauaugcagaguucauuuaaucaucuccauugucuuuucccugaaacucucugucuaaugguacuucuaugccaucgagcgaacaucuuggcugucauugaacuguccaucuagacucucacuuuucucuuacaaccagucuucagguccuauuuguccugucuccuaaauauuugcauauauucaucuuccuuaucuccgcuuaaguggcauguccuccaaaaauucuuuuuugauccccaauuaaagcauaauuguccuugaaguguguguccacagcagugaauuucaugcugcuauuccuuacgcuucccuguugucugugcacuucucucucccugcauagacuaguccgcuguguuggguucagcugugucuuuuucccugcugaugcauauuuagcacagcacaacauuuaagugaaugaaugggauugugaaauuggccugacgguuuuguuucacuuuaaaaucugugguuuaccuuuugaauagaguucuuuagacugugugucucuguaagaauguauacuucuggguaaaaugacacaggcaacauuccaucucacggaauugcagauaacucagaugucauauguguaugagcuucuguggaccugcuuaacagucuuaaauaaaaacugcagaagaguuuguuuuuuuuucuugguuuuugcuuauuuuuuauaggcaaaauuuauguguauuuuauauuauuuagacuuuaacucuugaauagagauaggucacuucaagcaguauuuuucauauaauuacuuuuauugguauauuucaaaauuauuuuggauaauccuacuuauacacuacauuuuaagagaauucuucauugaguguguauaaguuuaaguuuuauuuuuggaguuauaagauauguucucaggaauauccaccuuuucccuuuauaauauuuauacuuuuuauauauaguugauguuuuucuauauugauucaaguucuuaguuagauauuucucaucuuaaaguaaauggguuuaauucuugcuuccuaaaaacaaucuaauugaguuucuuauucauuuuucucuugggcugcuaacccaggggaauauucugguguguauguuuuuaaauacuuucccauuacugcuuucuaagcuagguguucuuggcugcugcucucauuugaugcuuucucaucguuuuuuguuuuuuuugucuccugccugaccauuuuucuuugcauauguuuuuagcuuuuaugcugcucuaaauguuugagaguuuguuacagauguuauauaagcacuuugagcaaaucugagcuauauuucuuuugucucuauaccuuuacuaaaaaguuagcacuaguauuuaaggaaaauucauuuuggagauagaauuuggaagcuuucagguucacuaccccaguuugugaauaaaauaugauuuuaugugcuauuugugaugcuugagaauauuugaaaauuauaauacauacaaaauaagaauccauaugucagcauuaauuuuuuaacauuccaaguugguuuuguuucaaauaauuaaaaaauuauuaagaauauuaaaaaacauuaaccucauaaacuucuuuuuuucuuuuuucuuuuucuuuucuuuuuuuggugggggaggggguaugguuuucaggacagacuauguagcccuagcuguccuggaacucaccguagaccagccugaugucaaacucagagaucuuccugccucucucucuugagugggauuaaagaugugcaccaccacugcccaacaguaauuaacuuuagaaauauuuucuuuuuauuuuccugaauuauaaauauugugucauucuccagcauuaucucaugacgcuugggccgagugcauagggaguucuuggguuuguucugcuggggcuguucauuuucuguuuuguuuuguuuuguucuguuuuguuuuguucuguuuuguuugucuccacuauucuucaaugaacuguuuuauuucuucaaucucuuaugaaaagcaaacaacuuuauuuuucugaaagaugacuacacuaaauacuuauauaucuuguacuauuuauuuaauauuaagcacaguucuauaaaguaacaacugaaaauuauuauuuuauguguggcacuuuguaguguugacuuggaguuuucauuguaauuaaauucaaucuauuaugaggaagaauuggugaagugggcuagagagauagauagcucagcuguuuagagcacugacugcucuuccacagguccugaguucaguucccagcaaccacaugguggcucacaaccauccguaaugagaucugaugcccucuucuggugugucugaagacagcuacgguguacucacauaaacuaaauaaaucuuuaaaaaaaaaaaaaagaaucggugaagcauuuuuaaguauauccgagagcaucuuugugagagaaggagaucaucuuuauuucugccuuuugcacaucaucaugcauugagucauaacauugugcguccagauguuuuucuaucaugcauagaacuuuauagauuaauaauaugucuccaugcuguuucuuacauaaaacauuucuugugcuuuguuuuugcuuuacguggaaugcaugggcuuuaagaccauaauuucuuugguaagguuucaucugcaucgggguucugucuucagccuuacuucuuucugcuuaucuuuuauuagucaucuaucuaaguuuuuaggcagaagccuacaauagcaccuaugauuuagaaauaauuuugagcccuaccaauguucauuuuuucccuaaauaguaauaguucuuaagacuaucuggcagaaaaauguugauccuccugaaauauuuucuaugaaaaacaaaagaacuguaaagaauuggccaagaagagcuggggacuagggcuugcaucagcaccagcagcuguugggaagccgaggaaagaagaugacuugagccgaggagacugagacagucugagcaguguaacagagcagcaagauccaucuagaaaacacacagcagcaaagagauuuagcuaaccaaauccucagcuuuggucugggaugacuaguuauuuauaauuuuauagucuacucaguaaauacaucaaaugaagucgacaaagaaaagcccaaaauaauaaaucuuaggaccauagcuccuauguaauuuuugauaaauuuauuuucaaaguuuuuaucauuuuucuuuugauaggaaugggucgugagguggagaaucucauacuggagaacacacagcugcuggaaaccaaguaagugugaaagacuaacccgggacaaaacucaggacuucccucuguccacaccaguccuuuccuacucaguugacauggcgggcacugugcugucuucucagcaccugugcacacagagacgcagguaacgggcacuuuauugcccugauagguuguauugcucuggaauuuuuguaauuuaguuuuuauuucuuucccaccacacagguaucgacauucuggguguaucaugcaccucuuuuccccucuaagaugugucauuuucuuauuuucuuuucuuugggguuuuuuacauuucugcaugaauguuuuuggcuucuacccugccaauucuguagagcuauucuucguaguuuuauauuuuggaguaguuuguggagccuuauggaacucaaguagcauguuggcguacuauuuaagaggacagguccuuuguuauaugaagauacguagagggucuacuugucaguuugcuguggcagagcaguuuugggacaaccaugccuguccacacagcacaccaccaccuguaaaugaggucacacccaacacguacuguaucucauacuuuuucuuuucagcuuauuucuaauuuaaacuacauucucaggaauuacugacagcaacaacaagagaauuugacuauauuguugaauaauaccuuugcugaaacaucaauaugaguagccuuagaaagcuggguuuguuuucucuuuguuuguuuuugguuuucagcacuggauuucucuguguagcccuggcuguccuggaacucacucuguagaccaggcuggccucaaacucagaaauccgccugcacucuaccucccaagugcugggauuaaaggcgagcaccacuacuaccugacuagaaugcuguuuuuuaaguuuaaucucucuuaauacugauuuuuuuuuuccaaaaaauuuuauuggggaaaacuacaaaacauuuacaguacaauguuuacagucacaauuuguagcgaacacauuccccaaaauauauuacaacucaaguugacuuaccuuguuacauucaaaacccugcuucugucaaaggaguccagagugcacacguggugcuccaacagaaccuacauaaaggcugcucguucaucugccagccaggaaagccgggagacauuccugccucuuuaugcugaaaaauaauacugauuuuuuuauuagugguaugucuuauauuauuagguuggcaaguaugaagagcaaauauuaaacuaugauuuuaugacuuuugucuaugaaaacauuaggaagaauauauuguagugcacagucuaguuuuaugauuuggaaggcauuuguaaugaugcacuugaaauauguaucuuuuagaaacgcucugaauguagugaagaaugacuuaauagccaaaguggaugagcugaccugugagaaggacgugcugcagggggagcuggaggcugugaagcaagccaagcugaagcuggaggacaagaacagagagcuggaggaggagcucaggaagugagugucuguuuuuggaagccgcgcugugcggccuguguuugccauccgcauguacggggcugugcucauagcuaccuugggauacacuccugcucugaacuaaacgccuugccaggguaccacaaaaauuauagguauaacccugagacugagaccuucagcacacucaaaccaggaaugaccaagagcuaccugaagagaguaaaggcucucagccauuuauuugacucugcuaugagcuggccucccucuuuguuuaccacucucuuaaccaaaaaguccuguuuuauguuuuguuuucuuuuacguuuuccuuuccaucuuggugucaaaagugggcuggagagauggcugagcaguaaggagcacuuccuugcuugcucuuccagaggaccugucuguuacuccagguucaggggaucuucaccccuuuuugaccuuuucaagcaugcacuuguaugcacguacacacacacacacacacacacaaagaggauaagguaaaucuuaaaacaaaaacaaaaaaccucguaaggacuggagagggugcucagggucuaagagcacuugcuacucuuccagaggaccuaaggucagucucugacauccacauucgucaucucacaacugccuggugcacacugacaugcucacacacaaauauaaacaaaucuuuaaaaaacaaacaacaacccuuaaaucuuccauuuuuuuaaaaaaaauguauuauuuuccuccauguagcuugcuuuuguuguugcuuucuguuccugagauagucuuacacaacacagacuggcuuguaauucagaguguagcagaggauggcuuugaacaccugcccucagucuucagccucucaagaagugauaacagguuuccaaguugaaggcagcagucugcuacccuuugggcaaaagaaaaguaaucuuuuaguggcaaauaaaacaauuuaccuauucuuucauuauuuuuggagaugaguucaguuguaauaauauuauuuuguuuuuauuuuuuuuucccuacuagagcucgugcagaagcugaagaugcaaggcaaaaagcaaaagacgaugaugauguaaguuuaugauuggggacuguuuuucuuauagcuuuuugauauuuugggauuaccuuacuaauacuuauuuuagaaauaaaguaaaagauagauagauagauagauagauagauagauagauagauagauagauagauagauagauagaugcaugccuuuaaaagaagacauguuucugggucaugacuaagcuggcccauguuuccauaugguauccacaugcuguauuuucuaguguuacaugcucacuuuuucucagugguucaguacucugaccuguguuagcaugcuauuauuucuaauuuuuuuuguuuuguuuuugguuuuuuuugguuuuuuguuuguuuguuuuuugagacaggguuucucuguauagcccugguuguccuggaacucacucuguagaccaggcuggcuucaaacucagaaauccgccugcuucugccucccaaguucuucugcacacacacaaauuaauuaauuaauuuuauggguuuugucugccuguuugugugucacauaugugccugauccuuaauuaauaaaacaauuaaauuauuuagaugggcuugcaagauggcccagcauggaaagguacuuauuaccaagcuugaugaccugaguucaauccccaggaccacauaguagaaagagagaacacacucccacaaguugucuucuguccuccauguguguguuucagaaugcaugcauccagacacauacauacauaaauauguaucacgggcuggagagauggcucagcgguuaagagcacugacugcucuuccgaaggaccugaguucaaaucccagcaaccacaugauggcucacaacccucuguaaugagaucugaugcccucuaaaggugugucuaaagacagcuacaguguacuuacauauaauaaauaaaucuuugggccggggcaagcgagacuagagugagcagagguccugaguucaggaccaucaaccacaugauggcucacaaccaucuguucagcuacaguguacucauaugcauaaaauaaaauaaaauaaauauuuaaaaaaauaauaaauauguaucacacacaaaacacauagacaaaauaaauaauacauguaaauguaauuuuuaaaaaacauagaauauugccaaauauauucuccaccccagaggaagucaugauccguuaucguuuauuuaaguaaaaaaauaauuucaucauguaaauauguacacauuguucuaauuaucaugaacugucacccuuuucucagacuacagucaccucaaaaaaaagagucucacuugagugauugucuucaguggucugugacaugacugagggauugucuuaauugccaguugauaaaggagagccaagccuauuaugggcaguaccaucccuaugcagacgauucugggcaccauaagaaagcuuaccaagcaugggcaagagagcagaccagcaaguaacauuguccugugguuucuacuucaacuuguacuuagguuucugucuuaacaacgaaacacagaacauuauaguacaagccuggaauggagacuuguggauuuuuggaguuugguuuuuguuuguuuguuuuguuuuguuuuuugugccuacucauaggggguauuacugcguugcagaauucagaccuuuuguuguuguuguuuacuuuuuugcuuuuugagacaggauuucuuugaagccuugguuaucuuacaauuagcucuauagaccaggcuucugccucccuagcccagguauuaaaggccuguacaauacccacuaccacccaccacccaguagaauucaagucuuuuguuauuuguggaugacuuuuguuugaagaggugggcuaaauucugaggcaggaggacaaaguaggaaaacugcuaagguuugagcaaagcuucugucucacuguuccaugauuucagugaugaucuaaaauauacaugcuucucugaacaaagcaaaacccuauuauuaaaccuaccugcuuccccagaagaaagcugagaaaucagcaggagaaggaaguuaacuugggcaugcuuuuuggagacuuauuucugucuaucuuccauguucauauccuauucucuagcaauaauucugucuuaauucuuuuaaagucauugaguuagaaauaagaaaugcuuaaaaacuucagauuugguuuaagugugagucuuaacaccaaaucacauguaacuucccagagugaugugcuauccucuuguuauagagugacauucccacagcccagaggaagagguuuaccagaguagaaauggcccgaguucucauggagagaaaccaguacaaagagaggcugauggagcuucaagaagcuguucgauggacggagaugauccggucuguaugagaagugcucuguugcuuccugcuguuuccuuagaugcauguguucuucacugccagccaaacccugccugaggguucacuaggagaaaccucaguugacauuuagauuaauaauagaacaagaucggggaugucccacagccuuaggugucugagauaguacugggccuuggaggauaaucucauaacuuguaagagauaauuguuguuacuuaggaauaauggucauuuuuccaaaaaaaaaaaaaggaaauaauauucuuucucaaugucaauuucacaugcaguauaugaaaauauauauaguaucuuccuauuaaacauacuuauuugacugcacccuucuuucucuucauguaaaauauauuuuccuuuggcaucuuucagucaaucaaaucuguguuuuuaucauuacuauguuuuaaugguucauacucauggaguuaagugccagugugugcauacaaugcaguacagucagauccagccuccugcuauucacucuccauacugugagccucgagcaaucacucuuugcaaucaagcugacuuccuuuuuuuuuuguuguuguuguuuuuuuuuguuuuguuuuguuuuguuuuucgagacaggguuucucuguauagcccuggcuguccuggaacucacuuugcagaccaggcuggccuggaacucagaaauccaccugccucugccucccaagugcugggauuaaaggugugcaccaccacacccagcuugacuuccuuuuuaaacucuacuuuugagaggacacauaguuguccuuuauuggcucuuaaaucucagugcugccaucuagugaucauggucuuaguaaguguucccuccuugaauucagaaacagcuauagaaaaguuugucuggguuuggugacaauauauggggcagacucugguuggccuuuccuucagucccugcucuacacuuugucuccguauuugcuuccaugaguauuuuguuccccuuucuuagaaggaccgaagcacccacacuuuggucucucuucuuuuugaguuucauguggucugugaauuguaucuugguuauuccaagcuuuugggcuaauauccacuuaucagugagugcauaccauguguguuuuuugugauuggguuacuucacucaggaugauauuuucuaguuucauacauuugccuaagaauuucaugaggucauuguuuuuaauagcugaguaguacuccauuguguaaauguaccacauuuucuguauccauuccucuguugagggacaucuggauucuuuccagcuucuggcuauuauaaauaaggcugcuacaaacacaguggagcauguguccuuguuauauguuggagaaucuuuuggguauaugcccaggagugguauagcuggguccucagguaguauuauauccaguuuggaaccuccaaacugauuuccagagugguuguaccagcuugcaaucucaccaacaauggaggaauguuccucuuucucuauauucuugccagcaucugcugucaccugaguuuuugaucuuagacauucugacuggugugagguagaaucucaggguuguuuugauuugcauuucccugaugacuaaggauguugaacauuucuuuagaugcuucuuggccauucgauauuccucaguuauaaauucuguaacuuuguaccucauauaguugucuccugagaggcucugccagagccugaaaaauauagaggugaaugcucucagccaaccauugggcugagcaugggguccccaauggagcuagagaaaggacugaaggagcugaagggguuugcaaccccauaggaaggacaacaaugucaaccaaccagaccccccacagagcucccagggacuaaaccacuaaccaaggaguacacauggagggacccauggcuccagcugcacauauaacagagaauggccuugucgggcaucagugagaggagaggcccaugguccugugacggcuugaugcccaaguguaggagaauucgauggcagagaagugggaguggguggguggguagggaaacacucucauagaagcaggaagcuggggaaugggauaggagguggggggggggcggggcgggaaaagggauaacauuugaaauguaaauaaaauauccaauaaaagaagguuuucauaaaaaaagaaaauauucaauaaaaaauaguuuaucccuugcaaaacagaaaaaaagaaaaguuugucaacugacuuuccauugauuuacucauauucuugaguuuggauuaucacaucaaguuuauacauuguuuuuaaguuuguaaacccaaccuccaacccuuaccuucucauacacacaucauuuuuuuguuguuguuuuguuuuuuguuuuucaaaacaggguuucucuguguaacccuggcuguccuggaacucacucuguagaccaggcuggccucgaacucagaaauccuccugcuuuugccucccaagugcuggaauuagaggugugcgccaccacgcccagcacacacaucauuuuuagccccacuugcuuauuaaguggccuaccagagcaguguaguuccaagcuguuuugugaaaguuuagaguacagauaaaagaaaccuuaaaguaagaacaggaauuuauaaagcaguauuuuaaagagggagcuagagcuuugcuuugcuuugcuuugauuguuguuuuguucuuugagaggucuuauuccaaacuggcuccagacuugcaauccuuccaccucagucccagagugcugggauuagaguuaugugcuguuacacucggccugagugccaguguuguuccucagagcccuacucuuguagucuagccacuugaaagaugaaggcaagaggcguucuugagaccaagaguucagggcuagucagaacagcagaguaacuccuuguuucuuaauaacaacuauaacaagaaaggggauaagucuuaaauagcaacccugagacuuauuggcuauuugucuaacaugggaaugcucuaacaagagucuuagcuucucguuuaagaaggucuagcacucuaucuaagcaagguuugacuuagcagacuuucucaugaaaggucacuugcuuaagugaguuaauaugaguuaaguugguucacucucuuacauuucaugaguuucuuagaacaccuaucuaauaauauguuuguuuguuuguuuguuuagggccucacgagagaacccagcuaugcaagaaaagaaaaggucaagcaucuggcaauugugagugagggccggggucagacaagagcguuacccugaccuuucccaguggggaggagauagcuaaacugaaguucuucucuuuaauauacagcaugccaacucgguaaggcugugcugcaggacccaaaguaggcugucguaagcugcacuguguugguuaugcaguggcuggacucuucugcugguguacauaaaaccaugggggaaaugguucuaaaauugacagucucaggaauccucaccaaagggaugaggaaaaguguaguauuuguacuguuugguuaguugucuuguauguguuaaaccugacuuuguaccagaaguacuguguguuuauugaaguuaaaacuuauccuuuuaagauuaaucuguuuacuggaagcauaaauguuuuaaaacuguggacaugaaaauaguuccuuaaguugagcuuagaaaauucaugcuaugaguuaacuuggugauguguguucucaguguagcagaccuuuguaugcgcugcacacuaagcuuuggcuguuaucacggucaucccccugcugcucacugaccacugugacuuugucccacauaggaccuagcuagccaaggagccuucguauuguacuuguuuguaggagcuuucaguacgcaagagcaucucuuucauuauggaacuugcuuauaucuagcauucuaagcgguagcuauucccccgaguguccaaguuugguugugacugacugcuaaggcgauaguauaaccauaaagcugguuuugcuaaugucuaacucacugccuuguaaaguuuugaaauuuucuugauuauaaaaauuuauggaaaauuggggcuugguuuucacaaugcauguaauaauagacauaucuguggguuuuguuugccucuuuuauuuuguuaguuucagccgacuuuuuagcucuucaaguaaugcaacaaagaagccugaacccccuguuaaccugaaguacaacgcccccaccucucacgugacucccuccgugaagaaaaggagcagcacuuuaucucagcucccuggggacaaguccaaggcauuugauuuccucagugaggaguaaguaugcugugucacucuuacuaacuccucaggaacuuguaagagacugcagccaggcacaguagcuuauguuaauccuguacucagugcugagacaggagaaucaucacuaguuccuugccagccuugucuguauagacaguucaaggcuagcaucagcuguacacauaaacucugucuucagaacaaaggggaccauuuuguguguuggaguuauggauagaaaugggaagaagaaaaaagaaggauggcuuucuauaguauagauggaugcuuuuaaguaaauugcccauagagcuuagcaauguaauuuuaaaccaaugaaagcugaggcaggaggauuauaauuuuuaggucauccugggccacagagugagacucugccccaaaaugagugagugaaugaaugaaugaaugaauaacuuguagccaguguuucuuaugaaaauugcacuuaaggacuagugagcuggcucagcagguaaaagugcugccauccuugauaaacugagauccauucuucggacguauauauuggaaggagagcacgcucuucuggccucugacggcacuaggcaugcacauggaauacagacauccaugcaggcaaagcacucgaaacacauaaaacuaaaagaauuaaaacuaaauuuaaaaaaaaaucaaaagaggauauagaaucuaagaguuuaacuuaaucaucuucaacaacggcauuagaaaauucucaguauuuguuaagaaaaggaagaucccaaauuacuucagaaguuuauguuuuuaaauauaacaucugaaacuuccuaaguuugaugacuaauaacucagauuaauauaacaugcugcuuauucccuguugaaggcuggucucacaaacauggaaaaaucagcuuugguauaaugugucuguguguguguauguguuuguguuuuguguacaaggcucuaggguauagucgaggaugacucaugcugggauuagagguuuuguugcauucucuuaauuaaaacugcaaugucuccuuuuagaacugaggcuaguuuagccucccgcagagagcaaaagagagagcaguaucggcaggugaaggcucacguucagaaggaagauggccgagugcaagcuuucggcuggagucugccucagaaguacaaacagguacuuggggaugugaccagcaugucuagcaggaagugcagguugagaagaugugaacuggaagcaauauccuaaauuucucaucucagcuugcuuagauuugguguguuuaggcaaauguggaggauguaggcuuugagggcuguuuuuuagagccuuagaauguaaauaaacauucguacuccgaaaagacuaagcacuuuuguguacaaacauguagugguaugcacauauaugauugugaauuucuaccuccugccgagcucuuguucuuacuauaugcaauugcugcuugaguuuuugcuuaguuuucaaguaagaaggacagaauugagcuugaaguugguuuaggaacaaguguggaacugccgugugugcuugugucucagugguucuguagucucagugcuaacugggcuuacugaugugucccuauuauauuagguagccaauggucaaggggaaacuaagaugaaaaauuuaccugugccugucuaucucagaccacuagacgaaaaagaugcgucuaugaagguaagcuaaccauaacauugaaggagagacuuucaaacuccaguuagacuucccaccccuaaaaaacuauuuaaacacugcuuuuguagugaaaugauugcucauuuuaaaacuugguuauuuuuguauuuugagacagaaucgcuauacacuccaggcuggccuugaacucuauuuuuuucuucccuguucuagucuugaacucuuucagucugccucguucuccuaagugcaugugcuaccacaucucaugaacaguacuagaguguauuaaaaugccugugguucuaccuauaguuaucuuuuaaaaggugaaauuuuucuuacuauuuguagaagaaaaaaagugacauaauaauuuucucccugcccucugccucugagaagcuguggugugcuguaggagucaauuuaucugguggcaagacaagagauggcgggucuguuguuggagcgaguguauuuuacaaggauauugcugguuuggacacugaaggcaguaaacagcggagugcgucucagaguaguuuagacaaguuggaucaagaacucaagguaaggggguggguggguaugggggacuuuugguauagcauuggaaauguaaaugagcuaaauaccuaauaaaaaauggaaaaaaaaaaaaaaagaacucaagguaaguacgcacugacaccugacauccugaucaaugaguguaagacuucagcucuuuaaugcaaaacuugucugaggcagccuaugguggggaucaaugugcacuuauuucccccaggugucccuuuaacauccauuacauugagguauuauuuacauauauucaagugacuacaauuccguugugccaaauguauauaaccacuacuacaaaaaagacauagacuauuuuuuaauugccaaccugcuuuaauuacuaaguuuuaauccagaaauauguauaaacaauuauauuuugacccuuccaaaaaaucuugaaauaauguguuauaguauaagaacacagucuuaagaauauuugcacauucauauaauuuuaaacauuuuccucugccuacucaggaacagcagaaagaauuuaaaaaucaagaagaguuguccagucaggucuggaucuguaccagcacccacucaacuacaaagguuaucaucauugaugcuguucagccuggcaacauccuagauaguuucacuguuugcaauucucauguucugugcauugccagugucccagguaaagcaaaacucugucuccucccucccuguguucccugcaccuccuuuucgguagagauggguguggaguuauggaaauugauaagaguuguguuccuguguuugugguuacagacuuuauguucuaguaagagaugauuuaaaauagacuagaagccauugaauaacuauguuuuuuagcuauuuaaaaaucaugugaagaguauuuuaaaaaauggcacuaugauuccgcgugguaguggcacacaccuuuaaucccagcacuugggagguagaggcagggucucugugaguucaaagcccuguaguucagggcuacauagagaagcccugucucgaaaacaaauggcaauauguagggagagcuggcugauagaggaggaggaaggccagcugaaguccuggaaucaauauguaaaauuaaaacaguaguugagaaauauuagucagccauaaaagaaaugacacucuuccccgccccacccccuguuauuucaugugguugaaauacuuuuuuuuuuuccccuugagacaaaguuagccugaaccacauaguggauugugucuccaaaagaaaacaaaaaggcuaagcugacaacuuugauaucauuaaaaaaaagaagaagaagaagaacuuuaaagcugggugauggugacacauuuaaugcaguacuuggaaggaaagggcaggugaaucuccaaggccagacugggcuauagaucuuucaggccaaggcuacauaaagaaacucucucucaaaaaauaaacaaacaaaaaauuaaauaaaguaauauauuuuaaagugacaaaaauaaaaauggcuuuccauuguaaaugcuuaaauuuuuuuuaugccuuacuaauauuuuaagccauugcaugucuuuuaaugauagcauauagaagcccaucuuggcaauaauaauaguaguagucauaauaaguuaaaaacuacuuguuuucuuuuguccuuuuguucuuuucuguuuguuuuguuuguuuuuugagacaggguuucucuguguagccuggcuguuuguucugaaacucacuagguagaccacguuggccuugaacucacagagaucugccuguuucugccuccugaguacuaggauuaaaggugugugccuccaccauccagcuaaaacugauuuuuaauguauuuuuauuuucuguguaugaguuuugccuguauguauauuguguguguaucagcugucuguggaggcaucaaaugcccuggcacuagguugacagauagucgugagcugcugaauugaaccaugguccucucugcaagugcuuccauuaaccuaucgcucuaguacccuacccccuccauuuuuuuuuuuuuuuuuuuugagacaggguuucuuuguguagccauggauguccuggaacucacucuguagaccagguuggccucagaaauuuaccugccucugccucccaagugcugggauuaaaugugugcaccacaacgcccagucucaccuccaaauuuuuaaagaagaaaaguuuuauuacauuuuaauuauuuugugugauagcagaaaugguaucauaccacaaugcccauuaacucucaggaguugguucucuccuuccauguagguauuggggaucaaauucaaggccaucaaucaaucaggcuugacagcaggcaccacuaucuguugagccaccacucucuucccucuuuccugacuugauauuagauauuacuuguuuuuaacuucacagagcaaagguguuccauuguuuuucucagaauguacuuuguucaauuucuaauuaguacgaaaaauuucuugagaagucuauguagguaggauccaagacaggauuuccaggucuuuguugaacacagugaccuaagaacuugcucuuaucaagggguaaugccaggacuauaauuggcucuccuuagguagauccaucuugaucuuauuugaguaaauacuguuggaacuugagaugucgauauauuagauccuuuuagauuuaaccuauuucuacuuuggaaaaaaagucauccaguguuaucuugacauucaaauuugauaagauauuucucauuauaauuuuaaucuuuguccaaauaaugaaaacuacccagugaacuugggagugucaguagaaaacuagaaggcauaugaguuacuguuccauuuaaguauguaaguagaaggucaggugugauggcauaugccugucaucccagcacuuaugaagcagacagaggcagcuagauuaacaguugaaggccagccugacccuauagagcagaauucugucucaaccccuuccccaaaaaaggauuaaaaaucugauaaaaguauaaguuaauagguauaguuaauaaaguucacuugaaucagucuguuuuguguuuggaaggagucaagucaggauauuaacguugaauaugaugcaugacuuacauuauuuuuuuuggccccauuuguuaacugguuguauuauauacuaguuaguugaccacugaucauuuuucuucuuuacuuacuguauaaauaguuguuaauuccugaaaugggacccuuuucagucuuuaaacuuuguagcuguuuuuauugugugugugguguaugaagaggcugcauaugccguggcacauggauggaagucagagaacuucgugaaguugaugcucuccuuccaccuuaaacaagccccagggaucagacuuggggcacugggcuugggcagcagaugcuuugccaacugggcgucucacugucauuuuuucuguuuugugguauuauggcuuagccagaagugauggacaccggguuuugggaggucagccuugauuacauacaguucaaggccaaaggaccaugugagauauugucuccaaaaaccacacaccccugcuguugucuaacguuaauggauccauauuauaaauuccuuuacaauguucuaaauaauugguuauuguguguggaaguucacacaugccacaauucauguacagaaacgagaggaaaacuuuugggaguugguuuuauguuccuacugaggguuauaagaaccaaacucaagucaucagguuuguauaguaaauauuuuaccuccugagccauguugccugccaugucucuuacaaaacaaaacaaauagagguaccuuuaacauguuuuucauuagaauaugaacuaauagaaauauuauuuuaccucuaaauuaauuuuuuguuuuaucaagauuacuuuaaauuaauuucacacugucuuguuuuuuguuuuguuuuggagacaggguuucucucuguggcccuggcuguccuagaacucacucuguagacuaggcugccucugccugccgagugcugggauuaaaggggugcaccuccaccacccagcuaacacugccuucuugaugguguauucuagcuguacgggucaccuguuuauucuuacuucaaaccuaaaggagcuuuacuagaaagaagcugccgcuuguuuacuggguauuccaacaaaguuguuuuguuguuuuguuuuguuuuguuuuguuuuguuuucaggagcucgggaaacagacuacccugcaggagaagaacuuucugaaucuggucagguagacaaagcgucauuguguggaagcaugaccaguaacagcuccgcagagauggacagcuugcugggaggcaucacagugguugggugcuccacagaaggacugacaggagcugccacuuccccaaguaccaacggugcuucuccugugauugaaaagccaccagguacaccuuuggagaaucuaaggcucuucugagagugccacauuacagacuugucaaucuuaaaguagccaaggugaaagaguuggaagaagaugcuguagugcccauguuagagaaagaacuguccaugucauuuugcaaugcccaggaggagucaguggaguggaauuccagagcagggguaguguaguaaaaggauggauagaaagacucauucagcauagagugguuucuguuuuuacagaaauggaaacugaaaauagcgaaguugaugaaaauauuccaacagcagaagaagcaacugaagccacagagggcaaugcaggguccacugaagacacuguggacaucucccagccuggcguguacacagagcauguguuuacagauccacugggaguucagaucccagaagaccucuccccaguguuucagucaagguaugcauccgaaaucaguaacuugagggagucugcacaaauaaaaggaaucagaaucaugucacauagccagaauacccacuaauugacauccuuagagggagccgaaagauguuuuauucgcuccuauuuauucuuucuggagauuuguccauccauuucuuaacucuauuuucugacuucuaaaaaauggaacaaguauauacccuuguacauacagaugcaaguguacgucguggucacuuucucuucuggauugcagucuccguuguggugcucuaccuugcaugcugucggccauucugcuuguucucucugugcuuacccccacuccaguuaccagaguuggccacuguuuacauuugugguuguuugauuuuuuuccaaaaugaacuuguuuaguucucaugcacguuuuguuggugacccucuacuuuaaaggaccguuuaauccagagccaucuaguuuguuuuuucuauccccuuagauacagcucuugguaaacugguuucuuuccaaguuuguuuuucuuaguauauagagcaaccaaaaauuuauuagcauuuaagucauguuuugaauuugauaacccaguuuuauaucauccaccuacuaugcccugacaaucugaaagaagagguuuaugauggaauauaaacauuuuacuguaauuuauuuuauaaaauuaauuauauauuaaaaauuaaauagcaccuccucugggaaugagugguuuuaaaacagaguauuucucccuucuuuguccuaccuaugccagaaaagaacuauuauaaacuuuaaaauaguaacagggccauaaauuuuccugucuuguuuuaguuuuuguuuuucuucuuuuuggcagccauuauuaaagucuuaaauguuaacugaugaaguuuauuacuauaucuuauuccccuuucuccauuuugcacuuccuaguuuauuaguauuucugguacaguuacugaacuacguaugcgugagcauuuaauacuggcauuucugugugagcauucaaugcugacuuuucugcagucuugguguucguucauuguaguaagguuaaauguagaaccgcucacuucuugaacaagcugaauauacuuaguguggguuuuuuucccuugugccucauuuucucaguaaugacucagauguguacaaagaucaaauaucaguauugccaaaugaacaagaccuugcgagagaagaagcucagaaaaugaguagucuuuuaccaaccauguggcuuggagcucagaauggcugguaaguaccaguguucuaacaugacauagccuuagucuuuauuucuacagaaaaugagccaggcaugauaaugcaggccuuuaaucucagcaugugggagguugaggcaggaggauugcaaguugaaggucagcuugggccacagaaccuuccauguuagccuuggcuaugugugacaccuucacaaaaacaaaaauucuaaguaagagauaaaugaaauguaguaaacauuaauguaaacaaagagugugguuaauacaaaaacuuuuauacccacacaaaacuagacuuucauuaguuuuaaaugguaaaccuuuucuuugucauagaauguucucuuuguguaauauucauaggaagaaagguaaauaggauuuuaaaaucugagucagacaugguaguacaugccuauaauuucagcacacagugagacagauacccuggcuuaaaauaaaacccugucucaaagaaaaaagugugcguguguauguguguguuuucuauagcaucugacuuagccugcgggccacagucagccacuggugugaaucacucugacauucaauaguucuauguaauagagacguaagguuauucaugaaauggguuuugugcagauaaggcauggggcaacccagaguuagcuggugucauuggcuaaugcuuacuauuaauagagguuguagcuuuuggguaaucaugcgcuucuguuuauguugauagccuguuuuucugucuuaggcacucauuuucucuccuccauuuuccccucaucucugucuuucugucucccucccucuucccauccuuccucuuucucuuuucauacaaaaguaauaagccauuuuccuaaaaacugaauguuauucugcuuuuuuucucgggggugccuguauuucuuaacuagaaacacuaaugauucugggccuuaacauucuugacuucacuuugcaguuuguauguccacucaucuguagcccaguggaggaaaugucuccauuccauuaagcucaaagacucaauucucaguauuguguaaguuuuguuuuuuaaauuauuccuuuuaaaguuuguuuguuuguuuguuuaaaggcauuugaugacauuacaaaugguuaugagccaccaugugguugcuggaaauugaacucaugaccucuagaagagcagcuaguucuaaugacugagcuaucuuuccagcccaaaacuuuuaauuuugauguaaaguagauuuaagacuaugaaagcuacuauguaucucaugacaaaucaguaugcaagcuugaaguuuuugcuuguuguuuucaaccaucaccuuaguucuuuucuauugcucugauaaaacaccacaaccaagaaaacuuacagaagggaugauuuguuugggcuauggaucuagagggauaaaagucaacuccauuauaacagggaagccuggcagcaagcaggcuggaggaucagggucugguacacucacaucuaggacugcagguagaaagaaagagaggaagcuagcaaugaugcaagucuuuuaaacucugaaagccaccaacuggggaccaaguauucaaauacccauaacuauaggagacagcucuuucagaccaccacaaccaucuuuguuuguuuugguuuuuguuuuuuucgagacaggguuucucuguguagcccugguuguccuggaacucacucuagaucaggcugaacucagaaaucugccugccccugccucccaaaugcugggauuaaaggcgugcgccaccacugccuggccaccacaaccaucuuaauggaacuagaggaacugaaugggaaugauguucuaaagagggaaguagaguacaaaauguuuaaauagaagacgacuuuccagauugaaucuucgcuuuagaguucuguguuucuuucagacuauuccuuauaguucaggaauacauugauuggaacauuggcuugcuaguuccuuuuccauagguugacaggcaaaauuccaacaguuuguuccuaaaucuauagguauagcaguaaaucauuaauccaacaguuuguuccuaaaucuauagguauagcaguaaaucauuaauccacucugagcucccgacaggcuuugcaugcucuccacccccccaccucacccaagagcuuuggauucacaaaugaaagacacacacacaaacacacaaccuuuauauuuuugauaugccuugauuagugcaaugguugggcacuuccaaaccuccccauggcuagcacacacuccccuccaguauucuugaauuaauacuugcuaaaucuauauuuuaucucugcuaccccagacucaaucuggggagugaccacugggaccacuuucccguauucuuacaugucagugggccuuuaauuuugaucuuucugcuucccuaucauggcgaauccguccuacaccccucucauggaggaaucccuucuccucuccccuguuucuugccugagaauccuaaaaguccugccucucacccugccuagccauugcccauuggcaacuuuauuucccaaucagagccaacuuggggcaggcuuccuuuagccuacgugcaggacauuguaggcagguuuuuugggguaacacaauuagcaugaaaaaacaagccacuacauacagaacuaacucuguuccagucaagaugugugucuggccuggagaguuacauugaggugugaugaaaggaggcaccuugggcuagaaagcaacauccugagauaaccacacaugcugugcauuaguuucugugacugcucccauaacaagaggcucagagugaguggccacauguucaaguauuggguuagucccucaucacaaacuggccuuggagagggcugcaccagcucaguaacacaugguccauccuguacuccugaguggagguucugaaauccuuuucccuauuugcagacaugugaaaggaauuguacuaguggcccuggcggauggcacccuugcaaucuuccacagaggaguugguaaguuuuuauaaugucauacaccaaaauguugcuuugcagagcauuuucaaguagauuggcuuacugcauuugaaagaaaugauacauaaaaagagaaugaaaguuuuaagugaaauauuuguuauauauuaguaaauauauggauggcucuguaaagauuuauauuagguauuucugauggacaaguguguuuauugcaaugaacaaugaagaguuuagcauuuucucugcccguauuuuauauguacauuaucucuguauguaugcuuaugauguauguacauaaguguccuguaagugaauaugggcaugcauuugcuaagggauguguguguugugacagaacagcuuuguguuaguuguugccuccuuauguuguucuagauagggucuuucguuauuuacuaauguguauaccaggcuagcuggccuccaaguuuccagaaauucuccuguuuccgucuccugggagaacugggauaacagaugcaagcuacuauccccuguuuuacauagauucugggagucuaagcucaguucuuuauccuugcccaacaagcacuuuaucuauugagcuaucuccccagcucucugaugccuuuauguaguauaauacagcaacuuuuucauauguuuaauuagaaaacauuugacaaggaucauuuuuuaucccuuuuuuauuuguuuugagacaggguuucucuauguagcucuggcuguccuggaacucacucuguagaauaugcuggccucagauucacagaaguccacuugccucugccucucaagugcuggguuuaaacgucugcacuaccaugcucagcauauuuguuugauuuuaaagauuuguagcccuggauagccuggaacuuguuguguuaaggcuggccuuaaacucacagagauucacuuguuucugccuccugaguggagacauuaaaaguacaugcugucacacacagccuuaucccuuuuuuaaaauuuuauuuauuuuuauuuauaagcauugauugauauucugccugcaugcaugucuguguaagaguguuggauuccccuaggacuggaguuacagagaguugugugagcugcuauaugggugcuagaaauauagcccagguccucuggaagagcagccagugcucuuaaccucugggccaucucuccagcucugcccuaauuuucuaaaaauuaaaaauaauuugucuauuucauuuaagaaaaauuuuguuuuguuugagagucucauucuauagcccacauuagccuagaguuagcauucuauagaguuaacauucuauagauuaacauucuauagaguuacauucuauagaguuacauucuauauagaguuacauucuauagaguuacauucuauagaguuaacauucuauagaguuaauauucuauagaguuaacauucuauagaguuaacauucuauagaguuagcauucuauagaguuagcauucuauagaguuaguuaacauucuauagaguuaguuagcauucuauagaguuagcauucuauagaguugcauucuauagagaguuaacauucuauagaguuaacauucuauagaguuaacauucuauagaguuacauucuauaaguuauauucuauagaguuacauucuauagaguuaacauucuauagaguuagcauucuauagaguuagcauucuauagaguuacauucuauagaguuaacauucuauagaguuacauucuauagaguuaacauucuucucaccuuaaccuuccaguacugaaaagggggugugggggaggaguguaagccgggcgugguggccaugccuuuuaucccagcacucaggaggcagaggcaggcggauuuaaggccagccuggucuacaaagugaguuccaggacagccagggcuauacagagaaacccugucucaaaaaaaaccaaaaaaagaaagaaaaagaaaagaaaaucuggaguguaaaacaaauaaauagaugauugauugauugcuagauagauagauagauagauagauagauaggaaagaaaaaaagaaaagaaaggaaaagaagagaagagaagagaagagaagagaagagaagagaagagaagagaagagaagagaagagaagagaagagaagagaagagaaauaugugcugccaagccuggcuucaaaacauuauuuuuagauuuauuuacuuuuuuuuuuuuuaaaaaaucuauguguaguuuacaugcacuacaaauauguauguuucuaacagaagccaaaggauaucagauucauuggaacuguagcuauaggcaguuguaagucaucugcuguggaugcuaggaaccaaacaugguuugcaagagcagaaagugcucuuaauuguuucuagcucauaagcccccaguuaacuuucaauugaguacaguucaaucauuuuuccuguuacauuauuucuacaaccauagguaaagauguagugacuugagaaagucugucucaaauagggugaauuaaggaaaauauguaucauuaugacuaaccuugcuaugugugucauccaaaaauaauuauccacuagguugaaggucaagcaaaaaggaaaacuaugugaaaaggaaaacuaauuguguuuuaaugaaauccucuguccuuauuggcauacagauguguuaggggaugauacuuaggcuccugggauggauuuauauguagagauugcuuguuaaugacuaugucaucacagagagaaggcuguauguugccaucucuggucuucucuagaauuuucuguauuuaaacuucacaagcugugucuuaguuaggguuuuacuuuuaugaacaggcaccuugaccacgucaacucuuacaaaggacacacauuuaauuggggcuggcuuacagguucagaggcucaguuuauuauuaucaaggugggagcauggcagaguccaggcaggcacagaacaggaggcgcuucaaguucuacauuuucauccaaaggaagcuaggaacagacugaauuccagguggcugggaggagggucuuaaagcccaccuccacagugacacacuuccuccaacaaggccacaccugcuaacagugcuacuuucugggccaagcaucuucaaaucaccacaaccucuuaugagaaauucuguugucaucuucuuuacuugacaguaaugaaggaaaccgaggccagcauuuuaaucacuuacucacaaacccuuagucagugaaagaauggaaaaagugaaauaauagaaguuuugauaaguagaauaaauuauauuugcagaauaaaacaaauuuuguauauacacacacacaggaucaauaucaagucuugcuauuggguucaaaagagcaagagauuucuaaggagucaggauuaucuaaagguugacuaucagcucaguaagauguaauuaaugcuaaagccuccagaaauauagugucuaucacagggcuggugaugauccuacauaugcagugggauucaauaaaguggaauuaacaugaaggauuuguaaagaaugauagguauaacauacacaagaaugcuugguuugaaaagauacagaaagccagguggugguggugcacgccuuuaaucucaguacucaggaggcagaggcaggcagaucucuuaauuuugaggccagccuggucuacugagugaguucccgaauagccaaggcuacacagaguagaccugugucgaaaaaucguaacaauaaaaacauugucuuuccauuaggcaaaacuacagacuaaugggugauuaaaugcaugugucauguuagcccucaguguuuuuaauuucucagcauuuuagauuucagauuuauaaauuauagauacccagauuguaugaauaauuccuaacacguuagcaaugaguugccuucaauuucuaccuaagaaucuagcacaaugcaaguaaggagagauaccccccucccccaaguaacuaucuguucuugugcauguuaugugcagguacaugcuacuagagauuggacccagagucuugcaugugugacacaaguacucuaccucuaagucauccccaagcccuaaguccauuuuaguucuaaaaaggcuuaucauauucaaauaaacuaugccugauuugucacaaaacugcuuuuucuuuuaaaacuagaucucacuaaguauccaugguuagccuggaacuuacuauauaaaccaggaugaccuugaauucaaagaagucugcuugcuuaugacucccuguggugggauaaaggugugcaccaccauaccgaacuacauuaucacuuuuggaaacauguuuuaaagggaauccaguagugaguggcagguuggagcagauguuuugugaucucuuccagcuuuguagcuuauacagauaaagguauacuuaauauauggugcuuugaguaccucaucaauaaaaagugggacgauuaacuauaaucugcuucuuguuuuaaagauggacaaugggaucugucaaacuaucaccuuuuagaccuuggacguccucaucauuccauacgaugcaugacugugguacaugacaaagucugguguggcuauaggaacaaaaucuaugugguucaaccaaaggcuaugaagauagaggcaaguuagccuauauuuuggguaauacugaauugguguucgcagagagaugcuuucccagcucuguguuuaagggcacuuuagauagagcuuuggaugucuuagcuuccucuaguccuuuacuucccuugucguguugggcuaugagguuaggaaaugauggggcuuugguuuuguguuuugguugguuuugguucuguuuuauuuuguuuuuaaggacagaggauucauacauaaagguuuguauguauuuguauauguauuuuauuugaguauguguuuuuugagacaaagucuaucuacauagcccuggcuauucuggaacucacuauguagaccaugcugaccucagagauccacuugcuucugccuccugagugcugggauuaugugugcaccacaugcugguugacuuugugguucuugauaugucuagucauacaaggauuggguugagaggauucaugaguuccuuugccucuaccccauguacauucagaaucaucugaauauguauagcacgcugaaaaauaacauuacagugaaaagcuuuauaaaaacaggauuuuaacuuuuggucacaguguauccauucuuacuaucuuaagaaaauuacaauaggaaaguuuuaagcugagacuuguauuucuuccuggcccaugucucauuuucuuccuuaggaaucuucccguuagauagugcuagauaugauagaacccucccauaagucuagcaucaugaggcuaagguagccuaggcuaccccuucugccaaauccauucuacagguaaccauuugguauuuauuuuucauggcugcuccuuauacagcgauguggguuccuuuuaguuuaguuacccauaggaucuuacuuuucauugcucuguaacaacaccaaauccugacaucaccucuuugaacgccauacacagucuggauggccggcaguguuuauuuacgguaauccccuguauagugcugaaccagcuccaccugguucuguuguugucucacauugagccacaaucucacucuggccgugaacucacagcaggucuccugucucagacuuccaagugcuaggauuacaggugucagucaccaugcccaacuacuacuuggucccuuguuuuuauuuggggcggggcggggggagauccgggggauuguguucugugguggaagaacagucauacaagauaagcacauuuagacuccuuuaauaaacagucaucagauuguugugcagauuagcagguuuugguuuuuuguuuuuguuuuuaauuuuuuuuaacaugcuuugguguuuugccucaauguauguuuguauugagaauguuggauccccuggaacuggaguuagagacaguugugaccugccauguaagugcugggaauuaaaccuagguccucuggaagagcagacaguacucuuaacuacagagucaucuccagccccaguuuaguagguuuuaaaugacuuucuaugagacaaaaguaauuucuuuagucagguguggugguacaugucuuuagucccugcacuuaggagaaagaagcaggcagaucucugaguucaagcucaaccuggucuacagccagggcuacacaaggaaaccuuguccugaaaaacaaaacaaacaauaauuucauaauuuaacaucucuucuagaaaucauuugaugcacaccccaggaaggagagccaaguacggcagcuugcaugggugggugaugguguaugggucuccauucguuuggauuccacgcuccgccucuaucaugcacacacauaccaacaucuccaggauguggauauugagccuuauguaagcaaaauguuagguaagcuuccaaaauguuuucuuuuugaaaaucagugggacugcuuucuuuugguuuguuuaugcaguguuguggcacuaacuaauauauaacuuguauauauugagcagauggucuacaacuacaguugaacuucacucuccucuaaugcucugagagagucacugaauaguuaacugucaucauuggaaguauuggacagagaugccaaugaauagcauguucucgacuagaaucuguuuugguuuuuguuuuuuuauuucucuccuccuuauuccuuacaucuuuugaucaccuggaacucugucaaauuugaaacuacuuaaagucaaauacuuuaucuugaucacuaucaccuugggccagguuacuguccuuucccccauuugaaaacuuuguguuuccuaacuuguauucuucuuucucuauucuucuguucuauacauaguaaauaaugggcaaacauauuuugaugcacuuugacucuagccuuuaggcuaagugaccuuuggaccaccacaggggacauuacauggucuagucuaguuucccuucucagucuacccauauugacaaguuccuuccauuucagggccuucacauguccuguguauccucacauguaccguguauccucacauguacuguauauccucaugugcacuaugugcccucacauauacuguaugcccucucauguacugugugccgucacauguacuguguauccucugccuugaaaguuuuucuuggucuuuguuuacuuacucucaggucuucugucauauugaagagggaccuuuauuuagguccuauauuuaaagaaaacaaaacaaaaaaggaaagacagagucucacuguagcccagguuggccucaaacucacagagaccuuugccucugccucucucccucucccucugccucugccucugccucucucccugccucugccucugccucugccucugccucugccucugccucugccucugccucugccucugccucugccucugccucugccucugccucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucucugccucugccucugccucucugccucugccucugccucucugccucugccucucugccucugccucugccucugccucugccucaucucccucugccucugccucugccucucucccucucugccccucucugccucuucgagcugggauaaaagguguguguaaccacacccagcuguccuuuuucauagguuuaacaguagugugaaggacuccuguccuaaggaaagguugcuucucucaauaauuuuuacccuuuuuuggucauuggccacagagaagcuaacuaguuguguauucucuccauagaaucaagcauguuaaaagcaugcacacaugaauuuuagaguuguacuuugacucuugguuaaagauucuuagcuuaaagauggagaaaugguucaguauuuaagaauauuugaacauuggcugcucuugcagaggaccuggguuugguucccacauggcaguucagcaucuuuaacugcaguucuaggggaucugacacccaucucuaacuucagcaggcaccaggcaugugagugauguacauacauacauacauaugcagcaaaacauacauacaaucaaucauuaaagagacauuuuucuuuaaaaauugcuagcuuaggcugaacgggaauuaagauugcugcuuaugccaggcaguggugguacaggccuuuuguccagcacuugggaggcagaggcaggcagauuucugaguucaagcccaaucuggucuacagagugaguuccaggacagcccccccccaccccaccccuacccccccccaaaaaaaagauugcuucuuacauugcucgugugaucaggaccgaaauucuuuaagucacugauguuugucucaaauguuuccuaaaagugagagaaauuacaaaaauucuuuuaaaauauaaaaacuuggggcuggagagauggcucagcaguuaagagcacugacugcucuuccugagguccugaguucaauucccagcaaccacaugguggcucacaaccaucucuaaugggaucugaugcccucuucuggugugucugaagacagcuacaguguauucauauacauaaaauaaauacaucauuuaaaaguaaauauauuuauauauauauauauauauauauauauauauauauauauauauuaggauaccauauaaaacuuaggaagaacaaacaauguguugugugcauauauauauacugagauauauauacauauauauagagaugguugugagccaccaugugguugcugggaauugaacucaggaccucaggaagagcagucaguauauauauaugcacacaacacauuguuuguucuuccuaaguuuuauaugguauccuaauacuccuagacugacuuagagccuaagucuauaaacaagaaaaaagguauguuuuguuagcaaagauugacuuuuauacauguaaaaaaauuuaaagcaaauugagaaccuuuuccguuuauaaaaucaaaugacauuugauuucccaaucuagcaaacuccaacuuuugguuguuauugcuucccugugucuguuuggguuugauuuggguuuguagaucccuuaauugagguuuuuuuuuuuuuccuuuguacuuucuuucugguugauuaaguaaugccagccauauguagaauuuucuuuuuccauuagccuugacuugucaaacaauauaaccaauaagaguuugcuuugagaugaacaugguggugccuacccacaaccccacuacucuauuauaagcauaccguuugugagguaagggcagaaggaucacuaguucaguguuauucuuggcuguauaguuaguucagagccauucuagacgucaaacacacacacacacacacacacacacacacacacacacacacacacacacaccuuuauagcacacuuuuuuucuuuguucuuuuuaaaccagagacuccuggggauuuagaaucuugcuuuaguuucucaauaaaccauccuuucucuuccugcccuuacagguacuggaaaacuggguuucucuuucgugaggauaacagcucuuauggugucuugcaaucguuuguggguggggacuggaaauggugucauuaucuccaucccacugacagaaaguaaguacauuuuaaaauaacugucacaagucaaagaauugcagggaauaauuguauccagaauucagaccaaaggaauuguuuagauuuuggcaaaucugugacaacgcugaaaucaguuuacaaacuacagaaucagcuuguaaguauccagacuauuguccacauuucaauguuuucacuguaggaaacccuuuucucaauucaggagccagagcccuauuuuaucuuuguuauaaaagguccauuucucuugagcccuauuauaccaguauucagaaacacuacauuucauucaucguaguuuuaacucacucuggcuaauaguugugacuguaccauuuguuguauuagaguuguuuuuuuuuuuaaaucuugugggaaaaaucuuagaucacugacucuuuccuuguacugaagacaggcucucuguuugaaaggaauuuggcuuuauuauuuuagagaacagauuguaucuuguauguuccucauauguaucccaugacauugaucacugaucauucacuaaguguuuuuguguacaaaaagcacaggcaagaauaguuuggggcaggagggaugcccuaaguccaucaaauaaguuagcaaauucccuuguucaguggaagggagggaagaacaccagaagguggauuuggaucccuuaaaggcucuauguucucagucccuccuugguuuuggugcaguuccuuacaggucuacagguucaaagcacuucucaaacuuaacacaguccaagauguuugaauuaucuuuucuccuuaaaagaggguugcauuuagcuuaauuauuuaacggugguuucuuuuggguagacugagaaagaaaauuuuagaauguacuccacaucagucuuaggguuuugauucuguuucccuggaauggcuucauaaagucauaagaaaucaagucaucauuuuuugagcaaagguauuuauuuaucggggccuugguaggaacgguccauccuuuggugcucugccaggcuggcaugauucaguagggccauguagaagaggcucagugcgcucacaguaaugcuucuccuucugucgugcacccccccauguccccuuuccuccuuucucacuuuagccguaauccuccaccagggacguuuacuggggcuaagggguaagugcagauccagaaccaaacuucugucuggcuucuuggagccacucugaggcugucuccucgucucuagagcacccucuccaaugcuguucagugucaccuacucgcagucacugcauugcagcagaauuuguuuuuguuuuuguuuuuuuuacuuuaaauguuuguuacauagccaccaacugcucagcagcuuagucuacugaucaucuuuuguugcagcuaaacuuucuuucagacuugguuuuccuuccaauaaaaacaugaaacaucucuuaaagcugucauuaaucuacauuauuuacucuauuaucaaucauguuuuuuucauucacuuacccauggaaucagggguauuuuguaagucuagcuauucuauaggaauccagcaaacugucaggcaggcauaaauucaagcgucuuugugagauucuuuuaagcaaagcuguccugcuccuuaccauggggaaaaaaaucagaagaugaacuauaaagaucauauuuaagaacauaccuuuguacuauagucuauacaaugcuuaguuuccuuuuaauaaggacuaaaaacaaaacuaagcagauuuaacuaugacucaauuuugcuuuguuuacuauaaugguuucccucaacuuaauagaaucuuagucauugcuagacuggcaaaauccccuacuccauuacugaaguacuuaaaaauaacuagcaugcuguaucucucuccagcuuugccuugagcuggcguugcugcacuuacguuaucucaacuggcuguagcucuuagauaauagcauaaggauuaaccaguaaccucuugcaucaguacuaguuucuagagaaaaauacuugguauuugguuuuuuguugcagcaaauaaaaccucagggacuccagguaaccguccuggaaguguaauccguguauauggugaugagaacagugauaaagugacuccagggacauuuauacccuacuguucaauggcacaugcacagcuuuguuuccacgggcaccgggaugcugugaaauucuuuguggcagucccaggugaguuagaucauucuguugagauauccacguaacugugucugucuuccuuguguaucacuaccccuccaaacacuaaauuacuaggauuacccacgauuucaguauaauaccuaaggaggcucuauaaaggagauaugauuagaguaaaauagauuacuuggaugaaguuauuuugcaaccucuccucuacucccuaaaacagauauuuuggagguauugcuaaguuuugaaaaucaaugguaauauuuugucaccauauauuauucaaaggcauucuuggcuacauagugcauuuaaagccagccugaaacaccacagucuaccuagauagcagaaacuaguuugaagcucacucuauagccccuguugccuuugaauucucaauaccucuaaucagccuccugggugcuagaauuacagaugugcuucaccaaaccguguguguguguguguguguguguguguguguguguguguguguguguguauguauguguguguguguguguguguguguguguguguguguguguggucuauaauaugcguuuaugcaugcauguaugaaggcugaagucaauguccggugccuuccucaauugcuuuccaccauauuuuuuagaguccuauacugaauccagaacucacugauuagcuaaacuggcuagucagugaguuccagggaucaccuguuuauacaccuguaccuguaccugcaccugcaccguagcaccaguauuacacaugcccaccuugcccaucuuuuaauauauaugcuagagauccaagcucaucuucaauuguguaucaaggccuguaccaacugagccaccccaucccccaauguugaaccuucuuauuguauauaugaacuuuucuuuuguaguauaaaucuaaaaguggaacuaguaauauugcuauuugucauaggccaauuagccugaaggaugaaguuguuguauuaacuucauugugaaugcuuugacuucuauugaagacucuacuguggacauuuuuucuagcaggcuuaauggauuccagaguaagcuugaguaaugcaguaaugaaggccugugaggaucuuucacaccccccauccacuuucaauucaaaauguaaauuuauagugcaucacaucauaggacaguguccuguuagucccuagaggcuugcagucugugagauuugaccaaaggacagcagguucugaaaagggagaaaguaccuccagucaaagcgucucugucccucucucucgcaugcacaccacccacccuucuggggauuggacauuguuccucacacaggcuaggcaaaugcucugcuucugagcuacaugcccagcccacagucagagcgcucgagaggaaagaggaacgguggagacuguucaauuguucauauugugaauaauauguaaaaauuucucucuucuaugacaucucauacucaaagauucuaucuuagaacuugaacuuuagaacaaaugacacauuuagcagcaaguuuacuugcauacucuuuuuuuuuuuuaagauuuauuuauuuauuauauguaaguacacuguagcugucuucagauacaccagaagagggugucagaucucauuacggaugguugugagccaccaugugguugcugggacuugaacacuggaccuuugcaagagcagucggguacucuuacccacugagccaucacaccagccccuacuugcauacucuuaaguuaaaaguaagacauacuuuucuuagcuaugaagaaaagcucauaaauuugaaauauauuuaaaauauuaugauauuauuuacuuuucuauuauuauaaaaacaugaccaaggcaacuuaaagacuuauagaagaguuccagaguauuggaguccauuauaaucaggacaguguaacagcaggaagcugaaaauucccauaucucagugcucccacugagcuuugaagauuaucuauucuuguuuacuuuauaauugguguuccuaguaccuugauguauacuuugugugugugugugugugugugacaagauuucauuaugcaucuuuggccagccucaaacucauuaccuugagauagcuucauuaccuucaacucacagagauccuccugccucugccuccugaggccuuagauuaaaggcagucagaaugcugucuaguuuaacuuuauuuuugaaucaagauuucuguagccugcacugccuugaacucaggaccauccuccuacacccuuccuaguacuugaauugcaaucaggaaucaaccaugugauuuauuuaauuuugaaaagguauuuaaaaaaauagcauucccuagcugcaucugugaugagugauauucacuguucuguuucuguauaaaacaggucaggucauuagcccacaaaguagcagugguggggcagaucuuacagcugacaaggcagggucaucugcacaggagcccaguagccagacgcccuugaaguccaugcuugucaucaguggaggagagggcuacauugacuuccggauggguaagucuuugguucugggaggucacuccaggugacggagacaucacacuuaugaugaugacuuaggcaugcguucucguggaaucguuuacguggagaaggauuuugcaugguuuucugccuacauguaucuauguauauguuucuuucauacaaaaaauaaucauuugaaagagcauuauaaacugcaaauggcccguguuaagguuugugugaagaacugaagaauuguaauuauauggcccugagcaagccauccacccucgcagaaccuuuuccucacccacaaacuuaagaaauaaaaauaauucauaaaacuugaugucaaaaauauuuuaucuauucacuuucucaccuugugccuaucagccuuaaaauuaauauguggaaaaaaaucagucucucauucccuuuuaauagguuugguuuuuuuuuuagaugaggucuaacaugcuguccuggaacugacuaugugaccaggcuggccucagauucccagagcucugccugccucuuccuuccaagcacucggauuaaccacuuccuuccuuccaguagguuuuauagagcagugcagagcugagauuguuaaagguugcuacacugcuguaaaugucgugguggagaguugauagcucuucccauggugggaagauaagguagagaagaaacuuuagauuacugcccucugaugcuggacaagagucggcaucagagggcaguaaucuaaagucagaggcgguaaucuaaagucagagggcgguaaucuaaagucagagggcgguaaucuaaagucagagggcgguaaucuaaagucagagggcgguaaucuaaagucagaggccgguaaucuaaagucagagggcgguaaucuaaagucagagggcgguaaucuaaagucagaggccgguaaucuaaagucagagggcgguaaucuaaagucagagggcgguaaucuaaagucagaggccgguaaucuaaagucagagggcgguaaucuaaagucagagggcgguaaucuaaagucagagggcgguaaucuaaagucagagggugguaaucuaaagucagagggugguaaucuaaagucagaggccgguaaucuaaaaucagaggcagguaaucuaaagucagagggcaguuaucuaaaggccucauuagggagcaagcggcuuaguggaggguuagcacuuccugauuuaaaaaaaaaaggcuccucugaggugauucugucucuuuugcuuguuguauagguuuguuuguauuucaguuucaauguuggguauugucauacauguuagacaaauauuuuaccacugagcauaucauauguccccaguuugacuaaagauuuuaaaagauuaaagccaucuuaaagaaaaucuuuuaaaaagauaaaagcuaagaguauauauacauuucuuaucuagaaaggaccaugagaugaguuaugggagaccuucauauacuguauauacuuguguguauuuagacaggaagaaggaaaaaagaaauagaaagcauuuccccaaguaucuuaguuaggguuuccauugcugugacaagacaccaugaccacagcaacuguuauaaaagaaaacauuuaauuggggcugguuuacuguucagagguuuaguccauuaucauggugggagcaugaugaugcacacacagacuucugcugcuggagaaggagccaagcguucugaucaguagacagcagcugauggagcuggcuuaagcaucuaauaccuuaaacaagaccaguaaugccacuuucugugaaucuauguggggcauucucauucagaauaccacaaguaaaguuuguguuuaucuuuuaagcaaaggaggauugcagaacuugaaauggaggagcaaugugguuagguuugggcaagagauguggaaaugagugaggaaaaaggaugucugagucagcugguaaugguggagacagaguaguacaauggggaguccuuagcuaguagagagucauguguucacucagagcacugucuaaaugggagcagccagaaaacagggaagggaaaagaaguacaaguguuugcuugcuaaaaagaaacacacuagucuaaacacagaagucuuaguauaucaauggcuugucaaacagaagcuauuaaaugcuuguagagaguacacugaggaagucugucacaguagaaaaugcaggguccuauugguggcagugcaccacauguggucagaagaaaccagagcaugaagguugaaggcuucugucuuacuucugggagacagaaauauauuaauguaagguuuagagauggaugccagcaagaacagaagaguuuuaaagcauuuuaaguaauuaaaaacuggcacaggaauguuuuauagaaaggaauuguagggacucuacuuagcuagggugaugguugcuuuuucuuggagugcaguguggcaguuggaaucauacuaaagaauaugcuagucggcaucucugcaguuucccaccuccaccaaauauuuuccauugcagagucugcaaauagcauaaaaauugcuuaaccaaguuuaacaguaucucuaggaauucagccuggaaaauagacuugguuuuuaagcagacgcuaauuuuaauagugaauauguuguuuuaaaaaagaaagcaugguaguaaauguuuuuaaaucucaccgcccugggaggcagagacagauggagccuggucugaguagugaguuccaggacaccagagguacaaagugaaacgcucucucaaaaaaaaacaaaaacaccuugaauuucaucuuguucguguucuuauucacuuucuguaauguuuuagcaauaauguauucagaagucccauacuuguaagggcguggcuugaauuacaggauauagagauccugggaaacaagauaguaacacucuucaaaauagcuuaacaggcaagcaaccagcaaccuuugucucugccgcauagucuucaccacugcagcuugcuguuguuguuuuuucaaauaaggucuccgguuguguggcccugcuggcuugcaauugacucucuagaccaggcuagccuagaacccaccgaaguuugcccaccuuugccugagugccaugauuaaggguguacucuacaacaucauuguauuucuaaaauauaagagccaaacuuggagcuagaacuauggcuuagugguuaagaacccuagauguucuuccagaggacgcuguucuauccccaguacacacuuagagguuuauuccaauuguaugggauguugauaccuucuucuggcuuucuugggcacugcauauacaugguucauagauauucaggcaaaaauacucauauacauaaaauaaaaauaacuaaaccuuaaaaaacaaaaacagcugggggcuugagagaaaacucagugguuaagagcacugucugcuuuugcagggguccugaguucaacucccagcaacuacauagugacucacaaccaucuguaaugggaucugcuguccuuuucugucugaugcaggcauagaugcaaauagagugcucauauacauaaauaaauaauuuuuuuaaaaugcagcugugcgauggugguauauaccuuugauccuaggcagagacaagcagaucuguaugaguucuagguuagccuggucuacaaagugaguucuagaacagccagggcuguuaaacagagaaaccuugucuugaaaaaccaaaaccaaccaaacaaacaaacaaacaaaaaaagagccaaacuuauuuuuuucuuaaagguuugguuauauuuuaguuggaggaacuugacuuuugaccugagcaugcuuacucuguauuuugacauuaacaugaaaaagcuuugcauauggggggugggagaggaagauguaggggaaaaugguuugcagagaaaagugcauauacucuauugcuucuguuccucuauuuuuagucaauggugucauuuucuugugcuaaacucgaaauuccagugcaucaguagaauaucuuuguuucuuagugugcacauuuuuaggauucugcugaagaauucaucccacuaaacaaguugucagcuagauuguaccagaauaaccuugcucugcccagcagagcugacugcuucgagcuuguggagaggagcggcaguaccuguccaguacucauugucucaguuggagaauuuaccccaggucaccaagaaucagcaggauuucuugggcuagagagaaauuuuaauccagcaauguggcugcucugacaagggaucacauccaaagauauccggcuggaauauacacuuucaguccaucuggcuggcuuacagacaagcacuuaauacacaccuuuaauccuaacagugaugucaaauugcugggcaggcagugaugaaucagagaaaggucugauagaaugauucagagauaggcuaugcccaacucucaaaacagucagcaaagagaggcuagagagagagagagaggaggagagugucaauugaauucaguuuaguuuggaacaguucagaugguagaguucaggggcagucuuuccaagcagaaugauucagucagaagcugagagaagcuaauuugagucagucagcguggggaggaguuugacccagaacagcagaauugaaucagccagccagaguucagaaagagcgagaaagaaugaguuuauuucauaguaaguuucagaggcugaaacguucuaggaggccuagguuagcagguggaggcuggaagcgaagccuucaaggcucgggcuuggagaagauucgauuguauagaggcgaagcuuccgggccugggguaguuagaacagagaaggacauucucugggcuccacccaggccauguagucgcacagcuugagucugcuccuacuugucacuucaucugaggagacagacgugacaucugcagugggccuuauuuaauaugcuccauauuuguguuuucuuaaauugaaauaaacgaguagaauguuuguuuuggccaaacacauaacugaguauauuugcucuuuucaucucccauuccuguuaccagugaacguugugguccccacagauucauuuguuugacugcuuggccauagagaguggcacuacuaagagguguggcauuguuggaguaggugaggccuuguuagaggaagugugucacuguggaggugggacuuugaggucucauaugcucagaguagccaguguagaauccggucuccuccugguugcuuucguaucaagauguaggacucucagcuccucuagcguuaugucugcuuguaugcaccaugcuuccugucaucaugauaacggacuaaaccucugaacuguaagcuaaucccaacuaaauguuugccuuuauaagaauuuccauggucaugaugucucuucacagcaauaaaauaaaacccuaagacagacauguuguaauacuguccagcauacuauugugaacuagcuuucguguguguguguguguguguguguguguguguguguguguguguguauggcuacccuuggaggccaaaagagggagucagaucgccugggacuguaguuacagauggcuaugagcugccuaacaggggugcugagaaucaaacucagguccucuggaagacuaucaacugcucuuaaccgcugagccacgucucaucuccccggcccccugguguucuuucccguguucucugcaguagaaaucaaacaugcuuugugcccuccuaggcaucacaugcauuguguuucuaggccaacuaugaguccaauacacaucaucuguauuccaccuaaccucaguuuccuuaugauccuuuaggugaugaagguggagaaucugaacuucugggagaggaucuuccacuggaaccuucagucaccaaagccgagaggagucaccugauaguguggcaagugauguguggcaaugaaugagucugugagagacagacgaggaugaggaaguugccucuucugcaugguuuauuuucccuuuuuccuuuauuuaaugcucuuuuugugaaagacauuucaccacauaauaaugugagcauuuuccccuguuaccuuuauauuacacaaucuguucuaugguaacaauacagaggagcgagcuaguuuacugcaccaguguuaauaggaaauuucaguauaucaugaacaaaucgaagaagguuuacuuucuguaaacugauaaauuacagaaagcaauccagaugugguuugcucugccacagucuaaugucacucacuuaauugaugaggccauguuuuaccugucacuaauaauggaacuaauggaaaagacuuaauaaaugaaauuguaccaugaaguacaauagaguuuuccccaguguauuauagaauugacgcacuaauaacagacggauuaucacgauuugucugaaugucccaagagcgcuaagagcuaacuguaaaguacuuuaacuuucacuuucaauucugacaaaucuuguuuauaugguauauaaaacuuuguuuucaucagacucgggggguuuuauauuaaagaaauuaaggcuacacuauuuaaauaaaauuucuuguuccugucucauuagaacucuaaaguuuacgaagccugcuucucugaauauucucauauuuuagaugaauuucacccauuuucauacugacauuuaagaaguguauuaucugacguuuaggaaauaaccugggaaguguggaggacacuucaauacuggaaggauggucuaaaaggaaauuauguuuugaauuccuuguccuagagaauggugguaguggauucaguuuuuuccauagaaaaaaauguacccauuagccacaugucccuaggcugcucuuaaccuaucacggaggggacacugugguggccguggauucugccucguuugcugagugcuuaaugaguaggaaaggugauuuguuuuauucuguauaaaacuaccaaacaccuagugcuugcuugguauaacuacucuucagcauuuguucccugauaaaaugccaucuucaaggaagugcggugggaaagcaggcagagucugcaccugucuccauucguggcauccaucugagaaaguggggucacaucuagcuuuaacugguaaccuuaggagguuucaaaaaccaugagcuacaggcuugcuuuccucucucaagcuuccugaaaguaaaugauuuaccauuucuuacccacugcugcaagcaaaguugaacuuaauuuuaugugaucucuuaaaaacauacaggaaacaggucuucgggucauuggaaggaccaccucauagaaaagaaaucaaauacagaucucuaauuguccaaguacgggggauuucccccggacugucauacaaaaauauguguaaaaaauauaccagggauuuuuuucacauguauaugauuaggcuagauccuaaaauacauaggaccuagugagcaugggaggcuuuuguaucauuaagcacauugggcacacucuaaaauuguggcccuguauguuuuaaaagaaaaacaccuguuuugauaaagcuguauaaaggauaaucaauauuuuguuugaucuacuuauucauuuuuuuuggugcagaccacuucuuuagcuugucugcuaugucuuuauuuuaaaucugaaucauuuguggcaaauacuuuuaaaaagcauuauuaacauuuauuggaaauguuguauaaauucauaaggaaacacaaaaguuuuggagaguuuuaaucccaagaagugucccugucauuguucagaagugcuuuucauguuugugugguccagaguaacucagggaaucagaugcuaaagaagaaauauucaaauguguuacccugguuauaauuguuucuuugaaauguaacaauguugacuucacuugcagacuguaggugcauggugauuuuagcuaaagaucucacauuacuguggcccugugaacuagcucaaggacgagagaacgcagaggcacccgugcggcuuguuuuaagggcugugcuuauauuuguaauucugcuucucuuccucuucccccauaacacaaauauucuugugauguuuauuuuggucaagggggugaucuuuggaagaaauaccaggauaagcugauugcagacagugacagggucuaaaaugccauugucaccacagggccaagaaggcuuacgugccucuaggcagccucccaugcaaaaacugacuuuuaaaggaagaaggcagggcacugagaguucucguuuuguuacauccggguuauauggguuauauaugaggcuaaaccguaugaauugccaguggacagccauuacuggucuauagaaauagcagugcuguauguuucaaccuaacacgcgauaggaagugcagguuaaaucucugugaggcaaaaggaaggagacugcuuucuacaacucagguuugagaauaacuucucuaacucauguagauccaaauuugucuuucuuacaaguugcagcuugcagggaguuuaaaacauuucaacauagagcgaugcggcccaucacuauugagguggaaugugguuacugugggaggaaaauccacucucagcuggagcaucguucacugccugugaaguugagaagagaccacuaaacgugcagccuuuggaacaaaacaaaaugccucauauuaaaaaugugugucuugcaaaugccaugaaaauggauauuuauuuccuaggaaguauuaugacuauuaccaaaggacucgaccagacuaggguucuucuuaauugaucauguuggcaaagagacugauugcaucccacuuuauaagaugggaagagaaggaaacaaauguugaaaucauaaaugcuuuucuaacaggguuaugcuauucuguaacacuaauugucuuucucuuuaaaaugaaguucuauuaauaauuuuaucauauauuucucaauauuugaauauguuuuaacuguuuguauccuaaauuuguuuucauucuagaaauccagaacuuuacuugccucauaaauuggguucuagaauugucccauuugcugucuuuagaggccacggcuucauuucuaugcguaaaaagcucauuuagcaauguaguuauuucaguauuuauuucuauuauggaaucccugggguucggaauguaacuuuguacaugaaauauauauaaauauguauaugaa

SEQ ID NO: 12188 - RNA, 4040 nt, Mus musculus
ucuggcccggcgcgcagagggcgcuguacggggacgcagggccgggccgccgggcuguguagagaagcgagcgcgcucguguaagcuugccguccccgccaccccugagccagagcagcgagcucccggacccgcccgaggcguccgucgcguguccggcgguggcgacgucuugcaccccgucgccucgccgcucccgacccacccgcgcccccgcccgcugccccuucucccccgcccagccgcggcucggcggcggccgcagcuccggagcagcuuguaaguacggcggggcggcggcuaggggccgagggaguggcugcagcguccugcgagcccggguguggaggggcggccucggggacccaagggaauggaguggcuccggggaccugguccggaggcuugacggccgacgggcaaccgggaggagggagcacccggggugggggcagcggcgcccaggcagggggagggggcgccgggauacagggaucgggcccggaccggugcuccgggaugcuggcuaggucccaggagccucgagcggggagcagagugggggacggcagggucagguuacggcgggggaggggaagacugggcggcccgcgccgcgaccugccggugcccgggccgcgucccugaggcagcuaaagagccugcucuccuuuuccccgggccgagcuccuccucccggagcaagucuaguagucuuccuccucuuccuccuccuccuccuccuccuccuccuccuccuccuccuccuccuccuccuccaccuccaccuccucuggcuguugcugcugcuguagcgcucgggcucccagcgcugugagcagaaaucuaaugagacccaacuggcuguuuauguaauucuucacaguccuguguuaaggcguugcuuuaaaaaccaccuuccacccagccugucugggcucggcugcaccuucaagcaguccagcugaaucugcuuucucugccugcucuuggguuucggcuuggaaaguguaguuugggggcuacacgagagauucuuugcccuuugucaccaagaauauggaaaauggaacagacggauccacaccaguuugauuauuuuaaaugcccuuuuugaucaaccucguuguacaaauagcucucccuuggaaauaccucucuuugcccuugaucuuuucuuauccccacccagugcugauccagcaaacguuuaaaggucgaccuuuucgcuccagccucuccagggacugcccguuuauccgaagagggaaggagauggcuuuuaaaaauaagaauaaaacugagaaacucugcccuuuaagcagaguaaucaauaggaguuuuaagcugcuuguuuuucuuauacuugcagcugagaggaauuucagaauguguguguguggggggggggggcaguacacaauaaaaaagaaaaaggcucccagaagagcaagagugugagagcccuuggcaugguuaaaacuagagaggauaauuugguuucauuuaccaagaugacaacucauuuaguaccuuuaauuuuaguaccagguacuuugaaaauuaaaaauaauuuuguaacuuauaacauuuccgaauauuuaacauaaagcagauuuaaaugugauguuuccaaaaggaacuagggauucacuucuaaaauggugacuagcaaggaaacuaaugaccaacuuguaaaaguggaguguacggguagguggguggaugagugugcaguacaguuaguaaacacugugcgagaagaaacauaaaggauacauguucuggagguccuguaaguccugcugggaagugguauguagaaugcuguuuuaacuauaaaucugucuugaacuuuagcaagaggauuuuuuuuuuuuuuauggucuguuccuuuuauuuuccagcggucauuuccagucuuucuagcccaguagacauuuucaaaaauaaaauugcuucagguagaaagcuuuggagcuguuacauugaucucacuuggauguguuugcuuuuguuuuauuuucuuaaaggaacaagaccacgggaagguugaaggauaaucuucuaauaccagcacuuugaaugagaauuuguuucucugccacaaacugauuuuuuuuuuuaaaaaauuuauuuuucugguggaggaguugaaacaaagcuaacuuuuguggcuucgcagcuaugcagcuugaaauccaaguagcacucaauuuuauuauuucuuacuuguacaauaagcuucccaggagacgugucaacauuuuuggugaagagcuugaaagacuucuuaagaagaaauaugaagggcacugguauccugaaaagccauacaaaggcucaggguuuagauguauacacgugggggagaagguagaccccgugaucgagcaggcauccaaagagagugguuuggacauugacgauguucguggcaaucugccacaggauuugagugucuggaucgacccguuugagguuuccuaccagaucggcgaaaagggaccagugaaggugcuguacguggacgacaguagugaaaccggcugugagcuggauaaggagaucaaaaacagcuuuaacccggaggcccagguguucaugcccauaagcgacccggccuccuccguguccagcucucccucaccucccuucggccacucugcugcugucagcccuaccuucaugccccgguccacgcagccuuuaaccuuuaccacugccacuuuugcugccaccaaguucggcuccaccaaaaugaagaauaguggccguagcagcaagguagcucgcacuucuccgaucaaccugggccugacuguaaaugugaacgaccuccugaagcagaaagccaucucuuccucagugcacucucuguaugggcugggccugggcagccagcagcagccacagccgcagccacagcagcagcagcagcagcagccgucaucaucccagccgccgccuccacuaccgcagcagcagcagcagcagccacagcagcagcagcagcagcagcagcaaaccucugcucuuucucccaaugccaaggaauuuauuuuuccuaacaugcagggucaagguaguaguaccaauggaauguucccaggugacagcccccucaaccucaguccccuccaguacagcaaugccuuugauguguuugcggccuacggaggccucaacgagaagucuuuuguagacggcuugaauuuuagcuuaaauaacaugcaguauucuaaccagcaauuccagccuguuauggcuaacuaaaaaaacaaaacaaaggagaacauguaucguacaaguuaaaaugcaucggcccaagggggaacuuuuuuucuuuuuuuuuuuugccuccuugagauuuuuuuuuuuaaagcuuauaguaaggacacauucaggcuugguuacaaaauaaaacacgcaucauuuuucauuugccaaccaagcacaaaguuauuuucuacugacuguauauuuuaaaguauacuuucagauauggccucuuacaguauuuaagauauagcaaggacauggcugaauuuuuuuuuuauaaaaaauuggcacuaauaaguggguuuauuggucuuuucuaauuguauaauuuaauuuaguacaaaguuuguaaaauaucagaggauauauauauauuguuucuacgacaugguauugcauuucuaucuuuuuacuacagugaucugugacagcuucauguuguauuuuuuuuacugaaauuguaaaauauccaucuuaaagacaucagcuauucugaaaauuguguacaggauauuccuuuagugguggaauuaaaauguacgaauauuugcuuuuucaaaaaaauguauuuucuguuaaagguuuaaagauuuuugcuauauauuauggaagaaaauguaaucguaaauauuaauuuuguaccuauauugugcaauacuugaaaaaacgguauaaaaguauuuugagucagugucuuacauguuaagagggacugaaauaguuuauauuaaguuuguauuaaaauucuuuaaaauuaa

SEQ ID NO: 12189 - RNA, 13785 nt, Mus musculus
ugcagcuggaaggucugggugucauuuauugacagcggcuuacacuguguuuucuccccuugauugcuuccuucggagcgcuggcccacagcccucgggaagaaagggcaaucucugagagagagggagcgggaaggcaggcgcacguguccuuggcaggugugcucauucccugcaggaugcaauccuucaagcuggaaucccauuggguauuugagaggaccgaugugggggguggagaggaagucuuccaugggacucacaucucaguccaggccucuugucccguccaaguccauccagguuuuaggacucuggugggggcagcgacaugaggcccacccaccuugaugggcagauucuucaccccgugcccuggucacacacaccugcuuccgcuggucaugguuaagaggggaugggccuuacaguugagauagaccacuuccucuggcccuccccagcugcaucuguccagguucaaauggcuggaaacacugagggcuugcuuuuguucaagugugugugccacugucuuuaaaucuucaauauacggcagaauggaggcccuaggccuaugcaggcugccagcaggcugcccauccacuacacacugcccugccuuucuucugccaacugcccgcgccuaggguggaaggccagucugcagaggcacuuggcaauuuuggauaugaaagaggguaagaaguguaacaauaaaagcuucgcuugauaauuagagaucugaagugauuuuaccuuuauuuccuucacuuuaagccaaucaugaaauuucacagugauuuucugggguggggcagaaggaaggcgucauucagcaugauggaggccguggcccggcuggccucacuggggaagcuggagaagcacggacuggcccgcuggcagguaggugauguuccgagagcgggagagcugguacgcaauguccucggcggccuccagcuuccgcagcucgaucaggccgucgccugccguggccagcgaguuggcgaucagcucagcggccuuggagucacccucagcagagaugauggcugccuucuucugcugcucagccuacagaagaggaggggagacugagauuacuccauagcguucauaucaagccauggccuaaccaggacaaagccaggccccuucagaggggaccuacuagguccccugggagcguucuucccuuacaauggggucaaaacuguccucccagucuccuucguucccuucauguccacgugucacuauaggacaugcuucucuuggcuauauggacauggucacuuauaugcugauccaaagccacggaaacagaaagggaaagcaggaaucaaaucaaucuuuagguccgucuuuccuuccagugccacgucaaaaugacuuccaucaaagccaggacaucccggugugguggcuaacaacuauguuagcacuaacguggcgauggcagaugggcggcucacugaaagccugaagcaagccuggcuuacacaggacauuuuaggucacccagggcuacaaacaaacaaaacaaacaaacaaacaaacaaacaaacaaacaaacgacccaaaaaccaaacagacaaaaaaaaaaaaaaaaaagcaagcaaaccuccaaaacaacccuagcagagcugggcuggguguagcucagugacacaucuccuagggauugaccucuggggcaccacaaauaaacaaauuaagcacccuaagagcagugacugcccuuugcaguuacccguagaaaacucugacuccggcauguacccaaagaugucucuggcucacccuaccaaagccagcaggacgacaucuaucaggauauaugauuuucagagcaugggaggagaguuuggcuuuaagacucugaacucaacacgcagccuucccucuugucaccgagcugcaucuuuagugcucaguucgaaacauuaagccgucugcucaacaaauguuuauuacacgcccaacaucacccagcagcacuagaccuguuaagguucggagccacaguagacacaaagggaaacauuccugccuacucagggggcgugcuccccacaaccaaaugccuuuucugcauuuuaaggauuaaacauccuuagauuaggagagcuaguggcaggaagaggcagacagcaaaaagccuuuacauucgccaggaagaggaggcuacuaugcacauacacuguguuccgucacucucugaaacaucuggguagauucgacaacaggggaaaaaaaaaaacccccaccaagcacaucuggcauguuugaucuccucugcugucgguuucacuauguaaccucgguguagaaguaacuccucagcgaggcugaaaacaugccagggggaacauguuuauguguaggagaggguuuuugaucuugggaaguaggaaguaagugacccuucagugauuuaggaccauaagcucauaaccccgacagcucccacagacucuggaacugaucggagggguaaggaccccucaauccucuucugcuuaucccagacagaugaccaauuucuaggccacccggcagaugggggagccaagcacuaggagggaaaggcuguuucugccaucugguugaacacucaccuuuuccaccacaaaucuggcucucuccgcuuccugcugagccaccuguuuggcuucuacugccucugugaacuccuucccgaaggucagaugugucuguggggagaaagugaguacaagcugaggcaguaauggcuuagacagcauugcugggagggcuccuggccacugcaaggaauggcgcuagcggcggcuggaggugcaagaagaugcccuuccaucucgguccccucguucacgccauguucacaccucugcacucuuagcccuucacacagugcuuacacagacuucagucacgccaugaggagaguggcaccuggagcuuugauggggcccagggacacuggaagggaucuacgcaaucaaucagcuccccagaggaaggaacucagggguuccaggacccccaucacugacuauugcucuuccaagagcuuuugaugccccguuccaagacuuggguggggggaggcagaugggaagccgagccccugagagcaggggcugcagcugguucccagggaugcgagcccgacggucucugcuuauggauuaaccagccccuuccuucucauagcgcuuccacccuagacaggaagacagaggguggccugcaagucacggcaucccugacacacacguaguucugguaaaggguuuaaaagaaaggcagguaaagccauuggucagggagagagccccagcuugaauguccacagaccuucccuaaucacuuaaguagcugggacuauuuggccgaagcgacucucugaggauaacacagaagagggaacagaccuuggcacucuaaaggucuagccuagagcgagucacuguacccaacuuuuuauugcagaaggcgcaggggcuggagagauggcucagugguuaagaacaccgguugcucuugcagagggcacagguuugacucucagugcacaaccaucuguaacucuagucacaggguaucuggugcaugcauguggcacacuuacauacacagauaaaacauaaaugugagcuaaaaaaaguaagucuaggaaaaaaguucacacggugcuaauuacuuuagguucaagugcgauuugcuucaccccucccccccaaucucugccuuguacaauacaagcaaaaaucuuggccccacaucuuucucacacuacacgucuuugggguuguuucuguucuuuuugugagacagucuuacccuguagcccagguaggcuggaacgcacggcaguuacaggcaugggccaauacgccagcuaaaucuuacccugcagcugcccaacucucccugauccacuccuggacucucaucugaagcuuggauucggaaauacaauccuaagaauugaaaagcuaaauguguaauuaaagaauaaaaugucuuucugaaagggccagcugagggcagcaaauuccccaggaaaucuaauuuucuucucacaccucuuagcuaugguuucuuguggucagcccacauuuccccaggacggagucuguggucagagucuagaaagaugccaaguuucucuuagguuuuuacuaguguguucucacugccaaggugcuuguguuaacugggagagccuggagcaaggcuugcugcagucgggggcugcaaccuggcaugcugccagaagagggagccacaugcccuuccccuaggagagacagaggaaggaggccgugccuggagggggaugcucauucagagaauggcuguuugaacagcugcacggaugcgaggggaagccuggccuuucuuucccaggcuggccacagggagaacaggaagcacucugccucguuaccugacaaaucacuccaagacuuuucccagagacucuagaaacacgaccccuuccccucaccuuggucugaaacacuauacuuccuauauugccuuccguugaaguuaugacacccagcuucacauuaauacagagaguauagucucgggaggugacuguugcuuacgccucggaggugucucccgcccucuccucugcuccaggcgcaggaacagucacucacuggccuucuauugccuuucaccagaggcucccaggacucccuugcugaggaaucccugagccaguccuacucuagacaggaaaacugccagucgcucccaggcugaccagucagccauucccugugcccaacaaagccuauaggaaucacuuucuagggagcgugggagacaguucagugguuagggagcaugggggcaaucagaguuaagaggacaaugugugcggcagacgaaaccuaaagaaugcucaacaaaagagaccugagacgguggcuucagacgcugagacguuuucagauuuucaagcccuacacccaguuaaguggacaugggaccuaacccugugugcccagaaacuaagccagucucugaagcaagagaagcagcccuucccccagugcccccgugaaccuuaccagggacacgucauccaggauaagcccaaauguugccgcucgcucugugaggucaucgcucaccugccuggagaccagcucucgcuggguaaucaauucuccagcaucgaaucgagccuggccacagagggauggacagaaaucuggucagguuacugaggaaggagaaacaagcggcacacucauggcuauaacccuccuacccacuacccccacacucuccugcccacccagccuccuacccaccacccccacgcucuccaccacccccaugcucuccugcccacccagccuccuacccaccacccccacgcucucccagccacccagcuaccuacccaccacuacucccaugcucuccuggccacccagccaccuguagguggcacccuguucacucaccaccaccgacuugaggaucucuguggugauagaaggcaggacccgcucaucauaguccucgccaaugcugguguagauacgaggaagcuggcuggccaccggccggaagaggauucgcagugugauauugacguucugcaagucuuaggguagggaguauaugggaguuagacacaaacacuauaggugggcuuuucuaugacuuuccuacucuaaguccacuauaagccauauucagaauuucaguuagacccuagaggagagagucuaguuccucagcagagcccagcauagcacucagcaccagucaggaaccacugacaggauggggauacauuagcgguucaguacacucugaaugcccucugaugagagcaguuuaggccaugugaccaaagaggguuugggacugugaacaccuuaagaaacauauaagcuaaugccaaggauucuagagugagccuaagggcuggcgugugugcuugcaucagagucaggggcccuggguuacugggaucugguggcaacagcauccagagucacugaccugggaugggguaccauugugcuggcacgaauggcaggacccagucuuagccaaacugaguguauugggcugugagagugaagagcaaucaugacagcaccuucgaguagacagcagacuacggcuagguuaucagacucauccagggccugguuccugacacccgagagaaaguggcaccucagcacacugauguguaaggauuucugauaaagucuaaacaaaggccauuaagccaauggcagggugaauucaaaaggcucgauauccacaugcauccaggagacagucagccccuacccacucccugacagcucaggucggugcagagcuaaagcacagcuaccacuagcaccaccagccccgccaugaguugggaguccugacccagccacucggagaagugggaaauucacaacuacacacaagccugugaucucuggacuugcccgucucuuuaacaagcaaagguacaaauacaacuuagcacaucugugagacaacagggacaggaagcccaagggcggaaaguuuagaagcaggauuuuaaguccagccucacucuuccccaucacccccgucccaccuucuauuuccucuugucaguaggcaagccaggcccagcacucugcaggagcagcagacagacguccuauuccccuccucucuuucugaccuaacuucucauucauaagguucuccaaucaggagguccgaacuggggagagcaggcagaucuccucugugcuccacacgccccuggccaucuccuccuccuccucuucuuccuccucacacuguuacugguucucaugcuugcccuccugaggacugaggucccccccaccuuuuuuuuuuuuugguuuuucgagacaggguuucucuguauagcucuggcuguccuggaacucacucuguagaccaggcuggccuccaacucagaaauccgccugccucugccucccgagcgcugggauuaaaggcgugugccaccacgaccggcagaggacugggguccuuacuaguucauucucuuuuggucauccugguacagagccaucgaccuggcacuagccuugcgcagcacaaggaacagacaugcccaggaacagcccugagggcaucgagugcugcgagucccacagaaucccucuucuucccaccaguuagcucccuuugcugccugcacgcugacugggaggggaaugcuaagggcuggucacuucaggccgaacuagaaauccagcggcguaucucaggcccagggcugcgaggcccagccugcgagagagcagucugaggucugcccugcuggagcagaggccguggaaaacaaggcaaagggaaagcugucagccacagggaaagcaagacaaacugccaaagacugguuuggacagucacucuggggaucaagaacugacgggaagggucaaccacagcagcaaaagacgcaguuagauuuccucaaaguuagaacuuccccccaaagauuuauuuuacuuuuuuuuuuuuuuuuuuuuugguuuuucaagacagggcagggcuucucuguguagcccuggcuguccuggaacucacucuguagaccaggcugcccucgaacucagaaauccgccugccucugcuucccgagugcugggauuaaaggcgugugccaccaugccuggcuuuuauuuuacuuuuuauguaugauguuuugccugcguuuaaguaugagcaccacaugugugcuuucuggaucccccugcagcugggguuagacccaauccccuaaugcugggaucugaacccagguccucugcaagagcaacaagugcucucgaccacugagccauccccccagcgcacaguaggaaacucuuaugcuaacccuuuagucgucucugaauguauccugcugccucuguuuaccuuugauauauuucagucuacacacacacauacacacaccccuccaggagagucacacuaugguuuuuuuuuuuaauuuuugaauacaauuuuuauuauuuuaugugcuuguguaugagugcacaccaucacacaugugggauccgaggacugcuugcaggacucaguucucugcuucuacaauguggguucuggagauuaaacucaggcuugguaccaggaucaauuuaccagccuacaauuuauuuuuuuuuuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccucuacaauuuauuuuuuuaaauuaaccuuuaaaauuuauugauuuaugcauuguguaugguguguguagguguguacagccaggguguguguagaggucaaagggcaacuugcaguuuucuucucuuaccgcaucugaccuaccagaggccagguugucagcuggccucucuccagucuuaaauuaacuuuuuaaguuaguaugcaaagcagugaguuuuauuacguuucuuuuccuuuccuuccguauuuuuuaaaaacagggacucacauauaagaggucagcgcugaacucgcugagcagccagagaugaccugcaacuuuagggacuggagcaugcuagguguggacucucccaaaugagcuacgccuccuccagauucccagauacccaggauggcguucucaugugggucacugugcuuugcuguacccccacuuccaacgccccagguacuccugccuaucugccuagagauuuucccucucccucccucacccccucuguuuguggagacaggcuguccuggaacucgcucuguaaaccagaccgacauggaacucacagagauccacccgauuaaaggcaagcaucgucacccaacuuuuuuuuaaaagacaggaucucucuacauagccuugcuuggccuggaacucauuaaguagacuaggcuacccugauaagucagagauucaucugccuuugcaaguccuggaauuaaaggcauucaccaacaucacacagcacagauauccuuauauaaggugaaguguaaccucuguauccuagaugucuccagaaugcgcacgacagcacgguauaccuccacaucucccuuauacagccacaggcaagacucaccuuugcuaccagugaugacugguacguuccguggucgagagcggcagucaaagauaauugguuucuguacccaagggaugaggaaaugagucccuuccccgaccacaauguccuguacgccacggaaucggucaaagaugacagcucuguguccagcauccacuagaaaggaauaauaaugacaggucagaaaaacccugucacucucuaacaaaaagaaaccuaucucuucaagauccuugccucuuucuuuucuguacuuuaacauuuguaaaaguucuuuauuuuacucugugugugugugugugcacacgugugugcgugccgugacacucauguggagaucacgggacaacugcagaggucaggcugucauccuugacagccaagugucuuuacccacugagccacccugacaauccucuccuuuacauuuagaaauaauuucauauaacugggggguggggugagguggggcagugugcaugccacgaugcauguguggacgccuagagacaauuuucuggagccuguuuguuucuucugucuuuacacaggcuuugggaauaaaccccaggucaccugguuggugcugugcgugguuucaagcuaagcuggugagauggccagcccccugaagaguucaaacuccugucccuuucucucacguauuagguuuccucuucugugcugucuuccugacagucacuuccugccccguaugucaccccagggacuucaguaacaggcagcccccuaggaaccuuucuccucuaaagagccggccugccuuugaauuucugaucaacuaccccaccccacccccaacucccaccagcacacuuccaggaaucaccuccccagaguucuauaaucggagaucauccugggccaacauguacauaccggcucuaacugaaccugauguucccagaagcaggauccuuauaggaacccuaaaacauagacguucccacugucuggucucuuuccuucuuucuuuuucuuucucuugagacagggucccaggcuaucguucagaucagcccagaacucagccucaucccuccccugccagcacugggaauauaaggaagcaaucacucugccuggcauccuucuguguuuuuguuuuguuuuguucaagauaaguucuuacucuguagcucggacugcccuggaauuuguucuguccaccagguuggccuggagcucaagaaaucugcuuguuucugcuuccugaggauaagggcuuaaaccuaugcacaaaucaccgccuggcuuguuuccuuuuuuuuuuuuuuucaagguagguucuuacuauguagccuuggcuauccuggacucaccauguaaaccaagcuggcuuugaacucaagagauuugccugccuuuaccuuccgagugcugggacuacugguauauaccaccacgggcagcuugcccaggaucuaauagcuguuucucuaacauuuggagguguuguggagaugucuugugcacccagggaagagccucccucccuccuucccucuccucuaacguuuuagagacaaggucuuacuagguagcccaugugggacuggaacucaagauccccagccuugugaacgcuggcauuacaggaguacgccaccaggcccaggcugaaguagucacuuccucucauuuccuguuugaauuuagaguugaucuaaaaaccuucacucugaaaauaacucaucaaaacaucauauagccaaagguccaggaguucaaagccagccugggacuacaggagacacugucuuaaaaacagaacagcugggugugggucugaguuacuuacaacugcuuuaguugagcuagguagacagguguacaccuuuaauuucagcccuugagaaguggaggcagguggaucucugugaguuucaggccagucaagagcuacaugguaaagauucugucucaaacaaaacaaaacaaaacaaaacaaacaaaaccaacccucccaauacaaauaaaacaaaaaccauacaggagguacaucaaaaucuguugcuguuuuaaaagaguaucagacuuagagggaaucuuuuuuuuuguuuuguuuuucuagacaggguuucucuguguaacccuggccguccucgcucuguagaccaggcuggucucuaacucagaaauccaccugccucugccucccaagugcugggauuaaaggggugugccaccacgcccggccuuagagggaaucuuaagagaaaaacuaguucaguccccuuguuugaccaaugagaaagcuggggacuaaaaggagggacucgcaaauaaggccauguaauacagucaaagaaaacccagcuuugcacuguggcaccauucaauaccuggcaaaaacuauucuccugggccggagagauggcucagcgguuaagugcaccgacugcccuuccggagguucugaguucaacucccagcaaccacaugguggcucacaaccaucuguaaugggaucugaugcccucuucuggugugucugaagagagcaauaguauacucauacauagaagaaauaaauaaauccuuaaaaaaaaauuuaaaaacaaaaaccuauucucucugcaaccagcugagcaaaacuuuucucaggacacagucucucaaacuggucuagagauguugccaagauacuucaugcaaauaaggaagagaaccaaugggcuccugucaccuccugucaucuggguaauaccucaucauuucaaaguggcuaaagugcuaaacauuggacaggagggcuccccuugaacaaagccucuaaguuaguggcuuucaaccugugggucagaacccuaugaggggggauguuaaaagacccuauuacaggggcugccuaugaccaucggaaaacaaaauuuacgauucauaaaaguagcaaaucacaguuauaaaucagcaaggaaaagaacuguauggugguggagguguaucaccacaauagugagaaacuacuaaauguuccaagcaucagaaggcugagaaccccugccuaagugaucauaggccucugaugacucacaaccaguaugugggguagcaggugagucccccuuaaccucacacaccuucagacagcagcuagcaucaggaaugucaaaugggcuguagagauggcaaagcgguuaagagcacugacugcucuuccagagguccugauuucaauucccagcaaccacaugguggcucacaaccaucuguaaugggauucaaugcccucugcuggugggucugaagacagcgacaguguacucauauaaauaaaauaaauaaaucuuuuuuuuuuuuuaaaaggaaugacacaugggcuaugcagaucaacagaaacuaugcagaaagcucuuccgcgccucaccauuauacaaagcagaguucaccacgccuccugcaacugccaacgccaggccgaacuuuccaauggacucaaacacuuuggcagccaugacuccuucuguugcuuccacucacaccuaaacacgggguaaacauaaaacacuuugacaccagauucucagagaaagcccgcucugaggcacagaguucaugucucaacauacauuuucauaugucuacaccugugggcccaaacucacucacugaacgccccauaacacugaccaccuugcaaacuguagaucaugucugcguuuguggacguguuucuuuacaaccauucagagaaagagucugcgacacuuggcucagcguaggaacggugcuuuguacccacgaggaacuuaguacacagaaaaaccacacucccuuuuccuagaccaauaggccacaagcgagaccggugcuacacggcugaagccaacaacaaaaagggcaauuucuguuaacauuuaaguuacacggucuccgacagccuuguuuaaccuucaguuacuuuaugaagguuaugacugcugaagugcauagagagguuauacucuuaaguaguagaaccaggguuagaaugagaagaccgaauucuagaagacauuguagaacuccuccccauaccaguuaauaggaaagcaggggcuggcaggggugcagcgaggcagagcggugaaggacuggagguggggcugcggcgggacgggugggggcacguagcugacaaacuagaaaccaguuagccuugaacuuuuuaaugucccgccccugcgucacccuugguacaauccucaaacucgcccuccccuuucucagacuucaacugcuuguguaucgggauuucuccaugcacauuuauccucugucucugacauccagcucuuuuuacuccaccagcuucuggauuuuuccucauccuguccccuccccuugcacauuccuaacuccuucuggaccgagauuucccccuucuccacuaggcguacccacacaugcaucccaugcccucauuguacauaggaaagcagaggcaggcuacagggacauaggaccagaggccucuaccgcuccuaccacgcuuaccugcuuucacucugaccuccacaugaauuccccagcuccggauacugcgcgugc

SEQ ID NO: 12190 - RNA, 25234 nt, Mus musculus
ucgaggaagugcggcgugaaguuguggagcugagauugcccgccgcuggggacccggagcccaggagcgccccuucccaggcggccccuuccggcgccgcgccugugccugcccucgccgcgccccgcgcccgcagccugguccagccugagccauggggccggagccgcagugaucaucauggagcuggcggccuggugccguuggggguuccuccucgcccuccugucccccggagccgcggguacccaaggugggucuuggcuuggggagggcucgggccgcuacggcugcgcccacgggcggccggagccgcggggccccgagagcuccacggccgggcgguccgggacguugggacgauuccggcuaccggcgccgcggcccggaggagaucggagcaguuggggaugggacagucacucggagaaccacacuggagguccggaccggccccuucucgcuacaccggagccucccgggcuccaggagacuccgggaacuccuugggaaaguucucugaaacuagucggaaaguuuuccuccggagggugugugaagcgcugugcgugcgugcgccugcuuccccccuuucgagccccccucacgcuuucucagagcucuuccaguuggcagccuccgccuccggaccggacugggcaggaugccuucgggguccccucugccccuccccucccccuucccacccccucuggcccuuuggguuuaguaaguuacuccagcuuccaguggggucgccguggagggggcgguggggaaaguaacccauccugucgagcagggaggaccgaguggcggcuccgcaguugaguugccuaucgauagugucugggauaugggggagcaggaggaggggcaggcauuuguuugcaacaguucucucucauucucucucucucucucucucucucucucucucucucucucucucucucucucucucucucucuucugugcuggggauggaacaccccuacccuccaucccagucucgcccguguuaggcaagcccucuaucacagugcugcacacuccacagcccuguuuugaacaaauuuccuuagagccagcuuaaguacugugugcuuugggauuccgggaaggcucggaucuugaaggguggucuuguguuuucccggcuuccauacaauaaacuggaaaggguuccugggcauuugggggcggggggagggcaccgaaaaggaguaaggucagcuagggguagacagagagcuggguuguuuucuugccuuuaucuucguguugggggcugggagggugacccagcaguguguauacugacccauauguccaguucuaccaugagcguaaaagcugacagucaccccgugugggucagcucugccaggcuccgugggugguggcuugcaugcauuccuucuacaguacuaagaacaacuccacaguggaaacauuaguagccuucuccuugucccaggggggaaaccugggcuggggaaaugaaguauccuggaguaacugguggaucccaggcaaugugaccagccacaggauaugauauaugauucacauaaauacgagucuagcugagcagugcggagacacugcuuccguaaucagugggcuguauugaagaugcagaacacagguucuggaaacaguaggugcucuccagaggccagcgagccuggaggcugguggaguaucaccaucugugcccccuugccccccucuccugccccaguuccugacagcacacugcugugcucacugugggauaccccugugugucugagguuuuuaugaugguuguguguuccucccaguuucuguugccaaacagcagucucucugcugacuuggggacacaggaugaacucugcccucucuaggaacuuccucaaggcacugggcucuaucuguuguaaacacugggagaugccccuugccuucuucaggauggagucuccuuucaguuucucaggaggccagccuuccugcugacuuuccgugcagaagagugagguuagacccuucaccugagcuggguagggucugcaguugaccagaaguggcccugugcuguagagcuggaaucugaagggucugcucuccagacagggaguggagggcugcugagccuucaucccuucagaugcacugcuggaugcagagggacaaggcagaguuugccuugccaggaaugguuaaaagggcagggcaccaucagcugccucuagcuccagguucgaccccagaacuggucuugggcagguguguaggggaaaggagaucuggggagacccagaggaucaagcuguugcuggguuccucaguacuaaagguuuugugaaaugcaguaaacacaggucuuuaacuuggcaggggucauuccuauuucaauucuagucugagucucuccaggcccuuccuaccuuuuguuauacauacggggacuaaauagauuccucuugcagaagaccuggggcucaguucccaguucucaccugguggcucacaaccauucauaacuccaauucuagauuggaugcuuaauucugaccuccacaggcaccaggcauguguguuagugcagacacaagggcaggcaagagacacacaucaaguaaaauuaacccuaacaagaaaagagagaaauauauugcaucucaaaaucaaauggaaaaggcuuucucuuuucuccuguaauuacccagaucccacuaagugcuugucucccguuuuaaaaacuucuuucugcuucuuacaugccagaucauuuuccauagaugguuuugugcucucucucugcacugucccgugaagcaggugcacagaugaaacacacacacacacacacacacacacacacacacacacacacacacacacacacucuaccucagagagaugaagagacuuaucaagggggcauuuagaggugaucagaguuuuaguugucaaacaggaacggacuagaaaagccuugggccggccagggagucacacaggaaaguguuccucucuuacucaguauggucuuccuagccccuaucccaggcuggagaaggugccucaagauaggggccugagaugccuuccuggcugcugaguuugccucuagcacaugcuggccuuucucuugggcccucugcagugccagggauggagggccggaaggugcagagaucacuaggacauacaggcucaugggaaugaugugggcagguaaaguggaaacuaguggagcaagggcagaggagggcuccgggaagguguguuugcccuagagugaaagacugauucagaaagagagucccuuuccuguccccuguggagagcucucccuccguggccucagggagugacaguucugugaucugcuaggccaccagucaggcagagaggaugugcagggaaccucuguccucagcagugguuagagucauuaaagcugcuguuuagguugcugcaggucuguuuacaaagcuucccuguguuuacagaguguuucucuuccuccucuccuuuaaugcccagggcccuccgaggggagugagaguucuugccaccaaauugaggucaguaaauauucaccgauggagccaacuaagucacagucgaugcugcugggcuuagagaucagucuuauuuagcuucugcccugguggucugagcauauccucccuguagcccaagaguaacugagccaagguucuggacaaaagacccugagccuagacucucgcucugacaccagcguccuacagcaggugugugcggcaagggagcccuggugucauuugagugagcucuggccucugaccuaguuggggagcuuuggggauguagguaguuuccuggcagagcuuaugaacaccaaaggaaauauuggcuuucacauggugagcaagauagcagcugggggcccaggaugcaggagguccuggguucucuccuuggugcuggaagugaaggcaagaaagagcucagcuggggcugaggaccaguugggagacaagaacccacaugagaagcuagaagcugggcugaaccuugauuaccaguguucagcaggagggacccaaaggaccugggccagcucugaacagagggauggauggauacuugucccuuucagcuuggaagcucuucacaagguggagucacacucauucauucauucauucauucauucccuccguagacgugugcccagcacucacugugugugagccgcagccuugcucugggauuguccugcuucuuccugcuuuugucuccaagaguuggaaggugggguuucuggagggacaccuguccuggagccaaagagcauccuguguagaauuagagccuuuuuucccacucuauaaauucuuggaacaggaugauuauggggaccauggucaaagcugguggggagagcuugguaaagaguggggagugggagggaggccgagacuuggcagagucccaaggcuuucuuggcuguagucagcauggugugugugugugagugugugugugagugugugugagugugugugugugugugugugagugugugugugugugugugugugaguguguguguguaugugugugugugaguguguauguguguguguuggggggggugucagcuggcagcuucuagcuccccuggaggaggucucaggguaccaauuuucccaccugucuacaaacacuuuaagacucuuacucaaaccaaccacaaaucagauaaacaaacuggcuagugggguguggcugccacucuuucugaccuccugccuagcccagcuacccugcccuuccugagccuguguguuuauuggucucacuggagaauuauuguguuuuuauguuugugggggguguggcguugguaugugccuguuaguguguguguguggguguauguguguuugguguguccauguauguuuguguguguuguguauguguguguuucauauguccauguaugucugugugguguguccauguauguauauguauguguauguauauguguuguguucguguauaugugugugugugggguccauguauauaugugugugguguguccauguauauguguguauguguguugugcccauguauguauguguguagggggguccauguaugugugugugugguguguccauguauauguguguggugugaccauguauguguguguguaggggaguccauguaugugugugugugugguguguccauguauguauaugugugguguaaccauguauguguauaugugugguguguccauguauguauguguguggugugaccauguaugugugucuguguguccauguauauguguguggugugaccauguauguguauguguguccgugugugcgcugagguuuaguggaaggaacagggaucuguggcaaaccuggauucacaucgagacucugucacucugaagcuguaguucuggucuggcuuguguugcuggaauuggucauugcuguuuuuuuuuuuguuuguuuuugauuuuuuacuuuuuuuuuuuuccaagacaggguuucucuguguagcucugccuguccuggaacucacucuguagaccaggcuguccucaaacucagagauccgccugccucugccucccaagugcugggauuaaaacucagggcuuuaugcgugcucugcaagcaauuuacugcugaacuugggcuaugaccuuggaagaaucaauuuccuucuuuguaaaauagaggcaguagcccccaucucugaaguauacaguagguacucaggucguuaccaugguguaugcuguuguuuuccuuugcuuggcugccacagcuggugucccuuccccuuggagauggggcagcagagagcugcaguggguaaacugucacagagggugggccucuacuccagcucugccacccaucccuguccccagcuaggcuggaccugggaucuggcucuggagacagcugugcauggaagcagcugaagcuuccguguugggggagguccuggcagcagggcguuauuuugggcuuggcugccaccccuagcucccguuucuccugggaaucuuggggggggggggaggcuggaggguggggaggcgugagccagaugacagaggguggggugcaagugggugcgggaugggguggguaggccuggcugucuccccuccauccaagagaggagccuuugaguucuauuucuguuccuucccacucucccuccuugcuuccuucccuaucuuccuggggaagaggcugucuacuagaaggccaucagcuugaugcuccugaaggcagccuuugcccugcaagcccucuucaaauccagaggcaagaugauaacugggauuuggcuuugggcuccuugucgccgggacaacaggacuccuaaaguccgaucccagagcugaccacuguacugucucuugaaucugcacccagucacugggaaggcaaagcgguaaccaauaggaagucucucucucagcagcucgggcaccuguguagacaaccuccacccgccuucucccccaaccccccaaccuccugggcaagacgcacaaggugauucaucuucucaccggagcagaaaaacaaguucaacugggcacuuuaaucucuccccugcuggcaggcuuggugccagcugcuaccuagagcccccuagcugaggggcagcuucuccuaugugaggacuuagugggaggaaugguaccccagccugagggucaggcaggcucggaacggcagugcaccuuggggacccccuuuggcugauaguuggcaccgggcagguacacagaguagugugcccuuguggcaggagucuuguggcauaccuucugccagcugcuucuggaguuuugccccaggaggagggugagagagccaguguaggaaccugcagagugucucgcccuguuuaggaucugcagccaggccuccuagcugauauccuaggcuuuucuucuccguguggaugcuuuuccaaagagcucucccaugaugaccaggccccugccugcccuccuaucccagcaaugacuccagucaauccuguuugccccuguuuuggggggcacucuggggacaguugucuugaucagggaaguugacauguggguguguugcgauggcaggaggagaaugcccugagccugugugcgugggagacagauggggguauccagaggggccugauucaucaucgccucucuuuggggauuuuucacccucaguucugggacaaagggaggcuuucuuugcagcaugcuaaaacccaguaugggugguaagcccuaaagggcugacacauuagggucccucuggcugcccaaggugacccugcuacagggggccucucuccagcuugccaacucuuucccaaacagaagagcauucuacucuaggcccuguggaugcagaggugugggaggaaaggcugucagccaugcuuucucccugucugaggugacaggacuccagggagugaguguggaggaggugacuagauuggagagggucguggccaguguccugacccacuuccucccuuccaucaguguguaccgguaccgacaugaaguugcgacucccugccaguccugagacccaccuggacaugcuucgccaccucuaccagggcugucagguggugcagggcaauuuggagcuuaccuaccugcccgccaaugccagccucucauuccugcaggugagaccugguccugccgagccuccugagucgaggugugugaggaaggggcaacuacauuccuguauucgcucucuugugguuccucaaucaggagugccuuucugauagcuacuuaaaaaccaguugacucccucugcagugacuggccgugguccagcuguccccaacacuauuccuuuagggcucuuaaguuccagguccagccuuuuggaugugaucuagacccuuagcuucuccaggccucaguuucucucuauauuggacuagcagacauccuggccuaccguuguggaucauauccacaggcccuggagugaagcugcaaggaauggaugugggucuguuaaaucacagauaccaucuuguacaagcccucgauacugagaugugcagagagguggggcaccgcuuaucaguccugaucuaacagacaagaaucuguugaggccagugaggaguagccuagggcuccaucuuggaucuaaggggucaagacugcucaguguccagugggaccaugcaggacacagccccaacccuguuacccucaggcuuugugaggcacaggcgcuucgccagcccagccgcgccucacugcccguccccugcccuucccaccaggacauccaggaaguccagggauacaugcucaucgcucacaaccgagugaaacacgucccacugcagagguugcgcaucgugagagggacucagcucuuugaggacaaguaugcccuggcugugcuagacaaccgagacccuuuggacaacgucaccaccgccgccccaggcagaaccccagaagggcugcgggagcugcagcuucgaagucucacaggugccuuuccugucauugcaaggguuuccugguucuugguugccgacuaagcuguucuggcuguggagaggcuccgugaggauuaaaaguaugguucucucaagcuccaugcaggcaggcugagccucccucucuuuucaccccagugacaauaaggaaaagaagguuacgcaguggcucggugucagagugcuugguuagcauggacaaggcccuggggcuugaucccuuccucuucaggaagaugcagcuuucauuaguagaggucaggauauuuuguucucuccauuuuggccaugucagaguauguggugaauaaccuguggaauuguaugugacagccccgagcugacagugucccaacuaggguacccggugcuuugcguacuggaccccacuccggucacgcuacagacguggaagcccugcugcuaagccuuccaguguuucuuuuuuguuacguuuauuuugguuuuucugguuuugugguuuuugagacagugaucucacuaccuagcccagguagaccuugauuccaaagcaguccuccugccucagcucucuaguucuggaauccccggcaugccaccaccagcuuucuccaguguuagccucacuccacagaggagcaauccgaggcaggcagggucacgcagccagucgguggugaagugggauuucagacuucagagacauuuuuguuguuuuugugcuggggauugaucuuagaucuggggcaggaugggugcuuguucugccacugagccucucuguuugccuccgcacagugagcacagggugaggcgaaaggccaguggggagcucccagccacgugaacaccgcccaccgcccccacugccccauccccucuuccuagucccuuguuaaucuccuguguggcuggcacucacagggaagucaggagcccccaagaguggucaggaaggggcugacuaucugucuuccccacagagaucuugaagggaggaguuuugauccgugggaacccucagcucugcuaccaggacaugguuuuguggaaggauguccuccguaagaauaaccagcuggcuccugucgacauggacaccaaucguucccgggccuguaagccauguccaugggacagcccaccugacccagacagccacccaucccaccuucccuguccuuguucaucucccugcccguaggcagggccuccaccuccugaggccucuuuacuuuuugggucccccccuuccugugcaacuguccuugggcucugcgacauauuccucccacccgccauucgcuccucccugcgucccucucagccucccuuuuucuuccugcuuccuuccuuugcuuccuuucuccucuggacuucccucccucacugccucuacccgcuuuuccugccucccccacccuuaccgucucccuuugcuucuguccacagguccaccuugugccccaaccugcaaagacaaucacuguuggggugagaguccugaagacugucagaucugugagucagagggagcccuggugucuggaggugggguuggggcaguuggauggcuggguguagccgagugacuuacuugggagaugucucccagaaggcaguggagcugagggucugguguccgggcccuacccagcccucauccugcccuuuccccaacagugacuggcaccaucuguacuaguggcugugcccggugcaagggccggcugcccacugacuguugccaugagcagugugcugcaggcugcacgggucccaagcauucugacugccugguaugugucucgcuccugugcccccugggucaacccucuagaacgcaaggggugggcaucucuccuggccauuggcgcacagguggaaacaucacagugaccaccagcggccugucucugccaggccugccuccacuucaaucauagugguaucugugagcugcacugcccggcccucaucaccuacaacacagacaccuucgaguccaugcucaacccugagggucgcuacaccuuuggugccagcugugugaccaccugccccugugaguacuggggagaaaaaaaccauccuuuuaaugccugggccggggaagguggcuuguauaagagggagcaugcugugaguaucgugugccccuuggagggcuggucaugacucucaagucugggugccuuauucuuuuccuuuucucuuucuaaauauggaacguuucacgaauuugcgcaggggccaugccgaucucuguguuguucccauuugaguaugugugcagcugaagcgagcgccuuuaauaguuuuuaaaaaacuauuuuauuuauauuuauuuuaugugcaugcguguuuugccuguguguaugucugcgcaccaugugcaugcauugccugcagaggucagaagagagggaaugagauccuuuggaacuggaguuacagguggcugugagcuaccacauggggccuaagaacugaaccuggguccucugcaagagccaucucucuggcucuugccauuuucuuguuuuguuuuguuuuguuuuggacaggcagggucuuuccuguaguccuggcuguucuagaacuugcuguauagcaggcuggccucaaauucauggagagccuccugucucugccucgcccaucucucccgacccccuuuuaaagucaguaucucacguagcuuaaccuggcuugccuugaacuuaacauauagccagagaugacacuuagcuucugauccuccugccuugcuccugccaagggcugaggguacaggugugcgccgccacucccagguuuuugccucauucuguuuaacagcugcauaacagguggcagagaaagagcccagacuugggaacugcauuugaaaccuguccccuaccguuuaauagucuuacugccuucuucuugcugggccucaguuucuucaucugugaaauaggggcacuguuagucccauccugauaacugcgaagcaucugaaugaguucauguuggugaaucuuugagaacaaugccuagccugcacuaaauacucuugaaugugucuugguccuccgucugcauggaguagggcuuuguguggcaguaacccugagcccuguggacacuuagggacuggacuuggaccuggggacccucuuuuccuuccuuuuauggguggugggguguggccuuuagggucuaguuaugcuucucuguggucagggugagaggacaaggugugugugggggggggggcggggaggccgauuguuugguuuaaguccugguuccuggguggcacaaaccagucacccugacacuuggaagguagagguggugggcuuagggguccuaagucauccucagcugcauagcgaggacuccuuaaaaaaaaucccaguucuguuacuuuaguagcacagcauugggggugacuuguauagcucuguacccuaguuucccuuucugcuaaaugcaaauaacaguguuguccccauaggaguguagugacgagcaaaugauugcccugaguucgggugcgcacagagggccuuccaggaguggugggagauguccuuagagcugggcaucguagccuugaucgaggaugacuggguagaggcuagggcacauggauguacauucccaaaucuguacagacaacuaccucuccacggaagugggauccugcacucuggucugucccccgaacaaccaagaggucacagcugaggacggaacacagcggugugagaaaugcagcaagcccugugcuggagguacccaccccauuccaagaccagcugcggccccgaccgccacuccaguccaguccgcccaacucuugcuuagacuucuuuucugcugucgccuccccugccccucuccggagcagucuccccagucucucuugucaacauagggaggaggcuugucacuucaugaugggacagcggacaggucucuggugugcaugugauccugagguggccccuuuucaccucccucuccuucaguaugcuauggucugggcauggagcaccuccgaggggcgagggccaucaccagugacaauauccaggaguuugcuggcugcaagaagaucuuugggagccuggcauuuuugccggagagcuuugauggguaaggguacacaguggccugagguggugucauggaggacccagaguuuguggcuaagaauacacaggaggcaggugggaguccacagggagccagggcauggaguuggagguauacauaucauuuaauccacaggcggggacguaauguggugaucaaaccauccggagggggcauuguuaaaguuguguguguucuuccaggccuucuguauauugguggacacagagugacagcuuugacuggggaggugguucauggaaacugccaugcaucccuugcuuuggggaaccucuuuuuuuaaaaaaaaauuuauauucauugguguuuaaucuucacgugugucugugugagggcgucagaagccccgggacuggaguuacagauaguuugagcggccaugugggugcuggggauugaagcugggccuuguggaagagaugucaaugcucuuaccugcugagccaucucuucagaccucaaagcugacucguucuuacaauagcugucgagugggagccagcaaagacaggcaacagggcacagacuuggguuuaaaaccuaccucugucugucugucugucugucugugccuaucugacuguuauucuuucucuuucuguauuugugucugucucugucccucucuguuuauuugacuguuauucucucucucuguaucugugucugugugucugucuaucugugugugugccuuuguucaaaggacagucucagguaugacuccucaggagcuguccaucuuguuuuucaaaauagggucccucucuggccuggagcucacuaaaacaggcuacaaugacaaccaggggaccccaggaacuguuuugucuuuaccucuccagugcugggguuacaagcucaguaucacauacggggugcugcugcuuccuucuccucuuccuccuuuucuuccuccuccucuuccuccuucucuccuuccucuucuuccucuuccuccuccucuuccuccccuuucuccuccuccuccuuaugacaagguuucucuguguagcccuagcuguccuggaacucacucuguagaccaagcuggucucaaacucagagaucugccugucucuguaggugcuggaauuacaguccuauguucggcuaacaugagcucuuuuauaugguucuggguauugacucagguccucauguuuguauggcagagcucuauggcuuagccucauugccgucuccucucuucucugugccucagugccucaugugugcagugaggaccaucauggcucuaugcucaaggcgguuuaugugggcacgcuuagaacagcgcuggauggaugccgagacaccccucgccccguguuuguauuuuagcauaugcagagaucaguguucuguguaucacugauggauauugggccauuuucaaaugucuuuuccuacaaacaguucagcuuguuucugccucuggcagcugaagccagugucucugcaggauauaccgcaaaucagacuucuagaccaaaggacacaaauauugcccugccagacuuugacccugggcuuugugccucaggaugagaacggcuugauaggcucuaucugaaggcauuugugagggugcagagugcuuugccaaggccuuccggggcuccugcccuacugaccacuccuucuggucccucuaggaaccccuccuccggcguugccccacugaagccagagcaucuccaaguguucgaaacccuggaggagaucacagguaggcuguacgcucuggccuccuucgcaggaacuaggaguucuggaccuuucuacauaccaagcccccuccucugccugcagguuaccuauacauuucagcauggccagagagcuuccaagaccucagugucuuccagaaccuucgggucauucggggacggauucuccaugaguaagugguggggaggggaaggcuaggaggucuggcuacaugcccugaggcccuugguggcuagaguaggugccuucuugugacuggaagcccccauuuccacaguggugcuuacucauugacguugcaaggccuggggauucacucacuggggcuacgcucacugcgggagcugggcaguggauuggcucucauucaccgcaacacccaucucugcuuuguaaacacuguaccuugggaccagcucuuccggaacccgcaccaggcccuacuccacagugggaaccggccagaagaggcaugugguaagacaggaagcccagcacugagggcuggcacagaggagucucaguagccucuggcggcagccuccuauaaccugugcaucaugucuuagagccccguuguuguuuagagacaggcucucacuauguagcccuggcuguccuggaacucacucuguagaccaggcuggccucaaacucacagagaucuaccugccucuaacucccaagugcugggauuaaaggcgugaaccaucaugcccggcuacagccugguucuucacuugccuauggauggcuuagccuugagcauggcuuccagcuguguccugccgugcugccaggcauccacaucccuccccuguuucuugaacuugcauguucuagcaccaacccuuaacccuucagccuggagccaugcuuacagcuuuuucccuuagaccugagccuagccaaacacuuccuucuccuugcugcaggucuugagggcuuggucuguaacucacugugugcccgugggcacugcugggggccagggcccacccagugugucaacugcagucaguuccuccggggccaggaguguguggaggagugccgaguauggaagggguacgaauugcagaggaguggguggcuugagggguacucgggguacucugccccaccccaaccccuuacuacacccaccucucucacaggcuccccagggaguaugugaggggcaagcacugucugccaugccaccccgagugucagccucaaaacagcucggagaccugcuauggaucggugaggugcuggugugcucggggcugggggagggacgagcugaggguccauccaguugcuacagggugaaauauucccagagaaggcuucacuggagagcagaagcagggaagaucagggaggcugggacuggggacuaggaacugcucacauuaugcuguggacccugggcuaccccuucuugcuauugacaccggagcccuuucaggcuaggacaagguuccaagaaggccugugucuuuggcaguggcuacgcuaaugaccaaaugcaggcccuguuuccagccucaguuuucacuucuauaaggugaauguuguaauaguuccucccugguugggguguggugagaacagaauuaaauaggauuuggcacagugcccaagcauggaauaaaaccuuuguacauaauaguugucacuugucacaccuuagggaacgcacgucccucucugggcgccuucacuuccuuguugagagcagggauguuuacuccaggaucagggaggcagugcaucugauuuggggacauggggccccauccuucugcuauaacgaugacaucccuaaacccucacaaacccuuccucucuguccaggaggcugaccagugugaggcuugugcccacuacaaggacucaucuuccuguguggcucgcugccccaguggugugaagccagaccucuccuacaugccuaucuggaaguacccggaugaggagggcauaugucagccaugccccaucaacugcacccacucgugaguggagggaguggagucuuuucuguagaaaggagggccuucauggggggagccuuuuuugagcucuuguugugaaaggggcagaagucuacguucacuuauauugagguguaauuuuuuuaaaaagauuuauuaauuuuauguaugugaguacacaguugcucucgccagacacaccagaagaggguaucggauuccauuacagauggucgugagccaccaugugguugcugggaauugaacucaggaccucuagaagaacagucaaugcucuuaacuacugagccaucucuucagccggagguguaauuuuuaucucuuuucuaauuacaaaaaaauaacaccuuagggucuggagaggugguuguguaguuaagaggacucgcugcuuucagaaggcuggaacuugguuccuaacacacacuacaggagacccuugauugccugauaacuagcuugaggagaucugaugucuuuuucuggccucugcaaguguacacaacacacacacacacacacacacucacacacauucauguaaauaaaguuaaaaauaacacauuaacacauagcucaguaaguagaggcacuugcucauaagccuagugauuucaccuaaguucccaggacccacaugauggaaggagagaaccaacucccagagcuuguccucugaccuccacaugccuguuguggcacaugcaugccuuccaaguuccaagcacaaacacacacauacauacacacacaaauaaauaauguaaccgaacuaaaucuguacaguagugcauuagaaauuuuaaacuacacauaagauauaaaauaauacuguuggcgguucuacugugaguacuuugaguuguuuccccaagucccuagugcuggagacuuuguggaugucagaagacaaucugaaagagucagcucuucccuuccacccuauggguuccagggauugaaugcaguugucaggugugguggcaaguacccuuaccugcugagucaucuugccaacuaccaacguguggccguuucuuucuuuuagguguguguguguguguguguguguguguguguguguguguguguguguguguguguauguguguguguguguguauggaguuucuacugcugugauaaacaccacaauaaacaguaacuuggcgggggaggguuuauuuaacuuauaucuccacaucauagucccauccagggaaguugaggcaggaacucaagauagaaaucuggaggcaggaauugaugcagaggaugcgaccggacucugcuuacuggcuugcacggcauggcuugcucagccuaccuucuugcaguacacuggaccacuagcucaguaguggcacugcccaccaggaccugugccuucccauagcaaccaucaaucaagaaaaugugcacaggcuuauaccggcuugcacaggccagaaugguggaaacauugucucaauuaagguucccucuucccaaauggcaguagcuuccaucaagcugacuuaaaagugcggauuguuuugccugcaugaagaucugucuggugccuuguguaggccagaagaggcagucggacccccuggaccucgaguuauggaggggugugagcugacaugugggugcuggauuaucaaaccugggcccucuggaauagcagucagugcucucaccuccuagccaucucuccaguccucuccucuccccaucccuccccuccuccucccucucccucuguccucuccuguccagacaggguuucucugugugcccuggcuguccuggaacuagcuugaacucagaaaucuacuuaccucugccuccgagcgcugggacuaaaggugugggccaucaccacccagcuugcccucauuuccugauauaauccaacacuuuccuucauauucugugcucugccuuucacccacucucuguaucuuuuccuacaaauguuucuccaucuacccucuacagaugucccccuucauagcacaucacucaguacaggcccuauuugagggauaucgucgcucuugcuugccuauuuauuuauuucauccugacuacaguuuuuccuuccucccuucccuccucccaguccccccaacccccaguccauuccucuuccccuucuccucagagaagggcaggccucccauggauauugaucagccauggcauaucaaguuacaguaagacuaggcaccuccucuucuaguaaggccugauuuuuguuguuguuguucagcuccacacacaaaggggcaucugugugcaugccuucuugugaccugguguuggcaugguaguaccaacuguuggggcagaacuguugacauuuuauugcuugguugguggagaucggugccaggaccuuguagaccuuuucccacuaagcuauggcccagccacccuguguguuuaauaggucuucccaaauucuccucacauguaccauauacccuaggccucuuucauggagggacuagcugaucuucccaccgucauagugcccugcuuccugcccagcgcaggaagucccaacagugcaggggagguggauucccagacugaagagggacucuucuuguggacaaguacagagcaauuuggagaccuggagcccgguucugcuugucacaugggaacaauccugccacaccugccccaggaggcuguucccagguuugaugauggcacucucucucucucuucugcagauguguggaccuggacgaacgaggcugcccagcagagcagagagccaggugggccugagccccagagguacccccuuacuucccgacuccuucauuggccuccguggucaguaaugaagagagauuacccagaaugcacauugucucucuccuuagcccauucuuucuuuacugauuuuuuguuucaacaaguggauacagaucugcucaggaugcuuuggaguaaggaaugcugggaaauguaguucccuagggaugcaggccagguccaagcuucuagaacugcagagugcaguggcagcuugugaaaccucagauuauccgagcugggcaccuagaagcuuccaggauggggugggggcgggcaggggggacgguguuguguuuucuuugcacuccgguggagagucaggcaagucuaggguggcuaagagcucucuggugugugcugugaaccacaccagugcagaaagggugugaacugaggccgugaggucuagaucuggaaggcaggguaggguucuugaccccugggccccaggacucugguuugccagaggagagcuuuagaagggagaaaagcagucuagggugugcucuaagaagcugcugcuugccugugaggcaaacacuggacgcuggcuguaacaacaggccuugugcagagcaagauggggauuaaggaagcaagggugacaagaauguguucugccucgacaugguggcagacaccuugugaccccagcacuuaggagacugaggcacauggcuuguaaguucagagccagucugggcuauaucgugagguagccucaagacuaaguauaccaacaaauaauggucuggugacuaucagggacccugugugccccaagauaagcagaaucauagacgauuauaucauggagaaacacggguccugagaacuuaggugcaacugcugcaaggcaggggaaaccauggcuccuugaagaaugcuuuggcuaguaccugagaguuuugggguacauauaacuggaccccauuucauaugaggcagaagccccuggggugggcugcacagugcagauuaacaagguggguuaucuccugugaaguuuuugagccaagggacauuccuguccuuucauggguucucuucaagcuuccuccucaaacuaguccccagucucugauucuggcucuuguuuccagcccagugacauucaucauugcaacuguggugggcguccuguuguuccugaucauagugguggucauuggaauccuaaucaaacgaaggcgacagaagauccggaaguauaccaugcguaggcugcugcaggagaccgaggugaggcgugccgagggccuccuagcacccccuuggcuuugcagcuagcugggcauucacccuaccacccucucgcuccagcugguggagccgcugacgcccaguggagcugugcccaaccaggcucagaugcggauccuaaaggagacagagcuaaggaagcugaaggugcuugggucaggagccuucggcacugucuacaaggucaggagaggaccaguucuggcauggguggaucugggggaggggcauggucaagagacuggagugggccaagcuggaggcuggggacggcuacuccucagugucuuaaugggggccugacucuagucccuuucuuuucgcucagggcaucuggaucccagauggggagaacgugaaaauccccguggccaucaagguguugagggaaaacacaucuccuaaagcuaacaaagaaauccuagauguaagccccccccccccccgcuagggaagcccuccccccuuacccucccccuugggaaugugaggagcccuccccccuuacccucccccuugggaaugugaggagcccuccccccuuacccucccccuugggaaugugaggagccccccuuuaaccuccuccuugggauugugaagaucaccccccguuuuuguuuuuuuuacccucucccuugagaaugugaggagcuccuaggugcagaucugggcugcuuuuuccucauugggguuugacucuucaucuuccuagucuggaggcccuggcuguagccagugagggagggugagggucucugggagaguagaguggauggaaguugaugguuuccuguaucccucuguucccuugucugcaggaagcguacgucauggcugguguggguucuccauaugugucccgccuccugggcaucugccugacauccacagugcagcuggugacacagcuuaugcccuauggcugccuucuggaccauguccgagaacaccgaggucgcuuaggcucccaggaccugcucaacugguguguucagauugccaagguaugugcuuuggggguugcuggcucugcagaucuuuugggugcaaaucccugccuucauucggggccaggaugaggugggaguaccccuaaggugugauguagacucacgugccacacggaugcccuuuguccaggggaugagcuaccuggaggaaguucggcuuguucacagggaccuagcugcccgaaacgugcuagucaagagucccaaccacgucaagauuaccgacuucgggcuggcacggcugcuggacauugaugagacugaauaccaugcagaugggggcaagguuggaggagggagaggaggagggagagguggggcgggcuggauugguaucugaccuuucuuugggauaacguggaaaagggucaccucccuaccacacccagucaggacuucuuacucugcauccccaggugcccaucaaguggauggcauuggaaucuauucucagacgccgguucacccaucagagugauguguggagcuaugguguguggaggcuguagaugcguugcugggcagggugggaugcaggcagaagaaugaggguggggauaggaggaaggggaggaagguugucuaugucuacccagugcagucuuauggccaccuggggagugaggagacuggguagaccccaccucuuggcacagccccucccuuugcacacccagacuuccucugucccccgacuccugacgccugucuguccuaggugugacugugugggagcugaugaccuuuggggccaaaccuuacgaugggaucccagcucgggagaucccugauuugcuggagaagggagaacgccuaccucagccuccaaucugcaccaucgacgucuacaugaucauggucaaaugugcguggcagggcugagccucaggcaggcagagaggaagggugguagaccugugugcgggcgcuuacaggcugggggauaaaugggagguguccuggagggagccucaaaggugccuuaccuauucacaguggaaguccugccagaggacaucuguggagaggagagaggccagucuaaaaggggacccuagaaacgcuccaggguucugccucaagaucccagaguccaguugugcucugccacgggagggcuuucagcuuagccaggguugucuaggccaggcugguccugggacaaggaugcugaacuuuuuuccgccuuagguuggaugauugacuccgaaugucgcccgagauuccgggaguugguaucagaauucucccguauggcaagggacccccagcgcuuuguggucauccagguacugggcuuucccacaccauaccugcucugacagcauccucccuccugcagggauagccccugccucuagccaaagcucggugaacccuuccagggaacuaaacaccaggcugggagggcugucaccucgugucuccccuuccuuccuagaacgaggacuuaggccccuccagccccauggacagcaccuucuaccguucacugcuggaggaugaugacaugggggagcuggucgaugcugaagaguaccugguaccccagcagggauucuucuccccagacccugcccuagguacugggagcacagcccaccgcagacaccgcagcucgucggccagggucagugcccaccucggaauagggaugguccugcccuuugagcucccccacccucaccuuuccugaagauuccauuaccauggcugcuuuccaacccuuggggccccacucucuccaucacugccaccaucgugaccuguguuucucuccugggaccccguuguuccccucgcagacuuuugaguagcucccaucaugaccuucucuuaccccagaguggcgguggugagcugacacugggccuggagcccucggaagaagagccccccagaucuccacuggcucccuccgaaggggcuggcuccgauguguuugauggugaccuggcaguggggguaaccaaaggacugcagagccucucuccacaugaccucagcccucuacagcgguacagugaggaucccacauuaccucugccccccgagacugauggcuacguugcuccccuggccugcagcccccagcccgguaugaaauccaggcccgagagauugggaggagaggggaguugagaacccucaggcuacacccacugaggggcaaugauggggcaggaauaucuuggacccuuucccuaacaacaucucuucucuccucagaguaugugaaccagccagagguucggccucagucucccuugaccccagaggguccuccgccucccauccgaccugcuggugcuacucuagaaagacccaagacucucucuccugggaaaaaugggguugucaaagacguuuuugccuuugggggugcuguggagaacccugaauacuuagcacccagagcaggcacugccucucagccccacccuucuccugccuucagcccagccuuugacaaccucuauuacugggaccagaacucaucggagcaggguccuccaccaaguaccuuugaagggacccccacugcagagaacccugaguaccuaggccuggaugugccaguaugaggucacaugugcagacauccucugucuucagaguggggaaggaaggccuaacuuguggucuccaucgcccgccacaaagcagggagaagguccucuggccacaugacauccagggcagccggcuaugccaggaacgugcccugaggaaccucgcucgaugcuucaauccugagugguuaagagggccccgccuggccggaagagacagcacacuguucagccccagaggauuacagacccugacugcccugacagacuguaggguccaguggguauuccuuaccuggccuggcucucuugguucugaagacugagggaagcucagccugcaagggaggaggccccaggugaauauccugggagcaggacaccccacuaggacugaggcacgugcaucccaagagggggacagcacuugcacccagacuggucuuuguacagaguuuauuuuguucuguuuuuacuuuuguuuuuuguuuuuuuuuuaaagaugaaauaaggauacagugggagaguggguguuauaugaaagucggggggugcuguccccuuucuccauuugcaaugagauuuguaaaauaacuggaccccagccuaugucugagaguggucccgggccgggucaaaccguauugcucaucugacacacagcuccuccuggagugaguguguagagaucuuccaaaaguuugagacaauuuggcuuugggcuugagggacuggggaguuaggauuccuucugaaggcccuuuggcaacagggucauucuccguuggacacacucauaccaaggcuacccccagaauacuccguuggacacacucauuccaaggcuacccccagaaugaaguccuguccucccagugggagaggggagcuuguggagagcauugccaugugacuuguuuuccuugccuuagaaagaaguauccauccaggaaaaccccacccacuagguguuagucccacccacuagguguuagcagggccagacugaccugugugccccccgcacaggcuggacauaaacacacgccaguugacacaa

SEQ ID NO: 12191 - RNA, 25234 nt, Mus musculus
uugugucaacuggcguguguuuauguccagccugugcggggggcacacaggucagucuggcccugcuaacaccuagugggugggacuaacaccuagugggugggguuuuccuggauggauacuucuuucuaaggcaaggaaaacaagucacauggcaaugcucuccacaagcuccccucucccacugggaggacaggacuucauucuggggguagccuuggaaugaguguguccaacggaguauucuggggguagccuugguaugaguguguccaacggagaaugacccuguugccaaagggccuucagaaggaauccuaacuccccagucccucaagcccaaagccaaauugucucaaacuuuuggaagaucucuacacacucacuccaggaggagcugugugucagaugagcaauacgguuugacccggcccgggaccacucucagacauaggcugggguccaguuauuuuacaaaucucauugcaaauggagaaaggggacagcaccccccgacuuucauauaacacccacucucccacuguauccuuauuucaucuuuaaaaaaaaaacaaaaaacaaaaguaaaaacagaacaaaauaaacucuguacaaagaccagucugggugcaagugcugucccccucuugggaugcacgugccucaguccuagugggguguccugcucccaggauauucaccuggggccuccucccuugcaggcugagcuucccucagucuucagaaccaagagagccaggccagguaaggaauacccacuggacccuacagucugucagggcagucagggucuguaauccucuggggcugaacagugugcugucucuuccggccaggcggggcccucuuaaccacucaggauugaagcaucgagcgagguuccucagggcacguuccuggcauagccggcugcccuggaugucauguggccagaggaccuucucccugcuuuguggcgggcgauggagaccacaaguuaggccuuccuuccccacucugaagacagaggaugucugcacaugugaccucauacuggcacauccaggccuagguacucaggguucucugcagugggggucccuucaaagguacuugguggaggacccugcuccgaugaguucuggucccaguaauagagguugucaaaggcugggcugaaggcaggagaaggguggggcugagaggcagugccugcucugggugcuaaguauucaggguucuccacagcacccccaaaggcaaaaacgucuuugacaaccccauuuuucccaggagagagagucuugggucuuucuagaguagcaccagcaggucggaugggaggcggaggacccucuggggucaagggagacugaggccgaaccucuggcugguucacauacucugaggagagaagagauguuguuagggaaaggguccaagauauuccugccccaucauugccccucaguggguguagccugaggguucucaacuccccucuccucccaaucucucgggccuggauuucauaccgggcugggggcugcaggccaggggagcaacguagccaucagucucggggggcagagguaaugugggauccucacuguaccgcuguagagggcugaggucauguggagagaggcucugcaguccuuugguuacccccacugccaggucaccaucaaacacaucggagccagccccuucggagggagccaguggagaucuggggggcucuucuuccgagggcuccaggcccagugucagcucaccaccgccacucugggguaagagaaggucaugaugggagcuacucaaaagucugcgaggggaacaacggggucccaggagagaaacacaggucacgaugguggcagugauggagagaguggggccccaaggguuggaaagcagccaugguaauggaaucuucaggaaaggugagggugggggagcucaaagggcaggaccaucccuauuccgaggugggcacugacccuggccgacgagcugcggugucugcggugggcugugcucccaguaccuagggcagggucuggggagaagaaucccugcugggguaccagguacucuucagcaucgaccagcucccccaugucaucauccuccagcagugaacgguagaaggugcuguccauggggcuggaggggccuaaguccucguucuaggaaggaaggggagacacgaggugacagcccucccagccugguguuuaguucccuggaaggguucaccgagcuuuggcuagaggcaggggcuaucccugcaggagggaggaugcugucagagcagguauggugugggaaagcccaguaccuggaugaccacaaagcgcugggggucccuugccauacgggagaauucugauaccaacucccggaaucucgggcgacauucggagucaaucauccaaccuaaggcggaaaaaaguucagcauccuugucccaggaccagccuggccuagacaacccuggcuaagcugaaagcccucccguggcagagcacaacuggacucugggaucuugaggcagaacccuggagcguuucuaggguccccuuuuagacuggccucucuccucuccacagauguccucuggcaggacuuccacugugaauagguaaggcaccuuugaggcucccuccaggacaccucccauuuaucccccagccuguaagcgcccgcacacaggucuaccacccuuccucucugccugccugaggcucagcccugccacgcacauuugaccaugaucauguagacgucgauggugcagauuggaggcugagguaggcguucucccuucuccagcaaaucagggaucucccgagcugggaucccaucguaagguuuggccccaaaggucaucagcucccacacagucacaccuaggacagacaggcgucaggagucgggggacagaggaagucugggugugcaaagggaggggcugugccaagagguggggucuacccagucuccucacuccccagguggccauaagacugcacuggguagacauagacaaccuuccuccccuuccuccuauccccacccucauucuucugccugcaucccacccugcccagcaacgcaucuacagccuccacacaccauagcuccacacaucacucugaugggugaaccggcgucugagaauagauuccaaugccauccacuugaugggcaccuggggaugcagaguaagaaguccugacugggugugguagggaggugacccuuuuccacguuaucccaaagaaaggucagauaccaauccagcccgccccaccucucccuccuccucucccuccuccaaccuugcccccaucugcaugguauucagucucaucaauguccagcagccgugccagcccgaagucgguaaucuugacgugguugggacucuugacuagcacguuucgggcagcuaggucccugugaacaagccgaacuuccuccagguagcucauccccuggacaaagggcauccguguggcacgugagucuacaucacaccuuagggguacucccaccucauccuggccccgaaugaaggcagggauuugcacccaaaagaucugcagagccagcaacccccaaagcacauaccuuggcaaucugaacacaccaguugagcagguccugggagccuaagcgaccucgguguucucggacaugguccagaaggcagccauagggcauaagcugugucaccagcugcacuguggaugucaggcagaugcccaggaggcgggacacauauggagaacccacaccagccaugacguacgcuuccugcagacaagggaacagagggauacaggaaaccaucaacuuccauccacucuacucucccagagacccucacccucccucacuggcuacagccagggccuccagacuaggaagaugaagagucaaaccccaaugaggaaaaagcagcccagaucugcaccuaggagcuccucacauucucaagggagaggguaaaaaaaacaaaaacggggggugaucuucacaaucccaaggaggagguuaaaggggggcuccucacauucccaagggggaggguaaggggggagggcuccucacauucccaagggggaggguaaggggggagggcuccucacauucccaagggggaggguaaggggggagggcuucccuagcggggggggggggggcuuacaucuaggauuucuuuguuagcuuuaggagauguguuuucccucaacaccuugauggccacggggauuuucacguucuccccaucugggauccagaugcccugagcgaaaagaaagggacuagagucaggcccccauuaagacacugaggaguagccguccccagccuccagcuuggcccacuccagucucuugaccaugccccucccccagauccacccaugccagaacugguccucuccugaccuuguagacagugccgaaggcuccugacccaagcaccuucagcuuccuuagcucugucuccuuuaggauccgcaucugagccugguugggcacagcuccacugggcgucagcggcuccaccagcuggagcgagagggugguagggugaaugcccagcuagcugcaaagccaagggggugcuaggaggcccucggcacgccucaccucggucuccugcagcagccuacgcaugguauacuuccggaucuucugucgccuucguuugauuaggauuccaaugaccaccacuaugaucaggaacaacaggacgcccaccacaguugcaaugaugaaugucacugggcuggaaacaagagccagaaucagagacuggggacuaguuugaggaggaagcuugaagagaacccaugaaaggacaggaaugucccuuggcucaaaaacuucacaggagauaacccaccuuguuaaucugcacugugcagcccaccccaggggcuucugccucauaugaaaugggguccaguuauauguaccccaaaacucucagguacuagccaaagcauucuucaaggagccaugguuuccccugccuugcagcaguugcaccuaaguucucaggacccguguuucuccaugauauaaucgucuaugauucugcuuaucuuggggcacacagggucccugauagucaccagaccauuauuuguugguauacuuagucuugaggcuaccucacgauauagcccagacuggcucugaacuuacaagccaugugccucagucuccuaagugcuggggucacaaggugucugccaccaugucgaggcagaacacauucuugucacccuugcuuccuuaauccccaucuugcucugcacaaggccuguuguuacagccagcguccaguguuugccucacaggcaagcagcagcuucuuagagcacacccuagacugcuuuucucccuucuaaagcucuccucuggcaaaccagaguccuggggcccaggggucaagaacccuacccugccuuccagaucuagaccucacggccucaguucacacccuuucugcacuggugugguucacagcacacaccagagagcucuuagccacccuagacuugccugacucuccaccggagugcaaagaaaacacaacaccguccccccugcccgcccccaccccauccuggaagcuucuaggugcccagcucggauaaucugagguuucacaagcugccacugcacucugcaguucuagaagcuuggaccuggccugcaucccuagggaacuacauuucccagcauuccuuacuccaaagcauccugagcagaucuguauccacuuguugaaacaaaaaaucaguaaagaaagaaugggcuaaggagagagacaaugugcauucuggguaaucucucuucauuacugaccacggaggccaaugaaggagucgggaaguaaggggguaccucuggggcucaggcccaccuggcucucugcucugcugggcagccucguucguccagguccacacaucugcagaagagagagagagagugccaucaucaaaccugggaacagccuccuggggcagguguggcaggauuguucccaugugacaagcagaaccgggcuccaggucuccaaauugcucuguacuuguccacaagaagagucccucuucagucugggaauccaccuccccugcacuguugggacuuccugcgcugggcaggaagcagggcacuaugacggugggaagaucagcuagucccuccaugaaagaggccuaggguauaugguacaugugaggagaauuugggaagaccuauuaaacacacaggguggcugggccauagcuuagugggaaaaggucuacaagguccuggcaccgaucuccaccaaccaagcaauaaaaugucaacaguucugccccaacaguugguacuaccaugccaacaccaggucacaagaaggcaugcacacagaugccccuuuguguguggagcugaacaacaacaacaaaaaucaggccuuacuagaagaggaggugccuagucuuacuguaacuugauaugccauggcugaucaauauccaugggaggccugcccuucucugaggagaaggggaagaggaauggacuggggguuggggggacugggaggagggaagggaggaaggaaaaacuguagucaggaugaaauaaauaaauaggcaagcaagagcgacgauaucccucaaauagggccuguacugagugaugugcuaugaagggggacaucuguagaggguagauggagaaacauuuguaggaaaagauacagagagugggugaaaggcagagcacagaauaugaaggaaaguguuggauuauaucaggaaaugagggcaagcuggguggugauggcccacaccuuuagucccagcgcucggaggcagagguaaguagauuucugaguucaagcuaguuccaggacagccagggcacacagagaaacccugucuggacaggagaggacagagggagagggaggaggaggggagggauggggagaggagaggacuggagagauggcuaggaggugagagcacugacugcuauuccagagggcccagguuugauaauccagcacccacaugucagcucacaccccuccauaacucgagguccaggggguccgacugccucuucuggccuacacaaggcaccagacagaucuucaugcaggcaaaacaauccgcacuuuuaagucagcuugauggaagcuacugccauuugggaagagggaaccuuaauugagacaauguuuccaccauucuggccugugcaagccgguauaagccugugcacauuuucuugauugaugguugcuaugggaaggcacagguccuggugggcagugccacuacugagcuagugguccaguguacugcaagaagguaggcugagcaagccaugccgugcaagccaguaagcagaguccggucgcauccucugcaucaauuccugccuccagauuucuaucuugaguuccugccucaacuucccuggaugggacuaugauguggagauauaaguuaaauaaacccucccccgccaaguuacuguuuauugugguguuuaucacagcaguagaaacuccauacacacacacacacacauacacacacacacacacacacacacacacacacacacacacacacacacacacacaccuaaaagaaagaaacggccacacguugguaguuggcaagaugacucagcagguaaggguacuugccaccacaccugacaacugcauucaaucccuggaacccauaggguggaagggaagagcugacucuuucagauugucuucugacauccacaaagucuccagcacuagggacuuggggaaacaacucaaaguacucacaguagaaccgccaacaguauuauuuuauaucuuauguguaguuuaaaauuucuaaugcacuacuguacagauuuaguucgguuacauuauuuauuuguguguguauguauguguguguuugugcuuggaacuuggaaggcaugcaugugccacaacaggcauguggaggucagaggacaagcucugggaguugguucucuccuuccaucauguggguccugggaacuuaggugaaaucacuaggcuuaugagcaagugccucuacuuacugagcuauguguuaauguguuauuuuuaacuuuauuuacaugaaugugugugaguguguguguguguguguguguuguguacacuugcagaggccagaaaaagacaucagaucuccucaagcuaguuaucaggcaaucaagggucuccuguaguguguguuaggaaccaaguuccagccuucugaaagcagcgaguccucuuaacuacacaaccaccucuccagacccuaagguguuauuuuuuuguaauuagaaaagagauaaaaauuacaccuccggcugaagagauggcucaguaguuaagagcauugacuguucuucuagagguccugaguucaauucccagcaaccacaugguggcucacgaccaucuguaauggaauccgauacccucuucuggugugucuggcgagagcaacuguguacucacauacauaaaauuaauaaaucuuuuuaaaaaaauuacaccucaauauaagugaacguagacuucugccccuuucacaacaagagcucaaaaaaggcuccccccaugaaggcccuccuuucuacagaaaagacuccacucccuccacucacgagugggugcaguugauggggcauggcugacauaugcccuccucauccggguacuuccagauaggcauguaggagaggucuggcuucacaccacuggggcagcgagccacacaggaagaugaguccuuguagugggcacaagccucacacuggucagccuccuggacagagaggaaggguuugugaggguuuagggaugucaucguuauagcagaaggauggggccccauguccccaaaucagaugcacugccucccugauccuggaguaaacaucccugcucucaacaaggaagugaaggcgcccagagagggacgugcguucccuaaggugugacaagugacaacuauuauguacaaagguuuuauuccaugcuugggcacugugccaaauccuauuuaauucuguucucaccacaccccaaccagggaggaacuauuacaacauucaccuuauagaagugaaaacugaggcuggaaacagggccugcauuuggucauuagcguagccacugccaaagacacaggccuucuuggaaccuuguccuagccugaaagggcuccggugucaauagcaagaagggguagcccaggguccacagcauaaugugagcaguuccuaguccccagucccagccucccugaucuucccugcuucugcucuccagugaagccuucucugggaauauuucacccuguagcaacuggauggacccucagcucgucccucccccagccccgagcacaccagcaccucaccgauccauagcaggucuccgagcuguuuugaggcugacacucgggguggcauggcagacagugcuugccccucacauacucccuggggagccugugagagagguggguguaguaagggguugggguggggcagaguaccccgaguaccccucaagccacccacuccucugcaauucguaccccuuccauacucggcacuccuccacacacuccuggccccggaggaacugacugcaguugacacacugggugggcccuggcccccagcagugcccacgggcacacagugaguuacagaccaagcccucaagaccugcagcaaggagaaggaaguguuuggcuaggcucaggucuaagggaaaaagcuguaagcauggcuccaggcugaaggguuaaggguuggugcuagaacaugcaaguucaagaaacaggggagggauguggaugccuggcagcacggcaggacacagcuggaagccaugcucaaggcuaagccauccauaggcaagugaagaaccaggcuguagccgggcaugaugguucacgccuuuaaucccagcacuugggaguuagaggcagguagaucucugugaguuugaggccagccuggucuacagagugaguuccaggacagccagggcuacauagugagagccugucucuaaacaacaacggggcucuaagacaugaugcacagguuauaggaggcugccgccagaggcuacugagacuccucugugccagcccucagugcugggcuuccugucuuaccacaugccucuucuggccgguucccacuguggaguagggccuggugcggguuccggaagagcuggucccaagguacaguguuuacaaagcagagauggguguugcggugaaugagagccaauccacugcccagcucccgcagugagcguagccccagugagugaauccccaggccuugcaacgucaaugaguaagcaccacuguggaaaugggggcuuccagucacaagaaggcaccuacucuagccaccaagggccucagggcauguagccagaccuccuagccuuccccuccccaccacuuacucauggagaauccguccccgaaugacccgaagguucuggaagacacugaggucuuggaagcucucuggccaugcugaaauguauagguaaccugcaggcagaggagggggcuugguauguagaaagguccagaacuccuaguuccugcgaaggaggccagagcguacagccuaccugugaucuccuccaggguuucgaacacuuggagaugcucuggcuucaguggggcaacgccggaggagggguuccuagagggaccagaaggaguggucaguagggcaggagccccggaaggccuuggcaaagcacucugcacccucacaaaugccuucagauagagccuaucaagccguucucauccugaggcacaaagcccagggucaaagucuggcagggcaauauuuguguccuuuggucuagaagucugauuugcgguauauccugcagagacacuggcuucagcugccagaggcagaaacaagcugaacuguuuguaggaaaagacauuugaaaauggcccaauauccaucagugauacacagaacacugaucucugcauaugcuaaaauacaaacacggggcgaggggugucucggcauccauccagcgcuguucuaagcgugcccacauaaaccgccuugagcauagagccaugaugguccucacugcacacaugaggcacugaggcacagagaagagaggagacggcaaugaggcuaagccauagagcucugccauacaaacaugaggaccugagucaauacccagaaccauauaaaagagcucauguuagccgaacauaggacuguaauuccagcaccuacagagacaggcagaucucugaguuugagaccagcuuggucuacagagugaguuccaggacagcuagggcuacacagagaaaccuugucauaaggaggaggaggagaaaggggaggaagaggaggaggaagaggaagaagaggaaggagagaaggaggaagaggaggaggaagaaaaggaggaagaggagaaggaagcagcagcaccccguaugugauacugagcuuguaaccccagcacuggagagguaaagacaaaacaguuccugggguccccugguugucauuguagccuguuuuagugagcuccaggccagagagggacccuauuuugaaaaacaagauggacagcuccugaggagucauaccugagacuguccuuugaacaaaggcacacacacagauagacagacacacagacacagauacagagagagagaauaacagucaaauaaacagagagggacagagacagacacaaauacagaaagagaaagaauaacagucagauaggcacagacagacagacagacagacagagguagguuuuaaacccaagucugugcccuguugccugucuuugcuggcucccacucgacagcuauuguaagaacgagucagcuuugaggucugaagagauggcucagcagguaagagcauugacaucucuuccacaaggcccagcuucaauccccagcacccacauggccgcucaaacuaucuguaacuccagucccggggcuucugacgcccucacacagacacacgugaagauuaaacaccaaugaauauaaauuuuuuuuuaaaaaaagagguuccccaaagcaagggaugcauggcaguuuccaugaaccaccuccccagucaaagcugucacucuguguccaccaauauacagaaggccuggaagaacacacacaacuuuaacaaugcccccuccggaugguuugaucaccacauuacguccccgccuguggauuaaaugauauguauaccuccaacuccaugcccuggcucccuguggacucccaccugccuccuguguauucuuagccacaaacucuggguccuccaugacaccaccucaggccacuguguacccuuacccaucaaagcucuccggcaaaaaugccaggcucccaaagaucuucuugcagccagcaaacuccuggauauugucacuggugauggcccucgccccucggaggugcuccaugcccagaccauagcauacugaaggagagggaggugaaaaggggccaccucaggaucacaugcacaccagagaccuguccgcugucccaucaugaagugacaagccuccucccuauguugacaagagagacuggggagacugcuccggagaggggcaggggaggcgacagcagaaaagaagucuaagcaagaguugggcggacuggacuggaguggcggucggggccgcagcuggucuuggaaugggguggguaccuccagcacagggcuugcugcauuucucacaccgcuguguuccguccucagcugugaccucuugguuguucgggggacagaccagagugcaggaucccacuuccguggagagguaguugucuguacagauuugggaauguacauccaugugcccuagccucuacccagucauccucgaucaaggcuacgaugcccagcucuaaggacaucucccaccacuccuggaaggcccucugugcgcacccgaacucagggcaaucauuugcucgucacuacacuccuauggggacaacacuguuauuugcauuuagcagaaagggaaacuaggguacagagcuauacaagucacccccaaugcugugcuacuaaaguaacagaacugggauuuuuuuuaaggaguccucgcuaugcagcugaggaugacuuaggaccccuaagcccaccaccucuaccuuccaagugucagggugacugguuugugccacccaggaaccaggacuuaaaccaaacaaucggccuccccgcccccccccccacacacaccuuguccucucacccugaccacagagaagcauaacuagacccuaaaggccacaccccaccacccauaaaaggaaggaaaagaggguccccagguccaaguccagucccuaaguguccacagggcucaggguuacugccacacaaagcccuacuccaugcagacggaggaccaagacacauucaagaguauuuagugcaggcuaggcauuguucucaaagauucaccaacaugaacucauucagaugcuucgcaguuaucaggaugggacuaacagugccccuauuucacagaugaagaaacugaggcccagcaagaagaaggcaguaagacuauuaaacgguaggggacagguuucaaaugcaguucccaagucugggcucuuucucugccaccuguuaugcagcuguuaaacagaaugaggcaaaaaccugggaguggcggcgcacaccuguacccucagcccuuggcaggagcaaggcaggaggaucagaagcuaagugucaucucuggcuauauguuaaguucaaggcaagccagguuaagcuacgugagauacugacuuuaaaagggggucgggagagaugggcgaggcagagacaggaggcucuccaugaauuugaggccagccugcuauacagcaaguucuagaacagccaggacuacaggaaagacccugccuguccaaaacaaaacaaaacaaaacaagaaaauggcaagagccagagagauggcucuugcagaggacccagguucaguucuuaggccccaugugguagcucacagccaccuguaacuccaguuccaaaggaucucauucccucucuucugaccucugcaggcaaugcaugcacauggugcgcagacauacacacaggcaaaacacgcaugcacauaaaauaaauauaaauaaaauaguuuuuuaaaaacuauuaaaggcgcucgcuucagcugcacacauacucaaaugggaacaacacagagaucggcauggccccugcgcaaauucgugaaacguuccauauuuagaaagagaaaaggaaaagaauaaggcacccagacuugagagucaugaccagcccuccaaggggcacacgauacucacagcaugcucccucuuauacaagccaccuuccccggcccaggcauuaaaaggaugguuuuuuucuccccaguacucacaggggcagguggucacacagcuggcaccaaagguguagcgacccucaggguugagcauggacucgaaggugucuguguuguaggugaugagggccgggcagugcagcucacagauaccacuaugauugaaguggaggcaggccuggcagagacaggccgcugguggucacugugauguuuccaccugugcgccaauggccaggagagaugcccaccccuugcguucuagaggguugacccagggggcacaggagcgagacacauaccaggcagucagaaugcuugggacccgugcagccugcagcacacugcucauggcaacagucagugggcagccggcccuugcaccgggcacagccacuaguacagauggugccagucacuguuggggaaagggcaggaugagggcuggguagggcccggacaccagacccucagcuccacugccuucugggagacaucucccaaguaagucacucggcuacacccagccauccaacugccccaaccccaccuccagacaccagggcucccucugacucacagaucugacagucuucaggacucucaccccaacagugauugucuuugcagguuggggcacaagguggaccuguggacagaagcaaagggagacgguaagggugggggaggcaggaaaagcggguagaggcagugagggagggaaguccagaggagaaaggaagcaaaggaaggaagcaggaagaaaaagggaggcugagagggacgcagggaggagcgaauggcgggugggaggaauaugucgcagagcccaaggacaguugcacaggaagggggggacccaaaaaguaaagaggccucaggagguggaggcccugccuacgggcagggagaugaacaaggacagggaaggugggauggguggcugucugggucaggugggcugucccauggacauggcuuacaggcccgggaacgauugguguccaugucgacaggagccagcugguuauucuuacggaggacauccuuccacaaaaccauguccugguagcagagcugaggguucccacggaucaaaacuccucccuucaagaucucuguggggaagacagauagucagccccuuccugaccacucuugggggcuccugacuucccugugagugccagccacacaggagauuaacaagggacuaggaagaggggauggggcagugggggcggugggcgguguucacguggcugggagcuccccacuggccuuucgccucacccugugcucacugugcggaggcaaacagagaggcucaguggcagaacaagcacccauccugccccagaucuaagaucaauccccagcacaaaaacaacaaaaaugucucugaagucugaaaucccacuucaccaccgacuggcugcgugacccugccugccucggauugcuccucuguggagugaggcuaacacuggagaaagcuggugguggcaugccggggauuccagaacuagagagcugaggcaggaggacugcuuuggaaucaaggucuaccugggcuagguagugagaucacugucucaaaaaccacaaaaccagaaaaaccaaaauaaacguaacaaaaaagaaacacuggaaggcuuagcagcagggcuuccacgucuguagcgugaccggagugggguccaguacgcaaagcaccggguacccuaguugggacacugucagcucggggcugucacauacaauuccacagguuauucaccacauacucugacauggccaaaauggagagaacaaaauauccugaccucuacuaaugaaagcugcaucuuccugaagaggaagggaucaagccccagggccuuguccaugcuaaccaagcacucugacaccgagccacugcguaaccuucuuuuccuuauugucacuggggugaaaagagagggaggcucagccugccugcauggagcuugagagaaccauacuuuuaauccucacggagccucuccacagccagaacagcuuagucggcaaccaagaaccaggaaacccuugcaaugacaggaaaggcaccugugagacuucgaagcugcagcucccgcagcccuucugggguucugccuggggcggcgguggugacguuguccaaagggucucgguugucuagcacagccagggcauacuuguccucaaagagcugagucccucucacgaugcgcaaccucugcagugggacguguuucacucgguugugagcgaugagcauguaucccuggacuuccuggauguccuggugggaagggcaggggacgggcagugaggcgcggcugggcuggcgaagcgccugugccucacaaagccugaggguaacaggguuggggcuguguccugcauggucccacuggacacugagcagucuugaccccuuagauccaagauggagcccuaggcuacuccucacuggccucaacagauucuugucuguuagaucaggacugauaagcggugccccaccucucugcacaucucaguaucgagggcuuguacaagaugguaucugugauuuaacagacccacauccauuccuugcagcuucacuccagggccuguggauaugauccacaacgguaggccaggaugucugcuaguccaauauagagagaaacugaggccuggagaagcuaagggucuagaucacauccaaaaggcuggaccuggaacuuaagagcccuaaaggaauaguguuggggacagcuggaccacggccagucacugcagagggagucaacugguuuuuaaguagcuaucagaaaggcacuccugauugaggaaccacaagagagcgaauacaggaauguaguugccccuuccucacacaccucgacucaggaggcucggcaggaccaggucucaccugcaggaaugagaggcuggcauuggcgggcagguagguaagcuccaaauugcccugcaccaccugacagcccugguagagguggcgaagcauguccaggugggucucaggacuggcagggagucgcaacuucaugucgguaccgguacacacugauggaagggaggaagugggucaggacacuggccacgacccucuccaaucuagucaccuccuccacacucacucccuggaguccugucaccucagacagggagaaagcauggcugacagccuuuccucccacaccucugcauccacagggccuagaguagaaugcucuucuguuugggaaagaguuggcaagcuggagagaggcccccuguagcagggucaccuugggcagccagagggacccuaaugugucagcccuuuagggcuuaccacccauacuggguuuuagcaugcugcaaagaaagccucccuuugucccagaacugagggugaaaaauccccaaagagaggcgaugaugaaucaggccccucuggauacccccaucugucucccacgcacacaggcucagggcauucuccuccugccaucgcaacacacccacaugucaacuucccugaucaagacaacuguccccagagugccccccaaaacaggggcaaacaggauugacuggagucauugcugggauaggagggcaggcaggggccuggucaucaugggagagcucuuuggaaaagcauccacacggagaagaaaagccuaggauaucagcuaggaggccuggcugcagauccuaaacagggcgagacacucugcagguuccuacacuggcucucucacccuccuccuggggcaaaacuccagaagcagcuggcagaagguaugccacaagacuccugccacaagggcacacuacucuguguaccugcccggugccaacuaucagccaaaggggguccccaaggugcacugccguuccgagccugccugacccucaggcugggguaccauuccucccacuaaguccucacauaggagaagcugccccucagcuagggggcucuagguagcagcuggcaccaagccugccagcaggggagagauuaaagugcccaguugaacuuguuuuucugcuccggugagaagaugaaucaccuugugcgucuugcccaggagguugggggguugggggagaaggcggguggagguugucuacacaggugcccgagcugcugagagagagacuuccuauugguuaccgcuuugccuucccagugacugggugcagauucaagagacaguacaguggucagcucugggaucggacuuuaggaguccuguugucccggcgacaaggagcccaaagccaaaucccaguuaucaucuugccucuggauuugaagagggcuugcagggcaaaggcugccuucaggagcaucaagcugauggccuucuaguagacagccucuuccccaggaagauagggaaggaagcaaggagggagagugggaaggaacagaaauagaacucaaaggcuccucucuuggauggaggggagacagccaggccuacccaccccaucccgcacccacuugcaccccacccucugucaucuggcucacgccuccccacccuccagccuccccccccccccaagauucccaggagaaacgggagcuagggguggcagccaagcccaaaauaacgcccugcugccaggaccucccccaacacggaagcuucagcugcuuccaugcacagcugucuccagagccagaucccagguccagccuagcuggggacagggauggguggcagagcuggaguagaggcccacccucugugacaguuuacccacugcagcucucugcugccccaucuccaaggggaagggacaccagcuguggcagccaagcaaaggaaaacaacagcauacaccaugguaacgaccugaguaccuacuguauacuucagagaugggggcuacugccucuauuuuacaaagaaggaaauugauucuuccaaggucauagcccaaguucagcaguaaauugcuugcagagcacgcauaaagcccugaguuuuaaucccagcacuugggaggcagaggcaggcggaucucugaguuugaggacagccuggucuacagagugaguuccaggacaggcagagcuacacagagaaacccugucuuggaaaaaaaaaaaaguaaaaaaucaaaaacaaacaaaaaaaaaaacagcaaugaccaauuccagcaacacaagccagaccagaacuacagcuucagagugacagagucucgaugugaauccagguuugccacagaucccuguuccuuccacuaaaccucagcgcacacacggacacacauacacauacauggucacaccacacacauauacauggacacacagacacacauacauggucacaccacacacauacauacauggacacaccacacauauacacauacaugguuacaccacacauauacauacauggacacaccacacacacacacauacauggacuccccuacacacacacauacauggucacaccacacacauauacauggacacaccacacacacacauacauggaccccccuacacacauacauacaugggcacaacacacauacacacauauacauggacacaccacacacauauauacauggaccccacacacacacauauacacgaacacaacacauauacauacacauacauauacauacauggacacaccacacagacauacauggacauaugaaacacacacauacacaacacacacaaacauacauggacacaccaaacacacauacacccacacacacacacuaacaggcacauaccaacgccacaccccccacaaacauaaaaacacaauaauucuccagugagaccaauaaacacacaggcucaggaagggcaggguagcugggcuaggcaggaggucagaaagaguggcagccacaccccacuagccaguuuguuuaucugauuugugguugguuugaguaagagucuuaaaguguuuguagacaggugggaaaauugguacccugagaccuccuccaggggagcuagaagcugccagcugacaccccccccaacacacacacauacacacucacacacacacauacacacacacacucacacacacacacacacacacacucacacacacacacacacacacucacacacacucacacacacacucacacacacacaccaugcugacuacagccaagaaagccuugggacucugccaagucucggccucccucccacuccccacucuuuaccaagcucuccccaccagcuuugaccaugguccccauaaucauccuguuccaagaauuuauagagugggaaaaaaggcucuaauucuacacaggaugcucuuuggcuccaggacaggugucccuccagaaaccccaccuuccaacucuuggagacaaaagcaggaagaagcaggacaaucccagagcaaggcugcggcucacacacagugagugcugggcacacgucuacggagggaaugaaugaaugaaugaaugaaugagugugacuccaccuugugaagagcuuccaagcugaaagggacaaguauccauccaucccucuguucagagcuggcccagguccuuugggucccuccugcugaacacugguaaucaagguucagcccagcuucuagcuucucauguggguucuugucucccaacugguccucagccccagcugagcucuuucuugccuucacuuccagcaccaaggagagaacccaggaccuccugcauccugggcccccagcugcuaucuugcucaccaugugaaagccaauauuuccuuugguguucauaagcucugccaggaaacuaccuacauccccaaagcuccccaacuaggucagaggccagagcucacucaaaugacaccagggcucccuugccgcacacaccugcuguaggacgcuggugucagagcgagagucuaggcucagggucuuuuguccagaaccuuggcucaguuacucuugggcuacagggaggauaugcucagaccaccagggcagaagcuaaauaagacugaucucuaagcccagcagcaucgacugugacuuaguuggcuccaucggugaauauuuacugaccucaauuugguggcaagaacucucacuccccucggagggcccugggcauuaaaggagaggaggaagagaaacacucuguaaacacagggaagcuuuguaaacagaccugcagcaaccuaaacagcagcuuuaaugacucuaaccacugcugaggacagagguucccugcacauccucucugccugacugguggccuagcagaucacagaacugucacucccugaggccacggagggagagcucuccacaggggacaggaaagggacucucuuucugaaucagucuuucacucuagggcaaacacaccuucccggagcccuccucugcccuugcuccacuaguuuccacuuuaccugcccacaucauucccaugagccuguauguccuagugaucucugcaccuuccggcccuccaucccuggcacugcagagggcccaagagaaaggccagcaugugcuagaggcaaacucagcagccaggaaggcaucucaggccccuaucuugaggcaccuucuccagccugggauaggggcuaggaagaccauacugaguaagagaggaacacuuuccugugugacucccuggccggcccaaggcuuuucuaguccguuccuguuugacaacuaaaacucugaucaccucuaaaugcccccuugauaagucucuucaucucucugagguagaguguguguguguguguguguguguguguguguguguguguguguguguguguguuucaucugugcaccugcuucacgggacagugcagagagagagcacaaaaccaucuauggaaaaugaucuggcauguaagaagcagaaagaaguuuuuaaaacgggagacaagcacuuagugggaucuggguaauuacaggagaaaagagaaagccuuuuccauuugauuuugagaugcaauauauuucucucuuuucuuguuaggguuaauuuuacuugaugugugucucuugccugcccuugugucugcacuaacacacaugccuggugccuguggaggucagaauuaagcauccaaucuagaauuggaguuaugaaugguugugagccaccaggugagaacugggaacugagccccaggucuucugcaagaggaaucuauuuaguccccguauguauaacaaaagguaggaagggccuggagagacucagacuagaauugaaauaggaaugaccccugccaaguuaaagaccuguguuuacugcauuucacaaaaccuuuaguacugaggaacccagcaacagcuugauccucugggucuccccagaucuccuuuccccuacacaccugcccaagaccaguucuggggucgaaccuggagcuagaggcagcugauggugcccugcccuuuuaaccauuccuggcaaggcaaacucugccuugucccucugcauccagcagugcaucugaagggaugaaggcucagcagcccuccacucccugucuggagagcagacccuucagauuccagcucuacagcacagggccacuucuggucaacugcagacccuacccagcucaggugaagggucuaaccucacucuucugcacggaaagucagcaggaaggcuggccuccugagaaacugaaaggagacuccauccugaagaaggcaaggggcaucucccaguguuuacaacagauagagcccagugccuugaggaaguuccuagagagggcagaguucauccuguguccccaagucagcagagagacugcuguuuggcaacagaaacugggaggaacacacaaccaucauaaaaaccucagacacacagggguaucccacagugagcacagcagugugcugucaggaacuggggcaggagaggggggcaagggggcacagauggugauacuccaccagccuccaggcucgcuggccucuggagagcaccuacuguuuccagaaccuguguucugcaucuucaauacagcccacugauuacggaagcagugucuccgcacugcucagcuagacucguauuuaugugaaucauauaucauauccuguggcuggucacauugccugggauccaccaguuacuccaggauacuucauuuccccagcccagguuuccccccugggacaaggagaaggcuacuaauguuuccacuguggaguuguucuuaguacuguagaaggaaugcaugcaagccaccacccacggagccuggcagagcugacccacacggggugacugucagcuuuuacgcucaugguagaacuggacauaugggucaguauacacacugcugggucacccucccagcccccaacacgaagauaaaggcaagaaaacaacccagcucucugucuaccccuagcugaccuuacuccuuuucggugcccuccccccgcccccaaaugcccaggaacccuuuccaguuuauuguauggaagccgggaaaacacaagaccacccuucaagauccgagccuucccggaaucccaaagcacacaguacuuaagcuggcucuaaggaaauuuguucaaaacagggcuguggagugugcagcacugugauagagggcuugccuaacacgggcgagacugggauggaggguagggguguuccauccccagcacagaagagagagagagagagagagagagagagagagagagagagagagagagagagagagagagagaaugagagagaacuguugcaaacaaaugccugccccuccuccugcucccccauaucccagacacuaucgauaggcaacucaacugcggagccgccacucgguccucccugcucgacaggauggguuacuuuccccaccgcccccuccacggcgaccccacuggaagcuggaguaacuuacuaaacccaaagggccagagggggugggaagggggaggggaggggcagaggggaccccgaaggcauccugcccaguccgguccggaggcggaggcugccaacuggaagagcucugagaaagcgugaggggggcucgaaaggggggaagcaggcgcacgcacgcacagcgcuucacacacccuccggaggaaaacuuuccgacuaguuucagagaacuuucccaaggaguucccggagucuccuggagcccgggaggcuccgguguagcgagaaggggccgguccggaccuccagugugguucuccgagugacugucccauccccaacugcuccgaucuccuccgggccgcggcgccgguagccggaaucgucccaacgucccggaccgcccggccguggagcucucggggccccgcggcuccggccgcccgugggcgcagccguagcggcccgagcccuccccaagccaagacccaccuuggguacccgcggcuccgggggacaggagggcgaggaggaacccccaacggcaccaggccgccagcuccaugaugaucacugcggcuccggccccauggcucaggcuggaccaggcugcgggcgcggggcgcggcgagggcaggcacaggcgcggcgccggaaggggccgccugggaaggggcgcuccugggcuccggguccccagcggcgggcaaucucagcuccacaacuucacgccgcacuuccucga

SEQ ID NO: 12192 - RNA, 23240 nt, Mus musculus
cgcgcucacucgcacucacaccccggcgcuggaggcgggcggcccgggccccaccggccccccauggacgcccccggcacggggcgcugagacccccgcgucguugcucagcucggaccagcgcgccaagccgagguaaggaggagggagcaagggggcauuaauaugcaaaugcaucgcgauugauuaugcaaagccgcgggucucuggccagcuuggaggcgggcugggggcgcccaggggguucccgccgccgaccucagucuuuuccggcgcccgggugacccugucacagcccgagagcuagccacuuacgcccuggggaaagaaggugcuguuaaguggucggugggccccgggguucgcccagggagauggcgucugggccuccccuucgagggcccgccccggccucuguccggccggucugcugcgcauucccggguugggccccgcugccugccgaggcucccccgcccgccccgccgcgguuuguuuacggugugccagaagcuugucguguccccccacccccccagccaaagagaccgaauggccuuugcaaagcugucucuagcuaggaagggcaaugugggugcggcaggguggaggggcuugcaugggcuggaggagagagaagccccccuccccuccccaccucuccaguugagcauggcuuucugguugcaacacuccuaauugcaaaaacgcggcggguggggugggguggggggagugugagcuuguaguaguggggguguacuugauggucccuagaugauuaggagaauuguuggccugugguuggggaagagaggaagaaauggacccguguucuguguguguguguguguguguguguguguguguguguguguccgcgcgcgcgcgcgugcaugcuccccguuucccucccuugcaacgugucucuggugccccuuuucuaucuugggcccucccuuguccagugugaaaagaaggccugggaagaugucagaggcaaugaagagagccacccauuuuagggacuggaggggggagcacacagaaggaaagccagggagacgggaggccugccccugaaugcuggcucuggacccaggagggggaggggaugaagggggccauuguccaagaugaagggggaggcaaaggugacaugcagacaacagauaugccuacacagacagcuacaugcucacucggggacauccaggcagauucaaggacaggagcugcuggacacacccacauggggacaagggaagaggcaggccuccacugcagaguggagcucaaagggugggacacacccacgggagaccaagagcagggcggagagacggccuaugcacauacccacgcauaggaucacagggagaugcugucacacagggguaagaaggagucauugucacccacaccgagaaagucacuaucgaaugcaugcaugcacacaugcacacacacagcaauuggacacagucgcacaaucauaaaagacccugucauucagaaacacacacauguucacauguguccagucauguagccgucauugcuugccaugacgaucacugucacucaagcaaacaaacaaacaaccgaagcuacacaucaauacauguguacagaacuuagcaacaaguauuuuccuggauuuggcuggggagcugagugagguucuauagacaauaaaaucucugcuaccgagaaaaucaaauuuaucuguauuaaaagacccuucugcauaauggcgcaaagcaugcaguccugauaauagagucucauuacugucacuugcuauaccaccccguuacuagauggcaagcuccuuaagacaugggagaaucucuagaagagcccuggaucccacccagagccgagcacacuaugagcucuguaaacacuuguuaauugauugacugugggaacuccaggcacaggugcacgucuuuacaccuagucucacaggugcagaggccgugccaagggcuccggcugcagucacaagucccaccuggcaguguccagauaacccuguagcucgauacauuguagcuggggcaggaaugcacuuaaaugcacauaaucacagacuuuuucccuuuggcuucuugcuaucuuuuaggcucaggcacuguguagcaaugggcuucccccuccucuuuagagagacagagaaacaagagcaaagugggugcaaggggguuccagagggccgagucacagcccugcagcaggguccagugacuuccagcagcuggguuuguccugguugcugggggaggggcgucuggagaagaguugggaguggcucucuggcccucucaucccuagccuguaagccaguguggaccugacugccucugcaugggguuauuuggcugggccuuuccuggggacccuaaguuguccccagcugaauguuugccucccacugcgaauccaccccuuuucucaccucuggcccuccuguccaaaccuggaagcuuuccuuaggaggcguaagcuggcaaguggcugagugagugagguguauuuuugacuuggaauuucucucuuaacucugucucucucaguugcugucuuggggugucuggcucuccuugugucccugccacuuuguaacguuuuuuucucucucucccccugcgcuccucucuguuucugccacagccucuuuucuuagagcuggcagcaacauucuacauacuuuuccaguuguuaauacucaaauucaggcccucugcacaacaucccccccccccagccuuccucuggggucaguaugggggggugcucagcuggcugcucaggacauccugcgcuuccucagcgcugcagcuguggcuggccagcaaauuuuaagggcugggaauggggagggaaggggaauaggacugacugcugcuuguguugacccucaagcuggcaggcccauccagggaaccuuagucaauucggugggcgcgccuuagguucaagcuacagcucuuuaaggagccaguuaggaggcuccuccccuaacuggauccaggugggaaaaccaugcccccaccaccaccaacacaccuagugcaguggcaggagcuggcaggacccagcugggucugaauuagaacucauggccuuucuucacaucccuggucacugagacccaccuuagagaugugccaacagcugugucuucuuugcccaacuucaugcuugguucugaggguacagcuguuuagacugugccaauuuggggcgggggggggaacuguagcccacacauagcccacacaugagaacagaaagaguggcucuuuuagggaggaaaguugaacagaggcuacuggcacaagaggcccacagccugggguggggguaugcaugggaggggggguuacuaacaugccuggccaugcucccucuagccuuggccugcuugcauaagaauauauucguaaugauucugucauagaguacucaggacuucaacugaaagaugaacugagguuugucacgggggcuacauagccagaugaaaggacaagguaucuuuauucuagcaggacauugcaggauuuauguugucauugguuaaaagcgggauuuuguuguuugcuugggaguucagcugccuagguuugaacccuaaaugcugcuugcuaauuguguaaccuugagaagacuuuaauuuccuucuugccuugucuauaaacuagagaugauaauaucuaccucauuuagcuuuugacauuuauagauauuagaugcuugggaagcugaggcaggaggaucaaggccacucuuaccuacauagagaguugaaggccuuagcuccguaagguauugucucaaacagauagacacauauauacugcuuuaaaagugccccuuuccuaaccagguguagugaauggcacaaagccacuggcuggaaaggcuggggaagaaagacuaggaguucuaagccagcuuuggauacaaagugagacuuccccauaaagcacuuaguucaugccuggagacccuggguuucugguagaaguuggguagagauguacaucuccugaccacugcagggauggggacagaagugagggagcagggaggguccagccaucucaccucucuugcucacagguuguuuuuuucuaacaagacucacagcaggccuuccugccccgccuccucugaccccucaccuuuuaacuuaaaaggagcccuuggcaucucagccugggacacaccuccucggcuaagggcacaugcgugaaugcugggugucaccacaucucucuugggacaaaccucaguguuggcaaugagagacacagagagaaagagagaacacauacaugaacaaaggcaggggguggggggcucugucacccuagaaacuuggggaggagggcagcucucuucuuccuccuuggggggucccaucacccuagcuaccuaccaggaccuagucguggcucacagaugucagcuuccucuauacacaguguccacuaguaaaaggugguggcagagaggcaauggaccagaacauagcaccuggagaucccggaucuguccccgugucccuuacuuggcugugggucuaaggaucaggauccucuuucccacaagccccauuuauucagccccugcucuucaaggugaaguaaggacaaugaaggagcggagcggugucuguuaguagauugacucggagcccuuggugugagagacgaucucaauuccaggucucauggcugccgaggcgcuuaggggaacuuuggagccucuuaaggggaggcaggugugguguguggacagaauacuggcugggaguugggggcuggguuucugccacucaccaguuguauaacuuggggccuggcuuuuuaucauguaguaccugcuuaggguaagggucaagaacauaauagcauaauauuggacauagagcuguagcuugcuagcagagcucuugccuagcaugcaugagguccuaaguuugaucccuagcaccacaggaagaaaaggcaagacaaauaaggcaagcuguuagcaugcacaaucugcgggguaagcuguuccuguggauuucuuucuccuccccaagcagagaaugcacgcacgugccaccaggaaccagagacaguuccaucucucacggagacaucuguggcucucguguagcuggacacguguccuuuugccugaagggcaaagagcuggggguacccauagggaccuccuuccuguuugucagagaggucagaaguucacagguagauggggagacaaaauggauaguauugcacccggaaauacuguccugucucuuugcuuuggaggugggcauucgaccuggagagcagggaguuaggguuuacaguuagguuagugcuaggggcacagccacacccacucagcaguaucgaggaguggugguuugagccaagcagccgcccaccuucucgucuuccucccccuccccuuccucuugugaggaugagaugagcuccuggcuccaaagcccuggcuucguguuucauuuucucuuuuaccaggcauggggaggaggaggggacgagcuuuggugacuauccgaauuuucauacacaucagugaguggguguguugugcaugcauccaugugagaguguuuugugcaugugugggcaggguagggcucugaauaucuccuggaacggguacuggagcccugcagcucugcgcaugcggggugaaugugugagucugcacguguccaugugugugccugagacucagcugcgucugcuguucucccucccucccucccucccucccucccucccucccucccuuuccucccucucucucucucucucucucucucucucucacacacacacacacacacacaaucucucccccuucuauucucuccuuccuuccuuccuuccuuccuuccuuccuuccuucucuuucccucucucccccucuggguuuccuaucaugcucucugccccccucccacugccucugccaguucugacugggugggggcuagcuuuugccucccuggggugccuagaagaacauccugucuuucuccccuccacauacacacaccauuccuucccuucugaagcgacacuuucuguggcuggcagacaauuucuucugcuuuagaagaguagagugcaggaguacccccaagcccugugccccugaugccaucugcugcaagcgccuuggccccgugacauucaugccuccagcguucagcugccccagcuuccagcuccaauuacccuuucggcuggggguggaguggggagaauauacuaugcccaguuuuuuuugggggggggggugcuccuaacucugcuuucuuggagacuuggaucuccugcugcuuucucugaggggaauuggggaaaaggguaugaaaucugguggaggcuggguacucgcccauccaucccuucaaauguggaggcugggcauaaccagggaggugacccuagaccuagcaccuuugauacuuuauggaacuagccuggacuaggggaagggagaagaagcaggugagaaaggcucuagggguguggguugggagcacccucuuugauguuaauacugggcaucuggcccaagacaggcuacuguuuaugucuuucugucuuugaccugcaggggggaauuuccuguuauauuccuuguggugguggcggcgguggaggggggacagggaggauccuuuguuuaagcaaccagucuccccgucaugcacaucccccaucuaaucucccauucccugguguuaaggccuccaguagcuaggaaaccugacuucuugguucuugcucuggaguucuagaaucccaagcaagaucccacccagagacucugccucucuggguccccacccccauccccaucuauaaagcugugccuaagucuguguguacuucuuugacaccugccaaauagucccugccuucccgccuucagucucuccuggcaccgggauagccgagaauuggguggggcaauucugccuaguccuuaccugagaacagaacaggguaggggucugugaaggagggagaggucccagccccugggaggcaucugucucaaaacauaggguguguguugcuaccacagguccucaaugaccauagauacccccuccccacucuuagguugguggcuacuugugggaacccacguuggcaccgggcacgucugcacacagauggcuaugugccugugcaugcccguguauguuuagggcuccuguggcugcccuggccucuccacauuacccuugaugauuccauaguaugggaucgggacaucuaugcgggaugauuggaaguuggggagggggguucuuuaguagcaagcagaggggaaggggagagggggugugaaccuacccacagcacuauuaauagcccacaugccaggccaccaagaaccagcugucaccguggaaaccauuucggcuccccccaucccccauccuccauggggugggacuuaggccgggcagaagcaucccccacccaucuuucuuuguuauuucccuuucucccuuugucucucucuuucaucgaccucuccucccuuuauuuguucuuccuaucucaccccuuccucuccugccugccuucucauuccucccuucuuucuugcccccuacuuccuuaacaucccuggcucuacccgcauccucccugccuccucuuuguucuucccuuuguauuuuuuuuccccuuuugcccauuuuuccuauucccaccccaccccaccccgucucuuccucccuuuucuccccucuuuacagcaagcgcccuaccauaugugugugugugugugugugugugugaaggauggcugggcuuucuucaaagccuuaaggacaaaguucaggggccccagaaagguggggccaaagccagguacagaugcugagaggugugccugcuagccggcuaggggagaggcccugcuggcuucgggaguccuuuggggguaucccagggaucuacggaguagaacaggcagcagugggaaccuggcacagugcccauggaugccgcauuggcuccuuguccccauccccucauugcagaaucacuuaagcuuaaugaaaugcuuccccccccccccacccuaugggcaucuuucccgugcugccacccaacagcucuuauccaacuaagaaagaguggguugccaggccaacagacagauggguccugcugucccguuguccaucugagugucugcaucccauuguucuacccacucugucucucuggcucugagcucuccacaucccccugcaaaaaaagguacuagaaaugaguugaacuggacuccagaaagaggggcgagaggcugcucuucagaaugguuacccuuggcauaacaacacccuucuccacgaaccuuuuccuacccguagcuagcuagccuagcguggacucacaugguugcaugcauggccgcuacacagagccccauauguccuuggagagguuuuuagguguccccagggguuccagagucuugcuaggcgccaaacaaaugccuuaaguagugaagguagcaccuugccccucuuccagugccaggagauaaccauaaccugggcuacaucacauggcacugggacacauucagcccagcacagagguggggcagagaaggacucuccccucccucugugggcacgugcaagcccuuggcagugcccagacacauuuggaguuaaggcugggccagggaggagagaggggaaauaaacaggguggcuuagauuggcacuaccccaggucugccuuguagcaacugguaguggugggauacugggggaagggcaccuccagagcuauggccggaggcaggaacuucccaugccacacucacuccugcugggguucccugccaggcccugcccacagcugcuaauacccauuccuacacaccccgcaccccggcauucuuugccugcccccaaggcccguuccccagggcugccccucucucugcuugcccacuccugggucugccuccucccuucccugggggcgcuugggccucgggcuggcgaguggauuuuuccagcuucuguaaacaagugauggcagcgugccaggcgggcaggagacaggcgggggcagcaccgcagccagggugugccaagcacugaggcacgguggggaggggggugcggggagggagacacccagacccaaagagagagagagaaagagaaagauucaggcagucagacugacucaaugaagccguacuggacacagagagcagugggagacagagcagucagucucuauuguccagccccccagaaugcuccuugcuguugccccucuguucuagccuagcuaagagcaguaggccccagugcccggcccugggcauccccacccacuucuucuccucccccaccuccaccccuuagggcuggcuaugccauuauaaauuuauaacaggaauuucuccacaagccaagaaaaacuugaccuacuuucuugacggcucccugggcuaagucuccccgcucaccacccccaacuccuguccagccccaagugcucaguucuagcuuugggggggguugucagagacagaacgggcccccuuuucuguacuccuccuauucucuccacccagggguugccugagugcagaggccuguccugcuguccugccccuacccagugcccugccuuaucucugcccccuccucucgccccaacuggacuccuuaucaacucaaggggguggggcagggggcccaaggcaaggucucugauacagcagccacgugauggaguuguacaugggagccauacccuuugucccccucccuuaugccugcaccugccugugugcauacacacaggauggcacaggccuacagcagggucacaguggcuggcucagaggaacuggaggugggggguuggucuagcaacccccccccagcuccuaguagcuaagaacggcuagguuucaagacaggcuguggaguuguuaucccucagccaccugcuuucuagcugcaugaacuugagggagucaccaaguuuucugggacucaguuuccccaucuggaaaguucauuuuauuauuauuuuuugauguuauacaauuuuguuucugagauaggggaucacuguauagcccaaacaugccucggauuugugacaguccuccugucucagccuccugagugcugggacuauaggcauauaucaucacaucuggauccaucugggggaagaaaguuuuguuuuguuuuguuuuuuauuuuuaaagaugagguccuuagcccaaacuggucuuaaacuuacuguguggcugaaaaugacccugaacuucuaauccuccugccuccagcaacuaagggcugggaggacaaacaugccuggcccuucuguuugcagagcuccugugcccccuucagaaggcacagaucuguucagucgacaucgucacacaauaguuccuucuccuuuccccaucccggugaauggcagcugaucaccuaagucagcuaauucuuguccugaaacuggacagugggguuugggacuuggcgagagggauuuacaaacccuuaaaggagcaaggcauggugguacauacccuuauuccccagcaguccagaagcagagguagguggauuucugugaguucuagaacagccuggucuauauagugaguuucaggccagcuagagcuaccuagugaggccuagacucaaaacaaaacaaaguccucaaggggcaggaaccgggguuucauuaaugcacaggaagcugagagucaguucucauuggcuucuguugucucguuccuucaagacccuagcguggggcagggauauaagccagagguagaacauaggccuauccugcccacaggagacacuagcaugaacauucacagucccuauacgcucucccacugccccacccugccuuuguggggaccccuaugccugugcggcaaacuacuugucucugcuccccucuugcccuaucacacuggugaauccuaagaaaccuugguuaaagggugguaacuauagcuaauguuuaauaggcgcucauaaagagccaggcauuuguucaaaugugagaauccagacuuguuaccugcugcauagaugaccucauucuuucccuucaucccucacugugucucgggccugcgucguagcucuccaacugcaccugcgaugugauguuauucuggucccguuccuauaccuauccuccaucucuacugccauuuugcuacaggccccugaaaguuacuaaauacccccaccaaauccugcucagugacauaccucuauggcgacaacuucuuaccccugccucucucuucucuccacagguaucuccagacaggacaagucucugaagacuucccagccccuaacccaguaccuuugaccagcuugccccuagcucucccaccugccacucccuggccccucccaccaccagcccucccauuuuuuuggggagcagggcauggugugaaaggcugaguacugaggggguuacuaugggugcugugcccuagggccuggguggcgggggguggguggccugugggcgugggggggccagugugcccaccccagucucuuggcgugcuggagagcauccuggauggaauugaagugaauggaacagaagccaagcaagguggagugugggucagacccagaggagaacagguaacgaaugggccuggcaacccgguaguacggcaacagauauggauagcucucuggguaaaagagagauggucucuguuuuagacauggcuuuuaagcaccccuggacauggacauggagccagcaagccugcugcuuaccuuaguccagggauugagggcaugcucguauuucuuagggaaucgggcacuuagauugggauguucacuuugaaggaggaagcgguaggaaagggaucauuacagguagcagacacucugccccuuccuuggcagugcugggccaucucagcaccccccaccccuacccugugucucuucucuauuguuacccucacuugagcaugugugugaucccaguggccuugccauuuucuucuuucucccaguccauucacugccugaccacaaauaagcguguuauccacaagccauggugcauauaacauaacauuuccggguacaggcaccaauaacuauuggucacaacccacacuuauuuuuggaaucuauuggaaaccccacacacucuuccuuguucauggucaaaggcggggacugcuaugcagcuccucccaggaaguggaagaacacaccagcuaggaaggguuugcuuccucguggaugagacagacggccgcgucaccuugcacacaccacuagggagagguuaccccucauuugcacugcucugcgucaguuuagagggucuccgcuuucccugucugcucuaaguggcacagagcucuguuccauuuggcgugaugucccaagagcaggguacauccugugccuauggccagggaaauaguggggguggggugcucuggugagcaguguagcuaacuguugucugggagaucagguccugagccagaaggccagaagcuuggccaagcaaagcccuugugcccaagaccgguucuuuggagggucagaaauaguagaugggauuugugguuguguaagugggacacuggguaagaaagccccuucccccaaaacccuccucucacacuuagacuuaugagacaggcuguucucacccuguaaccgccacuuggauugccuguauuucccugcccacacuucuggaagagccugcucuuagcucuuguaaaaagauugaaaugaaguuccuagucccucagagcuguggcaccucuucgcccagcccuccccucccccauggccacgugccaucuuguggcuauguguggaacugcacccagaggcucugaggccugugauagcccccugcucaacugggaccaacgugaucccuacacacucacaccaccagaaggcgggaggcaagccuggccuuccagccuugguaggaaccagacagggguaauccccagggugugugaagcacaaggcugucugugaccgugacccuggccaaggucacugugucaguguguugggaacuguaucaggccuuagggggaggggcccuggaacaugguacacacagggugguuguagaagguuauacaauccuugcaugcguagaggcuuauguaaccuguguguccugagguuauguaacacauauauggaaagccuggcaacauauaugugcagugacugagaguugcuaaaaauaccaugcaugaagaaguucagggucuuuuuccuggcugauucuggcguggugucccagcguacaaaaggcccuuugguuuuccuauuuguuaacuggaggcugugaacaggguaacccugauauuuucaguccauguggguuauuuagcauguguacaugaccuagagauugaggaacauguucacacgggacagagggacgacaccauuaggugccuguccagaggcuuucuguagcacauggguaccuagcagaagucuuagagaaugcccagaaaauugcaugcaauuguagauccuaaggcuuauuaccauacuuggguuuaugcugaaggcugcauaguuauucacacucgugggugugauauugcauauauauauauauauauauauauauauauauauauacauacauuugaaagguuauauagauuuaagaauauuccaaggaguguccuauauauuguggcuggaauguauauguguguaugugcgccuuagagcagcgccuuccugugacgggugucuguguguuuggggacuuuugagcauugcuuaaaugugagauguguguguuuguguuuuggggucucacagcaauaccugucugugugacuguacugggcccucaaacaugguuuuggccccaucuaagccccuuaucucucccaugcagcgaccagauagcuagacccuuuccaagcuuugucagcugauauaggggugggggguagaauaagggcauaaggaggggggagaaaccaagccugggggaguggaaaggggugaagucucuuaggugggaagagacugcccagaggcuacucugugugauucugcccacuuugccccaugcagugccaggucaccagauggaaagcgaaaaagaaagaacggccaauguccccugaaaagcagcaugucaggugagccuggcuacaugugucccuuacccucccacuuccccuccccccacagcacacuuggccuccucccaggcuaggccuggaccuccugugucucuggagggaacagccuacagaacauggguuggauuugucugguggugagaauagugauucaaaaccuauucuggccuuugaggaggauguaggucaggaagggccucuuugacccucccaugaccuccucaucaaugguuccaccggccccagggcaucuguucuccuaagaugguugcuucuucuccaagucccuuacucuauucuaucacuuagauguaacguggaagaaaacaaaagagcccuaccuaggccaaguacaauggcaccuaccugcaguuagugcuguuugggauacccauauaggaggauggcuugaaccagggguucaaggccugccuggggaacauaauaagauccaggcucaaaaauaaauacauggaagugaguugggucccugaguggacagucagaaaaaaaaaagacuuccauuauauauaucugaagggaaagggaggggcaauccccacccccuccuccccugguacguccccaggguuuuuccuuucuacuuugagauaaggagccccucccuccguggugauggacugggagaggguugagaaaggccaaguuggguggguacaguguaggagcugcucugaugggcuccgccccaugcccacugccuucacccuuucccccucccaggguauaucccuaguuaccuggacaaagacgagcagugugucguguguggggacaaggccaccgguuaucacuaccgcuguaucacuugugagggcugcaagguauggaugagccgucucccguccgccccucucccguugcugguuccccuuugagucugauaccuggcguaauucagucacauguaaccuagaguggaccgguuguauccuuuucucuucugcauuuaucuggucacuuguucauucauaacccuugcugugacacucguagcugugacacucguaugccaugugucuaaccucucugagccuugguuucuucuugcuaccuucgucauagaguuaauaagcaaauuaaaugagcuaauucaccuggcacggcuuuaaguaacugcagaggggugggaagaggaucuggcagaggugagacucgcgacugugauagccuuuaauacagugccuagcgcugucauagggucagacaucauucauucuuaguguguuaggaaugaggggugugaggcuaaauguacugcacaccugggauucuaguaccugggagacugaggcauaaagaucaugaguucaaggucacccuggaaugucugguugguucugggccagccucagccacaugcccaguacaguagcacacagauuuuaucccagugcccugaaggcacaggcagccuaaugccugugggcugaagccaaccugauccacacagugcauuccagacaauccaaggguacacagugagacccugucucaaaaaaaaaaaacaaaaaacaauaacaaaaacaaaaaagagcaugguacacaguauacaucauacucucaaacuccuugcaaucuaccaaagaagcaauccacacaggaucagugucuuucagaacauaggucauggaggcuggggaguuggcccugugggaaagugcuuacuguacaagcgugaggaugcgaguucggagccccagcuuccacgcagagagcugagcauggcagcauaccuguccgugacccaaaacugugagacagaagcaggaagaugcccgaggccuccuggcuagccaguccagcuugucugucacauaugcucccuagugagacccugugucacauaaaaaaugagguccggggcuggugagauggcucaauggguaagagcacccgacugcucuucugaagguccggaguucaaaucccagcaaccacaugguggcucacaaccaucuguaaugagaucugacucccucuucugagugucugaagacagcuauaguguauuuacauauaauaaauaaauaaauaaauaaauaaauauuuaaaaaaaaaaaaaaagagguccgaaagguggagaaugauugaagaggacccuagguguugaccucuggccuccaagugcacauacacaggcacacacccugugcaugcacacgcacauaugcucuauacugaagauuccugggcuaccggcaguaguaaguauacugcagauucccaaacuguguguguccccuacuuuguccaaaccuuauugugguggagcccaggacucugcuuuuaacaggagucccaggagcucccaauguauccggaaaaaacuaggaccugugcugaagggucaugauggggacauagaggagaagauugccaaagguucuuuuuagcagaggaucaaaggccacagacuuggaaaagccuauuagauacaaccuguuucaaccuguauggcuuuucugggaccaccaccuccugcagguacaggucuuuccagaaggagaucauuuaaaagugagaccaggcaugguggcacaugccuauagccccauauucagaagauggaagcagaaggauuagaaguucaaggccauccuaaaccuaugccugggcuacauaagaccaucucucaaguccagcagugguggcacacacuuuuuuuuuuuuaaguuuuauuuauaugaguacauuguagcugucuucagacacaccagaagagggcgucagauuccauuacagaugguugugagccaccaugugguugcugggaauugaacucaggaccucuggaagaguaaucagugcucuuaaccacugagccaucucuccagccccguggcacacacuuuuaauuccagcacucaagaggcagaggcaggcagaucucugaguuuggggcuagccuggucuacagagugaguuccaggacagccaaggcuacacaggaaaaaacccugucucaaaaaaccaaaaccaaacccaaaccaaaaaaccucucucggacuaacacacaaaggcauacacacacacaaugcagaagcuugaaguuucucuuaaugucagccagaccaaaaaccagucgagaucccaaguuucauagccauguuccuagaaaugauaguagcaacauagccaagaacaagaacccucggcuucaaggacagacagcuaggucacaagggaacaugccccaaagacagaggugccccucuccacuucuagagcuugcuuuuauaaauuuagaaugaaguccaggacucuguaucuugguacaauaacuuuaauucacccuagaucuggacucucagaucucagugucuucuagagaaagcccaguuuugacguggagauuaaauuuaacacacaugaaaggcacgugccacaugcccaucacaaaguaagguucagcagguauucgaacucaccuugcucucauccugauucuucaagugcuuccuuuaaagcaaagacuaaugcaacaauuuaguaguaguaguaguuaguaguaguaguaguaguaguaguagaagaagaagaaaagaugaagaagaagaagaagaagaaaaagaagaagaagaagaagaagaagaagaagaagaagaagaagaagaagaagaagaagaagaagaagaaggaggaggaaagcuuacaagcaaugaauguucccacucugcauucucuugaauacuauuuuauaaauugcauuugcaaggguaauaggcaaaauggugucuaugagaaugcuuuugggaucagcauugccuguagagucauuaagcaagauggccaagauaugaaccggacuuucuagggcuggcgauguagcgcugaugguugacuguuuccuucgaguucacaaagccugggucccauccccagcaccacauaaaccagcugugauaacacaugucuacaauccugccacuccagaggucagaagcucaaggucauacuuggcuacauagcgagucugagugcagccuggacuucgugaggcucuuugucuugaaaaauauauaaugcuuuuuuuuuuuugguuuuccgagacagaguuucucuguauagcccuggcuguccuggaacucacucuguagaccaggcuggccucaaacucagaaaucagccugccucugccucucaagugcugggaugaaaggcgugugcuaccccugcccggcuauauacuacuuuuguuguuauuuugguuugguuuugguuuugguuuuggcuguucuggaacuugcuuuguagaucaggcuggccuugagcucauaagagauccacuugccacugccuucugagugcugagauuaaaggccuguggcaccacuacccugcauaauacauuuaacaaauucuuuagaguagacuucuaaggccucaccgcaucccacggcagcccaggccaggccccgugcugacuaccacacucacuguucuuacuucugccaguauagacaucccucaucccucugcagccugaggguaaggacaugggguucuuugggucucuuuggccuggcaggguccagcaauucuggccccacagugaccugaggaugccaggugacacugacuucccuugccccuccccuccucagucaccuguguaguuggcucaggagaggaagccuuacugaugcacccugcuuccgaugccuccacccuagggcuucuuucgccgcacaauccagaagaaucuccaucccaccuauuccugcaaguaugacagcugcugugucaucgacaagaucacccggaaucagugccagcugugccgcuucaagaagugcauugcugugggcauggccauggacuguaagaggcacccguggggcaguggagcugggcugagggguagcggccgagggguagccaguccagguuaggcuucaucccaaaucccauuugguacccucauaccaccaaaagaaauagaaguccuguguagucuuuuuuuuuuuuuuuuuuuuuaauuuauuuuauauauauaagugcucuaucuguauguacaccuguauaccagaagagggcaucagaucccauuacagaugguugugggccaccaugugguugcugggaauugaacucagaaccucuggaagagcagauggugcucuuaacugcuaagccaucucuccagccccuccuguguagucuagaugcuucuugccguuugaagacuuuagaaagggaguuguugaguaaaaacuccugugcgcugagccuaguaagguuccugcuucccagggaaggcacauccaaaugaggaagggcucuuuccucgacuguagguugguuagcaagucccccacagcucaaaucagaaccugucuuuccuuggaccaaccuacuuggaguugacuuggucccagugauuaaacaugguuuguauugugccacccuauugcuaagugauuugggaagucacuugacauuuguacuagaguguguaauuucugagcuugggaggggguuugccaugcaaagugguuuuuuuuuuuuccauaaacagugguucuagaugauucgaagcggguggccaaacgcaagcugauugagcagaaccgggagaggaggcgaaaggaggagaugauucgcucacugcagcagcgaccagagcccacuccugaagagugggaccugauacauguugcuacagaggcccaucgcagcacuaacgcccagggcagccauuggaaacagaggcgaaaauuccugguaagaaggcaugcgcauugaaaauucccuuggaaaccuugguuugguucagcccaaagcugguacucugucccuguuggcaguuuagaguuuguacacuuguacacaugccuuugcuuucuagggccugccugucccaucuaauggggugcuccaugagaacuggguccaauccucuagauuccagggcggggcuaacccacagggacugaggacauagucacauaacaguauuaugggacaccugcaggguccagguguuguauucaacccucacagaaccgacugccaagugggugaucaguuuggaaggagaugggccaacggggccugguucccuaguagagaaugcuaagggauggaaaaugcacuaaguuacccaacaccaagcagauguguuugcaaaggacucguugugugacucuggccauacaacugagcuaugcugaacccagaaguguuggugauucuguuuuccauauagauuugcagcaaggauuaaaaggagcuauguagagccgggcgugguggugcacaccuuuaaucccagcacucgggaggcagaggcaggcgauuucugaguuugaggccagccuggucuacaaagugagcuccaggacagccagggcuauacagagaaacccugucucgaaaaaacaaacaaacaaaaaaaaccaaaaggagcuauguagagcaggcaaccagccuacagccugguaucaugcuuucaggcaugacggcuguguuuuuauugcaauuuauuaacuacuguccacaccauuaucagcauuaguaagucugaaaugcuggcucuggucuauccucuuccccuaauguugaagccuugaggcagaggcagagcugucuagcaggcuccgcugggacuuuccccccccccaagcugccuuggagcucccccugguggguagggagucuccgugagcgggugaaaggggucugcagccccagcugacccucgucucucucccucuagccggaugacauuggccagucaccuauugucuccaugccggacggagacaagguagaccuagaggccuucagcgaguuuaccaagaucaucaccccggccaucacgcgcgugguggacuuugccaaaaaacugcccauguucuccgaggugaguggcagauggaaggagagacuuguuagagagagucucgggucacuucccaggucacagagccucacuggguauucuucucauguucucuggacauggagugauucuuauagaucuauagauauucagcacaugcguguaugcacacacacacacacacacacacacacacuccuauucuaucugcaggcagcaugacucaucucuucauucugccuagcacuaacuagaaacaggcugcuguacuagcugugggaccuuggccaaguuaccuacguguucuguacuucaguuucugaaggagacugggagaaugaugggaccacacccuuagacauagcugugagguuuaagugcaacagugcaggaggggcgggcucagcccagcacagggugggggagacugugggguguggagaggaugcacugaagugcucugugauccugcuguuccacagcugccuugcgaagaccagaucauccuccugaagggcugcugcauggagaucaugucccugcgggcagcuguccgcuacgacccugagagugacacccugacccugaguggggagauggcgguuaagcgggaacagcucaagaaugguggcuuggguguggucucugacgccaucuuugaacugggcaagucacucucugccuuuaaccuggaugacacggaaguggcucugcugcaggcugugcugcuaaugucaacagguaucuugcuguggcugagaggugccacaaguucccagggcucuugcuugccucucuccuuaguuuugcauagguucugucucaccccuucccucccaggcugacucucuaugaccccuacaauccccugcccugcuagccuaugcucuauucuauuuucuuugcccuccuguuugguuccaggcuuacuuauugccucucacuaccaauccucucucugcccauucguuuucuguuuccagccucccucuccucucugccgucuuucgauuucacuaucuuccuuauggauugcuucauggccgcagguccucagugucccucccugagccccagccaccuccuccugcuacuacccucgucccucagugcuauuuucuccccuugaucccucccagucucucugccucaguaucccaucaugcuuucuccugcggcuuuccuagacccucuuguccucgggccucaugccucucuuugcucccugcagaccgcuccggccugcugugcguggacaagaucgagaagagucaggaggccuaccugcuggcguuugagcacuacgucaaccaccgcaaacacaacauuccgcacuucuggcccaagcugcugaugaaggugacugaccuccgcaugaucggggccugccacgccagccgcuuccuccacaugaaagucgagugccccaccgaacucuuccccccacucuuccuggaggucuuugaggaucaggaagucuaaagccucaggcggccagagggugugcggagcugguggggaggagccuggagagaagggacagagcugggggcugagggagaacccccaucucuucucuccuuccucccauccuuggauagaugcagcucccauacaccccugcacugcccagcccccucagacccuccagcccuuggacagggccauaaaugaacuugcuaugaaaggcaguaugggaggcuaggacccaaguucuagagucucugggaccccaaccucuaaaaaaaguaggggaagggaaguaggaagaauugagagggacaugccaucuugacuguagggucaggaggaaugaggaguaggggcaggugcccuuacucaccccuauacacacagagagcccugccaaguuccuuggccuagauuucccuucaggccacaggucucuacuuccccaaauaccuggguccugggugcaaaggacagcuuggcuuggcuuggcuuggcuuagcuccuccccuggaggcuaaaaaaaaaugguagucauccuaacugcacuuuggaaaccaagcaaggggagaauauaaaugaagaaaaacuagac

SEQ ID NO: 12193 - RNA, 52703 nt, Mus musculus
uggcggcuggguggggauuggcuggaggggcuguaauucagcgguuuccggagcugcaguguagacagggagggggaaccugggguuccgacgucgcggcggagggaacgagcccuaaccggaucgcugagguacaaccccgcucggugucgccugaccgcgucggcuaggagaggccaggcggcccucgggagcccagcagcucgcgccuggagucagcgcaggccggccagucgggccucagccccggagacaggugaagggggugcaggguggggccaccuccccgacggcacgggggacggcaugggggaccccacgguucgucagcugugggggugcuuagagcugugaauggacacuuacauggggcaggaggauaggaggagacacacagggucgucccggcggcacugacguccggaugacaggaaccagccugggaaaggaagggacgcuguaaguuucgagggggagaugcggagagagaguggggaguucugggggguguaggaccgugggggggaggacauucuaggcugaggguaacagaacugacagaagcggcccuccugugacugcucccggaggcuagggacguucgggccaccagagccacugccacucagguggagaucauugggguggaggcguuagaaggagccuccuuccugccccugugcugggccuggccguuccuugccuagccacuuucuuugccuugcucccguuccuucuguagucagcuguacccacuuaggaggugggaacuguugugucucuccuccugccucuccgccccucccccucccccuccccccccccccccagccucugggacuggcuagauuuuuuucuuaagaaucagauuuccuauagaaaauugacaaacuuguauccuuucuaaauucucucccaucucuuucuguguuaagcuaugauuucccccaccuuguuaagaacacuuuuuuuuuucccaauucaaaauaaaucccuggccaaaccagcucuaaagagcaacaaaccucuuuccucuuugacauuguucucucauaaacaccugguaaacucgacgagacgauaaauaauugagccauugcauuuacuggaucgugguguugcuuaauugcacaggccagggugagccaaucaagagugggaguuuucugucucauagccaagcucuuguguaaaagcagaagcuagggaaacaaagacaggcuggccuuggcugaguucuguguguaaacuuuaccuguugggggguguguggcuauaaauugguaaguuggcaaaauccagacuguugcucaagucacuuuuuucauaccugguccacaucccucgguuguaucaauugauguguguauggguacugucagugcuuauucaguuuccuuauucagaguguguguaguuuauaccugcuguuuacuacagugcuuauuuguguaugcauugugaauguugggcugucaguguaggugcagcauggacgugaauauauuaaagcaauaaaucacuucuaucuucuuuuuaauguggaauuagacuguuaggauuugagccagccauuuuuucucuuuuuauauuaaauaaugucuauguuccuugaggaaacauguuuguuucauuauugcaugugccggaccagaacacuaagcgggaucuuuuaauuuuuuuuuaguuuuagacuuuauuuaucuuuguucuauguguaugaguguuuugccugcaugcacgucugugccagugugugcccagugcccuagguggccagaagaggacaucagagcuucuggaacuagugacagaugguugugauccaccaccuggguccugggaaucaaaccuagggcuuuuggggagaaccacugggaagagaaucuggaauaauaauaaugaaaauguuggaguguuuguucuuaguguuagcacacuccccacaaagaaccauuagcagauucaugaaucuuuuauuuucaucuguaguucaucgggacaaauaaccacuuagagauaauccucaguuaugaggcucucgauaggggcugagagauagcuagguggcucacugaaugcuaaccucauuuuguagauaaggaaauugaggccaauaggccuagacacuugccuuaaggcaucgugaguuacaaugguuuaacgucugccuuuuacauauuucuugguccaugcuuaaguauucaguuucaauuuagagugaguauguucccuguugagaaguaucagagaaaaucugaauaaugaaacauuggcagcugaaagccaaaguaacuguucugugucucacccucucuccucccucuccccccucucuccuuuccccucccccuucccccucucucccucuccuguuagcauaauuuacugucaaacuucagcuauuuuuuuaauggagauguuuaggcaaauuuuagcuaaagggcggcugugaccucaaugacauuucagccggagagccuuguggucaguggucguuucugucuguagaaaguuccuuuuucuuuugucuugacauccaaaugugagaagggcgcggagguagugagcaccuuccuugaugcccaagcccagaagccuuuuagcugauguuuucuaagagauggugaugguguacagcucagagaauacuuaaccucucugacauugugaaaagugcuagggagagugacaucuuguguguagauuugcaggcuguuggagcaacuugauaaaugcuuuauugucuaauacaacacguugaugucauuaaggagagcaaggcauuauuacuuacaccugugccuucugucccucccugcucucuucuuucccucaguuucccucccuuuuacucuccuuuucucccuuucuggggacgaaaccuagguugcuaacaagcacucuaccacggaacacauuuuaugucauucggauuuuaaaguucuagccaaauaaaaaaaccaaaaaacucaucuaaagagugcuugaaggauagcccuaaaucuugaaggacuccuggugcuguggaccggccucagugagaugguggaggauggcauuggcuugcugucuuugauggugaaaagaauguuuggcuugcucuggugcagauaguugggauuaccagauuguauuugguggcaaauucuuggaaauaauuuguuuaaaggaguaacauuuggaagaaugaauuucuacuaugguucucauuuuuuuauguuauguuugcuauaacuuuauucagcuaacauacacacacacauacacacacacacacacacacacacacacgcaugcacacaugcuagacggaugaauggugcuggcggcacaugcccuuaauuccagcacuuggaaggcagcagcaguggaucucuaagaauuaagggccagcuggucuacaaauugaguuccaggccagcuaagacccuggcuuaagaugaacaggaacaaaacacuaagcagaagcuggccauggauguuucaugucugcaguuuuagcauguggcuagccaagaacugaggccaaaaaaaaaaaaaaaaaaaaaaaaaagugaguuugaagcuagccuggguuaccuagugaauuccaagucugcuuugaguagcuaauaagacccugucucaaaaaaggcuaggcaggucugcugguauaugcuugcaauucaaggauuugggagacacuggcuggaggcccacuaccaauuuaaggccagguauucugcguagcuagcuggagacuaccuagcaaagccccgguucaagaaaaaguauuuucacagagacaggaggauugcugcaaauuugaucaagggaagccugggguucaugguuucaggccagcuggggcuauguagagaaccccguguuaaagaaccaaaccagaacaaaaccacagcagcagagaguagaagcugggcaggagccaaggagaaugaguauucaaaaccccacccaaguucucauggaacuguaggccuaguggggaccagagugcacacuguugcaguauucaccuaaggcagaggagugaguggcucaagucugaggcuacggaggcagagagaccugggauccgauccuggauucacugcuucuuggucagaagcuaagccucaguccugccugucccaccacggccaccccccagcuccccuccugucccaccacggccaccccccagcuccccucugguuuuuuuuuuuuuuuuugagacagaguuucucuguguagcccuggcuguccuggaacacucucuguagaccaggcuggccuccaacucacagagaucugccugacucugccucccaagugcugagaccaaaggugugcaccaccacugccuggcugagccucaguuuucuuaccuaacuuuaaaaaaaaaaaaaaaaaagacagacaaaaggguggggggaaggucggucuguuggcauguuggcacaugccuacaacuugagguauacagggagacccucucucaugcaagugaaauguuuagagcaugcagcuccacagcaagagcccuguauaucuuaaguucuuaggaaaagguccaaggauagagaggcucauucuauacaggggugagagguuacaggagggcuaguuuccgggaacaccagagcacuuacaggaggguuaggaauucuugcagagcuuguacaguucuuucaagguggugggggcguggaugugcugagcuuaaaacagcauaguggguuuaggggcuaaaaguggaagcucuuaauugaggagaaggaaacaggaaggccacagagccacaucuuuuaugccuucucuucugaucaugucacuagaacuguguuuuaaaaagauugaauucuuuucaugauaguaauauaugcuguguuaaaaagcuuuaccuguuuuccuguuaauaguucaguguguguuuucccagacacucuuuaacuuaccaguucauuuuggaucuauuuuauugaaaaucauuuuaacagcucaacaaaauaauauggaaggcaaaucuacccccauaagaaagugauguuuagaccuuggcuuuccaucuugccagcucuaucugugguaauaaaugacuuuacucaccacugaacaauugaccugaccuuugaccuuuuaaaugcgucagucaagaaacucacauucugagcucuccuaagguaacuauugcuugggugaugugcuugaggguuuugugguacauggacagacgcaauggcauucuaaagcagcgcuaugaggccagacaccuuggguuugaauuuucagauacaacaccucuuuguccuuaaggcugguugcuuuaacaucucugaguuucaauuucuuuguccacaaacugccugcuggguccacucacaggguagcugugaagaccgagugagaucauuuguuacaucauaagaaauuuugcguggugccuagcacguagcuaacauucaaaugauaucaauuaacacugaaaucuucaaucuuucucucugguuaccaaguugggcaaguuaugauucauggcaccauuagugaccugaaggaaagaaagaguaauuaggagauuuugaccuacaggggaagcuaagugacuagggacuggggauuuacauggugacagaggagauauaucuuugacauagagauauagacauggcaaacuguacauuccuguuacauagaggcucucaugauaagccucuuugcagcuucaaagaccuaugauccacuccauguauuuuaauagucaacacauugaaaguuaucacuacucaguaauagucccuuggaguuuuucaugcucuuaagaaguauagacagcuacaggcuaggaacauggcugaguugguagagugcuucucuaguguguaugaagccauggcuuccaucccuaggacuagauaaacccagauuuaguggcacacuccucuaaaaccccuuguuggguggagauaagaagaucagaaguuugaggucaccauggacuacacugggaguaugaggccagucugggcuaugugagacacugucuugagacaugggugguggugguggguguugcugguggcauggcucaguggguaaaggugcuugccuucaggccugaccacuugaguuugauuucuuucuuucuuucuuuuuuuuuuuuugagacaggguuucucuguauagcccuggcuguccuggaagucacuuuguagaccaggcuggccucgaacucagaaauccaccugccucugccucccgagugcugggauuaaaggcauacgccaccacaccgggcuacgaguuugguuucuggaaccugugugauggaaggugagaauuguuuuccacaaguuguccucugauguccacaccugcagcaugguuuaugugugcauacauaugcacaacuagaguaauagacuaauguaaaaugauuuuauuuauuuauuuuaaagaauauauauauauguguauguauguauauauauguguguguguauauauguguguguguguaugugaguguguguguguguguguacacucuacacucuagcugucuucagacacaccagaagaaggcauuggaucccauuacagaugguuguugcugagaauugaacucaggaccucuggaagggaaguuggugcucuuaaucacugagccaucucuccagccccuaaaacaauuuuuuaaaagggaagcagagagaauaugauuggugguguguguucauaaaccccagugaugcugaagcugaggcaggaagacuagguguuugagaccagccuggaacuugcucagauucugugucagauuuuugaaaaagggccagagauauauaacucagugauagaacauauuccuaaugugaacagagcuuuggguucagucuccagaaccacacauaauuuuauacacuauauauauaucacauacauacacacacacauauauaucacauacauaaacacacacgcauauauaucacauacauaaacacacacauauauaucacauacauauacacacacacacacacauauguaauguguguguauauguauauauguaugaaugagagacagagucucaguauguagcucuggugguggcaggccuggaacucacucuauaaaccaaguuggcaucaaacucagagaacagagaucugccugcuucugccucccugguauuuguauuaaaggugugugcuaccauagcaaaaagauaagggacagauacucuuggacaguugaaggguagaggagugguuaggguugaaucuuucuuaggaaggaggagacgggagaggggaagaagagauccagaaggcuuggacguuggaugacauccaugaaugacccacaugaugcuggaaguugcuuugcuguguccugugcagcugauagcgucucucuucacaucuguguguguguguguguguguguguguguguguguguauguguauacaagcaugugugagggcgugaauggacgugcagauguucacaguuacccuucacuugauguguauauacagcuuuaucuuccuguucuguaacuuuucuuuguaccuaacaagugaauagccucacagauaacaaccuagcucccaugagucaaauuuacuauucaccucuuuaaguuuggguuggagaagacaggaauggaccugcaaccaguccaacccagugggcccauguggaacagaaggaagccagcggagcuagaaagagaaagugaaacuuguaacuaauggcuuccguguuguggaggaggggcgcaguuuauuacggggauguuuggguaguuuuuguagaugccauuucugaaaacugcuugggauuaggaaagaaaaacccugccugucuguguagccaucugcuuucccgacggcugauugauuuuauuaguuugcggugucccgaccucuuguucucgguaugagagucugugcuuugagucuggacucugcaccugcuuaggugaaagcuuacuagcaaguuuccccacauuguaucuaaugcuaaauuuguuuugcuuuuagagagcucgcuuuuuuuuuuuccuggcagaaucuaaaugcauuagacuguuccuuugucucccccucccacccgcacaaaaauccuaaaaaccucaaaacccaaaugcaagcuguguaauuaccuuucccguaagccaaacaaugugaguuaucauuaaaauaguuagccuuugaaguuuuuccuacuugugguuuggacacaauaaauauuuaauguaaagcugacuucccuuggcaaaucaguguuguuguggucuuuuuucugucaaaauguuuaggaaaaacaaacuucuuaacauuaaucaaaguaaacucaugcauaagagggggugagguaauuaaagagcucugaagccgguguguauguaaauauaugugugugcauauaaauguguguguguguuuuaacagguuucacugucuagcccaaagaucucuccacauuccucugccucagucucuuuaauacucauuccuaauuacaugugagaaaaaaaauccaguaugacuucguucaucagggcaggcucuucguggaacggggaguguucugggcgugggacgcuuucaagccccagugacuguauugaagauucucagggucacggagucauugggaaagucagugucuacagugggggcacugcacaugagagcaggugggaggaacugggaaugcuguacccugcucaguuuugcugagaaccaaagcugcucuggaagcuaaauguggugggcuacacuguaguccuuguacuugggcagaaacaggagcgccuuggugaaucugagggcacuugggcugcauaaccaguaccagaccagccagggccucaguggggagcaccucaaaaugccaacugcaagcaaauaaauaauaaguagauaaauaaauauguguaauuuccucuauauuuuuaaaaagcugauuucaaaguuuauuaauuaaaaagugauuuuuuuucccugcagaaauaucugggugcccuggaugacaaguguucuguggggucuggggucagcauggggggacagugcaugccuaagccgugcagagcccugaaaggaugacagaggagcuggggugugggaugugagcagacacugacuuaaacaugagaagagaagagaagguggcuuuguccaagggggaaaaguggugauauuuguugcaauuuguaacauguaacauuugaacuuagaaaacgauuaaaaaaaaacuguaaaaaaauugagcuuagcaguaaaaauuaaaaaaauauauacuuccccuauucaguaguuuccuguuauuaaugaauguaaguaacucuucaguguuaucggaugugauuuuuuuuuuuuuuuuuguaugauggagacuaaaacgugucagcguuuaaguuugugcaucuuaaaagcaauguuuucuaaaugacuaauguuuauuacaaaggcacguuggcagacauuccaugaaagguaccagguagagggcgucuuaauguagccgagggugaccccagagugcacaccuaccuguccuguggagcuaucaccuggcaguguuuuaaauggcauuaaagauuccagauuacuuugaaagaguguguaaucugcuauuugcuauucagcauaucuggaugaagccagcucucgauggaguaaccaaagcaauauacugcaacaagcauauguaagcuguucugagacuccaacagcucuuucccucccucccucccuucccuuccuuccuuccuuccuuggcucucaugcauguuagacucaguuacuuagccacgguuagcccugaacaccgaauccuucugccuucaccucucaagugcugggagaauacaccugaggcauugcacccacccagcuuuaacacuuuucuauuggaccagaaauuagauuacuaaaauuuucuauaaaaaaaaaaaaaugcaguucugggagagccagggcuacacagagaaacccugucucgaaaaaccaaaaaaaagaaaaaagaaaaaaaagguauuauuagcugggcagugguggcccacaccuuuaauccagcaccugagagacagaggcaggcagaucuuugugaguuugaggccagccuggucuacagagugaguuccagaacagccagggccacacagagaaacccugucuugaaaaauccaaucaaaucaaccaaccagacaaaaggcacauuuaauuuuaugauucucuguaugugcaggcauguguguggagaucagagagcaauuuucugcuguccgaucucuguuuccacuuuuauauggguucuggggauggaacucagggugccaggcuuguaugguuggcaccuuucccucaacuccucugagcccucucugcagcccuacauuugugaaacuuucagcggugccgcuuuucccacugauuucucccccuucggaacaugugguuaccuuucauaggcuauuccugcgacuuauguuaaugugcugugcacaguuaauugcuuaaaugaacuuuguuugagacagugucuucucgugcaaucuauuaggcuggccugggauuuagggaccuuccauuggggccucuuggccagcuuauacuuauaacuucuauugauaggugguaucuaauagguauuuucugguguuuugagucaaggucuuguauuuccaaguacccuugaacucacagauccuaagcuggcuucaguuuugugguaauccuucugccucagccuccauugugcugggauuacaaguacaugcuaccacuacaaauuuuuaggcaucucuaauaaauauggucucuguaaaugaagcuuuguuaggguccuuaaauuuugauagcaagaccaguccuaaaaacagugcauuuugagaacuguuaaaaacuauuaaaacagccgggugugguagcacacaccuuuaaucccagcacuugggaggcaguggcaggcagauuucugaggccagccuggucuacaaagugaguuccaggacagccagggccauacagagaaacccugucuugaaaaacaaaaaaacaaacaaacaaaaaaacuauuaaaacuauuaaaagguuuugguauaaauauucuugagcuguuuugaggagcuaggguuggggagggagaugacaucuauggcucugauuaaguggucucgggacauuguaaccacugugccagguaucaugguacagauggguccguaauuugagaaacacuuuuacaagggccauaaauucuucagaugaaugaaguccugucuagaaguuuggaaguuauugucuuaaagaaaaacugcuuuggagauuccuuuuuaucuugauuuucccugguauuuaugucucuaagaaugaaucuuggauugcgucugauugacaaaagagccauaccucaccagauucugguagcuucugagugcuugguugauuucuuuucuuguuuuguuuuucuuuucuuuucuuuuuuuuuuuuuuuuuuuuuuugguuuuuggagacaggguuucucuguauagccuuggcuguccuggaacucacuuuguagaccaggcuggccucgaacucagaaaucugccugccucugccucugcugggaucaaaggcgugcauaaccacacccggcuuguuuuguuuuucuaagaaagggucuggauaacccuagcuguccuggaacucaacuuuauagaccaggcuauccucaaacucagagaucuaucugccucugccuccugagugcuggaauuaaggcuuucaacaccacacgcagcuauaauuuuuaaagauaauucugaugcgaauuacaguuuaauuuggaaagaaauguugacuuaaaucagauauaaaaggaaguuuuuuucuugcuguagugacuguccuuggauguuaucugccaugcacucacuucccuuuaucagcuguagucacuucucucuccugucccucucuauaaaaugggaaagacuuuuacugggagccugcugauaucaucaguacccucaggguucccucugguugagagagugacuggagagauuccuugugaauucuugcuuccggcacagguuacagcucucccugaaaccugaauaggguuguuguuguuguuucccuccuccuccucuuuuuuuuuuagcagaguuucucuguguagccaugacuguucuggaacuuacucuguagaacagacuagcuuugaacucagauccaccugucucugccucugcuggaauuaauggcuuguuccaccucugcccagcuuguuccuuucuuaaaaaaaaaaaauuaaaauuaacuuuauuuaguguauauguauccccacauauacacuaggucagaggacaagcuucaggagucagaucuugcuuucuaucauguggacccuggggauugaauuuuggucuucagguuuggcagcagccccugcugagccauuuucugacccuaauauuacauuguuguugccuucugugugggagccaaucaugagagcagucguucuuauuuauucuucucaguauguuauuaauuuugugaagacuucauagaaaagcuuguguaguuaaucuuucuggggucagacugcuuguuuuguuuuguuuuugcuucguuuguuugagacacggucuuuaucccaggcuggccucauuguauagcugaacaugaccuugauuuuuguuuuuguuuuuuguuuuuuuguuuuuuuguuuuucaagacaaacccuugcuggguugcaacuggcuuguagaccaggcuggccuugaacucacauagcugcccaucucugccuccugaaugcugggauuauagcauaugcuaccauagcugguuuauguggugccagguaugcuagguaaacacucuaccaacugagcuacaucuccagcucuaggcuugucuuuuuuaaagcuuuccauaaaguuaaauucauuucaaacacacacacacacacacacacacacacacacacacacacacacacacguuugagucauuguuauaaagcucugugugggccuguugcuugauauauagucuucauuggccuuagaccuauggcaauccuccugucucugcuuccagagugcugggauacagguagguugacaaaguagaaaauaccucuuacuuucccuguccaguuucuccauugcuagcaucuugcauuagugugauacauauuaugcaguugauaauagcagcuauauguuguuauuaauuaaagaauacacaguuucuaucacacuuuacuguuacauauucuuugcuguuugauaguguuggagacauguugucuguuguagcucaggaugcaaguaaacuuggaaucugcccaucucagguucuggaguccuggcauuccaggugugccccucugugcuugggccauuuuguggauuuccacagacaugcuguguggccaccagcacaguaccacuugaaguacacucugccuccauagcccggugcucuacccacucaccccucugcagccccugccagucgcucauccccuuuuucuaucuccauaguccuguuuuucagaauauucaucugacaucauguaagcaguagccuucuaggcagcaguggcccagugccucucugguucgccuucuuucacggagcaguaugcguucagcuuccuccuugccuuugguagcuuugcgaggaacacugccuuguaugacccuucccuuagugauguucccuucaucugaagggcaucuuggcuuugucguuugggcugauaggaauaaagcuacccauuauuguuuggguuugcacucuucuaaugaccaggcuggccucgaacucagaaaucugccgccucugccuccuaaguacuggcuuucauaugccgucuguguacucucuuuggugugauaucggaucagacuuucucccaauuuuguuccauauuuccguacaauggaaauugaauuuaggguuccacagcuggguguaguggcauguuccuuuaaucucagugcucaggagacagaggcgggcaaaacucuguugaguuugaggccagacugaucuacagagggaguuacaggacagucagggcuacacagagaaacccugccucaaaacaaaaaagcaagcaagaguuuaggguccuacuuacuggcaaguguucuuuaccacugagcuacaccccgauccuuauuuuaaaaaauuuauuuugagaccagggucucauaacuuugaucaggccagucuugaaguuguguuguagcccaugcaggaccugaccuugggaagcaccugucuugguuuucccaguagcugggcuuacaggccugcucugccaggcccagcucucacccagauuuacacggagauuuuuuuuuuuaaauuguugagaguuuuaaaaguuucucagucuguauuguauauacaaguguacauguacauuugggggaggagaccagggccauaacacacaaggcaagcuccaacacugaucuguagucauaguuuucuuucgauguauuggguuuuuuuguuuuuuuguuuuuuuguuuuuuuuguuuuguuuuuguuuuuuucaugaaacucaaugucuuaacacuuguuagacugggcuaugccucuagcccgccuccuuuuuagguggcauauaguuuuaaguuuuucuuguuggagaauucagucucaugcagacacuaaugcugugagcuugaagucagagacaaggaagugaaguacuuguaucucaccagcccaaauggauaauuaugaucuuaaccuuuagcuccacugccuuuagauaaggcugggcauggggcugcagccccaacuacauaccaaggugcugacacuucuguucugacugcugucucugcucuuagaccuguccccuggauuauuucugacuccuccuuuggaacugagccuugcugacuuggaucuugcccagcuucuacucucuguugcugcuguuuuguccugguuugguuccuuaacacaggguucucuauguagcccuggcuggccuggaacucaauauguagaccaggcuggccucaaauuugcagcaauccuccugccucuguggaagugguuuuuuucuugaaacaggauccaacaagcuacguacaaaaaauggucuuaaguuacugcuagguauguaaccuugggcaagcauugacauuaaggcacacccccaaccugaaaaauaauuguuugagaagaaucagcauuucuagaauuauucuucuugguuuuuaauuuaauuuuauuuuuuaaaacuuaaaaugugugcagaugcaugguguauguguuguggggggaugcaggugcuugguguuuguauagaggucagagaucaauuuuguggaguuauuuuuucuucuaucuuuaugugagucccagguuaaauucaggucaccaggcuuauacaacaugcccuuaccuacugggccaucuuauuggccuucuuggggcccauuuuaaucucugucuuuugggggguauaaauuaaaggaaaaaaguaaaacauagccuuccagggggcucugggcuuuauuuaaauuaaaauuuucaaaaugauuuuauuuuaucuguauggguauuuugccugcaugaauaccugcaguucacggaggccagaaaaggacaucagagucccuggaacuggaguuacagagguugggagcaccugugugggugcuuggaaucaaacccagguucucuggaagagcagccaguacucuucuuaaccagugagccaucucuccagcccuuuuucuugagucuuacagaccuuuccuuaugcccuuccuuuccuggucauccuucuucugaacucaaagguugaagagccuuugcccucucugggugggguucucuucucuucacuuucuguguucucuauguagguuauuucagccacugcuuugauguauguauguauguuacauggcuggggaguaaacccagggcuuugugcauggaaggcaagcgagcacccuaccgacugagcuagguccccagcucacuuagccauuacuuuggccauaauucugauaaugaccaccagguguucaucuccaccccuguaggcuucuagcacccaccucgugcugcuuuccgacauuucuccauggguaccuuguguguacuugccucuugguccuacuguugaaaacuuaaccccauagccaccucucugaaagucugugcuucucucuucguucaacaaugaaauaaaugauaguucuuggucugcugucuuaguuacugcucuauugcugugauaaaacaccaugaccaagggaacuugaaaacauuuaguuuggaguuuaugguuucagagaguuagagaccauaauggcagggaaccuggcagcagacaggcagacauagaacugaaguaacugauagcucacaucuugagauguaaucacaaggcagagagagagagacagacagacagacacagacacauggggcagggagacugagacacagauacagagagaaugggagacacacugggaauccuguuagucuuuugcaaccuccaggccuguacccuaugauauacuucuuccaaugaggccauacuuccuaauccuucccagacaguuccaccaacuggggaccaaguauuuaaacacacgagugugugagggccacuccuauucaaucaucauacugugcaagccagagccccccagccaaccuugacuccuucccucccucauccuccugcuucuguucagaucggcagcgagucuugaucucacaucucgaguuuccucaacuccccuugacugucaugucccuucugugguggugaugcuaaaauugcuccuguacaagacucgaaaugcuggauaaauggagcucuccaguaaaaagaaaacuuaagaugcaaaagcagauagucucaucaaaagaaagaacagaugcaggccuggaguguuucaucccacaccacuucuaaguauugauccccagucacagcccuaaaaugccucaggcuuuugagugcugcauuauaggcauagaccaucaugcuaggcuucaggaguucucacucccaucccuucacaccuugaccuggcuucacugugcagcccauagcccaggcuggccuugaacucaccauucuccuacucuagccucccaaguccugggcuuauaggcuuguguuaccacauccagcuuauaggaucaucaccuauucuccugcuauccgcugaggcuucugaccugccaucuacuguaccuuccaccuccagcuuugggcuguuugagguuguaggccauacugcacauccaacagcacuuuggugcuauuuucuuaccugugcuagcucagguaccaugcugcacucucuggguucuagaguucuaugagcucccccccccaaucccuuccaucuugcuuuucauucuuuguccaugugcuuagguucugaucacucagaagauucgucacauuccuuguuuucacacgcuguucccuuugcuuagacuggcugccccuuccucuccagaauggccaugucuccuguagcccugcuaucuuugugaaacuuuccagcucucauucuuagggcugccauuccaucaaaacagugcucggugccuuagacaguaggaaccaagcugcguagagcuugcggggacucuuugccuuaccagaugcuaccccaagcugccucucaggcuuugucuuugucuuagaggaggcucugacucuaccuguguuucucugggcuuagcagagcaccuggcaaagaguugcugaaauauucagcaagccaguggagcccuguacggcuggccugaauccauagaucggucagaaaaccacagagaaaagaaaagcaugcauuuugcauguugcucuaccaaggccacaauuauacucuuucuuuuucugagauagccucugagcagucucaacuauucucagacccacaaagucuuagucaucuaaguggugguguugagaggcagacaccagacucuggugcucaugggcgaggauggggcuagaggugagaucuagggacugccggaguguagagugugcuuugaaggagugagacugcaugaaucauuuagaaagugaguuguagagaaagcaggagguuuauauuaagagaguuuuacagcaaagccugucccuguaaaauugugaaauauuuucucaugaauguuagacucuguaaagauugcauucagucauucauuugggaaaaauaucuuuggaaucaacaaacacagugaaccaccuugaacuucaugcuuaauagacaaacauuguguuaacucuuucuggggcagggauucuggagacauggcaggggguggggggcgcuugucuucacugugugauaucuggguaucagcugggaagccuugaacaucugggcuuuucuuuaguucccagcccaggccuggccuagcaugauugcagcugugaugguagaucaacugcauguggccucuuugucugucuuguguuucuuguagaauggugguuggguucuggagcgccuuuguccuuucaggagaaucccaacagagguguuggagauuucauaucaagcuuggucucauggcacaggucugaaauccuaguuacuugggaggcugaggcaggaggaucucaaauuuaaggcuugcuuauacuacugagugauuucaagaccagacugagcaauuuaguaagacuuuguuuaaaaacaacagaccccccccccaaacccucgaaagucagguuuaauuccucagcaccacaaaugagacagugcauuucacacuuucagcacugugaugcugggcuagggauggcuuuagccagguccaggggaaggggagcaaaggaugaggaaggggacagguucuccauccaccgcuggacgcuugggugugaggcucuccuacaaauccacuaugagaugacgucaagggaaaggagcaggugugugccaccauacacccuggagagaagaauuuccucccuccucuucccuccugagccccucccucccuccucuccucccuccuucccuuucuuuuuaccuccuuuuugaggcagagucuuaccuuguaauccaggcuguuccugaacucauggccauuuuccugccucagccuucugagugcuaauauuacagauauaaacauauagguucuuagcccacuuuagccucugcugaauaacaaagggcuuccuuggggucacuuaaaggaaaagugaccugaauaaauuuggggaauuucuuucuuuucuccaguaaucauugagcuacaucguaggcuugugacuuugaaauuccaaacuucauuuccuuuaucagauccuguaucucuaccucccuagcacuggcucccaagcccacgcugcaggugcugggacccaaacauagguccuaugcuuauguggcaggcccauacagggcuaucuccucagcccugaaauguuuguuuuugauuugaguaacauuucucuuguuaaaagaucccuaaaaagucguugaguuuuccaaacagcaaaacagaagagcuggacuccucaaugaauacuuuuuugcugggagugugucuucacuuuggaaaaugugguccccuuagccaggagugguggcacacgccuuuaaucccagcacuugggaggcagaggcagaaggauuuuugaguucgagacuagccuggucuacaaagugaguuccaggacaaaacaaaacaaaaaaauguaguccccuuaaugccagauaauucccuccagcaguucaucaguucuacuacacacacacacacacacacacacacacacacacacacacaugcuuucuguucaucuguuaggaacuggacacugugcuggaugcuggagaggggggcacauuagugagccgaagccaagguucuuccugucaucauggaccuuagaaugaaggaguugaagcaaggcauagguccccugauacugaaggcaagcacacaugugaaggcccgugaacggaggaguagaguagccaagugaguguaggaguguagcuagcaggcaaguggcagccagacagacacagggcuaucuugucaugcauguuugcucuguccugcuagcuuugugugcuuuaaguccggucugacacugacccugugaagugaguacaguugucuucuauuuuucugcauaaggaaggcuagacaccuggcacgcaucucggaggggagucaggguccacaggcuguugcuuucauaguugaugauuuuuagucucagagcaaaaaguggugagccuuuauggacguggauggcagcucuucagaaagccuggagggaugcaggcagaugugcagauacagguaaaagcuccuagcuguggguuuguagaagccugggaguguuuuagaaacagcuagaguacagacucuggacaucugacccuuuugguuaaaugucaaccugcuuuaucucugcgcauguuuauuauugggaugcagcggucucagugucccaagugagcggagcugaaauggcuucagaggccgugcagccccuugcccuccuggagucugcauuauggcugugauaccucaaggaagagcaucuccauguaagugucagaugcaacaggaacgaggcagcugccccguacauaacucucuucaugccauugcccagugaaguuauaucugagaggucuguuuuuuggagacggcuucucagcacugacuguccuggaucucacucuguagaccaggcuggccuugaacucacagagauccuccaugccucugccucccaaguacugggauuaaaagcauuugacaccaccacccaguuuagaauuccauuuaaauugucaucuacacaaugacugugaccucccagauguggccaggcacagcaagacuaacagacccuuuggcucaggcgccauacaucuguuggaacucuggaaaaguucuuugacuuagcaucguucuugacucaugacaaaauucccagaucagaauccccaggagcucugacagcaggcugcaucaggaugcugcuccaugccauuacugccugugagauccugaauaaaucaugucaaauucugggccuucauuucuccucgguaagaugaagauaaaauauugucuugaccaaugagauggcucaacagguaaaggugcuugcagcugagcccgacagcuuacguuugaucccuaccacccacacagugggaggagagaaaugacuccuugaagauugucuucuggaugcaccacaucaucauuaucaucaaugguuagcacaaagaugagaugaaaguuccacacgguauucagcuauagauacugguuuucuucuuuucuuucuuccuucuuuuuuuuuuuuuuuuuuuuuuuuuuuugaagacagggucucauguagcccaggcuaucuucaaauucacuguauaauaaggaugaccuugaacuucugaugcuuuugccuccaccucccgagugcuugcgugugcacaucuccaugccaugccugguuuuaugugguguuggcaguggaacccagggccucguacgugcuagggaaucucuucacuaacucagcuacaccucuagcuuuuggauuguucuucaaccaaggcucuuguugacauucaucuuuuuauuuugaauaguacuuaguggguuuuucauuguaugcugcugguggugguuuuaagacagggucuagcauaguccagguuggcuucaaacucaccauuuaguggaaggauguccuuaaacugaucuucccauaucuaagcucuaaggauaggaauugaaagcaugcauuuucaucuuuaguguuauuaggccuagagcuauccugugcaaaauauguguggagagauuugaucaucuucagacaucuguccugagguagggucaccagaugcuaauuccccccaccccacccccaggauaugacagcaggguccauuauaaugcacgugcuucuccauaucagggaaagcucugugguugucucugauaacaccuagggaauuggaugaacuguuugcucuuuggcuuccugaggcacugagaaauggaauuccuguuaaaugagagggucaaagacucagaaggagcaacuacuguucaccugugacgucacuuaaguuuaguaccauccuuccgaggcgggguagucccuguugugcugaagaggaggccuauucagcagucaagccuuguagagagaguggaagggucacagccuggggaggugaccuuacgcacaaacugaguccuuuuccuuuuuucuagagcuagaggcagcucugaccgucgacuuagugguugacaaagcacgucuggcugugucaaucuaaagguuugcugucuucuggcuccuuuuaucuacaauauuugaaaucaaauauggugcauaucccauaucaguuauggauuuuuguaguaaauauuuaaucucaauuggggguuucuaccccaccuuagaucauuuaguucccagauaaaagacccaaaacuuuuauauuuauaauaagccuuaaacaacacuaaagcugagcagauaucaucucucugugucuauuuugucuacuuucaggcaaauaacccugagcuaugacuugccguguuccacuugagccgcucuuacuccacuggccagcccucauggccagaucucacaaucucuuaccccauggugucuuccucucuccaccuucucucucuucccuuucaugguccuuucucugaccccaagcccagaaaccaaaauucuacccaccucucuucugcccagcuauaggcuguaggugucuuagucaaccaauaguuuuaaacuaaggagcaaaguugcauaacaugacuugguguguuugaggauuuccucaucccuggggcaaccgacccuggggccaguauuccgcaucacaguacauaggaauaggucagugcauuauuuguuuuguguucucucugucuccuuccccuaccccccuuuuuccugacuuucaugcuggaagugaagaggaaguggugaaucacaccuuuaauccuaguacccaggaggccaggcaggcagaucucuugauguugaggccagucugcucuacauauccaauuucaggucagcccgagcuacauauauggccccaaagaaggcuuuuugacacacugugaaauugaacaggaauuguccucuuuuaaagauagagucccacuuagcucaggugggcacugaacuuauuauguagcugaggcagacuuuaaacuccugagccugcuguuucuuccuuccgaaugcugggauuaagggugagucccauuacacucgcuucagaaaugucucuguaucacuuucuguuguggauuuuuauuugcauuugcauuuugucccucucuucauccuccauuuuagguuuacugguucauuuauguucauacaugucuuagagaguuuaggaaguugugugauuaaaucccuucuaucuguggucuccugugguuccccuaguuucuuuagacugaacuauacaaaugaggacuguuacuuuaaugauaauuuuucuauuaagaaguuccuuauuagacugaaauuauuuuccuuaugacuuacuguugguagguuauuccccacagggcuaagaaauugcuguuuggaaaagucuagaaggauuuggugacaugcuguuucauuuuccuuuucucuugagcuauagaaacuaggaucaucagggacuagagagauagcuuguuaguugagagcacugacugcucuuacaaagaacacaaguucaguuucuagcacccucauggccauucaucauccaacuguaacucuacuuucaggaaauucagcgcucgugucuggccucugcugguacacacacaaacacacacacugcacauauauaauauguaagcaaaacuuuuauauacauaaaauaauaaaucucuuaaaacagaagaaaauagggucacagcaucuuaguuacuguucuguggcugugaagagacccaugaccaaaacagcucuuacuaaagaaagcauuuaauuuggggcuugcguacaguuuuagacgguuaagcacugcucaucaugacaggaagcagucuggcaagggacaguagcugagaacuuuauauccucacaguagcaggcagagaaagauaaggccugauaugggcuuacagugacaaaccuccagcaggccacaccuccuaauccuucccaaacgcuuccacuaacugaugggcaagcauucaaacauaugagcagcauucucauucaaagguucacacacacuuuaucuuuccucugaacauuugcaaugauguucugcccaccucagccucaugaaagccagcagagcagcaagcuugugucauacucuaacccauccacuggagcaaugacuugacuucuacucuggugcccaggaugguacuuggcauucaaacuguugguagaucacuuuuuguguucuggcuucugagagcugguuauuaaagcacaggcuucaagugauuuuugaagacaaaaguuagaucuuaacagaagucgggcaugaugugugcccuuccagucuugguacucagacugaggcagggagaucagccagccuacacuacccagccauagcacguagaguggaucagauuaaguuguuuauguugguguuugugaugcugaggaugcaacugagcaugcuggguaagcacuguaccacuaagcaauguccccagccucuuaaaucaguuucuaacuugaaaaacagacuugaggugguaaagugucuucuagauguuuuccaggaaaacaaaugcagcauacggacuggcagagguuuccuggacagcuuggcugacgaucucuaaacgcccagcugucagugugcagaaugcuuagucuaguugcucuuguguugauuaguauggcuugcagcuaagcagcaucugaggacauggcuguuggacacucagggcuaaaccauggcacccacacgcccauguucuccugaaaauaacaucugcgcuuugcuuuuagcuuaggauaauuuucuucauguagaauaguuuggcaguauuaccuaucuugguuagaucaaaacaaaacacaaaauuagucguucuugaugguccaguuaauuggaaaaaggcacaagcuggucucugguuaagaaaaagccauucuaccagcgaaauacaccaaacaucaacacugaaacaagccucuugaguuacagacagaaauaagucggcuauggguaacuuagcuuuuuucuuauguuagauugaaaauguucccccgacuggaguggucaucugugauggaguagguagagugggugagguuuuaugguuuuuaucuugggacuggcucugcauuuguguccaagauaaaugaugaaaucaucugguuuuguaacuuauagcauuggaauuuacuauuucaagcagaugauuuaauuaggaucauggcauuuuuuuuacaguguggcccagaacgacagugucuuugauuuucauaaauagaaagcgggucacauaugucauacuacauuuucuuuucuuaagguuuuguuuguuuuguuuuuguuuuuuagaugggggucucuguguaguucuggcuuuccuggaacucacuauguagacuaggcuggccucaaacucacagauaucugacuaccucugucucccaaguacuaggauuaaagauaugcaccaucacaccuggcauguuaaauuuucuaguaacuguauuaaaaaaaaaaaagaagugggaagaauaauuuugauaauguauaaaaccuaacauuucuaaaauaauauuucaacauugagauuuguacauuuauuucuuucacuguuuucaaaugcugcauauaugggugugagcguccacacuuccuuggcccaguggccacagguggguggugucucccaugcucaacaacgcaaucuuuugguucaauggaguccugugcagugauguuuacauaaacugucauauagauuuucuuuuguguuucuuugugcacauguucaugcauguguagguacauguaugugcaggucaaagggcaaccgugggugucauuccuucgacuuuuguuugacacagcaucucauuagccugaaacuuugccaaguaggcuagaccaacuggccauugaacuuccagggguccacaugucuccaccuccuaucuugcccucauuggcauuaugggcacaccaccacacccagcuuuuuauuaauaugugaguucuaggaauccaaucucagguccccagcaagcaugguaccaacugaaccuucuucccagcuucaaauugguauggacugcuauguaagucagguccugggaaccacaggacaacaggaagcuuuucaucuaggagaggcugauucugacuuggccuccauguaagagggcccugauagccuuuggugccuuacuggggcacugcacggagaggcacagcgcuucaggcuggagcauguguuccugcaggcggcuuuuauuccaccuaggguuugcuguacacauaccacucccuaaucuugggcucuuacucaugguuauuuuuagaccuccaguguucuggagagacauugucaugagugguuagcugggucggguucucguagccgagcguuggaguggggcaguccccaucucaggauuaaguuguuuacgugguauucagcucuccuuccuuucuuaccccagauuuagaaaaaauauauuaaaaucuauuuauauaaauguauauuuauauaaauaauuccuuuuguugagugggcagaguccaggcacauggcucuuguccuugugagccugccgcucugcucucuguccucccuaagcaccggucugagccagugcagguuuccugucuauagccgcacggauggccuggaugcagcaggugugugugggagggaaggaaccgaaccgacgugugcuggacagcugcugggcgcuguauucuuagaugaggcuuuaggaauauuccuucagcggccccaagaagugaucaucuguauucuagagaccaggaaacagaaauccagaagaaggaaaccagccagcuucacgugacauuugcuuaaccccgcuugaccucugguagagaauaggcuuguuguugucauuuggucagguuuuuagauuuauuuuauuuauaugaguacacuguaguugucuuuacauacacuaaaagauggcaucagaucccauuacagaugguugugagccaccaugugguugcuaggauuugaacucaggaccucuggaagagcagccagugcucuuaaccucugagucaucucuccagcccuggucaguuguuuuguuguugaagaugaugauguuguuucuuuguuuguuuuuuaaauuuuuuauuuuguuuuauucuaaugagcauuuuucccaaauguacccauguguacuaugugacuuguccagugccuucagcgaucagaagacucugucagauagauccucuggagcuggggauaaguauacugugagccaccauaugggugcugggaauugaacuugguccucugcaagagcaacaagugcauuaaacuacugaaccagcucuccagcacaugugcucucucucccccuguguaugugugggaauggaggugguggcgaggguuuagggcucaggcuggccuugaccugucugucaugauaucauaggaguucugggauuacaggcaugagccgcugugccuggcuucaaaguagauucuagaacuuaaaaucacaccuaauuguaacagaagaaauugcguggcagccuugaauggcagcucaugccugaaauucaagcacuuaggaggcagagguaggaaauaacaaggcuagccugagacccuguuuuagaaaaucaaggaccuggagacuagcucagugguggagaacuuguauaguguuugauccccagcaucaggagugggcagagcuguggugguaggauuugugaaugcaaacacguauuauucaaaggacuacaaaaaacauacaagcuccuuuucagagucaccaggguauccccuaugaguacuuguggugaccacauauauauuuuggcuuacagucgagaccccugacugcagcaggauggcucaguggaaccagcugcagcagcuggacacacgcuaccuggagcagcugcaccagcuguacagcgacagcuuccccauggagcugcggcaguuccuggcaccuuggauugagagucaagacuggugaguccuucuugaaaacucccugacuugggggguuuagcauugagucaggacacaaccuguucuagguucacaccuuacuaacccuuugaucagacaugugagggcaggugcgggggaaggauugggagaacagagguaacuuagucucuuaacgcaucuguucacagugcauaugacagcggccucuuugcacuuugaaacagcuugcugguagauguuuuggagucagguuugagucucacuuacuuggugagaucucugcacauuuugagucuagaacagugagauacagauguuuuuccuuuuuaaaucuaagaauucuaugucagguagaaauuggggucuaccacacacguggcuuccccugguaaagaggaggcaugggaugaggagggaacuagaggcauagaggaaaugccagcuguuuaccucacuuuaguguauucaggcccgugugcuaguucuggccuaagucagcccuaucugcgugugaccuacuuuuuccagaagacauaccugauuuggugaugggccaaagagguguggaucacaccucagccuggcauugcucauuaagcuaagaagcacuuauagacacuagucugacugaauacaggguuggccaagaauuuaaggcaaacaaccuuaucuguccuuuaaaaaaacaaaaacaaaacauuuaccaguaugugugcacguuuguauagauucaggcgugugugcauucguguaugcguguaggccagaagacaaccucaagugucauucuuaagaacgccuuuuggguucguugagacugagucauucauugguccagaguuaaccaauuagggcagaccuucaggaucuaucucugaugcccagcgcugggcuuacacgcaugugcuacugugcccagcauuuucuuuuuuuaauuuaaaauagauuuuuuuaaagauauauuucuggcuauguuuucucuucccccaucuccucuaagaucuucccuaacuccccuccuacccaaauccacacccuuucucucucucucucacuagaacacaaacaggcacuaagaaacaguaauaagauaaggcaaacaaacuggaauaaggugaaauagaccaacagaaaaaaaaaaagagccaaagagaaaguauaagaaugauaauauauuugccagcauuuuuaugugaguucuguggaugggagcucagguccucaucgcucucacgguugaaccaacugcccagacugcaucuguccuuucauugucaucauuguuguuguuguuugguuauuguuguguguauaugguauuggggcagcgcguggacaugccgccgugugcacgcggaggucagagggcagcuucaugaagucaguucucugcucucuaaggauuaaacuaauguugccagguuucccaaccaagaacuuuuaucuguggcgccaucucaccauccccuguuuuuguuuuguuuuuguuuuaagacaaggucuuguagucuaggcuagccugcuacuugcugcagucagcugagggucccuugaacuacuuaccuuccugcuucuaccuccaaguauuaggacuguaggugugugcugccauacuaaggucuggguuuguuuuuuguuuguuuaugagucaaaaagucgggcuggugagauggcucagugaguaagagcacccgacugcucuuccgaagguccggaguucaaaucccagcaaccacaugguggcucacaaccaucgguaacaagaucugacucccucuucuggugugucugaagauagcuacaguguacuuacauauaauaauaaauaaaucuuuaaaaaaaaaaaaaaaaaaaaaagagucaaaaagucuuacuauauagccuaaaacuggccuugaacuuacuauauagcccaggcuggucuucaacuuucaauccucuugccucagcuucucaaguaguucucagauuacauacguugcaccacuagacuuguaucugugcaucuugcucaaauauuuuaguccuauagauuauaagaaugaauaacaguaucuggaaacauucucauauuaaccuuuaaccuuuuuuuuuccaugcuggggaccaaagccagagccuugagcacacuaggcaggugugugucacugagcuacaccaccuauugaugguacuguugaucugagaaugagaaauggaaaaugauggauuuguuaugacaucagauguuauaacaaccccuugaugguggauucuggggguauacguuuuagaguccuauuauuacugccuuugagagaaugucauccaaacuggcuuggaacucucuagguagggaaagcuggccuugaacucuugauccuccugucuccaccaccccguauacagaugugugcucucacaaaacgcucuccaaauuacucaugcagcuuaccuccucuuccuagggcauaugcagccagcaaagagucacaugccacguugguguuucauaaucucuugggugaaauugaccagcaauauagccgauuccugcaagaguccaauguccucuaucagcacaaccuucgaagaaucaagcaguuucugcaggugcggugggaaauggaugugagacggcagccccacagaguggagugcugauguuccugcccggaaguuuuccuuacuuggcuaagugacgccugucuuguacucuaaaucaaaggagaaguaauuagcuccuucucaauucccuguacacuggcccugggcaccauuaccagaaauucacuucuuauguuacaguugcagcaauaagcaagggcuuaauguuauucuguuauaaaagcacacuauuaacaccuacuugucauaggcacaugacucucaggucuaaauguuaaaaguuuagccauuaacuggguacuccuggguaaagucagucauuucccuauaaagucagaugacccacggugccaggaugaccucacacuucuggcuucugccaucacagaggccacaugcuccugccuucccuucccuccccauggauuucagucagaugcugaagccuuugaucugugguuucauggaggcucugaggaagugacuuaaguuagccaaguucacuccacaccuccuuagccggcuauagcuuccuacucuccaucuugcuuacagagcagguaucuugagaagccaauggaaauugcccggaucguggcccgaugccugugggaagagucucgccuccuccagacggcagccacggcagcccaggugagagcaagaagaagcaaaguggcgagcaggggacugggaagcaagcgauuguauaaauaaguggaacaguaaugguuuagugccucugaagaggagaucacuagacuacauuaaagcccuaaacauacauugaaaaugacaaaaaauuucauacagucucuauuccacucccaaccaacaguguugcugaagggugaacuugagcucagauuccugagggcugggaguugaggugcucacaccacauccuauaagugaggugcuaggggcagaaccagggcugccugcgugguggacacacacucggagacauauucccaaccccggauuguugauguuguugaucggguucuugcuaugcauagcugacuuccaguuugggauaaucuuccugccucugccacccaagugcagggguuucggugaugccaccaaacuucccacacguccauuucuuguuuucauuuucagcuuuugagauggagucacagucugauacccagcugccuagaacccugugcgugggcugagcccuuucaaacccacaccagucccuugcuucagucucuagucauugagauuuuaggcaugggccaccaggcucagcuuccuuuugagacagagucucaauacauacccccauaugguaaacucuagauccuccugccucagccucccugugagccaccaugccugauccacagggacuucccagugccugaccccugaguuagaacuugggaguuggcaaagcacaccucccuagcaauuuguacggagcuugagagacucuagaccacugcuuggggaacauagaggugguuuuuagggacaaagccuucauucuugccauaggcaaguuuaggagauaggagauaggagagggagggacccagcuuuggggcugggcacugugaaggucugucuguaguacuucuuuaugucuuaucagucagggucgaucccacaggggaaaaauguaguggcuggguuguuuuuccaagucuucugagaggcuguuauacuauaguuugagcauccaugagaagugggaagagcgccugucucuaaaaugccuguucagcucuacuuuggagacucguggucguaguagagagaacagaccagaagugagagguuguagaagcaaaggucugggcuggaggacagaccuggcuucaguuccuagcauucaagagguggcucacaaccaucugcaauuccaguuccagggaauccaacacccauuugggcaccaggcacacaugcuggcaaaaacagccacacacauaaaaugaaguaaauaagucuaaagaauagaaaacaaaacaaaguaaaaagaaguaaaaagccggcaguuggaaccugacuggagcccuugaccagugcgaugggugugagggagugguuagcuguaggcccagggugugagcauuucuagcuuugaaaacuggauggauaacaucucuccuuaucauagucuucaagauccucaggcugcugucaggcuaucugguugguucuuaaagcaucuacuuguuaguuucugcucccagcaaagccccaucauuuuaccuaugaccccuuaaggcauuagccucuccgggcugggcagaagccuuggaagcacaauuuuaaaaguccuugggaaauguuuuuucauggaaauauguuacacuuuguugucaucaguucuuaauuuauuuauuaauauucucugagcacugggaucaagccugggcuucacucauuuaggcaggaucuccaguacugagcuguaccccagcucuuucuagauuuuuuuuuuuuuuuuugacaguuuaccuuuaggcugcuugaaggaugaggcaucuuaguucaacaugugggcuccugguuuaauguggagaauggguuugcaguguuuccuguugauaaaaagccaguggcacagagagaacagugcaagcacccucccagcacccuccccuuuggaugggauggagcucagacgagaggguuccacaaauccaugugugugcuaaucuuaguuauuuauuauuuauuuauuuauuggcagcaagggggccaggccaaccacccaacagccgccguagugacagagaagcagcagauguuggagcagcaucuucaggauguccggaagcgagugcagguaaucgggccucacccagggagccgcgcugugcugugcggcugcagagugugguccugcgugcacgcuuucauuaucuucaaaacuuucuuuucccuuuuucccaaagguaaccuguguuuuacuucuguuuuugguugguuuguuuguuuaaacaggaucuagaacagaaaaugaaggugguggagaaccuccaggacgacuuugauuucaacuacaaaacccucaagagccaaggaggcaagcgagcuguggggacggggcagucugugcaaggcuacgccgugucacugagucucagggccugccuuccaugguaggaggaggagcugcuggcccuucacgggacaauuuuugcauuguuuguuuuugagaugggauuugaccauguagcucuggcugaccgugagccuacaaccaucuuacuucagcucucugaguagccgggacugcaggcgcacagaugguguagagccuuguuaagaaggcuguggugagucccucugcucaaggagucuuuccuccuucccuuagacaugcaggaucugaauggaaacaaccagucugugaccagacagaagaugcagcagcuggaacagaugcucacagcccuggaccagaugcggagaguaagcgaucuggaugcuuccugagcaucgcacgccuagcguggaagacaguuucugauggcuucuuucucuagaacugacuagagacugcgguuagacaugggcugggguaauguguucugacuugguuuugguuuccaaacagagcauugugagugagcuggcggggcucuugucagcaauggaguacgugcagaagacacugacugaugaagagcuggcugacuggaagaggcggcagcagaucgcgugcaucggaggcccucccaacaucugccuggaccgucuggaaaacugguaagaguuggaagaaaggcuucuuuuucuuuagucacgggccugcaaggggggggggggggggcggggcggagcggggcggaggcggggcaugcugcucccucgccaugcuuuugcuuuugcuuuugcuuuugcuuuuucaugcugggguggaugugugguagacaagugugccagagccacuggacuacacuccuagugcuggacacuauugcuaagauggcaccuuuuuuuuucuuugagaaagaaucucacugagcugcauaggcuggcccucauacccacuccauagcccaggcuggcccucauacccacuccauagcccaggcuggcccucauaccuacucuauagcccaggcugaccuugaauuugcaauccuccugcuucaucuucccaaauggaauuaucugggauuauaggcaugcaucacucugccugccuuaagguggccuuuuuuacacagucaaguuuaguccaagaauuaaaaccauuaccuaauuuuaacuuuuuuguuuuuuucugagacagaguuucucuauuuagccuuagcuguccuugaacuugcucuguagacuacacuggcucaaacucauagaggucugccugccucugcuucccaaguacugagauuaaagacaugcaccaccauugcccaaccaacaaauuuuuaauuaaaaagaauaaauuaauaaagcuuagaucacuaauuuaagauauuuaaauaauacuuucaguuguauuuaacacuaaauucuccauuuuaguuauuuuaauaaucuaaaacaauauauguuauuugcaaaggggggaaauaacugaauauauauaaaacuaauaaaaugaaauaaaaaaaaugaaaaucuagucuuugaguaguaccagcaagucaccagacuuugugauagucauuuuguaggcaucugucgugauuaaacaugugauuucaugacuauacaugugaugucauaacuauacaugugaagcuagaaaucgaguuguccgucuccuuccucccuuccuuccuuccuuccuuccuuuguuguggugggauggaugccucagggucccuuugcuucagucuccugagugcuggggucaccacuaggggacagaggugacuggaacuuccuuccauuauggcaggauaacuucauuagcagaaucucaacuucagacccgccaacaaauuaagaaacuggaggagcugcagcagaaaguguccuacaagggcgacccuaucgugcagcaccggcccaugcuggaggagaggaucguggagcuguucagaaacuuaaugaagagguaacuuguaagagaugacguuccgaagggaggaaccggcagaagacuggucaccacagcgucugagaugccauccuuuucccuuccagugccuucgugguggagcggcagcccugcaugcccaugcacccggaccggcccuuagucaucaagacugguguccaguuuaccacgaaagucaggugggccuguccuuacacuuuggguggaguuuugauugauguccaguccucuucccugaggauuuuaagggaaggaagguucuguggugccauagcugaggggccccauugggugagagaugaagcccacuccucaccuggcucagaacacgugcaguauuucucauugaaugcuuuuuauugccuucccgugagaagucucuuacaacuugcuucacaugcuuaggcaucucaguacuuucuagcugaaggguuaguguucacuuuuaaugucagagaugacucugcggaaguagaauuuggguuuguaaaaauaauauauauauauauauauauauauaugcgugcgugcguguguguguguguguguguguguguguguguguauuuuucaucuagacaggucuuuguagcccuggcuggccuggaacacucucuguaaacuaggcuggcuugaacccagagauucaccucccuuugccucccaagugcugggauuaaaggcaugcaccaccaugcucagcaauauuuuuacaucuuaggaauugaaguauuaggggguuuauauuuuaacgagaucaagguagggagccuacuaacuuuccuugacuauauuuuuuaauagguugcuggucaaauuuccugaguugaauuaucagcuuaaaauuaaagugugcauugauaaguaaguauucuuuauguguguguguguguaaguguauaauuuuuauuauuuaaaagcaacuguuaaauucaugcuuugcucauauucuucccuucucccaaguacauucagaucuccuccuccuguacucacccaaguuucucaaaaaaacuaaacaaccaaaaccccaauacaacaaaauccccaaaagacugagaacaaaauacaacacccaaaaagaaaaaagaugggacuaaaauugugauuaaauaagagcaugcacaacaaacuauuuguuggucaacuguccugcucacgagacccgcacugagugguugacaaagccagugcugcucccagcagcuccauugcuaaucuuucacccuagugguggguuuacauucauucauucauucauucauuuuuuuuaauguaacaaaauaaaauauaacaaagcaaaacaaaggcuaugacauccaaguuggacgagacaaaccaacaggaggaaaagaacccaagagaaggcacaggagucggagucccacucguuugcacccugggaaucccaugagaacacuacaugggaagccacaauauuagcacagaggcccuggugcaggccccugcaggcccagggcaugcugcuccagucucugcgaguucauaugagcuuugcucguggugauucagagggccuugugguuuuggugaccucuaaccccucugguucuuaauguuuuuucugcugcuucuuccuugguauucccugagcucugaggggagggauuugcuggagacaucccauuuagggaaugaguguuucaaggucuuucucugcaugaugucuggcugugggucucuauauuucuucccaucuuuggacaggaggacucuucucugaugauggcugagcaaggcacugauaucugagucuagcagaaugucaccuggagucauuuuauuguuuuuuuuuccuuucucuuuuuuagaucaguauuauuuaguuuuucccuagguccuugggcuaucuagucucugguucuuggccacccaagccuuguuggguaugaguuucaucuuguauagugagccuuaagacucuuguugguugguuacuuccacagguuugugccaccauugcccuagcauauccugcaggcaguacacuauuacagauagagguuugaggcuggcuugcuguucacacuucucuuuugauagcaugcagaguaccuuccuauaacaaagacucuggcauacaguggggggcucuauggaggcaccagcuucacgugcccauguucagugaguuguguagguguuauccucaacaguggggccuugcugucaguuguggaaagcaaccgauggucuugauaacagcguggauuguuugaggauucccuuuggccaacaauucaauuagacuuaacccuaacccaguacuggaagcuuuauuugguggcaagagaucgccaguugggaccccaacucucccccauuacuuggcgauugaaucuagaucaccuucacauaugugaauguuuuaggagguuccuacuguacgagaugucgauacuacuccacggaugcuccauaaguguugccgucucccauuguucccucccaccaccagcucuccucuccccucggcuuccccauuugcuccuccaaguucagaccucgucuauccagaaucccucaucuauccagaaucccucaucuauccagaaucccucaucuauccagaaccccuucuauuucuuuuuuccuaauuagaucuauuuguucucuguaguuccuuagucuguauucacccucugugguucuuaaggauugcagcuugguuaucauugacuuaauggcuaauauccauacauaagugaguacacaccacauuugucuuucugggucuagguuaccucacucaggaagauuuuuuuuuuccuaguuccaucuauuugccugcaaguuucuuuuuuuuuuuuuuaauggcugaguaauacuccguauguaaauguaccacauuuucuuuauucauucuucuguugagggacaucuagguuguuuccagcuucugguuaguauggagagaacagcagugaacgugguugagcaagugucugugguaggaugaagcauccuuuggguaugugcccaagaguggucuaacuggaucuugagguagauggauucccgucuuccugaggagcggccauacugauuuccauaguugcugcaugagcuugcauucccaccagcaauaugugaugguggcccuuacuccacauccucgacagcaugagcugucacuuguguugaucuuaacuauccuguuaggcauaugauagacucucacagcaguuugauuugcauucccugauccuaaggauguuggacauuucucuguuucucagccacuuggguuuccucuauuaagaauuuucuguuuagaucuguaccccauuucuaacuggucuguauuuucuugauauuuauuuucuuaaaauucuuuucgggcauuuguccucuauuggauauguaguugguuuaaaagaaaaaucccguucuguaggcuaccaauccguauucuuaagccuaacucuuguuuucaaaugagggauggagaagcaagaacuuggacagacauuugacuuuagagaugucuccauucagggaucuucuuuuugugaacagcuguguucaaaacccuugcaaacccugcccgguuugccugaagcauugaaaagaaaaguuugagugugugcagcucaguauugcaggcucaccuagcacgcacgcaugcacgaggcccggguucaacccccauacugaaaaauaaacguguaaauaaguaaugcuugaaaauagaguauauggaaagagaacugguuugaaguuaauaaucuucuuccacaaacccaccaacacaugcuauuuguagguaaaaauauagcaauggaaaagaaauuuuacuuaguuuuauuuugagagagcgucugacucuacaacccuggcuggccuugaauucacagugacucaccugccugugcuccccagugcuaggauuaaagguaucugacaccaagucuggcuaagaagaacuuguaaaauaguguucugaaauaagauaaagacagaaaugucauaauauaaaaagauggccugucagagacaggcagcaguggucacgugaggauagcauuuccagcugccuugugggagguggugucaguuuuugguaacaacauaccuuucuggaaaacccagcguggcuccgauaauaaggaaauucaccacccguguaacuggaaaugcaguuggggcaaguaccuaaggaugaggcuggugacucacaggugucuucaggaacccugggucuuccaugccauccuuaccgugccauccuuaccgugccagcuguagacagguucccuuccagguggucucauggcuguggacagaagaucagccuaggcuauugccuccuuggucuggcugagaacaggccuuuaaucccagcacccaggaggcagaagcaggugaucucugaguucaggucuacagagcaaguuccacgacagccaggagggcuacacagagcgcugucucggaaagccgacaaaacagacaaggcagaccccgucuucaccugcucuguggcuuccucuguucugaugaaugcagugaucgggguucccuggagauagauggcucugccaucccuuacugagagaauggagcuuuccuuaggaagggaaagaagcugugguuaggcccccagcuaaggcuacuguuuaagugcauacagaguuguguuucacaccgaaaauguaacugagcaucgaaaggcauguuccaucagaguagguucuggaaagaaagaggggcucuaaucucagcuuuuauuaacccuugucuguguucuuuacagagacucuggggauguugcugcccucagaggguaaguugggccuccuuuuguucuuucucauccaacuuuacccucuggcuacucagcgcucacuguguguugguuuuucucccaugauuuaggucucggaaauuuaacauucugggcacgaacacaaaagugaugaacauggaggagucuaacaacggcagccugucugcagaguucaagcaccuggucgguguccgaggggagaggaggcggcacaggccagguggcagaggaggggggagagacuggcacagccucaagugacacuugccuccuucuucuuccuuucuuccagacccuuagggagcagagaugugggaauggaggccgugccaauugugauguaaguaaguuuuguucgggcuaaaagcaauuguuuucuuucuuugaggaagaaagagaaagcucucucgcucucucucucucucucucucucucucucucucucucucucucucucucucccucucucccucucucccucucuccaacccagaauuaaaacuuuaacccacuacuucagauguuuguccuuuagaaaaguuggucgcucugggccagggugacaugcucagaagucacaggugcuguggaguuuucuagcgagaaacauuucccugaguguuggggaguuggcucccuuucagcagugggaagucccucgccaagcuguuacccacacccaucugguagaaaagaaguuuccacauugcccggggcuucccagagucccuugcuacuaccugccagcuggcucccuuuucagugccuggugagacaaaaggaagacaucaagucagccagucagagcuaaacagaaaaaaaaacaacaacaaaacaaaacaaacaaaaaaaaaccaccaaccaaacugugcucaggagcugaggcaggggaauugugaguuugagaucauucugucauucagcacauacauguaaaagagcuggaaauucauuccugagaauucaucaguaauuuguguacuaauugaugagggucuguggucccgugcaggucccaguuccucuuucagagcuguagaguauucugcugccuacaccacagcucaugaccacagguagccacauugcuugacugcuuguguggcacugaagguuaucacagucacuuuagaaagugacuuggcauaaaaaugagcacacccuguaaaccggcaguuccagucuuaggaauuaacaguaaagaaagcuuugcauaggugaacuaaggacagauaacacagucacagccauuggucauugacacagcucagaucucucagcacuggggucaugagcugugguguaggcaguggaguacucuacagcucugaaagaggaacugggaccugcacgggaccacagacccucaucaagguggggguggggugucaggagcaggaacacacugagagugcaguucacugugugaaguacacaugcuuggagaaacaaccaugaacacgguugggaggagcugggagacagcagagacaaagacacaguaaagugcagagaagggggauucaccuggggaaucucggugauaauggcaacuuaugcgggaugauaaugcuaggcuaucgcucaguguuggggugcacuuagaugcaugagacccugaguuugcucccuagugcauauaaaaggaaggagggagagagagaagaaaccuaagaagccuuccuuuauuccuuccuauucuccccuccuuccuucccuuucucccucccuccuuuccucucuccucccucucccucccuccucccucucccucccucucccucucuccucccucucccucccuuccucucucuccccucccuccccucccuucccucuuccucccucccuuccuuccuccuuccucuuucucuccccucccuccuucucccucccuccucccucccauccucccuuccucccucccucccucccucccucccucccucccucccucccucccucccucccucccucccuuccuuccuuccuuccuuccuuccuuccuuccuuccuuccugugugucuguguuuguguauggucgcacaugugcgauggugugaaugugaaggucaaguugccacuugaaggacuuguuucuucuuccaccaagugggucccagggaugaggcucggguuggcaggcagaugcccuugcccacugagccaucuugcuggcccucaaauaaggacguaagcuggguggcuuauccuuggaugcucauugcuuuguuauucuucgugccuugaauguguauuguaagauaugguuauguacuauguagugcauaugugaggaucauguccuugggucuuuggguggaagaaagagggcagaguugugucccugccagugucucugagagaccuuaugcuguugcaggccuccuugaucgugacugaggagcugcaccugaucaccuucgagacugagguguaccaccaaggccucaagauugaccuagaggugaggccuucccagaaccaggcggcucgugugcgggggugcgugugcagggaggccaggacagaacgccugccgggaugauggcugucugcccagccuggauuuguuucucauuaucuaucucagaaacgucccugagagccacccuguccccaagaguaaagucuugcuugaguaccuguuaugaaaaucuauauuagugauuguuuagaaucgauuugaugaaguuugggcaagugggucuuaguagccgccauuuagauuuuauuuuccugcuugcuugcuugcuuguuuccuuccuuccuuccuuaaagauuuauuuauuuuauguaugugaguacaccauuacucucuucagacacaccagaagagggaauuagauuccaucacagaugguuguaaagccaccaugugguugcugggaauugaacucaggaccucaggaagaauagucagugcucuuaacugauaggccaucucuccagccccuguuuuccaucuuucuugaucuuauuaaguuuagaccuggaaaagcagacauccuuagguuugauuucuaacaccucagcuucauggaaagaugcagguuguuuggagguugccuuccaggucugucucuggagagucgggcugagggccuggguuagccuuaguguuuggguuaguguuaguuguuuguuuguuuguuuuuaaagguuuguuuguuuauuuauuuauuaugagugcacuguggcugucuucagacacuccagaagagggagucauaucuuuuuuauggaugguugugagccaccgugugguugcugggauuugaacucgggaccuucggaagagcagucagugcucauaacugcugagccaucucuccagcccuaguguuaguuuuuagggccugacuuugaacaagucacugaugauguucagacaucagugcugaugcaggcugguccugaugcaggcugguccugaugcaggcugguccugaugcaggcuggucuuucuccucuugguguucuugcuccagccugcacuugccgugagggguggccauggugugauuuuuaauucuaacuuauugagaugcgggugacaaggguugggagcugugagagcccagcugucccacuaagucauucaccgccuguccccauacucuacagacccacuccuugccaguuguggugaucuccaacaucugucagaugccaaaugcuugggcaucaauccugugguauaacaugcugaccaauaaccccaaggugaguuucccacccccaacccucucugaaaucccugaaccuugcugcuucuccacccccggugcaggcugucagugucacucucucauccaagugggugcaggcugucagugucacucucucauccaagugggugcaggcugucagugucacucucucauccaagugggugcaggcugucagugucacucucucauccaagugaacaaauguguucuuuucaauagaacgugaacuucuucacuaagccgccaauuggaaccugggaccaaguggccgaggugcucagcuggcaguucucguccaccaccaagcgggggcugagcaucgagcagcugacaacgcuggcugagaagcuccuagguugacagcuucagacaugucuggccugggggguggucauucagucgggguccccaugucagccuagggcaaggcaccaugccaggaccagguugcuaaguguguuugaagagcauguuucuuucuuuaaaaagccaaagacaauaguuuuaaauuuuuucuccccuuuaaaaaaauaucuggacugaaaguaacuuugaccugugcuccuacaaaaaaaaaaaaaaaaaggcuccugaccccagcugccagcuuugucacuguguguugccaguucucagaccacacaaggcaaggacaagcagggguccaacaggacaucugugcuggccuaaucuagggacagcuguugggcuugggugugugugggcauguguggcacacacccuguaaguacauguacaaaugcauggccuuuuuguaaauucugcuuaagaaauagcuuuggccaaggcugaaauccgguuguuguuuucucuuccagggccuggugugaacuacucagggugucagaucacaugggcuaaauucugcaaaguaagugauccuguugauucccucaguuaggagguagguguggggugcccaggaccccuuucuccagcagcugucaggagcugccugaggauagaggaaccugaggguguaagaaggcucuggcaggaaagagcuggggugaguggugguggacuugcuuucccauucuuuucuccaggaaaacauggcuggcaagggcuucuccuucugggucuggcuagacaauaucaucgaccuugugaaaaaguauaucuuggcccuuuggaaugaaggguaagguuaaacucugcaguaaggcugcccuguguaacgagucaccuacucccagcaagcccgugacugguuguccuuggcugcagguacaucauggguuucaucagcaaggagcgggagcgggccauccuaagcacaaagcccccgggcaccuuccuacugcgcuucagcgagagcagcaaagaaggaggggucacuuucacuuggguggaaaaggacaucagugguaagaacgcuugccuccuguaucacuugcuccaccugcuggccacuggcagcacccggcuacuucauguucuggguacuacugcccccugaagggcagagagggccugugccuccugaagagguggccugccaguuuguccuguucacucauuuggcuaacauuuguguagaaaagugugauugaaaucuuacuucuguacucccuuuccugccuaccccguuaauacauuugcggcagguguuuuugccuaugagccagcuggaucucuacaagcccgccuggauauugccucaguuccaagucacugggcagggcauucagagucuccagcacucacuccacuggcauaaucucuccuuccaugguccgugacaggcaagacccagauccagucuguagagccauacaccaagcagcagcugaacaacaugucauuugcugaaaucaucaugggcuauaagaucauggaugcgaccaacauccuggugucuccacuugucuaccucuaccccgacauucccaaggaggaggcauuuggaaaguacuguaggcccgagagccaggagcaccccgaagccgacccagguaguuguugacuuuccauggcuuugccuuccuuccuagugagaaaguacgcauccuuggagagacaaggacauggcugaguaucuugugggagcagggcuuggugauuccuucuuuugggaaagagugguuuauuggguuccuugacagggugacuaacucaggauucaagaggaggacagaaucagcccucagggagcuuggaagucugaagaugaaaauaguaucucucccucuuccucucuucucccuuuccaucucccccucccucccaccccgccacuuuaaaacacuagaaagagaaaugaaggcaggucucucuggugcuucuccagucaguggguuccagaagacccgagacagauuugaguccagcaugcuuugcuguccugagugagcagugccaggagucugaagaaaggcuuucuggggcaguggcuguuggcagccuggggcagagcugacaucaagcuggagguguugauguuccagagaugaugacuggagggaauguggacuuggcauuuagaaacaagaugcaucuacucugugggagugcguguggcuguaaaucagcauuucucagccuuucacggagcgcuuaagacuauaggaaaacagagauuuccauuaugauucauaacuguagcaaaauuacagcuaugaaguaguaagaaaaaguaauguaugguuggggucaccacaacaugaggagcuguauuaaagggucauagcauucagaagguugagaacugcugguauaaauuauaugaaaaauagaaauuauguuguguuaagucuguagugucuggggcggucccaguguaaagagucagaggugucuggucugaagccauuucaaacuuguugcauugacgcuugccucuguccuuaugcuggugaggagucugguuuucuaagacuguuguugaucauugcacaugcugagcuccgaggugcccugugugagccggccuccuugcucugaggugcccugugugagccggccuccuugcucugaggugcccugugugagccggccuccuugcucugaggugcccugugugagccggccuccuugcucugaggugccuugugugagccggccuccuugcucugguguuuuuucaccaaccgcuucuguucacauagcaccugcacacagcuuccccggcucugcccaccauucuuggaggagucgcuuguugacgguuacuuuccuuucccuuuguucugcuguugaguucucuucauucuguggaggaguucagcucucacuuccugucugucccuuaucucugcuuccaccuugccuucaguuggaagaucuguuuaucagucccucucacacuggucuuuguucuuuucacagaggacuuugaaguccgagcacugauccuuuugacuaauuuugcuuucaagauccaggccccuggucaggcauccaccuccaucaccauuccuguguaggcugcccagagacauuccucaggggcaaggccugggcaugagaaaggagcccacugccugaugggcuugccugugagccuagggagagugcacugggggcuccggagcccgaugauggaaggguaggggguucagaugauccccuuagggaggugagccuguaugucccuguccucugccccugcuacaggaguauugcaguagagaccuccccggagccucguccugggucuuccuugucugucaggaggcuguaauauacccugugcuccucuggagggauuuugagcaaguucaccaggcagcaacaggauguuccuucucucuuccaucuccagucugugucccgcacuccuaccucgggccgggucaaagaauauuucucucuugaccacuggagaaugaaagucuucucuucuccgcucuaacuuauuguguaugcauguguguugggggugguccuuguuggaggaccuugagggugucagcucucuccuucuaccauguagccccugaggacagagcucaggcuuggugacagaugacuuaagcacuaagccaucucccugauccccucugucucuuuaaggugacaguucucacucuagagaccuuuucuagaacuguaggcagcacaguugccucaauaauuccuuugcuucugugcugaguuaaccuguuucuuggccacaaaugagcuugcauauucaucuaagagcacuuucuaauggcuucucccagggguuugucuugcuggaugcuuguaagccccaguguucugucugugcuuuucuuagccuacccacacagccccaggcccgcugcgagcaucauuaacugaacccccagggcuucaugccaguguccccagggcuuccagauuucuuggccuaacauuucaguccucacauuuccaacauaaacggcagagauggaagacagccaguccugucucuuucucugucccacacaugaaagagauggcgccuuggccagguuuccuggcuguugcacauguucucggaccugguguccugucucccaguggcugggguauguuuuccugauuggaaguggcuuuggagccuccagcacguaagcauuuaguccuguuggugucugggcuggucaccaaacagggaagucaauucacaagugugaccaggucacaggagaagccuaacgcuacacaaagaugguuggucgcucaggcaggguggggaaggaugcacaagaguuggcgguaggccgggcagugguggugcacaccuuuaaucccagcacuugggaagcagaggcaggcggauuucugaguucaagcccagccuggucuacagaguaaguuccaggacagccagggcuacacagagaaacccugucucaaaaaaacaaaaaacaaaaacaaaagaguugacgguaggcuggguagagguggggcaggugucucugcagaagucuuugcagcucaggaaauucuauggaagagauagaacuucaaacugcaagacuggauggcaagcagcaugugaugagggaggacagcccuaagagcuggacugcggugucugggcaguuucuguaagguuggcucacgccgucugggagaggcaggaggauuccucuugcauguucucaaagcaagucacaaucuguuaaagcccggguuuccucucugcaggugcugccccguaccugaagaccaaguucaucugugugacaccguaaguggccgcccuucccaguuucgcauucauuucuaguguccuagugugcucaguuguccccaggaauagggaggacauggggugagaguuaccgugaagggcugguagcugcugggcuuguuuagugcucagagugaccuuguguguuuaaaaagcuugaguuuuuauuuuuucuguuggagaccagaguuugauggcuuguguguguguguuuguucuuuuuuuuuuucccccuccauugugucuugucaaccuggcccuucccacuccugccguccccccuuuccuacagaacgaccugcagcaauaccauugaccugccgauguccccccgcacuuuagauucauugaugcaguuuggaaauaacggugaaggugcugagcccucagcaggagggcaguuuggugaguguuuggagggucaggccccauugaugcuugccuguacagagccagggccugccauccacacugguagaaaucggcucuagagcugggugugguggcccaagccugaggcagaaugaucccucccugugaguucugaggccagccuggucuauaaagugaguccaggauagccggggcucuauuacacagagaaacccagucuugaaaaaacaaaacaaaacaaaaaauggcucuagggccauguucugcuguggaaaugauacucacacacaugcaguuucccaguagccacaguaaaagcaguaagagacuuugacagcuuggguaagcagcagcggcacuucagcaucugagaaaucauggagcuguccuccccugucccgccuccucuacugagucuuugaaauggaguggcuuugaugccuuugauuuaggcuagucucagguggcaguguguggcuaaggcuaccacacccagggcagccucagaccccugaaagagagagugagggcugagguggagacugugcucuucugggagggcaaggcccuccugugaggggcaggaagucuggcuuuucugaccuuguccaugucugaaggaacaggagacuggugguuccugagcccuguccucguacagagggaugaggguuugugagucggcuuuagucagguggcugaacugacacucucugugugucucugcagagucgcucacguuugacauggaucugaccucggagugugcuaccucccccaugugaggagcugaaaccagaagcugcagagacgugacuugagacaccugccccgugcuccaccccuaagcagccgaaccccauaucgucugaaacuccuaacuuugugguuccagauuuuuuuuuuuaauuuccuacuucugcuaucuuugggcaaucugggcacuuuuuaaaauagagaaaugagugagugugggugauaaacuguuauguaaagaggagagcaccucugagucuggggauggggcugagagcagaagggagcaaggggaacaccuccuguccugcccgccugcccuccuuuuucagcagcucgggguugguuguuagacaagugccuccuggugcccauggcauccuguugccccacucugugagcugauaccccaggcugggaacuccuggcucugcacuuucaaccuugcuaauauccacauagaagcuaggacuaagcccagagguuccucuuuaaauuaaaaaaaaaaaaaauaagaauuaaagggcaaaacacacugacacagcauagccuuuccauaucaaggaauacucaguuaacagccucuccagcgcugucuucaggcugaucaucuauauaaacccuggaaugguugcagaucaaaucuguaaaagagauccgagagcuguggcuuggccucugguucaaacacaaaggcuagagagaaccuagauaucccuggguuuuguuuacccaguaugcuugucgguuggaggugugagguaggccaagggcacuggaaagccuuugucaucacccuacucccuccccaacccagacuccagacccuguuucagggucagccugcccugugggugccuuacugggccuagggucaaccugccuuccuuucccacuugaccuugcugguaguauguccccuucccauguccaaaggcccucuguccugcuucuauugggaaucccugccucaggaccuugugucgagagggauugccuuacagguuugaaccugccucagacuacaggcccucagcaaagcucagggaguaugguccuuauucuaugcgcuugguucccagggauaucuguaaccacagggcaaaagcugacauauacuccaggucugcccucauaugagugguguauucuuggccuccccugagacuggcaacugucugcuccccauugggucucccaggugagguggaacacaguuccugcaccuacuguggccuccaugucgcuugcuugcuucgcucacucagcuuacuggaacacugaguguucaaggcaagccuuuccugacagaggcauggcuagauucagugacucaaagccaccucauucagcugaucagugucuguggaauuguuuccuuccaguuaaccagugucugaauuaagggcagugaggacauugucuccaagacgaacugcuugccuugaccaccccagccuucugcuucgagacaguuacugcucucccaccccaucaauguucuuuaguuauacaauaagcugaacuuauaaacugaaaggguauuuaggaaggcaaggcuugggcauuuuuauggcuuucaauccuggggacccaggaacaaggugagggcuucucuggggcugguguuguaccucaggggcucugggaagucugugugccuggguuaaccacccauagugagccccuggaacugcccacuuucccucuccuuggccccacuuggccccagccucacccagccugcagacugcuuagccuuucagugcaguggcuuguguucuggccacugcacucagauuccaauguaaacuuucuaguguaaaaauuuauauuauuguggguuguuuuuuguuguuguuuguuuuuguauauugcuguaacuacuuuaacuuccagaaauaaagauuauauaggaacugucu

SEQ ID NO: 12194 - RNA, 63193 nt, Mus musculus
guuccgaaaggcuagcgcuaggcgccaagcggccgguuuccuuggcgacggagagcgcgggaauuuuagauagauuguaauugcggcugcgcggccgcugcccgugcagccagaggauccagcaccucucuuggggcuucuccguccucggcgcuuggaaguacggaucuuuuuucucggagaaaaggugagacagcccugaggaacagaaaggguaccccggaauacucauaugaaaggcaggaagcugcugguggagacggguguuuacugauuaggaaaguaccuggggcggaaccaaagggucccagacguuuucaaacaggacucuugggaagggugcaguuugugcauucccgggggcagcugugaggaagagggcaaaggaucuacgagggggaguucuggcuguaaucguaucuugaagguuguauacggaugcgggcuaaaggaugagaggaaaggcgggcagaaguguggcagggaagaggggggaaaaacggaguuuguggagggaaacuccugaagaacuagacccgaguacauuucacagaagguucuagaagggaaguacauaagggaauggcaauaguaaugaaugcuguuggcagagaagacguguuuaaagagagccuuaacagggaaacauccagaagagguaggguggagacgcuuuagcaguuuuuaaguguuccuuuuggcgacuuuuaaaauaauaugugugcuucuuuuuuguuugguugguuagcguuuauguuggugguuugguuugguuugguuuuggcuuuuguguagccuuggcuguccuggaacuagcucuauagaccaggcuggccucgaauucacagagauccaccugccucugccuccugaaugcuggguaguugauuaguuuugagacagagucuagucucauuuauauuagcucuggcuggcuuggagcuguguauaauagaacaggcuggucuuaaacacuccuccaccugccccugucucuggggaggagggggucaaagauauccacuaccauucucagcuaguuuuagaguuugugagacagggccuucuguaauuggguuguguagcucuaggugaccuugaacucuauccuccugccuguacuuccugaaugcugaaaguacagguugaaacaaccauaucugaucuuuuggccuccccaaacuagcccaaaaagacugcugaacuucugaguccaagccauccuccuccuucaacuucuccagucccugaaacuauagguaugacaccacugguuuugauucuaagcaagaaaaagaacaccagacucuggggaaaguucauauauauaucacuucuguccagucacuccauuuuagcuuuuuuuuuuuuccuugaagaaaggaagugacccaaggaaggcuuucauaucaaagaguagagaauuuagauugcuagcuacaaagagcaacugcuaagaauuuuauuuaucuguugauuuauugguguuuguuuguuuuguuuugagacaggguuuuucuauauagcccuggcuguucuggaacucacucuguaguccaggcuguccuggaacucagagaucugccugccuuugacucucagugcugugaucaagaauaugugccaccacugccuggagaaauuuuuauuuuuuaaagauucauuuuucauuaucuuuaauuauguguaugugugugcagagguucugaccuggauguagcguuccagacaucugacaugggugcugggaagaggcacauauuuuuaaccacugaaccaucucuccagacccugaguuuuuuguuucuuaagauuuauuuauuuauuuuaugugaguacauuguugcugccuucagauacaccagaagagggcaucuaagcucauuacagauggcuguaaaccaucuugguugcugagauuugaacucaggaccucaggaagaacagucagugcucuuaaccgcugagucaucucuccagcccccggguuggguuuguuuuuuguuuuuguuuuuguuuuuuuuaauguacuauauguaaguacacuguaguugucuucagacaccccagaagagggcaucagaucucauuauggaugguugugagccaucaugugguugcugggauuugaacucgggaccuguggaagaguagucagugcucuuaaccgcugaaccaucucuccaguccgguuuuggaguuuuuaaaagaauuuuuuuuaaacaguuccauucauuuuauauaugugaguacauuaucacugucuucagacaugcuagaaaagggcauuggaucccauuacagaugguugugagccaccguguggaugcugggaauugaaccuuuggaagagcagugaguuuacuuaacugcugagccaucuuauuagucccuuguuuuuguuuuuuagugaaguuuuuucaucaacuguugguauaauucuaaagcacuccaaauuuaaauuuuucuuauuuagaaaugacaagccuggugcaguagcuuaaacaccuguacucaguaggcugaggcagggcgauugcuucaaguuggaggcuaaucugggcugcauaauuauuuccagaugugugugggcuucagcgugagaacuccuccaaaaagcauggaugggggugacuuaccuucaguaauuccagcacuaaguggguggaggcaggaggaucagagguuuaagacuagccuugaguacauaagguacaaagccaguguggguuacaugacaucuugucucaaaaagggaaagaaaguuggcaagguaagcuacuguauuuaaaagcccuuuaauguaguuuaauugcauguguuuuuaaauuuguguuaaaaguucacuggaacuggaagaaauggauuuaucugccguccaaauucaagaaguacaaaauguccuucaugcuaugcagaaaaucuuagaguguccgaucugguaagucaacagaagaguuuacucagcuggaauucuucaugugguuacuguucaugcaaaugaguagcagaggcuuaagauaguagagaaaaacacucuguauuaaaaggacuuuguauuuuucaucccugaagaguuuuaaaaauacagaaagguggucuucacucugccaucccuccucccuguccaggcaaagccugacuugauguguucuuccucauggcaggauucuggcuuuuucuccaggggugggacagccugaucucuuagaaugacucucauaaauagcaucagaauaacaauggaaugcuugggguuugugagggccucugucuaccuuugacacuaggguggaaacugguccuguaaauuuacaugagagugccccuguccucagcuuuuagcaaguccagugugggaugagguuuuaaauuucucuuucuauaaaauuaauugaggccugaccuuuuggucuauucaggccuuuccacuuuccugcuuuuuguuuuuguuuuugguuggggguuauacuagauuugguuagaccaacucaaucucaaacucaccaucuugcccaggcuggcuuugaacucagauccuccugccaaggauucuaggcauacacuaccauaccuggcuaaaagagugaguuuugaccaguguuuaucuguguaaguauaacucuuaccuccaagauaggaaauguuuccauuaccuuagaaaauucucugguguucucagugaguucuuacuuuucaggccuacuaggaccuuuggaaaugaggcuuuagugugugauuuugugauuuuuagaauuuugugcacuagggcucagaauguagcuaguauaauggcuuagcuagcacaccgggagcccucgguucaguuuccaucacuguauaaguugggccuagugaccaacaucuauaaucccaucagaagagugagacuuaggaguggauaucaggucaucuuugacugugagacuagccuggaguacagaugacccugauucuuuuugcuuggaaguagagaaacuuggugaauagcuuuaggcuccaaguucaguuuucagccccaaagauagaugauaaagaaauggauacucggggaaaaugaauccucuggcauaaggaauguuaaaaauccuaagcaagggcuggagaaugcucuuccagaggauuugaguucaauucccagcacccacauggcagcuuacaacugucuguaacuucaagaucugacauccucacacagacauacaugcaucagaucccauuacagaugguggugagccaccaugugguugcugggaauugaacucaggaucucugggagagcaguuagugcucuuaaucucugagcauacucccuccgccuuuuaaauuuuuuucaagacagucuuccuguguaguucugacugaccuagaacucaccauguauaccaagcuggccuugaacucacagauauccuccugucucugccuccaaagugcuagaauuaauaacauguacugucauauccuacuuaaauuugaaauuaguucuuaaaaacuuuuuaaaauauuuauuuauuuauuauauguaaguacacuaacugucuucagacacaccagaagagggcgucagaucucauuacagaugggugugagccacugugugguugcugggauuugaacucaggaccuucagaagaacagacccuuaaccaagagucagugcucuuaaccucugagccaucucuccagccccugaaauuaguucuuaauacuuuauuuuagugcuggggguuaacuuggggacucgugguugcuauguuguugcuguguuguuuuguuuuuguuuuuuucuguacaggguuucaguauguaacccuagcuguccuggcacucacuguguagaccagacugaccucaaacucacugagaucugucugcuuuuuccugggauuaaaggcaugugccacugugcccagcuuuuaaauauucuuuaguaauaugguauuagaguacagcauuuagaaguagggggcuggagagauagaugucuuggugggaaaacuuuuaccaugagagcaugaggaccaaaguuuggauccccagcacccccuaaaugcuagacuagcaaugacagcucuagguucaagugaaaggcccgucucaaugcuuaggguggaaaggaaggagggcaucagccuggagccuccacaagugugcacacacaccacaugucaaaacauagcuuuuuaguuaaucaguuaggugcuuguuuguuuaaggggguuguguuuuguggcuuuuguuuuuguuuagcuucgauggauaaaugcaaguaaauuugccucugugcuucacgggguuguuauuuuguucagagucaaguuaauaagguuuagguagaugugugugcuuccagagacaagauuucaaaagugcuagccacucuacagcauugcagcugaauaaaaacaaguccuaaugagauuuacaaccaagucuaugaaauaucaaagccacagaggcagaaauaacacugcgagagaaagaugggcugugagaagccuaaguuuacugaggauaauuauaaacagugaucaaaaagucuucaguaacgugccauuuggguccauuuauucuacauucccgugggacucagucauaaaaguguaauguacuuucucauucuggcaaauuaaaccaucaguuaaaaauucaggcuggguggugguggcgcacgccuuuaaucccagcacuugggaggcagaggcaguuggauuucugaguggcucagugugccgacugcucuuccgaaggucccguguucaaaucccagcaaccacaugguggcucacaaccaucuguaacgaaaucugaugcccucuucuggaguaucugaagacagcuacaguguacuuacauauaauaaauaaauaaauuuuaaaaaaaauucagauacauacaaacuaaagaugcaagggagaaaguuacugcuaaauuuucaguuguucaaugucccuggcuucuucgugcacuucuuguucuccuugagacagggucucaaaggucucaguccuccuaucucagccucgaaaugcuagaauuaugggugugcauuugcaagcuuuaggcuugcuuuuuguuuugagauggggucucacuguguaaaccaggcuagccucuacuucucagaggcccacuccucugccucccaguguugggauuaaagguauaugccaccauaccagguuugcuuuuaauaauuuaauaauaguuguuuuuaaagcuuaaggucauuuauauagaaugcucuauagugggauguucaaccuacgugugugucugugugucuguguguguguguguguguguguguguguguguguguuugauuuguuuuguuuuccaguuccugggauugaacugagggccucuucauggucggcugcguuacacguacagucccaaccuaccugggugaauuuuaguuaugugaagcuucuuccucuguauguuaauaggaaacgaauccuauaggcacacucuacugcugaguuacacgugcagcccaugcaguuaguucuuaaugauaacugauuagaacuaaaaacuguuacuuggagcuuuuaucgcugcuauugggagacagauccaaggagauuucugaauuggaggucagccugguuuauguagcaaauuucuggacagccagggcuacauaaagauccugucuaaaaccaaaauaaaaauaaauacauaucuaccuaccuaccuagaaaaaaauaaaacaaaaguuauuccuuggggugggugcaggauaaggcgcucaguccucagaucuccugcacugagauuccuucugucccucaauuaugaguggcagcuuuguuuuuauucucaagguggggucuugugauguucagaguggucuccaagucccauguucaugucgucuuccuaucucggccucccaaguaucuggaacugccaauaugcacuacuauaccugacucuguggcaggcccuugugguguuugcuaguccuugauguguguguauccaugugggggaaguuguuuuguuuugucuugcuuuuugcuuguuuguuugucccccccacccccuccccacacauacacaggcuuucucucuguguagcccuagcugucuuggaacuggcccuguagacaugauugaccuugaacucacagaucuaccugcuucugccuguuuuguuuguugguguuaaaagccuaggucaggacuggcuggccggcucuuuuuacaaaaauuaaaugugacuguaauauuuuuuaagugcugaaauggguaccuaguaguucugguuuuuuuuuuccccccaaauccaaaucuaaaugcuguucccagugacucauccuguuaaaacucaaaaguacagauacgcaguaggcugaaaauacuguguggcacgaaaaguguuuaaaacauuugaauuuuguaguaaacauuuacucuuaucagaagcuagaagagaaacauuuuaauuuuuuuuuccauuuucauuccuauucaucuccaagcucuuccuacaacagucacuaccuuuuuacauaugggaguuuucaucuguucagaguugguguuuacaguguguuuauauagcuuggaucauaauuaccauacugaaauauaauuauuucagaauugagucaguggugagaaugaaagccaucugguaucaugacucaauccaauuucucuuuuacuaagaacuuccuuuggugucuagccugucucagaagcaguaacagagcagucuccucuguggacauuggauucucacagugaccccagaagacugccaagggggacuaaguucagguagacagcuuggcucgagguuguucugcuccuguagacagagcugguaguaggagccagccuucaggcuuagucagguguggucguugcccucugcaccgucaggaccccucugaccacaaguccuacauuacuaagccccuuugggcgggcuuuucccucccagccuuucccgugauccuguucuacauguaacaaaaggacuguguuucucucacacuagcaagucaucucuuuagugucuuacauggccguuaccgcuagaacucagugucuguaucgcacacagaauaaaguaaagacaauagaugaguuuccugccugccugggcucccagcuaccucuguccucuacugcaggccuccaugaugcccucucagaguggcuggcaugcgcuaccaccaggcacaguccugcucagcuucacuucuccgcugugcugucucugcucgucuccagugauugcaguuugucccuuaugacucagcuguccucugccgucacuuccuuguuuguguauuuuuugugccguucuauauagaccugcucaugugcacugcgcuguguccuuuuguccuauuuaguuuuuccuucuagcacauuucuuccuucuagaugauaaguuugugcagcucauuuuccuauuuuauuugugcaaaugcuugaacuuguccuacucaguuuuaaaaagucaagucaaucccaauccaugccaacacagcgcugugaggugggcugucaagauggcucagcagguaaaggcacuuaccaccugacagccugcguuugauccuuaggacgcacagauuguucucuggcuuccacaugugcaccguggcaagugcacacacucacacaucgcccaguacauacacaguacaaaaguacauucuuuuaaguacugugaggcaaucaaaaauauauacacuaggcuucacauaaccauggcuaggguacauacacuccaagaucucuaaagggugucuuguaaccucagauaauacugaacccugcauacacuaugguguuuuccccucccccucucucaaugcauacauaccuuugaugaacuuuuaccuuuucauuuaaaggagcauuuuaugcccuugcugugguaugucuaaauugccagcuugauaugguggcauauaccuagaauaccaggauuucagaacugagucaugagggucugugaguucaaagccagccugaguuacauagugacacagaaucuguggggugggguggaguggggugacuggcaucauugcuuguuagcucuggggccauaguaagucgaauuuaauguuacucgaacacagacacuuuuauagccuagcacccgauuucguggcaaacuucuacugaucuguuagcaguuaugaguacagccuggauacacuggacuaaagcagagcuaggcuggguuuaguacccaguaacacauaaagguguuuaacacugcacaaagggaugaugauucagauucuggggggauggaguaauacugacuaaaaaucuucuacauuuaaaaacucauggaugugccagugggauggcucacuggccaaugcaccuaaggcacaagccuggugaccuuaguugguaacacucauagccaauuaaaaggcaagcaaguaaaaacuuacaaugggcuggagagguaacuuagugguuaaaagcacuugcugcucuuucagaggacgcagguucaguuucuagcaccuucaucagguugcucacaacagccuguaguuucagggaaucugacacccucuucuggcucccaaggacauugcauaaauguggugcccacuauacccacaggcacaaguccucacaaaagucagucuuuuucuuuucuuuucuuuuuuaaauuauaacugagggaaagcuugcuauaaagcaaaccuuucgggggacuggagugaugacucaacaguuaagagcacugaaugcucuuccaaaagguccugaguucaaaucccagcaacuacaugguagcucacaagcauccguaacaagaucugaugcccucuucuggugugucugaagacagcuacaauguacuuacauacgauaaaauaaauacaucuuuaaaaaagcaaaccuuucugucuuuuuuuuuuuauggguuuugugugugugugucuguccauaucaagguaugucacauguguuuagguuccuagauagcccaggaaaauguaucagguccucuagaauauagcuccugacaguugugagcuacaugaugugagugcuggggacuggucagguccucugcaggacuagcaagugcucuugacugcugagccaucucccaucuuuucagccacugguuugacuggggauggaggguucuggaggguggccuugaacuuucaguauguccaggaugacccaaauucauucuccuucuucuauuucucaaguucuggaauugugggacuacacuaccacacuaaggacaauuuguguguguguguguguguguguguguguguguguguguguuuguggaguuuaguuaagauucaggauaugcguuggaaaugaugccugacagugaaaauaaccaaugugagagaaauaucaguugucaagccagggccuugaacuugguugggaggugcucugcuguugagccucauucccaaccuagagcuaaucuuauagaugcuggcaguaauccagagcagugaggagaccgguauuucugucugcuuucugaaugcuugaugaaaggaucuuuuguuuuguuuccuuugagacggggucucauuguggaacccugacaggucuugaacucucagaaucuaucugcuuccuuucugccucuccagggguggaggcaccagcacacccacaggaucaaauuuucuccucugaucuuuguuccuagcaaggcagaccuuugauacugaauuauucuaacuuucuuuuuuuuuuuuuuuuuuuuuuuuugguuuuucaagacaggguuucucuguagucuuggcuguccuggaacucacuuuguagaccaggcuggccucgaacucagaaauccaccugucucugccucccaaguacuaggauuaaaggcgugcgccaccacugcccggcaugaauuauucuaaaauagugguucuguugggguucgccaaaagacccuuacucacaaagaccacaaagaccgccaccaucgcugcaacccacauaaggauuuuuauugauccuacauguuggggacuucccucccagcacgcaggccagaggagagacccagaacaaagaaagaacacacuuuuuauaccuuuguaaggagcagauuugagcaacaggauucucauugguguagcaaguaacccuuucaggcauugguugguuuguauagugacuaaguaacccuuuggccuagugacucacuuugcuugccccaugguggguuauuaugauuuggucagcaaagcaguaauacauucugaacuuauggaucagcuauuaacgccacagcuguuaauguucucgcaacaaggucagggugguuuguggucuuuuucagaaugcaauauggggcgggaggggggcaggagaauugcuaaucuuauuaugguuauuucucugaggacagcuaauauuguuuuggcagcuuguaggcuaauucauuuugacugcuaaaacuauguuuuuacauuuguuuagucaggcagcuuccuuaucuggcucugcacuuggucugcugguacaguuuggaaaguccuuuucgaagagggaagguacuggguggucuugaauucauuuugaauauuacaguuaucaaccuuccuaaugcuuuggccuuuaauacaauuccuaauguuggggaugacccucaaccauaaaauuauuuuuguugcuaccuugugauuacaauuuuucuacuguugugaguuguaaauaucugcguuaucuguguuuuccaacggucuaagguuuauuaaaccccuaaggggucacgacccacagguugugaaccacugucuuaagccuauauccaggcucagguauagcaacuuaaagcugaaccucuuuagccaaaaccaaguguuuguuuguguauaaacaacuacuaagccacacuuauucuuucuuucuaguuuggaacugaucaaagaaccuguuuccacaaagugugaccacauauuuugcaaguaagugaaugguuuuguagauccauuaguagcuuuuguacguguucuucacugcacagcauuuguuucuucaguuagaugacaagaaaacuagccuuguuuccucagggagcaccuaggaauuccucauguauauuggcuguagccaucguucuugguaaaguuguaacauagcuuaucuguguauaagaagucacauagccgccaggcgugguagugcacgccuuuaaucccagcacucgggaggcagaggcaggcggauuucugaguucaaggccagccuggucuacaaagugaguuccaggacagccagagcuacacagagaaacccugucucgaaaaaccaaaaaaaaaaaaaucacauagccauguuguacagagguucuguuggguuuugguguccaagggugaauguaggcugaaagcaguugugaaaugagcagcucuguuucagccaucaccccuucuugucuccguucacuccuaagugaccuuccgcucuuccugagcaggaggugcaguguuugugaguuuuguggugcugaugaaaauagggaucugaacgauauauauuuauuuuauuucuauaucugaacaauauauauuuauucauucauaucaaugacuccagucacacguagcccuccguaucuagagauuauguguuggcugaaugaaucacccaugggcugaaaauguccuggaaaucaggaaacaaauugcaucuacauggaacauccacaaaccuuuucuccuuuucauuguucccuaaaguauauaaagucauagccacguaucauuuaauuuacaaauaaauuucuauuuacguguguaucuuugcuuaugugaauguaugcauguauguguuggaucuccaggagcuggcguuacagguaguuguaagcuguccaguguggaugcugggaagcaagcucagguccucugccagagcagcaaguccuuguaaccacugagccaucuuuccagcccuggaucauuuauauuuuauuacauuaccuauucuaaguaaacuguaucuuuuuuuuuuuuuaagauuuauuuauuauuuuauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccaaacuguaucuuuuuauguaaggaacuugaguauccaaagauuuugguauccaugagaccuaucucgcccauucugagggaagacuguuaagaaucuugcucuuuuuuuuguuguucaaacaguuuccgauguuauaguucuagcagucuaugaaguucuaaaugacucuuagggcuagccugcaacuguugacaucuuagggcuagccugcaacuguugacaucuuagggcuagccugcaacuguugacagagaugcuucacaggggugcuuuguuaugcuuuccuuuuuuuuuuuuucuuuugguuuuuugaggcaucucaacugugugucccugaguagauuugagcucgguauguagaccagaugggcucugaacuuccugugguccugcuucugcuucccaaauacugaugguacaggugugagccacagcaucuagccuuugaaugaagguaucuaaaucagucgugauagcauacaccuugucuuaguuacuguugcugugauaaagcacuguaaccaagagagauuacagaaggaaacaguuaacuggggcuuagaguuccagaugaguccaucaccucaucccucagucaggccgggaucacagcaggggccuggcagggggugugacuggcauggugcuagaacguuagagcucacauccugacccaggaagcaagaauaauggaaauaguaauuuuuguuauuguuauuuaacaacuuucuggccgucuggcuucuacauguuaaacuauauauuguguaggaacaguuucuuuuuucuauuuuaguuuucaucaugugcacucaugugggucgugucagagcauguguagaugaguguagaugcccauggaggccagaggaagguguuggauucccuggaguaggaguuccaagcauuuuugagcuaucugugggugcugagaacugaacucggguccucaauaacagcaauccaagcccuuaacugcugagccauauuucuaguccucuuaauggcauuuugggacaugaugggaacauucuaagauagggcuaauuugagguaauagucuacuggguucugucuuguucgugguucuuuacccccucugcuguuuucuuccccuccccucucucuguguuguccccucugcaauuccaccgucccuguugccuugauauuucuaccuugccucucuggcccagagcacuggagccagccagcugugaacugaaauuguaagcgaaaacguuuacuccaaagagugagaguuacagucuccacgugccuguguuguuccauauuuaccuuaccuuaguucaggcugacacauugcucaguaccacaucuggcuguagcuguuuuacuggauagugcaacucuuaaagcuuacuccucaaggaguuuaugggucaguagcaacagcauccuguaagagcuugcuauucucuuagcccuauccuacacuacugaauaaagcauuuaaaaauaaggaauuuaaaaagagggaaauauauguuaaaagacuuggccauacacuacauuugucuccuaguucacuauuaacacuaacuuuucaauuccuuucaucuuccuugguugucauuaauguugguaucugcuuuuuauucccuacccugucaugugcauuaaaauagcaaggauuuuccuuugcuuuagcacuuacuguaucuggagagguaccaguuaugaguuagucgugugccugagucacaucguuaauuaucaccacugaaucucuaccgcuuguccaugagccauucgaguuccuuuuuguguguggagugacuuuuggguugaggaaaugacccaguuggcaaaguaugcaccauacaaaacuaaggucuuuaugugcccaggacccaaagcuaagcguggcugugugugccuggaaucccagggcuggggaaggagagauaggagggucccugggcuugcugacuaguuauuacagccaaaucaacaagccccgggugcagucagagagccugucucaaaaaauaagguggagaaugauuggauuaagagcccuggcuaucacugagugugguggccugcacuuuaaucucagcacuugggaggccaaagcagguggaucucagaguuugaggucaaccuggucuacuaagugaguccggaauagccagggcuacacagaaaaaccuugucucaaagaaaaaaaaccaaccaaacaaaaaaagaguccuagccauccugggacucauucucuagaucagccuggcuuugaauucaaagaaccuuuacaaguacuaaccacauuaucuuuucuuuuaucucagugucugucugucucucucucccuuccuuccuuccucccucccuuccuucccucacccccuucucucucucuuaacagaguuucuuuguguagagccuuggcuguccuagaacuuacuuugucgaccgagcuggccuugaacucagagaaauccaccugccccugccucccaaaugcugggauuaaaggcuugugcacuaugccagaguagaauuauauuauuuuaauuacuguagauuuguagugagauacagaguuuuuguuuacuugguccaaaaaaacaaaccugggguuuauguauacuaggcaagcacuuuacauacauacacacauacacaacacacacacacucacacacacacacacacacacacacacacacgcauguuuguauauguauguguguguauauauauauauauauauguauguauguauguauguaucuggcacuuggugcugagccuuuaaacuaauacaaccauuuuauauuaacuacuuaagcauuuauaucugauuauacagcaugaaauaauuaugaauauaucauuaaauaugcugcauuaauuuuuuuaguguuuuacuugaucauagcaguaagucauaugcagguaagugcaauuuucauaggucauuucuuauaucauuugauuuuucugcuuaugcagcaucuaaaaauaauuacugaaaaaucauugguuguaauuuaccugccauuacucuuuaaaugacucuuaaaggcauucguggcuguugccuuuugaguguucuuucuacaaaagaaaaaaaaaguaacuuaaauugguuuucuuucuuucucucuuucuaauuuauagauuuuguaugcugaaacuucuuaaccagaagaaagggccuucacaauguccuuuguguaagaaugagauaaccaaaagguacauaauuuguauaaucaugggagguuggaagcaacauggcaggaaaagguagaaauuaauauguaaauaauauuucuauaaaaccauucaccaauagaaaaauauacuaauguguuuggggacuaggggugcuuacuaaguaggcacaaggccucugacuucacuugacaguaccucauaaaucaggcaucuugccugacgugccugagcagguaagguugcugucaagcugaagaccugaguuugguucccaagacccaugauggaaggugagaacugccuguccucuagccuccaagcaugaacuguggcauacacgcacucuuucucuaaucaaucaauuaauuguuuuuuuuuuauuauuauuuaagaauaagagcuggagaguugacucagagguuaaggguguuuguaguuuaugacugucuaugaaguuauuuccuuggaaguuuuuaugagacaucugcugucagcaagucuuaccaccuuggugccuuguucucccacccacaugcuagucagcccccauccuacuuagcucucaacuccagugcgcucaggugcgauggccauagauaacacacucagucuuucagauggagcugcacuuaggucagccgcacaucgccuaccacgguuaguucuguuagggcacgguuaguucuguuaucuuucagucaguccuguuuugccaguguuuagaucauaguaggcugucagauauuuuuaaaagaaaaauuaauuauauucuaccuaagccuaagucucucuucagauuuuggugucuguuuucaaaaugacaaauuuacuauuugauggaagucugagaagaagugcuggcaguaaggguugaguugggauguuaaguaucaaucguaaguucuuucugcuguugauuuauaucuacucugaauucaggguagaauuuuguggcagggacggguuaagacaaggucucucuuuggauuggaaauuaccaugacuaaccucaaacuagagauccuccugcuucugcugagaucgcaggagugugcuacucugcuggguuuuuugguuuguuuggaacagugucauguaguccagauuggucuugucuauucuucuaucucugucuccuuccuacauacuggggucacaggcagacacagccaugcuacgcucgggacuauucuguuaggggcuuuuaccaaaguauuuuaaaaaucuguauagucaaaaagagaaugaaaacauacagacacccaaaaucaaagccaaguaaauauacucaugaaguuuauucucaugucacugauucagugauuauaaugugacgucucugguaggacuggguuuguacugugcuggggaucaaaugacuaguucucugggguugugcuuucugcugcaucuacagucggaaagcuacaauccauguguuuaugugucuuuguuuuagugugcuuaaaauuaauaaucacuuauauaugcuucucaaaaaaaaaaaucugauuucaggagccuacagggaagcacaagguuuagucagcuugcugaagagcugcugagaauaauggcugcuuuugagcuugacacgggaaugcagcguaagugucgugcagccugaggcagugcuccaggggcugguggaaaccugagcgcauuuggagcuauuguaugagacuggucugguuaaauuaugcuuuacuuauugcacuuauuuauugggaggcccggagcacaggcugggacagaugugucuauuuguauggaacccagaggucaucuccagggauuguuccucaguuuuugagacaagguuucucagggauugagcugauagaguuaguguuggugcuagcggccuuuacucacuggcccuacuuuuuacauuuuuauaacuaguaauuguauguguuuguguaugagaugugagugcacacaugcaugcgcuagggcacacauuuggguauaaaaggacaauuuugggguugauuuuuuuuuuucuuccaccuuuacaugguuuuaaaccugaaaauugugaggaaaaagaccaaauccaugauugucuaauuagagcuagcuuuaucccaauacuagauaggacaguggacacuggccagguacauaccugggccucccagaggauggcauugaauucuguuagucagguacucauacagacagaacacacaggcuauguacuucccaccuucucccaaucugggagggggaggggcaagcauucauucugauguacuuccugccugccuaucaagcuuguccuguguaguugggacagccaaucuuacagcucccaguauuccaggagguucucuguccucgggcagguggggcuuacagguuaacuuuagcccucacccaucauuuaugaucaagcucagguccucacgccagggcaagcacuuguaccugcugggcuagcuugucagccugcgguuuuaaauuacuccuauuagucuugcauuuuauaugucaaucuugcuuguuuuuguuuguuuauuuuugagacaguuccuggcuauccuagaacucucuguagacaagacuggccuugaacucagaggucugccugccucuacuuccuaagugcuaggauuaaaagguaugugccacuaccaccuugccuagcauguauaucucaauguuucugaaauagggagcauuuuagagaauugugguaaauuuguuaguaagcaaguuuauuaguuuuuagguauuucagagguaauaaaaauaacuuaagagucuuugaauuucuaaacaggacuuuuaaaacaguuauagguagucagagcuggagagacagcucaacauuucagaauguguaacuacucuucuuaacagaggacccagguucaucucucaucagccagagcagguggcuuacaacuuuagggcugcaaugccuucugacuucugcaggcaccugcacacauguacuccacauaaacucaugcucacauacacauaguuaaaauuuaaacguaggcaagcaugauggcagacaccuugaaucgagcacucagaaggacagguggaucuuggaguucaaagcuaucaaauuccagacuaaagaaggcuauacagaaccuaccuuuaaaaaaaaaaaaaagcccaagaauauuaaauauacccauaaugcauuauuuuuguuugcuuguuuuuugagacagaguuucucuguguaggucuggcuguccucgaacucagagacccuccugcuucugccucuucugcugacgccaccaccacuaggcuuuuuuuccuauuauucuuauacagcaaacacaauauucuuuuuggauauuuagugaagauuaaugucuuuuucuaacuaaaacaugccccuuuuuguuuuacaguuacaaaugguuuuaguuuuucaaaaaagagaaauaauucuugugagcguuugaaugaggaggcgucgaucauccagagcgugggcuaccggaaccgugucagaaggcuuccccaggucgaaccuggaaaugccaccuugguaaagcugcuuuccacguuuuuuucugccgucucuuuauugagucuuagugaguuagugaguguguggaucuauauaagaacuuaguagagagaggauggugauuguacauuuaguggcuggacaaguguucuaauaaguaagaauuaaauucagaaagucaggggaucuggugugaucaacaggcgcuuuacaggcccuuugccugccuuacaacuccaucugcucugaugcagguccgaaaugggcacagugucccugaucuuuuguaagcaaauuguuugcaaauugcuucaacuuaaccaguguaagaauaaagaaaauacaaugacuugcucugcuccaguggaugauggagaucauggaaauacaccuucuaaguauucuuagaaugcugggauuuuauggcuggcaauccuuuuuaaaaaugcuuuuauuuaaauauuuuagauuuuuuuaucauuaauuauguaugugguggggguugugcaugugacuauagaugcuuuguagucuagaagaggcuaucagagccccucuaccuaaaguuacauguagcuaugagcuguucaauguugcuacuagaaaccucugcaggaacaauucaugcucuuagccucuaagcugucuugacgcgguucauggcuuucagucagcauguaaugcaguccacgugcuuacauauacuaaugcacugugacauuuucaagugagauuguucauaguucuuucccucuguucccgcccuugcuaccucugugccuccuuuguagccuccccuucagauuccuccucuuaucauuuauccuucucaaaaauacauuuuauguugcuggccuucuagugauuauaauuaguuuuggaaaaauaaaucugaaaaaauauuucacaaaguaaaccguaggcauucuuuacuguuugacagaaggacagccuagguguccagcugucuaaccuuggaaucgugagaucagugaagaaaaacaggcagacccaaccucgaaagaaaucugucuacauugaacuagguaaggggcucagguuuuauuaaguuggaaaugauacuugcuagauuguuuggcuuagaguuuucucauagauguguauguguugcauggaguuuugguaagugaagaugaaauaauuuuauggguucuaucaugaauuauagauuuuguaaaaguuaaaacuuuacaucuugaagaaucuuacuuuauaaaaggaacaaaaggaaaaaugucugguuauggguuuaagugaauuuugggaaaaacuuagucauaauagaaaaaaaaauguuugguugccauagaauuuagaaggaucugggauaaauucuacaagcucuguguucaaucucaagcuggccaaaaagacugagagcucagacaggcuucucuaucuuagcacauuugucaucccagcaucuaagaggcuaaaguaggagaauccucagugaguuugaggucaaccagggauacacagagaacccuagcccaaaaucaucgucaucaccaucauugccaccaccacuaccaccaucaccaucaucauaauaguaaauaaucaaauugggaagaauggugguguuuugaguuccagacuaccaucugucuccaucaacagcagaucuauaaaaauaucccagagacuggggagauaucuuaguuggugagguacuugucaccuaaauucaaucccuacaaucuacaggguggaaggagggaaaucagcuccaacaagcuguucucugacaucuacacugcacaugcaugcacauacaaguaauuauggauuacuaggaguagugcaaacguuaucggcuaauauucaggagcacuugauuagaauauaggugcuauuguaguuuuuuuauaccuuaucuaaaaugucaguccugaggugaugagaaaauuaacuuacaaagaaguuaagaauuuggacauaggaagcuggcuuuggggccugugcuuucggccacuucucuguauugccacaugugucuguaccugcuacauaguggguauuaauuauaaauauaauaaauauuucuggaugaacuauuauauguuuuacaaaaagcaggguuuuuuugguuuguuuuggguuguuuguuuugguuuuguuugagccuuaauaaucuugacugauuuuuggguuuuauuuucuuuguuuuuuucuagacucugauucuucugaagagacaguaacuaagccaggugauugcaggugagucaaagagagccuuugucugugaagcuauugucauaucuaauuaguauugaggagccuagauuuagaucauaguauuagaaaaaaccuuaaggaccauuuaguuuuaucuacuuuauuuucugggaaaucuuuuuuuguuuguuuguuggauacuuuuuuuguuuguuuguuggguuuuuuuauuauuuauuuacuuuauguauaugaguacacuucucugucuucagacacaccaguacaucccauuacagaugguuaugagccaccaugugguugcugggaauugaacucaggaccucuggaagagcagucagucuucuuaaccacugagccaucucuccagccccgaauacuuuuuuaaugccaaacgaguuuuagauaacaguggaagucagcaugcacuuguuucugccagaucguuguucucugaguuucucauauaugguaauaauuacuuauuuugggguggggucugucuauagagcccuggcuguccaggaacucacuauguagaccucuaagucucagaaaucgucugcugcuuuucaagucaccaaaggcauccaccacuaugccugacccaaacaucuuuuauuuaguuuaguuuauguauaugaguacacuguagcuguucaaaugguugugagccuuucaugugguuguuggaaauugaauuuaggaccucugcucgcucugcucggccccgcuugcucaguccuugcacacuucagcccaaaauuuguuuauuauuauacauaauuacacuguaguuaucuucagaugcacaagaagcggaggucugaucucauuagaggugguugugagccaccauguguuugcugggaucaaacccagguccucugggaaauuaacccauguucuuaacccugaaccauuucuucauuacuccaagguguuggaccauccacugagugugcuuauagguuguugcucuaaaggcccccacaaccucgaaggaaacugucucucccucagaaucuaucaguuguccauagcuccuuaguuagggguguggcucaugagccccuccccucucucugcuagaauguugauaggcuugaucauguacagauguuguguaaaccaaaauugcuaugagcucauguacagugccucugucauguccaauagacacuguuuugcucuggucuuuccaacuuacgguucuuagaaucuuuuuuuuuuuuuuuuaauguggugugaaccucuuuuuuuuaagguuuauuuauuuauuauauguaaguacacuguagcugucuucagacaccccagaagagauucaguuaucauuacagaugauugugagccaccaugugguugcugggauuugaacucagggccuucagaagagcagucggugcucuuaaccacugagccaucucuccagcccucuuaagagucuuuuaaccccuucuuuaucaauggucugugagcaugcuugcaagaguaugugagugugugugugucugugucugugugugugagugucuguguguguguuugcauaucuagaaagcaacauucuacacuacucugaccuuagugacuguccuuggagaacagaugucagaaggugagucagucagcucaguuguuccagcccuaccuagagacacgaacauaauugaucuugcacauuugacugagcauagaauuucuuauuagggguugucuuuuccccuuuagugugagagaccaggaauuguuacagaccgccccucaagaagcuggagaugaaggcaagcugcacucugcagaagaggguaagucaggccuuccugacauaaugacacuaaggggcaguggagugaugccguuccauuauucccaucaucugaaggccauuugccaaauuuauuuaucauuuaucauucacaacaucuuuuuaaagaauuaaaaugucgggggcuggagagauggcucagugguuaagagcacugacuccauuuccagagauccugaguucaauucccagcaaccacauggugguucaugacugucuguaaugggguucaaugcccucuuccaguguuucauacauaaaauaaauaaaucauuuuuuuaaggaauuauaaugccauuauuuuuucuucagcugccauugugagauagugaguaguacuagacuggggugguuauaguaauaucuuguguaacuaaagcugccaaugauuuuuuuuuuaagaguucuauguaacccagagcaauuuaaccauacuuuuguuuaagccuuccaagcuggaacuaaucugcuuuuauuucaaucuuaagagacuaugggggcuggugagauggcucagagguuaagagcaccgacugcucuuccgaagguccuaaguucaaaucccacaaccacaugguggcucacaaccauccauaaugaaaucugacauccucuucuggagugacugaagacaguuacaguguacucacauauaauuaauaaauaaaucuuaaagaaagaaagaaagagacuagggaaauaagauaugugcucuaauuccuguguuugagaaaauaucuuaaucugcacaauaggauuguaugagcuagaucuucaguauauuugguaguuuaugauuuuagcuccucuaaagaagccacuggaaaccaguuaguggugauggaagccuuuaaucccagcacuuuggaggcauaggcaggugaaucucugugaguucaaagcuagccugggcucauagauuucucagacagacagggcuacacagagaaacccuaccuccaacaaacaaagaaauaaaaaacgccaguggacuggggcuggagaacuggcaaagcagugaagagaacuuguuccucuugcagaagaccuggguuugauucccaggacccacacuggguaguuuguaagcauccaaaacucgaguuccaggagaucugcagcccucuuuucucuucuuugcgcaccaggcgugccuguggugcacauacuuggauguaagccaaaacacauagacccuuauuuuuuuuuuuaagaacaucuaaaauuuaaaagguaaauaaauaagguuaguggauugguuuuuacuccccaguuguaucugguauguaguuucucgugauaauuccauuuuaaagaaccuucuuauuuuguguauuucagcugcuugugaguuuucugagggcauaagaaacauugaacaucaucaaugcagugaugauuuaaacccuacugagaaucaugcaacugaaaggcauccagaaaaaugucagaguauuucuauuucaaauguguguguggagccauguggcacagaugcucaugccagcucauuacagccugagaccagcaguuuauugcucauugaagacagaaugaaugcagaaaaggcugaauucuguaauaaaagcaaacagccuggcauagcagugagccagcagagcagaugggcugcaaguaaaggaacauguaacgacaggcagguucccagcacuggggaaaagguagguccaaacgcugacucccuuagugauagagagaaguggacucacccgcaaagucugugcccugagaauucuggagcuaccaccgauguuccuuggauaacacuaaauagcagcguucagaaaguuaaugagugguuuuccagaacuggugaaauguuaacuucugacagcgcaucugccaggaggcacgagucaaaugcugaagcagcuguuguguuggaaguuucaaacgaaguggauggggguuuuaguucuucaaggaaaacagacuuaguaacccccgacccccaucauacuuuaauguguaaaaguggaagagacuucuccaaaccaguagaggauaauaucagugauaaaauauuugggaaauccuaucagagaaagggaagccgcccucaccugaaccaugugacugaaauuauaggcacauuuauuacagaaccacagauaacacaagagcagcccuucacaaauaaauuaaaacguaagagaaguacaucccuucaaccugaggacuucaucaagaaagcagauucagcagguguucaaaggacuccugacaacauaaaucagggaacugaccuaauggagccaaaugagcaagcagugaguacuaccaguaacugucaggagaacaaaauagcagguaguaaucuccagaaagagaaaagcgcucauccaacugaaucauugagaaaggaaccugcuuccacagcaggagccaaaucuauaagcaacaguguaagugauuuggagguagaauuaaacguccacaguucaaaagcaccuaagaaaaauaggcugaggaggaagucuucuaucaggugugcucuuccacuugaaccaaucaguagaaauccaagcccaccuacuugugcugagcuucaaaucgauaguugugguagcagugaagaaacaaagaaaaaccauuccaaccaacagccagccgggcaccuuagagagccucaacucaucgaagacacugaaccugcagcggaugccaagaagaacgagccaaaugaacacauaaggaagagacgugccagcgaugcuuucccagaagagaaauuaaugaacaaagcugguuuauuaacuagcuguucaaguccuagaaaaucucaagggccugucaaucccagcccucagagaacaggaacagagcaacuugaaacacgccaaaugucugacagugccaaagaacucggggaucggguccuaggaggagagcccaguggcaaaaccacugaccgaucugaggagagcaccagcguauccuugguaucugacacugacuacgacacucagaacagugucucaguccuggacgcucacacugucagauaugcaagaacaggauccgcucaguguaugacucaguuuguagcaagcgaaaaccccaaggaacucguccauggcucuaacaaugcugggaguggcacagagggucucaagccccccuugagacacgcgcuuaaccucagucaggagaaaguagaaauggaagacagugaacuugauacucaguauuugcagaauacauuucaaguuucaaagcgucagucauuugcuuuauuuucaaaaccuagaaguccccaaaaggacugugcucacucugugcccucaaaggaacugaguccaaaggugacagcuaaagguaaacaaaaagaacgucagggacaggaagaauuugaaaucagucacguacaagcaguugcggccacagugggcuuaccugugcccugucaagaagguaagcuagcugcugauacaaugugugauagagguuguaggcuuuguccaucaucucauuacagaagcggggagaauggacucagcgccacagguaaaucaggaauuucacaaaacucacauuuuaaacaaucaguuucucccaucaggucaucuauaaaaacugacaauaggaaaccucugacagagggacgauuugagagacauacaucaucaacugagauggcggugggaaaugagaacauucuucagaguacagugcacacaguuagccugaauaacagaggaaaugcuugucaagaagccggcucgggcaguauucaugaaguauguuccacuggugacuccuucccaggacaacuagguagaaacagagggccuaaggugaacacugugccuccauuagauaguaugcagccuggugucugucagcaaaguguuccuguaagugauaaguaucuugaaauaaaaaagcaggagggugaggcugucugugcagacuucucuccaugucuauucucagaccaucuugagcaaucuaugagugguaagguuuuucagguuugcucugagacaccugaugaccugcuggaugauguugaaauacagggacauacuagcuuuggugaaggugacauaauggagagaucugcugucuuuaacggaagcauccugagaagggaguccaguaggagcccuaguccuguaacccaugcaucgaagucucagagucuccacagagcgucuaggaaauuagaaucgucagaagagagcgacuccacugaggaugaagaucuucccugcuuccaacacuuacugagcagaauaagcaacacaccugagcuuaccagaugcagcagugcugugacacagcguaugccagagaaagcggaggggacccaagcaccauggaaggguagcagcagugacugcaauaaugaggugaucaugauagaggcaucucaggagcaucaguuuagugaggauccaagaugcucuggcagcauguucucuucacagcacagugcugcccaagggucaacugcaaaugcaaacucccaggauuccaauuuuauuccaccuuccaaacagaggagucaccagugugggaaugaggaagcuuuccuaagugacaaggaauugauuucagauaacgaggaaauggcaacuugccuagaagaggauaaugaccaagaagaggauaguauaaucccagauucagguaguuuuguugguuuauuugccccagucuacagaagugggcugaacauacacagucaaaucuccuucuuggggcuagagagauuucgggugguuaagaguagguacuuuggggguuggggaaaggcuggagagauggcucagcuguuaagagcacuggcugcucuuccagaggauguagguucaaauccuagcauccauguggcagcucacauuuuuuuggucacuucaauuccaggggaacccauuacccucacacuuauacaugcagguaaaacacaaaugcacauuaaaaaaauaaaguggugcucuaucuaagaccaaguugaauucccagcacccauuucagguggcuccccccggugucuccugcauuaguguauaaguagcccacacagacauacacaugauuaaaaauaaaauauuuuaaugcugucaugcagccagaaugccugggggcaugagcuugaguaaccuaauuuucaguagacuugauucuacuuuuuauugcagaauuuuucugauuuguuugggcuuugguuuugguuuugguuuuagacaguuugucuauguagcucugacuagccuggaacagagaucugccagccucugccucccaaaaucugggauuaaauacauucauuaccucacccagccuauugugggaguucugaaaggaaauccagugucccaaauguagccaauuaugugacaugagggagaaguagaagcuauacaaggggaggaacaggcacugaggcugcaggguucgcgguccaguuuuacaucugagucucugauuguguugucauuuuaugugaagaggcauccggauacgagagugaaacaaaccuuucugaagacugcucgcagagugauauuuuaaccacucagguaagaagcaggcacgcguuugugauguccucuggauaguguaaaccuacgugcucauacaugguccuuuguuuccuuaagggacacuucuaaagcaucuggguggaacucacuaccuuuuaacuguagaaccccagccagaucuaaaaauccuacuugccuuauagcaaaauuauaugaaagcacuauuguaucaaagggauauguuuauucucugaaccaaacugaagccuacaggauucuuuccacuagaggccaucuuaccuuucacuguauuauuucuuuuaauuuuugucuuuuauuaucuaguugcuuguuaguaucuuucuacuuggaaacgaauggccaggguauucauuccugcaccugguaacucccacagaugacgugagugcuccugcacucgaggcaggacaggcucuugggaaaaacaucauucucacagccagauccuagguuuaucgccuaacuuucuuuuugauuaaaaagaaaaaaaauuccuaaacuugcauuucaaaccuuagauuugucuagguauuucuuuccuguguuuaucuuucacuagcugggcaacuucugaggguuccccauccuguauuccucuacagaguccuaggcagaguguacagcaagucuggagcaaguauuggucagacucucugugccugaccaugugaucucaguuaauuggcuuauuuucucugaauuaaaauagcgauacuuuuuuuugguuuuguuuuuuuuuuuuuuuuuuuuuuuuuuuuuugguuuuguuuuuugagacaggguuucucuguguagcccuggcuguccuggaacucacuuuguagaccaggcuggccucgaacucagaaauccgaaucagccugccucugccucccgagcacugggauuaaaggcaugcgcugccacgcccggcuucuuuuuuuuaacauacauauuuguauguauguauguggauaugccaccaggguaaauguguggaggucaggugacacagucugugcggcagugcugaggaucaaaucagguccuccugugguggcaagugagcugacucacuggucccguggugugguuugaaucaucuugcuauagcuucuguuucucuuaaagcauaaaugugcuuuuagcugcagcauacgagugacuuuucuuccccuucuuuuuuuuuuuuaaagauuuuauuuuauuauauguaaguacacuauagcugucuucagacgcuccagaagauaaucagaugguugugagccaccaugugguugcugggauuugaacucaggaccucuggaggaacagucagugcucuuaacugcuaagccaucucuccagcugucuucuuuuuuuuuuuuuuuuuuuuuuuuuuaagauuuauuuauugauuauauguaaguacacuguagcugucuucagacacuccagaagagggagucagaucucguuacggaugguugugagccaccaugugguugcugggauuugaacuccugaccuucggaagagcagucgggugcucuuacccacugagccaucucaccaguccccccgucuucucuucuuaaaaaguacaaaacuaaaugaaacugggaauucuuaguauuacuaaggucacuuuguugucaccaaagacagcauccccuguugguuccagcaccccaguggcagaggcagguggaucucugaguuccgggccaggcugguuuacauggugaaugccaggccagccaggccuacaaagugacaccuugucuuaacaaaauaagacaaaaauugauuaaaagacuuaaaucuucucaugguccuuucuggauuuauuuggggcucugucaauaugucugucaccuaauucugucccuuagcugcuuguuuuuuaaguuucagcuuuuuauuccaucugucuuagccauacuguauuaaaucugacauucaauacacuacuguguuguuucuugggucucugauccuauucccagaaagaugcucauuauuugaucaggauucauuguuuuaaguguuuuuauaucaaguaucuauucaagacagguagcuuugauguugaguugcacggacaagcaaaaugauugcaauggacuuucccuauguucauauagaacugaaggguaagagaugauacagagugccucauguggaaucacugauauacuuugugaugcucaugguguguguauaguauauguguagugugggugugugugcagugaaggugcaagauugucuccucccacccacuauguaggaccuaaggauuaaccucaugucauuaggcuugguggcaaguaccuuuucacacugaaccaucuugccaacccuccuaccucccccccccccauuuuguaacucaaagauuuaauucauuuguccauuuucauauuaaacacuggcugugaaguuccucugugaugggcagugguacgggacuuaggguugcauaccuuguacgcccaugaccuuggcauucccagugugagggaagcuuagacaggggaaucucaacuuugaagcuagccgaggauacauagaccgcucuucaaaacaaaaagaacacaaaaucaacaaggauuccuccucccaucagggaaguuguguguuccccugaauguagugaugcuuuggcagccugagccacguaaugaggcacacugcuguccugauagacagguauugcugggcuuugaaagauuagaaaagauuaccaaaugggaaaagaggggaugugggaacugaggcaaagauacagauggccugaaugcauagggaccgccacugagcagucuagugucucuagaaagcugggcugaugggaaaugcugggcgucaauaacagauaggaucaagcuguccucagacuuuggaaugguuuaucuaggaaucugaacuuugacuugagggcaguaaugacgaaguucuuuagcgcugaaaaauacuagcuuauuaacugagcuguguuacgccauuugaggcccuuuuggaaaaaggauucuugauguaaagagauaaacgugguaaccugucuggcuuuguccucccuggugcauuugagcaccuauaccuauaguagaauugucuuaaguuuuacauuccuuccuguaggaaaagccacugcaguagugguccgauuacuuuucuuucugauuuucugguauguuuacuggccauguggaaguuagauggcauagcugugaguguuauuaauucagcuuuuaaagaauuggucugauaucuguguggggccuuggcuaggauuugaucagugaugucaguacucacggguaccacgugguggcauugguggcacugcagauguuggcagcauuacagucucaguagcagugggaaccuuuguaaagcucgaaauuacguuuuguuuauuugguuuuuucaucauaaaguucuccugggaacuaugaauuuaucauagcuguaggaagaauauggcuugauuuuaguggaaagcaaagucacuuucaaggucaaaagacagagaaggugaaacagauuuuguuccccuccagcagcugaaaaccuagcaucggcauuucuucuaaaagugaugaagagacauacauauugggaaauucuuuauuuguccacauccuuugcuugucaaauaccuuagacuugcuagauugucugugacaggaucucacuguguagucuuggcuauccuggaacucacuauauagaccaggauggccucaacucaacucaacuacugcuauuaaagcuauuaugcuuagcugaaauuacucuuuuuuuuuguuuguuuuguuguuguuguuguuguuuguuuguuuuguuuucugcuuucaagacaagguuucucuguguaacaacucuggcuauucuggaacucacuuuguagaccacucugcaaucuggccuugaacucacaaagaucuaccugccucuaccucccaaguacugggauuaaagguagcuagauuacgucuuaagguggaucaguaaacaguaugaaccuaugggaaagaagaguucauuuucuugaauugaaaacaguaauuugggcuggagagguggcucagcgguuaagauaacugacugcucuuccaaaagcccugaguucaaaucccugcaaccacaugguggcucacagccaucuguaauggcaucugaugcccuuuucuggugugucugaaagucaguuacagugcacucacacacguuaaauaaauaaauaaauaaauaaauaaaucuuuuauaaaaaagaaaagaaaaagaaaacagcaacuuguuauaggcuuucuagaacaucguaggaaauuauucaacacugaauccauguaaaaacuaaauuuacuuggaucuaagcacagcgauguaucuuuucacucagcuacaaauacauuuuuaaauuuuaaaaauaauaagaaauaaauaaauggggcuggagaaggggcucagugguuaacagaccacucaguucagaggaccuggauucagcuccagcugauggcuucaaugcccuuccgugaccucugagagcaucgggcacgcacauggagauaaaucauucauaaaccugaacuuaaaaaaaauuuuuuaacuaggcauuuuguagacuaauuaaaugucuuaucucacaguagcgagucuuuagaacacaguuuauauaguuugugaacagauucuugugaauuuaagcuuaaaguacuguaauuaccccagucugucccccaucuuuaaaagaaaaugaggagcuacagugaagcagaucuaucuggaagagcucgagggugcacucuccuccaacaucauuuucaaacaauugcaaggucauuaaccacaugaguaugguuggauuaaaggguauucagccagaacucauaauuccauauuaggugaucucagcucccaugcuaaaauuaauugcugugacauauucuuacuucguggcacaucucucagaguauauaacuuucuugguguucuuguuugguuuugcagcagcgggcgaccaugaaguauaaccugauaaagcugcagcaggaaauggcucaccuggaagcugugcuggagcagcgugggaaccagccuucuggccacuccccuucccuccuagcggacccuugugcccuggaagaccugccagaucuggaaccaaacaugucaggagcagguguguagugcugaacaaaugccaguguuacaagcaaacuucuucccucccucgacccucuguuuccuucgaagagugaggacugaguuccaacauugugugaucuuugcucagugcagguuuacugaguugcuccacgaguaacuugggaaccuuagaccuagucccugcucacgagagcugugccacugagagggacccaagggaaucuuaauucauguucuucucuggguguuuagaaggagaugcuauggaccccauaggaaauagaaauaguucuugcacuucguuguuagagaguaguuauagguagccccaucauuucagaaagccaugugaaaauaagacccauucagaugaaauccuuacagugauagaucacaaagugaagaucugcuuccuggguuuucugauuuauaagacgagaucuuugguuucaggagcuucaccuuauguuuucaaguagaaagugggcuuugguggucauguugguaaucccagcaguugggguguggaggcagagggaucaggaguaagggaaguuuucauuuagagaauccuggugugcggcaggccacccacaggaggaguuggugcuuaggaacagaugagggcagugagccuucucggaguuucuucacugaaguccuacaugacuugcugcucaaguuccuccugcaacccuuccuguacaguccucuggacccugaggcccuccuuugacuauuagggacucaagucuguucaucauucagucaagugaccuuggucuccacacgugccuugucauauuuccaugcucagaaagaaacaguagcucaugcaagggaagcugcuuguaaagcucucuccuugaauacuuucuuuguaagcgcaucuucauuuaguucaucaccagauaaugaagcccagagucccauccccuauacaguaaucucuggguacugucacugucauuacugugaaaauagacaggacuuucagugcucuuacacaagauaagacuuguuagugucuggcuuugaauaucugccuaaaccuacuaccucauauuuggcauacacaauagaggguugguugaagguuuguguuguuuuguuuuuagcucccacugaaugucucccgauaaaguguuccuuuguggcucauuucuaaaauacuugacugucaugagcaacuccagaguugagccuuucuuaccuuaggcugauguauuaagagaaacucaauuucuuuucccuuuuaaaagaaaggucugacagcacacaccuuuaaucacggcacucagagaggcaggugcaagaggaucucuaugaguuaaggccacccuggucuacauagcaagcucuaggacaggacuauauagagauacccuaucuccauaaacaaaaagauuuuuuuaauauauauagacuuaagcacuaggguuaauaaggauuacagaaagguacaacugcugugugggccugacaguuaccugcaaccccagccuaagaaggcagagacagggacccccagaucaagcuggcucgggagacuugccaaacagcaaacugggguugagugagagacccaaccucaaugaguaaaguaaaauagccauggagagggccagagagauggcucagcaguuaagagcauuugcuguucuuccagaggaccgagauucaauucccaacacucacauggcagcucacaacugacuguaacuccuauuccagaagaucugacacucucacacagauauacaugcaggcaaaacaccaaugcacaugaaauaaaaauaaauuaaaaagagccauagagaaucauuuuuuuauaucaauaucuggccuccaaacacuaauuuacauguguguucacacaugucacauacaauaugcugugcacaucugagcagguacuuuaaucacugagccgucuccccagcccauggucuuaaagaugaugaaaugcccuucccuggggucuuaacaucaaugcccagcucuucugcauagguuuuccuguuugucuaagguuuaucccacaaccuucagaaauauuugggcagaaauuuguacacacacauuauaccucuaaggauuuucuucuaucgugucauauucccugucauucagugagcaaauauuaacacuuaugagaucauggcucauugugguaaaaguaauuuucagauacaucugagcuuuucuagcugguagcauauuuauuccuaggaauacuuguucaauuuuucuaggauccuccccuuugaauucugaaugaguugggaauaguuggaauaaacaucuuauguaaccugugucucucugugugugugugugugugugugugugugugugugugugugagugucugugucuguguguguguguguaagagaaagagauugagagagauuuguuuucucuuuuuuaagauuuauuuauuucaaaugaaaaaaaauauuucauuuauuuauuucagugacauuuugucacugucuucagacaccagaagaucccauuacagaugguugugagccaccaugugguugcuuggaauugaacucaggaccucuggaagagcagucagugcucuuaaccgcugagccauuucuccagccccuuguuuucucauaauagcaggauucugcugugugauccuaacugaccuggaacuucaugucucuuuaauggauaaaagauauuuaauuuaaauauacauauuuaaauuuuuaaauaguuuuguugucugcauguguacuugugagcaccugguguccacagaggccagaagagggcauuggcgcucccuggaacgaaaguuacaaggcuguaagacacuacaugaacaucauacgguucuaggaaccaagugcaaguccucuguaagagcaacaaguccucuuaaccucugagucuucuuuuuuggacuguuuuugaugcuuaaauauucuacuauacaugauugcuccacacuuugaauugcaaugccuucuuuuauuuacguguuuauuuggacaaauucucucuagacugugcuaagacucccucuggagaccaggcugaccuccaacuccacacucacacacccuuguuuguuuguuuguuuguuuguuuguuuguuuguuuguuuuaagagauuuauuuauuauguauacagcauauaugccugcaggccagaagagggcaccagaucccauuacagauaguuguaagcuaccaugugguugcugggaauugaacucuggaccccuggaggagcagacaguacucuuauaaccucugagcgaucucuccagccugcuaguuuguuuuugagauagggucucacaguauagccuuuucuguccuggaacucacagagauuucucuuucugugccuaccaaauacuaagauuaaagguauacacugucauaccuagauuucaaugacuauuuaaugaauagaagauacuuacuuuucaauuaauuguuuuugauguuuaacuauuucuucugcugugcauaguagcauuugccucuuuaguucccagcccuugggaggcauaggcaaguggaucucugugagguccaugccagccuggucuacagagugaguucauguguuccuuuuuaagccauuucucaaagggaauagcaccugcuagagccuuaaccuugagucugauaugauuuucccuuuccugugccuuucauuauuauuuccuauuguccuagauuucuuauccaguaccaugagguaggugcaugccugugugcguguucccaguaauugaaaguaugaggcaaaugucaucucaucugacucuucccugcgccacccacccaccaccuccgcccccaccuucuccuuccacuaaagcuccagcagaccuggugccauccugaugagcuuggugcuuccaguacuuuugcuuuccugguggcagagauuuuggcauaggucaguuugcuuccaagauaagaauacauuauauauuuuuguuuucuuaucauuauuuaguacuagcuggugcuauccuuugucugcugaacuagucauaucaguaaaauucugucuaauaucuuuguuuaaauaccagcuuugggacuuggggcguacuucaguugguagggugccuggcuaacagugaagugaaggaguugguaucugguaccuagaaucagaugugaucacacacagcugggauccugcagcaguggcggccggagaucaggaguucaguaucauccuuggcugugcguucuaccacugccauccgugcuggcacaggcugguaaaacucugagaagaugacaguccuguuacacagaaaaagagaagaugaguuugauugucauagauugcugcuuuuaaaaaaaaucaauauccucaccugaauuaagaccaucagaacaaaugaguaaaauagauuuuucucauuccauuuaaagcaauuuuaacuucaaagaacauuaaugagaauccuguaagccaaaauuugaagagcgcuugugaugacaaauuccaacuacaacaucuggagggucccaccaguggagaugacgagucagggaugggaagguaagagacguccgucuguggcauccgagugacaucuuuguuacacugaacuccugucaacuuuccuccuaucccugagcuguggccaugacucagucagucaugugauuucuaugcaaacauggggcccugaguucagaucccuugaacccaucuaaaaguuaucuguaacuuugagcugggguuccuggggcagggacugagacaggcagauccugcgugcagugagcuuagauucagugagagaugggcauauagccauauagaaucccaacggguagacuuccucuagccuccaagugcaaccacaacgggcaccuacagccauauuuuaaaaaaaaaaaaaaugcaagaagcaguaacacaagccuauaauggcaacucuggggauacaaagacagaagcucuuuaucuuuaguucuguuggccagccuguuuauccaaauugguuagcuugaaagacacccugccucgaaaauaagguagagaugaaucaaguuggauucucaguguuggauugcgccuucuuccugcucccuuaugcagguaauguuucuccuguccugccuggguuuguuuuuuguuguuuuguuuagggguuauguugguugguugguugguugguugguugguuggagacagggucacccuagaugguguggaacuuucuguagaccaaccuggccucaaacuuggaguaguccuucuuccaccuucagaauacuagauguacacaauuacagacccuuagugacccuaggucacguuccuuugucgauuuggauauaggcuuuguuguguauguacaggccuaagcuacaacccgaaaaaagggaacuuagaucuaacuuugucuuugagguuagaauguaauguaacugaacuaaaacagaagccugcuaccugaugguagucuccgggcagaccuugcccugauugaauuuuuuaccucccuagaaaaagugugucucuuaauuuacucugggaaauauucaaaauaucauuccaggauauauauuuaaaucaccauugcuaaaaucuauacaaaaaaaucuauauuaaaaaaaaaaaaagacugucacguuaaaauucugaguucaggaauugggggaauguaccaucucagcuggcuuuuauuuucagaacuacuuaacaccuaucaggacagacagacaucuucagcacuccaagcaacgaaagaacucuuguuuucucaauugcuauugugucuguauaucccuuugggaauggugacagguugucgguaaucuaacaaugcucuuucccuugccuugcacuuaacagaggacaucucaaggcuaugguacuagcauugugauugugaccaaauaaauaaauaaauaaagucagcuuccuugggcacugaagcuguguuuaguaguaagcaucucauuggcauacugucaugaacacuccaaacacucgaggaacuacuuacuacacacauauauuauuaucuuuaagggaugugauaguggggauccgaagcaggccuucccaugugcuaggcaagugcuuuagcucugagauaugugcuuaccccuaagaguugacuuuugauuuuguuguuuuuaauuuauuuguguauguauuuggagacaggaucucagauagcccaggcuggcuuugaacuuaccauguagccaagggggucuuuggccuuuuccuugggagguagacucugagucaugugcuacuauuccugacuuuuauuuuauuuuguguaugugagugguuugcucaaauguaugucuguaucaugugcauccuggagcuggaauguuuauuggacagcugugaacuaccauguguuugcuaggacuuaacccagguccucuccaagaaggaaaaaaaugugcuguaaaguauuaagccauuucuccagcccagccucuuguuuuuggacaucuuaagggcagggaauaaaagugauacucuaaauucuuccaaaauuagguagaaauaaaguauagagaugucaacauggcucaguuuucuaucuccauaagaggccucacaugcauuuggacucaaggggaauauggaaucuaaauuaggaauaguggguauuuggcaaaaagaaaaaaaaugcugacauucuuuucaacagcuccaagaucagccucaggccucagggcuucagaccagcucugaggggcugucaugugucagcagcagcauguuaggcagcaugaauccaaggguuuuuuugcuggucauccccuauuucucugacagucagauguucuagucauacguuggcugcugagggggcgugaucaggccuuucuuuuguuuuuguuuuuugguugguugguugguugguugguuuugguuuuucgagacaggguuucucuguauagcccuggcuguccuggaacucacucuauagaccaggcuggcuuugaacucagaaauccaccugccucugccucugccucugccucugccucugccucugccucugccucugccucugccucugccucugccucugccuccagagugcugggauuaaaggcgugcgccaccacugccuggcugaucaggccuuucugagcugguagugaugguuuuccucuuucaucccucuccccaggccuuccccuuuuaaaucuccguuggcaggcaguaggggcucugcacauggcugcucuaggcaucuucaaaagagaaacucccccucucaggaggagcuccuccagccugcuggaucagaggcgucaucugagccacacaauucaacagggcagucuugccugccaaggcgagagcuagguaauacuccaucuuuuuuaauggaaagacuuuuuguuucacugucugcuguuguaguaggucuucaaaugcacuggcuuguggauguuuguuauccuaagguaagugcaccuuugaaaaauaacucgaguugcagucugaguagcaagucugaccacgguggguuagcaauaauugacuaugguagacucugucaucgacauguuuggcuucaucuguuagaaucuuaagacccagaauaaaguuaggagucuguccuuugucacauccuaaagugagcuaucuuuaauaaauauaaaugacugucuuuuaugcuucauaaaucacauaaaaugauauauuuuauuaauuguaaaucaguuuuuguuaguaaagaaaggcuuuaauuacucaucaaaaugcaugaucauaaaaacacuauuuggcaucagaugcagugucuggcugcguucuuaccucgcuuacuuuuuuguuuaagauguacuuacuuacuuuuaugcuguguauaugggaauuuugcccacgugugucugugcacugcauguguaccuggcgccuguugaggccagaggcggguguuuugaucagugacguuuuccuaaaucuacuguucuuaacaugcuuaguuagcaccuguuaagugaaaaauguaaugauuuuauuuaugauuuuaaccuucuguuccuuccucaugaaaaucuuguauauugacugcccccaaauuggacaauacaguaaauaagaguauuuaaaaucaccucuucuccuguccaguuaugaguaauaaaauauugcuauuuuggcuggucaugguggcccaugccuguuagugccaguaccugauuggcagaggcaggaggaucacugugaguuugaggccagccuggucuacacagugagcuccagggcacauaaugagacccucuaccaaaauaauaguaauaacaauacuaauuccuguuucuuuagauauuuuacucaguuuuauuuuuuuaaauauaguucuaaaauauaauacagcgggacaggucuguggucucaguagcugauguaggaggauugccucaccuacaguucaaggccacugucaucagugacacugcagacccuauuucaacuaaucaauucaaauuuaaaaaugguuuuaaacuuguuauguagcccagguaagccuugaacuugugauucuccugcuucagccuugaguagcugggguuauaggcccaugccaccaggccugacuacagacuauauuucugaacuggcaagauagcuuaucagauaagagcacuugucaccaaaucugauaacaggguagaaggagagagccaacccuuuacauauaaugccguauuauuccuuuuagauuuauuuauuucguguaugugggugcacugucccugucuucagacacaccagaagagggcaucggauccccauuacagaugguugugagccaccaugagguugcugggaauuaaacucgggaccuuuggaagagcagauggugcucuuaaccacugagccaccucuccagccuauauuauucuuuagagaaguuaugguaccaugcuuucacuacuguauuuucuucuucuuaacacaacuuaaugggucuuuuucuucacagaaacuagaaacuucaguucaacauuuucugccacuuaaguugaguuugucuuccuugcagaaggaaccccauaccugggaucuggaaucagccuuuucucuaguagagaccccgaaucugaguccccuaaagagccagcccacauuggcaccacaccagcuucaaccucugcacugaaaauaccccaaggucaaguugcuuuccggagugcagcugcugcuggugcugauaaagcagugguaggaauugugagcaagauaaagccggaauugacaucuucagaagaaagagcggauagagacauauccaugguggugucaggcuugacccccaaagaaguagugaguguguccucuguaccucucuaacuguggcuugacuuuggcugccagauaauuaguauaaguaguggcaauggauaaccuguaggaagaaaguuauuugaagaaauacuuggugaauacuaggcaccuugugagguaugauagagauuuugaauguauuggaauuuccuuuuuuuuuuuuccaaacaaaacaaacaaaaaacaauaacugaguaacuagguagagcagcucucuucaguaggcauugucuucccccucaguucacaucaaguaaacuugucugcauuucuccagggcuugucuuuaucuuggcugggaacagccugucuguccuuucugcccugcaauacuuacccccucgcuuacuagggcuugggcaccucgggcccuugugcaccuccagagauggaaauuguuuuauacucacuauaaacauuaagcccacugaacccauuuuucucuuuaagcugcuuauagauuuuaacaauucuggggaauuuauuucuccuauaguuaacuguuacgguaauauauaauaacaugucagaccaucgauuggauuuaauaguagaugccauuuauuacacacugagaggcaauauuaagcaauaaacucuuacuuaauagagccuucauaggcguggcuccauuccccauccuaacagcucuccagguagugugacucagcauagauucucgauggccccacguguuccgccauugaaaaggcaaggcaagcuuugcugcccucacagaugcaguauauccauacaagaugauaacuugauguugucacuucacagucccaugcuccagcagcaguuccucuggaaaaucuuacacguacuuguuugaauagcuccugguggacuuccuugcacacagagaauuccccuucauugaaaucuuuuuguuucuuuguuugguugguuugguuugguuuuuugguuuuucgagacagggauucucuguguagcccuggcuguccuggaacucacucuguagaccaggcuggccucgaacucagaaauccgccugccucugccuccagagugcugggauuaaaggugugcgccaccacugcccgcucauugaaaucuuuuauuaccuuaauccuuuguuuuugaguucagcucuuuagagauagcuagaguagucuaaucauuuucgccuugggcaauucugagcugcagauuaaacuauaagugcuuggguacauguuuucuuuaaacaagcaaagaagaaaacuuugagcucuauucagacuugcugaaguguguuaaauuuaugaugaaagccacugacuauauuacacaugauuaauucugaagcccauauuaagaugaucuuuucagcaguugccugucuaacugaacccuguuuuaaagcugggauuucagcaauuaaccaguucagaauugcuaaugacacuggcagagggcaacagcaaaaguuggaggaggguagcauuggcuucgccagccugcuguucuucagugcucaguggcaguguggagugaggcagcacgggcuggcuuccauugcaguacuaaggggcgcauaaaucuuggcguggguggggaaggcuaggaaaugaagcuucuugguaagcaagcuuauuuaccaaacaguagcuaccaguuauuuccacugugcccauaauagauaugguuaauuucuuuuacugccuauugauuuuuauuugcuugauagauaauagcuaagggacucuagauuucuuuuggaaagaaugagucucuuccaauauuuuuccuuaagagagaauugauauuuuuuguacugaaucuacaaauaccuuugcuugagugcuuuguaacuaucagaguugaaucuugacuuuaagcuauguauuaucuacaacagaacuuucuauauaaggcugguuacaacucaguuugagauguagacuuauaaauuuauuagaguauaguaggcugucauucuguaaagaaacucaagagaaucaggcuauaugaucuuugguuauaauuccauggcuucuuguacuauauagaacuacauuagaaaguuucucugacuuauacaugguuuuggggguuuuguuuguuugaaggcgaggcauuguuuacuugugugagacaagaucucacuauguaguccuggcuggacuagaacucaguauguagacuaggauggccuugaacucauggaucugccugccucugacucucaaguaccaugccugacugauuuacacauauugucaauuuuuuuagacuucaggcauguuuuauguuuaaaagccaggaugggguaagccugccaaccuggguucaauccccaaaaugcaaaugaaaauggaaggagagaagcuauucuacaauccuguccuuugacgccuacacagacacgcugaagaacaagcacacacaaucaacauuuaaacaguuuuaagagaugugccuuuuaugagaauggagacucaaaaucagaguaauuauuacuuuaagcuguguagcagaauuaacagcauaauucaguguuugauuuuuguuucagaugaccgugcaaaaguuugcugaaaaauaccgccucacuuuaacugacgcaauuacugaggagacuacacauguaauuauaaaaacagguacacuacaaacuuuuacaggcuacgcuguauuuacaucauaagcuauaugaagagcuaugucaaucaaguuaagcaucccuaacccaaaaguucaaaauccucaacuauuugaauguagacagcaucggaaacggagaacuccacuucucgugggauaguucauaggcaggaugugggcaugggcagcacguguguaccguugccuucaggugugcagaugaagcugaggggaagggugccacuuaauugacaugcagaaggcccuggauccgcaguucucaccuguggguccugacccuuuggugagguugaacaacccuuucauggaggucaccuaagaacgugugaaaaugcaggugcuuauauuaugauucauaacgguagcaagauuacaguuaugaagaacaguuaugguuggggggacucaacacaaugugaagaacuauauuaaaagguugcagcauuaggaaguugaggaccacugcucuagguacuaucucuagcaccauaaguaagaaaugacccucagauuggccguggagacucacaccugugaucucaacguucaggagacugaagcaggaaaucauaaguuuaaggccagccuaggcugugaagcaagacuuugucucaaaaaauaaaugaagcaacagcaacaaaauuuggauuugugcuaugcauggaagaugucucaauauauaugcaauuuugcuaaaaaaaaaauacuuuugggccuagcauuccagaguccuuagccuaucuuuguuuaagcaagccauggaugaaguuuccugauagucauucauugcuuuauaaagguggccauuuuguuugaccuacuaauuuggguuaaaauuuggggaguggccaggcaaagugcugaaccacuuccugucuaccugcuuggaguucagugcauauagaacagaccaaaucauggaagagcaagugaggcagagaagaaguaagucuucucucgaacucuggagacuagcuagcuacauguggccucuggcuugaguguggcugaguaaguccucuaaccuuaauguggaaaggggaaagagugagccacucacuugugugcuuucuccucguuuagucuuaauugugcuuguauaagauagcucugggagcuuucacugacuguguaaagucugagugaacagcagacauugcaggcugcuucccugcauuaacacagccugauaacguggagcaggugaagccuuugaauauuguggagugauagucuaggugauauccgcugugcugagcgcagugcuuuucauaguggcaacuaaugagcucagagagcauugaaggacagauggagaaaagaacucaguguaguuccagggcucgagcaauggcucaguggacccagguuugacccucagcacccacauggcagcucacagccaucuauaacucuugugcugggggauccagggugccugcgacuuuaggcaccaggccugcaugagacauguagacauacaugcaagcaaaacauacauaaaguaaauauaaaacaauugauuuuuauuaaaagugauguuugacaaaguaaaggaaugagacugaaggggccaagauauccaucuuuaagcagcugaaaaauuauugucaggcuucagaaauuuaaaaacaagccacuauuccuggggauguaggaaguauaaauuauggcuacacucuaaaaccuggcuaacagacucuguuuucugguguacucgugccccaucugggguauuucuccccacagggcucuaggcuuuuccaaggggcccaaggcucuuugacucuuugccuuaagaaagcuaaaaucuaggucccuucuucaguggaucguaccagggggcagugcucauuacaauaggugccaggacaagcuguggcaagcuaaguacuauugaagaggggaaugucguugaauuuucauacauuuuaagcagcaaguuuggaugaaaggugauaaaggcugaaaagggagcuuuaaaauacaaauuaaaccuaaaguaacucuuuaaacucaaaagcaauacaacauuuguugcuugugaacuaaaaucggcuuuuauagcauuuaaacaaaaagcuuccaaaaaaauaugaguaauucugugaggcaaaauggccacuucuacuugcagauggccugcugugcuugggauucaguugaauacuuuucuccuguuuaaaugguuuuuuucuguuugcuuaguucuucaaaggggccuuugaaacacuaggcaauaaacagauucuucagccacugcuuauugaaauacaaaaaagggauagcuauaacaagacuuuuccugaaccucucaggaauacaggggguaaggguccccugggagaaauugccugggugaacuucuuucacgucggcauuucugauuuaggaucuuuuuuucaaauguuggacuucagcacuauuuucuucucucacauauugcugucugguaaaauagaucucaguccauaucagucagcacuacagcauggguaaucaacgggaucgaacucuucagcuaaccuuggcaucucaaagcugagccagugauccucuggucuuaacauggcgucugcuucuuccaaacuuguaaaccccacaccugguugucugucaucagaggugaaucaccauuccagacugaucucgagcuagggcuggggcuccagcucuucaggggcagcgccucuuauucgcucuuccucagccuuuggguguuuuucauuuuugcagaugcggaguuugugugugagcggacacugaaauauuuucugggcauugcaggaggaaaguggauaguuagcuauucaugugaguacaauauuggggggugggggcgugucucugcugcucccucuagcaccucagagcugcauuuuacaccuaacauuaacacgugagguuucugcugaugccaagucugagcaccaaagggucucuagugguaucacaaaacuagcuuugucucuaggugcgugucgcuuuguucagauccacuggcauugcugagaaagugauuucuuucauaaccaguagggccugaucuucucugagcagagcuagcauaugaacaaggauucauuuaauagucggugggaacccaugcacagcagcacuuuuauaauguuuacacuagguagcagcugucuccagagggaggucucugccacgagccuugugaaucgcugagcuucccaccuccacagaagggacguguuguucuguucucugugacuuaccuucucuguauucucuucaggggugguccggucuauccaagaaagaagacuucugaaugugguggguaccugauacgaacugaucugggacaccucgcaugggucagguggggugucaggcggaggagggugugggucugcuuucuuccucaacaagggagugaugcagaacaggccaggaaaugucauauucucaggcauucuagguuuuaaaggaaagucuuuucuucggagaaagaauuuuacagauuaaaaauucggaggaacaaauaaugaaccaccuccagaaacagauggggugaugcaccucugugacccuggcauguagcaagagccugucuuuggguugauugguuugguuuguuuuguuguuguuuguuuguuuguuuguuuguuuugauacaaaguuucucuguguagcccuggcuguccuggaacucacucuguagaccaggcuggccucgaaaucagaaauccaccugccucagcuucccguacugggauuacagcuugcaccugguuuaagagccugccuuccucucucucucucucucucucucucucucucucucucucucucucucucucccuuccuuccuuccuuccuuccuuccuuccuuccuuccuuccuuccuuucuuucuaucagaaacaggguccacaguaauauaaaugauaauuauuaucauuguuacuguuauuauuugaguuucauguaucucagaauggcuuagaacuccugcuccuccuguaucugucucccgagugcugggauuguaagauuauagguagguuccacccugcuaagcuucuccugacuccuuuguacaccuuuguaggaaacuugcuauucaccauuguuaaagacuuuggguagggauguggcuugguuuaugcuugucuuugaggcccuggguuugagcuguaguaccucacaaauguguguuacaaaagcuuguuauuuaggcccugaggcagugggagcugcagugggagaaggucauuaauccugaaacuauauggguucaaagccaacauaagcugcuugagacccugucucagaaaauaaugaauaugcuaauaugcuaauauaucuguuuauaaguuaguuuccuuccuagaaacgcugcuuuuucuaauacuaagaagagugugagguacaucugguaagcacguaggaggaagaauaaguuuagaacagccgagagcugaugacaagagaucacacaaaacaaacucaguggaaucuguuuaaaacuguauuaugcacuauccugauuuuaauuucacauaaggaccauuuauugggagccugcuaagugucaguuaugaggaauaacaguaaacaagaauggccaauucccuguucuggaaaugauguauggagagauaaacaauaaacaagaggccaagcgaagucuuuuguuauuugugaccuaaauaacaagaaagaauugucuuugaaaaauauagagaaugguucuuauagguaacaacagaaagcauaaagauuuggauguaggagugaguuuggcuuacuaaagaaaaaucuagcugggcagugguggugcacgccuuuaaucccagcacuugggaggcagaggcaggcagauuucugaguucgaggccagccuggucuacaaagugaguuccaggacagccaggacuauacagagaaacccugucucaaaaaaaacaucguaguugaagacggggaauuaguuuagggagggaccagaggugagaugaggggaaggagucagccaaaggccaaggcaguucagauuuuguguuaaccacagucauaauuucaguuuuauuuuuaggauaaucuggagcauggauauagucucuauuuugggguucguuugaguuuuuaguguggggaaggugugugacuugacacguguggaggucagaggacaacuuguaagcaccagauguugguucucuucuaccgcguggaggcuggcaucaaagucagcaaagaucaaacuugcugucaaauuuggcagcaagagcuuugcccacugaaugcgguaccucuacccugugcuugguuccugcuccucaaacacuuacagccuuaguuucagucccaguggcuuucaagcauucuuccugaaaacuuccaccucccaaaauaguuacuaugaaaaaaaaaaucugaguuucuuuagaauaggguguaugggugugugcgugcacgugcgcgcaucagagacaacuuuguagacccuccuaccuuuauauggcucugugguggacucugguuaucaggcuucauggcgggcaccuuuaccuacugagccaucccaccagccccaucuuaucauugugaccucucuaacuguaaaucucucaacagaacucugaaaaacccuaauuucuucagaugacaaaauacaguugauuuaagugaccaagaauccuccaguuauccucucacaauguuagcaguuuaauguaaaugcuaagugaauguuuugagaagauacaaauguuagaaauuaaaaugcauuuuuaaaaagucaagucccuaaucccagcacucgggaggcagaggcaggugaauuucugaguuugaggccagccuggucuacaaagugaguuccagggcuguacagagaaacccugucucaaaaacaaaacaaaaaaaaaacaaaaacaaaaaaaaucaagucccagugggaugaaagccaacugguaauuucaacaaagauucucuuuggggauguugggauagcuuagacgaagguaccagcugcccugaccauuggaaugcagaccucaggacccacguggagaugaagagagccaaccucagcaaauuguucucuuaacuucuacaugugcgccacacaauaaauaaauaaaaugguugcuguaauaaauugacuuuagcagcugagaucccaguugucuuagucaggguuucuauuccugcacaaacaucaugaccaagaagcaguuggggaggaaaggauuuauucagcuuacacuuccacauugcuguucauuaccgaggaagucaggacuggaacucaagcaggucagaaagcaggagcugaugcagaggccauggagggauguuccuuacuggcuugcuuccccugccuugcucagccugcucucuuauagagccaagacuaccagcccauagauggucccacccacaaggggccuuucccccuugaucacuaauugagaaaaugccuuacaguuguaucucauggaggcauuuccccaacugaagcuccugucucugugauaacuccagcugggucaaguugacacaaaaccugccaguacaccggucauuaccucuaguucacaaaguaauuuccuuacuuuuggucaaaacuugugauucugaauaccuaaaguagauuugcuggcuuuacuucagaugaacguuggcgcucgcgcucucucucucucucauuauuugaaugaucuuuuuguguauguauacauggguguuuugccugcaugcaugucugugugaagaugauggauucccuggaacuggacacagcucacagacaguuacaagcugccaugugggugcugggaauugaaccuggguccucuggaagagcacucaguaguaguuaagugcacuugcuaaucugucaaggaaccaggguuuuauuccagcagccucauggguucucacagcuaauuuuuaacuccagguccaagacauauauauauaugguacauauaacauacauuuaggcaaaauacucauacauaaaauaaaaagaaugaauguuuaaaauauauuuucuaagauagggucuuaccuggguuugguggcaugucucuuuaaucucagcucuugggagaaggcagagucaggcagauuucugcaucccaggccagccaggcuccacggucuugucuccaaaaaauaacaaagacaagguuucauuauguaaugcuggcuggccuggacaugaguguagugccuuaaugcuucguggcugggccgucacccaccccaguaaucacagagguuuguguuugguuucagcaugaauuugaagucaaaggagauguugugacuggaagaaaucaccaagguccaaggcgauccagagaaucccgggaaaagguaaagucccucuuuaugugacagaaccccagccuaaggcucugcagccagcugcuauggugagguuagucuuuaccugguaggcacuuggcaugauugcuaucagaccacuggcugggcaguggagacagguuauuguuuuguuuuguuuccuagcccaagaaggcaaauggaguacuugugugccccauaagaaagagaacauuaggcugagggugcaguuguaguuuggguuccagucugagguuuagauccuagcugauggugacagagcuuggaccucagagaugggaagccuuuuguguuuccugcaccacggugucuuuucucuaagcaucacaugagugcuggaugagcagugugugcacagaaagugguuuauaguccacaguuuuacaacacugugauaugugugcauuaccucuauuucacaugagaaaauugagggcggguagcuuaaguuccccaucaucacauaacuagggagcgguagaagggggagagccuguacaccugcacuccaagucuaaauucacaagugucuuggcuuuagaaaguuguagacagcuucacaggagcaaaacagauucucccugcaacuuugcaaguaagagcaggacacucgaugacuuuccccagcguguuauagcagauggugcagccggaacuccaucuuccucgcaggaagaagucuucccaagauuucgcaccugccuggcaggccugagccagcugccgucucgguuacuggauaagugcuuguguucccaggcugcuuuucuuuuucaagugugcaccagcagguguuucagaacagucccacacggagggagcaccuucuguuccuucauagaaacuugagaggagaccaguagagguuguuuuucuaaggagaacugcucuggacaggaucacaaaucaagccuggaguucugagcccugggaucagcccauccucucucugagccuaucagaucccuguuccagaugccaagaacagcuguucacccugcuuccacuucuccuuguuucuaugagccgacccuuuguuccuauguaccugggagugcacaauuagcagugggucccuucucccucaagaucccuuaggauuucucucacauucaaaauagcacugauggaaauugcuugggcgaaguagugacauucagaagauacuaaaaugucacuacaguauuuucacaaagaaaucuauuuguagaggugagcuucagauuucuuaucucaccacuagacacugucaucaguaagcgucaaccuggauaugaagagccuucucaaggcagcguuuggcugccugagggaacuugucgcauuucugagcauuagguccugucagcacguuggggaucuguuuuauucguacagauugggagaacagcagagguuccugaacugccguucccaacaauaacugauuugcccgcugcuccuuucuccugccugcaguguaggaugaagccacuuccaauggagcuaucugugugcuuuuagccccuugaucuucucucucagccucugugccuaggugauuuuuagaccuagacaaauuuuguguuagugucauuaaaggguagaaagauggucaaaaaaaaaaagggucacucaaaugauauaugaaaguccuaggucugauggcacuccugugauacuaacacucaaggcuaaagcaggaagaaugauagcuugaaagccuuucaagaauucaugcccauguacacauaagaauuuauuuuucuuucuuucuuccuuuuuuuuguuuuuucuuucguucuuuuugaauucauacuaacacaguuguuacuagacacauugaagcuguucuaaguuucaucaaaaaaaaagaguucaaagcagauauuguguuuccugcauucaggaguuggaggcagguguauaguuuuuucaauaugguacaguggcacaugcuugcccugugccagccuuagcaucugugaaguccugccucuaaauaaaccagcuccuuaacagguggugguaguggugcacaccuuuaaucccaccacucgggaaggaaacaggcucacagaccucugcuaguuauaggauagccaaggcuacacgaagaaacccugucugggggagggucggaguacgguggggugggguggaagugcaaugaggaagacagccccucauccccacuguacauggugccacacaccguuaaucccaguaugacagacagacagauggaucucuacauuccaaguccaccuuuguguacauaaagaguuccaggcuaccaggaccauagugagaucuuuucucaaaaaauaaaaauaacugaaaauuuagaaguucaggcuugggcauaguaguacacaccuuuaaucucaguacucagaugacagaguuuggaucucugaguuggagaacagugagggcuacuauacauaccgagaaacccuuucuugaaaaaaaauuuuuuugacucaagagauggcucagugguuaguagcacugacuucucuuccagaggacccagguucaaauccuagcccccacauggcagcucauaacuuucuauaacucgaagaucugauacucucacauaaagacguucaugcaggcaaaacacaauacacauaacauaaagguaaauaauaaauuaaggcaggggccgggcggugguggcgcacaccuuuaauccccgcagaggcagaggcagguggauuucucaguucaagaccagccuggucuacaaagugaguuguagcuauagccaggacuacacagagaaacccugucucaaaaaaaaaaaaaucaaaauuaauuaauuaaaauaaauuaaucaagggagaguacagagauggcucagcaauugagagcaccgacaagucuuguagagguccugaguucaauccccagcacccacauagugacucacaacccucuauauugggaucugaugcccuuucuucugaugugcacaaagauagcacaccauauacauaaaauuaauaaaaauauuuuuuuuaaagaaaagggaaguuaagaaguacaguuucucgcucacaccguauuucagauguucaacaaccacaugugacuuguagccuccagccuuaggagaccagacacaggacauuuccaggaucacagaaaguucuucaggcagcacugaggagcacuguaauuacauuuuucccuuaggagggugcaugcucuguguguaaagcgagcauguucacauagcaggcgcucugcuggcgggguucacauuuacuucugacguaacaagccugagugggccucucacuucagccagagagcucugcauuucuugcuguuaaacauaaaggaccggggggauuguguguucguugucucuacuuuuguuuuccucaucucugaccagagucaccagcaugagccugggccggacuaauaacaaggugggaagugaaugacuacagaggccagagauaugacucagaggccuuggcaccuggaaaucugacuacuccuggccuccacuggcacuugacauauaugacauacaugcuuuuuuuuuuaaugacucuagaauguagauugauugaaugcaaauuucaauaaaauauaaaaucaguucagaaucuugaacugauugucucugggaaagaggacaaacugucaagugauagucucuuccauugugcauggagagugucuguauuucuuauaaaaacccacacucugguggugcuauucccagcauuuguuagauggaagcagaagggucagggauucaaggccagccuacauugcauuauaaguuuugaggccacuuggccuauguaagaucuugucucacaaaaaggggagacuggagggguagcucauugguuagugcuugcugcucauucagaagaccugauuuugauucccagcauccacauugaccaauucacaacugccaguaaccucagcuccagaagauguggugcauucuucauucuuccagccuccuuagacaccugcauaccacgugcuuuaucuucucuuuucuuguucucucucucugucucacacacacacacuuaaaaauuauaacuggggggcuggugagauggcucaguggguaagagcacccgacugcucuuccaaaggucaggaguucaaaucccagcaaccacaugguggcucacaaccacccgaucacgagaucugacucccucuucuggggugucugaaauaaauaguaaaaauaaauaaauaguaaauaaauaaauaaauaaaucuuaaaaaaaaauuauaacuguuucucuccaccccaucacuuacucuccucucuuugcagcucuucaagggccuacaggucuauuguugugagcccuucaccaacaugcccaaagguaaggcccugggagucugcagcguauuacagauagcauugaccuacauggaaguuccucggguggauuaaaugguccaguggaagacugcugugguucugggcuuauguaucaaaggcccuuguccuuguauagauuugguuaguuccuuucaaagggaaggucccucaucuuuuuucucugcuucccuucaccuccuggggcuggaguuguaugacuuaggagagggaagccuaggagcagugguucucauauuuauuuccucaugcuuuggugaccuucccucccaaccauaaaauuauuucgcugcuacuucauaacugauuuugcuaguguuaugagucauaauguaaauauccaauaugcaggauauuugauguaggaaaacccccccuccaagaggucgugacccacagguugagaaccacugcauuggugucuggccacagcaaggggcccuagcagugucacuuuguuuccuucuguacugguuacugauugcaguuuuagaaggucucaagugucacucaauguuuuauguguuuagacuuuaauauaaugaaagccagggacgcuagugaguauccugcgggagggguuaaguuaguagccucgguucaggcagcgccuccacaguucccgggaaugagcagauguuccuucaagaacaguaggaggaugcuuugagcaucuccaaagaagccuagaagguugcucagucagugcugcugaugcugaggcccaacuuccuaugagauucauccccuagauguguggauccuggcucacaugugaucuuuccuaaugacacgcuggaucucuggccagggugaccuguaucuuuuucccacuggauaaaauaucuuccagucuuugacauuuagaguaauuaccaugaagaaaggugcucucaagggccaugauugucaguucccaacagcaaacuaggauguagcggcaaaggaaaaagacuggguuuuucacauagugucuaacaauuuagcaaauuuuuggaaauucaguccucuuuuucaacauguuucauuuggaagaccaugaggccuuccuuaucuaccacauggcuucauggagacuaauaaccaaaaguaggcagcagcuacaucagcggcagauugacuuagaagucauacugauuuuaggguuuuucuauccuuaaauuaaaaaaaaaaaaaaaaaaaaaaaaaacagcucacugagguucgcuucaggggaggcuguagagggcacugggaguagaugugggucgcuauugugauuuuacaucugugcugugcagaugagcuggagaggaugcugcagcuguguggggcuuccguggugaaggagcuuccaucgcucacccaugacacagugaguaucacaguggggccuuaaggagaggaaaacacucuccuuccauuaaacaagucccccaaaguagcccaaagggcuuucucuacccuugacacuguagcagaagacugucugugaguaaaagcuuagaaacuguaagcauugaauguaucgagggaggucuuuuccuucuagcccuuuuaaccacguaaaaguggacaugacuuucccagaagcccugcuuuggcacuaaaugcuuuuuccuuucuggguaugcagggugcucaucuaguugugaucgugcagccaagcgccuggacagaagacagcaacugcccagguaaaguuucuccauguacuguacacuuacaucaugugagguccuguuggauggguuugauucccuacuaguuaguuaucugguuauuaccugacugauauaauucucagcugcuuuuuuuguuugggguuuuuguuuguuuguuuuuuuuuuuuccuuuuuuuaaauuuuuuuuuaauuuauuauuuauuauaucuuaaguacacuguagcugacuucagacacaccagaagagggcaucagaucucauuacaggugguugugagccaccaugugguugcugggauuugaacucaggaccuucagaagagcagucagugcucuuaaccgcugagccaucucuccagccccuguuugggguuuuuuguuugguugguuguuuuguugguuuugguuugguuugauuuuaagacaaggucaugucuuagaacgcagagauccaccagccucugcuuccugaguacugggauugaaaguguugucaccaugaguggccuguuuguugucuuggguuuugguuggccugcuauguaaugcauccuggucucaaauauuuggugaucuuucugccucagccuugaaagugcugagauuauaggggugccccaacugcacucaauguuuuuauaggguuuguuuuguugauugauuguuuugagguuuugguuuuucugagacaggguuucucuguguagcccugacuguccuggaacucacuuuguagaccaggcuggccucaaacugauucaucugccucuucccccugauugcugggaucaaaggcgugugcuaccacuacccagcuuucagccuauuuuuaauguuugcaugaaugaacaacuaaaaugucuauuaaaagaucuuuaugagccgggcgugguggcgcaugccuuuaaucccagcacucgggaggcagaggcagguggauuucugaguucgaggccagccuggucuacaaagugaguuccaggacagucagagaaacccugucucaaaaaaaaaaaaaaaaaaaaaaaaaaagaucuuuaugauggggcuggagaaauggcucaguggucaagagcacuggcugcucuucagggguccuggguucaauucccagcaaccacaugguggcucacaacugucuuauaacuccaagaucugacacucauacagacauacaugcaggcaaaacaccaaugcauguaaaauaaaaauaaguaaauuuaaaagaggaggcaggcuggagagauggguccaugguuaauagcauuagccgcucuuccagaggaccgggguuuaauuuccagcuacuauauagcaacucacaacugucuguaauucuaguuccagggauccaaugcccugaaacagacauacauacagacaaaacacugauguacauaaaauggguaaauaaauuuuuuuaaaaaaggaaagaaaaagaaaaucuucaguauguguguacaugccuguuuguuuacuuuuaaguguauauuuguagaaguuaaaaguacuguaugagaccagaugugcugguacacacuguuaaccucagcauuugggagaauaguuggaucucugccagcuuaaguaccgucugcucuacaggucaaguucaaggucuaccagagcuauaaaguaauacacgcuuggauguguguacauacauguacauuuacacacaagugaucguguuuaugauauuuugucuuuucacuuaagauauuccuccacaccaucugcucucucguggcuuuuccuaaaacagguugaaguucguauuauuucagucugggcuuuuaccacgcucacuccuuuggcuuuugaauaagguccuaauguguuguuucugaguaccugcuuagcccuaagaacuuauauacucagaucuuagaaugguaugguuggagucucgucuagaaggaugacuuacaccagucucugcuuguuucugucugcagauauugggcagcugugcaaggcacgucuugugaugugggacuggguguuggacagucuauccagcuaccggugucgggaucuggaugccuaccugguacagaauaucaccugugacaguagugagccacaagacuccaaugauuaauuuaagaaauggucuuccaugcccggggagcaccucucagucuuuggugcuuccacacccuacuuacuaaguauuuuucaugcauccgccuggaaaaaccagcuucuaccuaugugagggugggugccuuaaagguuuucuaaccaagucccccuuugaagucugucuugaacacaaaaaguuuucaccugagaaagcuuuaucccaccaauugagcaagaugcuaaucuguugcauaucguucuuggagagacaguagaguggcuuggcugaucugagcugggcauggugguacuugccuauaaucacagcauuugguggaaagagaugggcaugucgugaguuguauaugacugaagaacaaauagcuagugguccugauuuguuccuuauaaaauugcauguucauaaaggccaagagucaaguccuucaaggagauggcuugagaucugugguuugacuuaaaaucagugcuccucaaggcuccagguuuaguagccagcaccaaacaacacccagaauaggguuugugcaggacacugaggaaauucagagccagauuauguauuugaugugaaugugagguuuuucaagugccagugucaaggagagccuucuaauuccccauagcuuaugagcaguguaucuguuguagcagcucuaaguaacccauucuucuuuaaauacacggacucugauaugaauauuucaugucuguacaaugauggauuccaccaggaaaggaguuguugcuuucuuugaaguaauuucuucccuuuugcucccuguugcugaggcauacuacuucauaaauaauuuugcuugcugaaggaagagaacauauuuuucaugaacucauaaucuuggacuguuuauagauauuggggggaguaggucuucucuggccccccccaguaugcaagggcaauggagaccugauuauauaaaguauguuuauaaaugcugugcuguuaauacugcaaauaaacuaaauagcaaacau

SEQ ID NO: 12195 - RNA, 15570 nt, Mus musculus
agaaacaaccggagaagcagaggcuuuauuaaggucuggcauaagaggcaaagguggaauuaggccuggguaggccuagggcagagagccaucccuacucuuccacccaacccccccccccagcugccgcccacaugcuccugccucccagagcacagcaccaagaacacaggaccccccuguucagggcagaacccaggcagaacuuugucucccaugggggguugggagaggggagacacaggguguucugagaauccccuuggcccuguugccauaauaaacaagggaagucccuguauguccccagaauagaacacuggaucucuguggugggggugaggaacuuggccucugagcaagaccuaggcagaggccaagcugaacugaagguacaggugagccacagcgaacuucggcuacugccuuuagauuuggccugccuccacugucuuucccgcagacucugguuagcagcugagucuggccaggaguaucagaugggauaguggagcucugaccccagagacuucuacaggcaucagaaagagggccuucaccaauaccaaaucaguugauauauacacugagcaaccccaccaugucaaggggaagccacuggugccuaguaagaauauccaccucuguggccgaagggcggagcggggccagugaguucugggagguaggcaggacucucauccaagugggacaaagggacuguguccuccucacugacuggccggucaaacucagccuucagagcuggacguugauuaucugggaaggccagagagaacagggccuccggcucgcacacaaacuuguacacguagcguucgccagccaccuguggagagaggguugucaggccagacacgaacgcucugccucaguagagaauuuggagacuuuccccuucucaugggccacaaauaugcacuaggaccucuuugccucuuacacugguucuucuugaaacccacucccuucugguucuuguucacgucucaucucaaucauagcacacuugggacuauucauucauugucuagcaacuuuacaggggaaccuagggguuuacauuuucuguucucgaaaaccugcugagaaugcccgccuccccccccccccacacacacaccccaccugaccuucucuugacacacuuugaacccuuagccaccccuggccccuccuuguggccgugcuaggaccucagcccaaccuucugcaugaugccuuucucauaauaguaucgcagcgagcggcucagcuugucauaauucauggcuggccgguucuucuggauaccccagagccuggcaaccugggggacaagagacaaaaggauuuggguggagaugcaaucucagaggaaaaauagcaggggugggguggggagugggacauuugagguucuuggugcggggacaaucuaggcuagucaccagcacaaugcugacucuggcuuggcaagaacugggucaggcagacugaggacagugguggaagcaagugccaccauuucuccucucagggcuccaaaggugccggacaggaggggugggaauacguaagaccuaccucuucagguucaauuaguuuaaacuccauuccccggccuguccaagcaaugaaaugagcauuuguugggucauccagcagggccaccagaaacugccacaguuguaaggcaccccggcgcugguaggguggccccucccggaaagcuccaaucccuuccugcuugaugucuccugggaaaguggaaauaggugugauguacauaugcccuaaccaacucccccacccacccauguggcuuccccaaacucuuccccgaguguccugacuucuuccacuaaugaaaugggauuccuacaggacccaguaugugacaggagugaagaagacccugacccuccuaccaagucacuucucugaccuucaaauuuuucagggacaaugcagacaucaucugggaauggucgaagggauuuuucauagccauaaccuuguggaggaaagauggggauugcucagaucugaggguucacuguugaaaacccuagagaaugcagagagacucguagccugggugacucuuucccccauagcuaggauccugcugccuuacccaucacuccaucaccuggagaggguccagagaagcccucuggguggagguacauugaugcacauccagggacaucugggggagggaagaaaaggugacauuguaaguggcugaggugaagcaggggaggaaggccuguacacauucaaggaguuggugcugcuagccugcaauccagugaccauccuuuucccgccacuaaaucccaggggaaguucacccagagggagcugcaagcugaggcccucaguuugagggcaggggcagaggguauggguggcagcagcuggggccaggcaggcuguucucaaggcccaagauuccagggagcagcuguuuuccugugaguucaggggaaggagggggugagagaugaaucuccggggguugggaaggguuugccuaagacuuccucggaaugggcacauguccggucgucaggucagguuccaagccuaguaccuccaugccuuugugugugugugugagacagagagagagagagagaaagagagagaagaguugggguggaggugggggauguaucuauuuaaagaagaggcagugggcucuggucuguuuuuuuccucagguauaagcagguucuacuguguuccacgccauagaacugaaaccucccagcuccacuuaggaaagccacgcuucacguuccaacccuuucccgcccccuccacucccaccuaugaaugagccgcugacacccgacaccucucgggggaggaggcaggagggaggguucauucauuccuccauuuugugaauggaauucuugacuccauucaggaaagcggagggaggaggggcaagaguucaagggcaaguaacccgauccccuccggauccccuccggucuccagccuuugaaggucagcagcccugcgcaccucccuccuccagcccccaccaggcucgaaagggaagcacucguccuguucguccgcuuuccccggagugacuagggauuuguagauaagcccccuaugcuaaaauacugugggcaucgggaaaagaaaaaaucuaaaauuccagccaaccucugcagcuacuguucuguugucuaucuuucuaucuauuuaucuaucuaucuaucuaucuaucuaucuaucgacaaggucucacucuguaguucaggcuggccugaaaacucauuaugucgccuaguuuaaauuccuagccauccaccugccccuagccuccugaauacugcagcuuuuuuuuuuuuacacuagacaccaccacuccuugaugcugaugaccacuguaccuccacuucccacauugcauggguaccgcucccucauauuuugaaaucacuguggagacaaggacuagugaccgucucauguuuuuuuuuuuuacccuccaagagcauauacccuuguuccagucacuguacucuggucuuaggggguuaauuaaaacccucaaacuuaugaccgaaguaaauacccaaccuuuauuauugucaggagcuauuagggcaaggucuauaauacccugucaucuuauuugaaugcuggcuggaaaacgaucauucuuuagaauaauuuaaaaaaaaaaaaaaaguauggaccauggaaagacacaaaccuucuaggaaucuuugcuuaacuucccugcucacuggaguacuggccaccccaccuggcaaucccagaaaaacccuuccgagcccaacacccccagcccagcccaagagucucuuaccugagucguaggcgaagucugugcgcuccuguuugaucaccacccccgccccuggguaccugugcccacugaccccacccuggcuugaagcgggcuggccagccuguucguacagggggucaugguacuccugcuugaaguucugcuggggguagggugggcagggcuccgacaguugguguugauagggggcugggagagguucccggcccccucccugaggagaugugaaggaguggcacauguccacgggcugcuggaagacggagcuggaggucauggaugaggaaggaagaaaagagaaucuuccauuagcccccuugagccugucaccuguugacagggcucuggagggacaaugagacaccaucuccugguucucccagccaggucucuauagagaacuaaggaacugagcccagacugccuggcgaggcccgggucccccggugcuucagaucugucuccuuaccugugcucaccaagguacccguggccagggugggacugggaagagcuggaggcucucaggaggcucugcugcuguucugcccuggaaaagggcugcaggggcgacuguccaggggcaccgggggcgggggacuugauggcgauuugucugggggagucauaggcacuggaguugagggggagauggggaugaggggggcagagaagcuaggugaccaucuuuguaccuuucauaccccaggaagugauuauugccacugcaguggaggggccggggaauuguuuguuugguuuuuguuuuuuauuuauuuuuuuuuguuuuuguuuuugguuuuucgagacaggguuucucuguauagcccuggcuguccuggaacucacucuguagaccaggcuggccucgaacucagagauccaccugccucugccucccgagugcuggaauuuguuuuuguuuuuuuuauauaggguuucucugcaagcccugguuguccuggaacuuuaucugcaauccaggcuggccuugaacucagagauccaccugccucugcuuccugagggcuaggaauuuuuuucuuuuuaaauggugucucauggagccuaggguggccucagacccuccacguguggccaacaauaaucucaaaacuccuguuuuucacuucacagcugcugagauuacaugcaaguaaccacccugacggguuugugugguuuugacaaucaucuccagggcuuugucuguuaggcaagcacucuaucaauuuaacuacauuuccagggcccaggugaauucuuuuauuuucuccccaaaagagucuugcucuggaacucagcuucaccuggaacucuuucgggagcuacgguugaccucaaacucacagugccucuuucucaaggucacaccacccaccauaccuaagugauggguauccucucuuaaugcuggaacuggaccucucugcuugacaaucucucuccgaagcccaaagcaacugguuuaaguagggcgugggccuccagguagagacucacugggcucuugaggccauucugcccacugugugaugucuccugcuuauacucagaggaauccuugcuagugcuaccuacaggagcuaggaaaccccguuauccaacccucaccucuacaggugccucagcucaugggugcccucuccuaccccacaucucaacagagccuucgacuccugacacccuccugggcuggggcucaccuggaguaaaggcacugcucuccauggugguaggggagugguggcuuccugcugcaggacagggcggggucugugcggggacucugggguuccuucuugauccuggugguggggcuauggaaagcuacugugggguaggacagagcaaagccagaguguuacauagaagucaacagagcuccugacaccucugcuuucugaagaccgggguuacugguacagucuccucccagcucccauucuuaaacacugaaguuggaugcuuuuggaacauuuugguuacauuaugucuaguuuuauaccuuagguauuaaccuugguguuaaccaaggggaccaucuaaaagacacacacucuuagcugaggaaacacuuuccuaagagugaacaucucagaugcagggccuuuuggcuauccugaguguccuggaaaauuccaagugagggacauguuuucuuauuuggggcuaugaagguucuuugaucucgugaggagggaguuuggcuguuagcacacuugcaugucagccgaguaauaugcagaugcuccuaguuaucugugaggagcauugcccuuuucugagcccuuacugaggucucugaguccagcuacccacuguggcugagccuuggugugagugacauccuggcuuccuucaguucggucaaaugcccuggaauccacaguucuggugaccacuguuuuccauucuuguguucuuuucauuucaugggugacagcauccgagagccaucacuuaggcaguaccuaacagccgaacaccccuccucagacuuuucucuuuugguuuuuccaagucaagggaucucuguguagccuugguuucugggaacucacucuguagaccagguuggccuccaacucagagaucugccugccucugccuccugagugcugggaucauccugacuuuuuuuucuuuucuuuucuuuucuuuucuuuucuuuucuuuuuuuccuuccuuccuuuccuuucuuucuuuuuuguuuguuuuuccagacaggguuucucuguguagcccugacuguccuggaacucacucuguagaccaggcuguccucaaacucaacuccgccugccucugccucccaggugcuaggauuaaaggcgugcgccaccacugccugguuaugacauuuucuucuuuucucucucucucucucucucucucucucucucucucucucccucucccucucccucucccucucccucucucccucuuccuuucgaggucaggcuuuaccaugucccacauucacucuccagaucacaggugugggcuaccugaccugaccaggcaucauuuugcaacaaugacaccuguaacauuggggucagauuugggagaaugucccgagcauuguaggauauauuugcaguaccauuagguccauuugcaaccaacccuaaacccucuagagccacugacaaaucuuuccugggauagcaucaccagcacugaagaaaauaacagaauacugccgagccaucucaaguccccggcuuuggcugcagagaaaagcaucaguuccaggucgcauggcugagaccccagaggggaacaaaggucuucacccucuugucacuacguuggucucaguguccauauuacaggauggggagcccugaccuucacucugucuuuaggugagagcaaacugcucuccuauggaugacugucccccaugacucacuuccugucauucccucacccccaucccccacccuuguacccagcacucacuacucacaguuuucugaauggaaaucaggaacaaacugcucaucacuguccgguaccugagcugcagagagaggccagagaggugaguccaggacgugacccugcaaaguggcaacuccaggaaggcagcacugucacccugcagguuaguuccagcccugcagaggucuagagccugccuuagaccaagggugacugcaccccagggccugcacuccccagaugcagccccaugaagaccccccagggaggacucugagaacuugucugagaaaauaguuuuugccuggauguuuugucucccguccuuggagugcaaaugaacccacccuucacaguuuacaaggcuuugucaggggugggcaggccuuaagacacuguggcagccuguggaucuggaaucagaugaggagauucugaauuugggaagggacccaggagccugcacuuuaaauaccuucccagguauuuuggagacacacaagagcucuagagcuuucgaaaggcaauggaggagagaggaugugaagaggguuaaaacaggacaggaggcagguacagauacuggcucaucacugcuaaggagaagaagggccuccccagccuggaugucugaggaccaaggguggguaucucugagcuaaaggauacucaaaggacuccauagggguuuuguuguuuuguuguuguuuuuaguauagaauagagucuauuuagggcaugggauggggaguuaagagaguaguagaggcagagaaaggcagugagaaggagagaauagagauuuggaggccagccaugaccauguuggggggacuggcaggagaggaggggcaaguuggaagcaagaguuaagagcgacuccacaguuuuuguuuaccuuugccucucuaucaaggcggaggauugcagcagaaagaagaacagauacagagaaggacuuccugauugucuaagcaggacaauggagcucgugaccuaggagacuagacugucacucccuggagacugggcaauguggaaauggcaagauagaagacucagacuucagaggggcuggugaggcaugggaguugagagauagagaauauucuacaccccaguccuaugugagcaugcaggcucagaccuuggccacaggacccuguguuugccagcucaccucccccaggcccugcaguccacacagccgucaggguggacaauagaaaccaaaucacuuugcugucucgcugaugggcaauuuaaacguuugcccuuggccuccucagcucaccuuccuugccugccucuuaggcaccuuggccuccuuuagcccucaguccugcugagcuggguccuuuuuccccuccacgccccgcgcccccagccucacccuacguucuggaucucacuauguagcccaggcucaccugaaaggcaccaucuuuucugauucugccuggaaugcugguuacagauggccacccugccaggcuuaucagagaccuucuuugaccacccaaagcaaaacugucccuuuugcuuucugucucagcagguacuucccccugaccugugccuaucuuacuaauguauauuugcauguuaauuaauguucaucucuucacugggaacacaggcuuugucuucuucaggugagucucuagcacccagaacaggguccuacucagaccagauacugaaugacuguuucuuaugaauaagcauccaacgagaccuguccucaggcuggcaggagcuagggccacagacuggggagccgaaagcagugagcuccucacccaggcagccuuucccuuuccccguagcuacuccucuccacacaccagcuaccaccagaguuagcacaacaccggaaaagcucaucuuacaaggaaggauacuugggcuguggucaagugcuugcuucgaaugucagaggcacuguguguuuauagauauagcuugauaguugauuuuuaucuauuuauuuaugguggggguugaaucaaaguccuuuugaaccaccugccuuucauuuuuugagacagggucuaacuagguaccccaggcuggccuuagauucaccuuuuccugucucagcuuccuugugaucacaggccuauuugacacugcguccggcuuagaggacuguuuucuagacagagauugaggcaagggaguuuaagauccagaagucucuggcuggugagauggcucaguggguaagagcacccaacugcucuucugaagguccugaguucaaauccuagcaaccacaugguggcucacaaccauccguaaggagaucugacucccucuucuggagugucugaagacagcuacagcguacuuacauauaauaaauaaaaaaaauaaaaauaaaaaaauaaaaaauccagaagucuccaguaguuaagagccuacuuagaucaauguacuacaauucuaaaguggcuacauacaucagugaggcaaaaauagguguaaaucccaugcuuuuuagaagcccaacuauaaucacacagcagcaaucccccagauguccugauuaaagacucgccuggcucuguuagccacacugguugguucuaaguccucaaauugggcaagugcuucuauaggcuggaggugggccaggcauccauauuugcaauaaaugucccuggugaguggcucauguggaaagcaccagucaacaggaaggggaaggacacauuccuuccuucugggugucagggaccauucaaagguaacagacaaucugaagguggcaggagcaagcaggcugacagauaguucccucccuacuacuuaggcaaggagggucccgagggcaaggaaggggugcaaaacuuggcaggggguagcugacgcacucuggagccccucuugggaccucauuaacuacugguuuccagugagguaaugggcugggggcaucuccugcugacgccacugggcuagugagcccugugggucaucugaccuuuccuucugccucaggcuuuaacguuuauccagaacccccagaagagauuuccccuuaucacacagauuguaccuucaaagagaugaugcgacccucuucccaagaaugggggguaggcccuacucucugcucagcucucccaauauuggccuuuucccaaagggauacaacagggcccucagucacccagagacuaucagcaaagauagaaacagaaacagagcuucaagaguuccuggagagcaggagaaauuuuaauuacuauguuuggucuugcgcacacacaccauucauucuauuuguugacucggcuguguuuuggcugcugagccagugugacagagucugcccccagcuccacuggcacuaaaaagggacugucugggcggggacaugcagaggauuaaggcagguguggguguguguauacccaguguaaagcaugugcaagcguacacacacacacacacucacacacacacagaauauauuuagggaccaucccuccaacaggagccaggggggccccaaagauggguuccagaagaaaugguuaaguuuacaagcuaaguacagaaccaaagccuaccacgagcaagcugccauguaucccacagaagggcugucugucauucucugggguuggggacagucccacauaagcgugaaugguagcauccuugggagguucugcuuuauuguguccccaacggcuggggcgcucacacccucacccugcccccacucuggcagcuucuauauuggaaggaaccaguucucuaucuguggagggggcauuccucuccaagaaccuucuaaauggagaggaaauagaaagauggaggaggcauggaacuaggaaagacuagggagaggguugaggauuaacccuucccuugccaacagucccccccccacccccagacuccagggugcacgaacacuuucacucuaaaacaaaauacggguuaaagcacccuccauguuccccucuacgcacaggaucucuuuuuggaccuauaaauagggaggcuaaaggaccaggggagagccacccuuggaggaccauuuagcugcaauaauuuuuguggaagagcccagauccauuccuuaaaauccugauaaaagcuauacauaagccauucucuuccuagaaaaauccauuuuaucuucagauauggcgcaacccccaacaauuuuacaugcagaauagcaauaucaagaaccccaaauuauccauaagccuucugggaauuuacaggcccucccuccccaacuucauacaaaggaugaacauagcuuagucaguuuuccuaacuaccaaagagaccacagagucauuguaccucacaguucaugaaggcucccaacaaucccacaaagcaacccuccaucagauccacaaaccuuuuuuuacauaaccagccacaucuuggcucagucugcccgagccuggguuucucuguggcaucugaucccuuuuccaucaccuuaacagaucccaggcacccagaugacucuccucagcucaucauaucccucuucacccagaaaagcccagaucugauccccaagauguguaugcugcuuccaaagagccacaccaacacucaccccaaaaucucaaucagcagccgauaugccaaagccaaauccaccucucucggucucgguuuggguccagccuggucacuccaaccccaccccccaaucuucacugccccacccacacucuaagaauuugcuguaucuuuccaaauugaggcucuaggaagaaaccaagcugagagaggggagguugggcucugggccccauucuccugauguuccccaccacuggcagguuucuagaggagcucauuccucccugucaccccuuuauacucuaggggagccacugaccuggugggaagaggcaggagaggagauuggggugaugcugggauggugcagggggacaggaccccggcagcugcaucugucuccgcagagagaggagcgaguggccucagcaucccaccccccccucaggccuggccauccaucgccagcugggaaccugagcugcucccucaggaggaaggagagggaaccaaggagaucccagcccccccccuagcauuccccacccccaucuccccacccacuggauuuaaauguacagggacucccaaggcagcaguauguaacacgcguguauacgugugcgcaugccugugcgcacacgcacuugcugucacacugacacacacagacagacaggcagacagacacauggacuaucaccagacccaccaccaaggggagggucuuccauggugggguggagagaacauuuuccuuuccaugucauucaaauagaccaaaugcugccaaaaggccacccugagcccacuccuaucuaacucacaacuggggagcuggccacugugggggcccucagcugaugggcagggaggaaacccagagagccagaccaaaaucaguaacuaguugauaaaaaagaagguuuuugaaagcccauggagacccugaguucuucagcuccagaaccugaagaaggguaagccuacccaacaaagcucuacaugcaacugggagcugggcacucaggcaugcagcagaggaagaggcacacuauacccagaccuccccacccccauuccacauuuuggaggauaaacuccaugcuaaacagucauucucugccaucaucaccaccacaauaauaauaauaaauaauaauaugacaacagcaauaauuuuaugugugugaguguguguuugagacgauggccaagacagaccucaucccauuccacaaaccuacuuagugguccccuuuccuucuuauccaggcuucuccuauagagaauccugugagagguggauuggauuggugaagagguggagagcuuugaaauuccaaaagaaagguacccacaguggaagaauggggaaugaaucccuuaggaaaagaccucaagaaaaaauucacuuuugguuucuggaguauuuagaguauuaacacaaaaggaggugagagcgaagauggggaugcuaaugcuuccugaaucucagagacuguaagucaccaugccuccuuccacuggcagcccugccagcaucacccucaggcuaacuaaccucaccaaaacaccacagcuagaauccaacuaggacaucugcuccacccagcccaggcugggccacugaccccauccuggcuaggacuuacaaccaacccuccagcauacaggaaggggaacauugccuggggguggagguauucaagagggauggagggaggaccaguugccacuggaauuauaaucaaggcuauuuggggaggcagcccugaaucuucucugccaaagugccaagaaaagaaguauugaaacuuuuguuguuauuuuggcuuggucaguaaauuggcccucggaguuaggaagaagugaaaugaagagaguaaaaaaccaagcaagguuccagcaacuccagaagauagguaauaaauuacuccuuauuccucccguuucucauugcucucuuucaauaccucaacaccccaacacuacaccuaggccaggagccuccugccagacaaacucugcaaaugaaauuuucaacuaggaaaaaaaaaaaaaaaaaaaaacgggccuugggccaaaauccauucaaauaagcaaauaccccacacaauagucugauucauccccaggccuaguuauacaagccuggcuccgggcgagaaaauaaauaucgauauguguccacacugggcaccggggagagugacaugguuagggacuggagagaugggguugaaggacuccuugagacagacaagaaccccccgccccccaugucccacuucuaauuuuaggaaggaaacaaaacuacucaccuucugcgagccacgucucuuggaagugacugagguccuggaagagaucugaugggugaauauuggauuggugaagagguggcgauaauauggggaagagaccuggcgagcccggguuacagccuccccacuggugauaagggacggagaagaaugagugguuugacuuuuggggaaacguggguuggggaaguccaggauaaggcuuugggauggauguacguggauuaagcagaggggucgcaguuugucuguuucuuuaccuucugagucggaaggcggcagggagcccggguccaugagcuuucccugcgggaccaucagcgcuucgcccaagcucccauuuccgggagauuucugcuggaaggaggggggaagaaugcccccgaaucacccugaggagucuagcuugggguuggggguggggucccgggguggcucaggggccaggcgguccuggacccacugagaccccccgggagggggcugcggggcgaguaggggcggggugcggggcgggggcgggcguggaggccggcgcggcgcucacgcugcagaagguguagggcacucgcugguccaaguauccgccuuucauccuccgcuccauccggccgcucccuccggccacagggccgggcccccgcgcggaggcagagaccugggaggggggaggcaguucgcacacggucccgggagcgcugcgggggggagggggcgaucgcgaggcuuuggaucggacagcgaaacuucuccgacucgcugggaccugcgcggccgagcgccuccaccgccacuccucucccgccaaaggaggucccaccugcucccuugagcugggguuggugugucugcuuucugcagcccugcucagcccgaacuggguuacauaagacgugugugugcgugugugugugcgcgcgugugugaguguguguguguguaugugggcgcgcgcgcgcggcgcacaccauucgcacgcccauaacucaggcgcccccuccagccucgaaucccgacgccucccacccccgccccggaaugugcggaagcgggcgccgaacagagagaguguggugugugggagaugaagcggggaaaucacagacacucucccuuccuuccccuuccgcagcuucaccugagguccgggcgucugugccggagccgcggggggaugcucagcaugcccgggggaugacacaacuaagguggcggggcuaggccggagcgaggcggccugagccccggguccccagagccccggcuuguuuuccgggcgcagcagacaguugugagcccgggggagcagcugauuggugcauuuccuuugccuuggccucc

SEQ ID NO: 12196 - RNA, 14538 nt, Mus musculus
gucaaaccuugguuuuucacuuuauuauacaaaaaaaaaaaaaaaaaggggaaaacaaaaccuccacagugggccuugaucugggacagucacgucuaagccgcucccgugguacaaauucaaguguggugguuguugaaaccuacaaaagacuccuuaaauauuagaaaaaaggagaagggucccagugcugaaauauauccugggcaaccucugacagcaccaacaugucccacccccacagcccuaccucuaagaauuuuccaauacuugcagugggaggaacacauguccuguucaaaguuguuucuaagugaaaacgcauuucacucaaguguaacaguccaggguguucaaacaaggagauggaguucucugcaagcccucucaggaacuuaaaacccugguacuaaauuuuagaauaaggacagugugugugugugugugugugugugugugugcgugcgcgcgcgcugagggcaggggguggggugggagggaaucuucucuuuaggaaucuccaucacacaguccaggcaaaugucuuugcuuucaagagggacuggcagcugggcugcagccuacuuucuguggagagccuacuucccaccucuggcuuucauuuaagaagcaaaacccaauagcacgaacaaaaauucuggccaacauaguaaaacugauaaucaccacagguaaaggugacuaggauuucaccgucaagggacugacccucuucagaaggucccaaacugcuggcaagcaguuagaggagcaguugcagagagcaucuucugcauacagggguggcggcaggaaagagggagcagaccugagaacucaaaggaaauggggauggccagaggacacggggcaaggcaggaagaacuuccugaagcccagggcaccagagaaaagcuuuaaggcucaugccaugguuugccccucccacuuuccugcuggacagcacagaccugcagcagcucagggacauggccuuggcaggggcaaacuaguauaggaagcaucagguggugucccugaaccccacaauggaagauggcagggaggggcagccuugguuuguuccugcuagggacaccaucucccaggccucuaccgacccuuuuuccagauucaaagagacaggcucuagacacacacacacacacacacacacacacacacacacacacacacacacucuucucucucucuccuauccacaggcgcagucaugcuguaucgcucgcucacgugugugcacaucacacacacagccucacacacacacacacacacacacacacacacacacacacagccucacacacauucuaugcauaccuagaccuuuuuuuuuuuuuuaagucucaauccaccccaucccaggcccucccagucccagaaaugacaacagagacggcagccgagaucgguaggaaacgucucguugacagcucagagcuuaaaaaaaaaauauauacacacauauauaaaaaaacacucugccccucccccacgaacggguccaggcagcuccuuccugcaggggcagggaagagggacagggccacugccugcuuucuugaaggcagcacccuugucucccuccaguucaaugugggggguccagguagcaagcccaucugggaaggaaaggccccccgaacauccaccuugcugcaggcugcagguguggaggucucaccaaacucuuuaagacucucucccacccccaaacuccccaguccauuguccaugccggaacugcaaaugcagaagaggggcagggugggcccguccagcgcuggcucagucugaugguugcugucccuggagaacccuggagcugaggcuccaaggcugcagaguccuagcuugggcucaugcagccuccuaccccccacugauuuaaaaaacaaaaaagaaagaaagaaagaaaguggggaagucuggaggguacgggacagaacacagggagagacaaagguugucaaagguugucaguuggggagaugagcucugcaggggcucucuccuuggcugccugccugccugccugccugggguggaggcugagccucaguuggagucagaauccgaagaguccccugaggaugaagagcuggagcuacugcccucagacucguugucuucauccucaucgucgucaucuucgucaucuucaucgucgucgucaucaucauucugggagaauaaagaccccaccgucaccguguguguggcccuccuggugaucuacaacaacccucccucccaccacgccuccugcccaccucauccccauccucgcuuucaucuucacugcuggacucagaagaguccccgccauccucagaagagucaccguucucaucaucuuccucuuccuccuccuccucgucguccuccuccuccucaucgucauccuccucggacuccugggagguguggagacgcaucagcagccagauacacccaccuugccagccacccacccaccuugcaggggugccuuaccgacuuggacugcagggugguccggcuagacuugggguuugggccucggagcuuggucauguucuuacguuucugacagaaaggaugggaagggggcugaagugagucccagccccugcagagucccuccagccucccccuccacugccuugugcuccugcuuacauuggagauguauucuuuguaugcugcgcgguccuggggagacaggcucuggggagaaagaacugggaauaagaucaaccccauccuacagcuggcugcauacgccgacguccacugggcagagcucccacauaccuuaucuuuacacucagucuccuaaacuuugggucccugcagaaagcuuuuaggggcucagaacauaacuccugauucugaacacugaaccaagucaguuuucauagcaaugcccuacccccaacugccguuuccaaaugguagcccuguaccuagggcuucuuuaacugcaaagcaugcccccccccaaugacucacgaggucaaccccaccuggaccccagucuuugaaaugacgacgaagacugacaaaauucuugaacacugaauuccugccaucccucugggucuuugguuagccuaucugagugacagguaauucucccuggacaaaugugaccauucaagcacagcaguggagacugccagccuagccaggcccuacaagucuccugguccuugcuugaacgaagagcacccagucuacacaaacugucuacuauguaaccuuggcaaaugacuugauaccuuggcuugcuuagcuuuaaaaaaugucaguacccacugccccgcaggacuucccagucccugcaggcacucccuuccaaggugccuuuguccucucucucaccuugacccagagguccaagugcaccuuguacugccucuguugcuccuccgccagcuucuuauagugcuccuucuggcucugggagaugcgcugccagcggcugccaaucuccaccaugcgcuccuucagcggcaggugauuuagcuccccauuggacagcagcuccugggagaacuucugguaaccguuccugcagcguggggugacagggacagucaggguccuaagggagccgccuucuaagcccugucuacaccauaggucccagccucaggcuuacauaggagguuucuuggguucucccuggaacuucaucuucuuggaagaguuuguagcagcuggaggggcccgcaucucacuuaacucucucuguggagagagacggagaggucacacccacacccgcacuccccaccccacuggcgggggagaucucaacucggcagagauuaaggcaggaggagcuagagcugguagugguagcuagcugggauccauagcaggacucuucucaaaacaacugcuggacaagucacugcaccaagagggucguuucaaaaauguucccugaaauggaaguagucccgucccgccccccccccccccccccgccaaaaucacccaagaggcuaguaccuugacgcccaccuagccuaugccaggccggaaguuaagagacuggcucagggucuuaaacaaagcuggcccuccuggcccaucauggaggcagguggcccaaccccuucccaccucauaucguuuuuggucuucugcugccuucuuaauccacaucagcuucuccuucuucuccauguuguuccaagucaucuccauggcuuucaaggcuuucacccggucauucuaagguacaaacccaggauaucaguuaugggagggggucuguugcuagagaccauaaaccgauccuuccccacucuccgcuaccuugaagcgggccagauagucuccgaugacacucugcugccagaucuccucagcccucuugggcgacuccggcagcuugccccuaucuucacgcuccccgcccggcuuccucucagacugcgccuucagcgcagccucccgggccuuguauuuagccuauagaaaaagcaaggauguuaacauucgggccaccccuagggggcgcgcuaagcccacccagcauucguugccggcucccuguugaggagggcggguccggcagaagccgugggcagcagugacguccaccaagcuccgccccacccauggggccgcucuccaagggagccaacaaggaagcugaaagcuucccuucuuccggcucccgccccagcaauugagcccggguacacgguacacgugugauucacuucuggugccggggagcggcuguaaccgcgcgcauggaaguggcccaggagacccuuagggaagaguaguagggggucucuccaaggcccgaccuucuucuucucggacaagucguuccacaugcgggccagaaggcgggucaguucgcuuucggagagcucaggucguuccuccuguagcugccuucgcuucuccucagagaagaugaacauagcagacacaggccgcuugggcuucucggagccacccuaagggaaguacggggaguaucggagguacaauugccacuagccuccuccugugagcggcuccauccuggcccccacccccacgggcaugggacacucaccuugccaccuuccugugaaggcuucuuggaggccggacuggugguuugcuucuuauugauguucagcaucuucuccucccccagaacccgcugcugcucuuccuccggcaagcucuagguaggaagaaggguauggggcugcagcaggcagguaggccggcuccucggacuccagaaugcgcccucugcccaccucaagguggugccuacuuaccucaaggaaccgcagcagcucuaccucauaaucuuucuuuuucuaggaaaguaaggggauucagugaguuggggucagccuccauucuccugggccagccagccucagcaggccccuagggacuggguguauguaaccuucucacccccugaagauggcagccaagaggccugacagacaggggaggcuaaacccggcccaggcugaaggcagguggcugaggcaccuguaaucagugaguuacugagcccaggcaaagcucaugcgcuaaaccccaagucaagaccccgagcucgggguggccuggcaccugcccugcgcaccuggucacauuucuugugauaggcauccuucuccuucugagagagcagcuuccauugcuggcugcauagcaccaugcgcucugugcugggcacauccuucauguuggccaugagcuccgcacaguacagggaguagcuguuccuauugaauccggaggaaggcacacccaugagcaaacgggacuggguucaaguucuucacgaacaacucccugauggcccacucgcccacccauccagggcggugcucacggaggcggcuugguaggucgcccaucgaacuuguccuugagcuggcgcucggccuuggugaggguggacuuggugaugccuuccucacugauguucagcucagggugcuucuggauauagucccgcauaaucuccugcagagggagguaggggagcggaggguaauggggugugggguuagcggggacaacauaagggggagagccgcuggggaggggaggcagggagcaaagcuggggauggccgugugucugugugucugcugugucaucugcaauaugguguccugcucugcccuagccugagaucucucgggugggaacggggcuuguaagacgguagggacagaggaaaggggcccaaaaggccccucccucaguagaaggucagggaacgacugccacgugcagaacgcuguggcacgagucagagggcaaaggcucgugaagagccggauggggaggagcgcagcggaagccuaaccucguacuccuuccgcugcuccagggccuuaugaauccauuucagccucuuuuuguccgagagcugagaccacugcuuccccagggaguccuucaccuccuucguaguggccugcaaaccaaaagccgucagacacacgcaggcagccaggggcaggggagggggggaggggcacagagggccccgccccccucgggccacaggaggucacgcaaguguccaccgcaggccaggaggguaagguggagaggcagggauccgccuuggugcgagggacaggcucacacacacacucauucgcacgccagcuggcccaggcccuguccaugcaaucccccccccuggggaggggccuccucuccugcuccccugcaccauacccagccaccaggcgcggcuccccccuugccaccgccgugugcccuccgccccuacccuuuggccagacacucacauccggccgcacuuugagauacaccuucuucucguggguguaccacaguugcuggggaguuuuggguuucucggggauguccgacuucuuggcauucuggauaaggucagggugauccucccuaaccaggggaccggagcaagggucagcaggggacaccgcuagggcagaccccagcuagcugcccaagccaagccuuuuaggccuuccugcaggagcucgguggaaguuuguggcuggcaaccugucccugccccugaaccugacacuacagucuacacaagacuuccacguuucauggacggucaguucuagucucagacaguacguuuauccuaccgcacccagugccccauagcccuccucugccuuaccugaaucgggccagguuucgcucgaacuccuguuucucccucuggaaguccugaauauauuucaucugaggggaggaggggauggagucacccaggacccaaggccuacuucacccagaucuagaaaaagccacccuccucugugacugccuugcuuccugcuaugauuuuagaugcuugguuccugugccucuagugagcuggacuuacauuaagcuuggugacuaacagccagauagugggauuuucagggagacucccagucacccaucuccauauuaagacagaaugccccagaagccaggagacaucacaucacccaguaggugaacugugacagguucggacuacccagcacuuucucuaauaccacauaacucccuugagucucguggcgcucucuggcugcugugcucccucuucccaccaucucuguggcagcugauguuggucuguccccucugggguggcuaacagcaccaggaaggcuuaauucugcuucugaagcagcagaggauauuguugaaggggcaggagaugaguucucacaacguaaaccaccucccaauaaauggccuaaaucugcaguuucuuucccauccagcaccagcucugggucuccggcauuccugucuucuuggucacuguccccuccugccuugucccuuccucugugcuccuggagccccaggcuuuuagaaaccccucccuccucuuaugccucuucccucuugcauaacauccauuucuccuuccuuccuuucucaauucugggucaagauagcacuggaaaggaccagaggcucacaacugaacuagacuccuccuuguaagaggcaccaggagcaagcaaggaggcagcucauuuccaccaugcuucccaacagaaaccagaaacagcacggccucccuagggcacccucaguccuccucagacgggaacuuaaaaggcaucucaggguucacccuccacgccucaaucaggaguacugaagugacuuaccugaaggaccagacacagccgaccggcaacaauaugacaggcccacauuagugugcccgugccuaagcuuucuccacucaaguuucucugucccucccugcuucugcuucuuagccucucucucccaccccucaggggucuggugguguguguagucacagucccaaguccucacccauggggucaauggcagcccugccaguuaaugcuacuugggcuuggguaugggccacagacagcugguuuuacccaaccaagccuaucccauuuuggauuuaacaguaagagcauaugagcucagccagauuaauucguuugacucuguguucuuugcccaccagugugcauccuucagacccuacugcccggcacugacacccuuggccucaucacccagcaucuccuccucacguuuggcucucucccaucuuuaacguguugaacucccuucaguauuuugcuucccugucuuccagggaaccccccugagcuugucuugggcuuuauccaucucugcccaggagguucggacaacguuuaccuaaaggccuacaccccugagaaucuggacaggggucuguuucuguaggaggaagcagccugaggcaaggagagaccguguacccuuguacacgggaaaacaaggucacuuaugugacgcggcagggggaagagcacuggagggcagaagagguuccaaacucaaguguguuccagcaucauuuagcuggaagccucaagcuacucagcacuccuaugccccaguccuugcucaggacaaccagucucuccccuuuccugggucucuugucuacucaaguaucaugguggguaggagaauggcugcacagauucacagggaguguggcuguuuggcugugggguacaggagcagucugaacgccuucaggguccuccccugcaauggguccugucugaccaugugugggccaggagggggauagguaccccggugaccuccaaaacaacuacacuguuguguugaccccuccacacgcccaauauggagucccuuuugucucucuaaggccuauccccaccccgcugaccuucccacaccagcugcccccuccugcaaguauaacuacccuccccacaccugagcccccccuccccccaccuucuucuucucuggaaguuccuuguauuucuuagacaggaucuuagucagguccagguugcucaucuccggguggagcuucgcguacuuggcccgcuucuccaugaagaagcggaaguaaggggugagagguuucuuuggaaaauccggguguuucuggaacacaggaaagcgggguuagaugccaccuauccuuuaaaccccucuucccugacgcgagcuucuccuccugguaacucaccuugagcuuuuugccuuuguaaggguuuuuaacauguuccugagcaucaaggaucaauucugucaauguacggaacuuccuuaccugggggagcaaacaggaagaaaggaauuugggaaacaucacugcauaguccagcaucccuuuacaguguuagcacugcccuccaccacacugaguucaaugaagaaaauaaagcgacaacauagauuauaggcaacuucugacccagaggcacucgcucauaucugcuacagaggcccaaguaguuggggacaaccuaagagcagucacagacugauuucaacguagcuuccaugccugcaucucauucagccccuagaguauccaaagucaccuagaagauugugguagaacugugagcacuaggcgguugcuaucgcccaggccacuuccuccccuaaggcauacauuagagcugacagaagaacacgugaaggccuucuguccaaagugacugguuugcuuuccccguuuucucugagaugaaaagcauauacacagccgggcgugguggcgcacgccuuuaaucccagcacucaggaggcaggggcaggcggauuugaggucaaggccagccuggucuacagagugaguuccaggacagccagggcuacacagagaaacccuguuucugaaggaaaaaaaaauagcauauacaauauguauuuauuuacaggagucaaaaagugggaagcacuuaccucguuagaaaucuccacccauuugagcuugcacauaucuccugaaaaauccuuaaacgcaacuuuuucccaauccaugugcgacucugugguuuugaacuuggagcugucguuggaugggagguuguucuucaugcauuccagcagagucagcauaucuuccugggaccagcggucugugacauguaagagaagucaccacaccuggcucaugcccuucucuugaucuguuccccagccucugaguucacccccuccuccccaaagccccugguugcuucucaucugaaccaguacauggcucaguccuaaaaaagaaaaauaaccgugguccuauuaaaucagggaagggacucuggaccagauaaaauaaccaccauacuuaaguuacacugggaauccugucuugcuuaccucaaagcaaucacuuuuaacaugcuaggcugccaugggccccuauuuacaguaugagauggagugggaagucuagugauuuagggccuauggacaaagggcucaucagaaagggagggaucagggaaagaacguaucuaaauguggucaggcucuaugugagugucaaacaugcaaggccugagguugaggugugaguccuaaggcucccagugaagaugucuguccagcacagcuggagaucaacaacuaaaggcagguacuccaccacucuagucacuuuaagggagaccaaagcagcauuucuggcaacugagaaaaguggaauucaaacauuagcaccauacacaguaguucugagaaaaggcaagcagguggacagaguucucagggccuuggucucuggagaaccccagaacuccaaguugacaucuuagcccaauuauuuucagcugcuaaagugcagcccagagacagcucugagccucucugcuauggaggcugggcugggggaacccuuggccaggaugcaaaagagcuccugacuuucauuugcaucugguaaccugggccgguuuccgcagaaaagggucacauggcccauaauccucucuccccugaugucucacaaacauuggcagaugcccaguuuccuacuacccuccaugucauaaacauaacacugcugacagagguggcuagggucggggcaucuauaauuccuaaggcuuggagccauaaaccacaauccccuucccuguuuuccaccugccucuagugaaaaucuccacuaaggugugauacuucaagcuaagaaaccaagaaggcuggcuuccaagagucuucccugugacccucauucauagcaagagaucguaaagacucaaguucuaagcucaaggccaaguaauuuggauuuggccaaacccccaugugacagaugcuucacuuucuaagacuuaagacugucugccagugcacagaacgaagccugagaggaaccuuuuacaaggcuggagagcucgugugugaaaaaagacaaguuugaaaagagaagcuggggacccauaccuuggccuuugggggcggccauuuccaggucugugggacaguccgcuucuccguucauucuccagcuguccagccaccuccucggucgcgcuggccgggccacccggggucaaagccaccucacccuuuugaagagacaccaaacccacuuaaggaggcugagaggaggggggcuuucuaucccacccccucacacaugggagggggcauagguccacacucucagcgagacccgaacaggaggcucauagacuucaucagugggugcaggagugagccccacucuucucuaccccagcccccagagccaggcggugccgcaugcgcccuccccugcccacgcgagagacugcucccagcucccgcgugcagcuagcucccgcccuccggccuccuucccccacccgggcaaaaaaaaaaaaaaaaaauucuccuccuccuccuccucggugagcgcccgccccggggaggccccaggcuggagggcgggggaggaagggcggguaaagggcgcgcgcgggcauggaagcgggcacgcgccucagucuccuccucccgcuuuuccccggccgguuccccccgccuccgcaacccggcggggacccggacgccgcgcagccgccgccagcccgggagcgcagcggccggaccgcccccggggacuagaucuggauucccgcugcuaccccccucccgaccucccaacgcgguccccgccuguccgggcaggcgagcagucggagaagcggccuagcuugucccccguccccgaaccacccggggccggagacgccgccgccaccacccagccaccccaacacgcacggaagaaacccggcgcagaggcgcgaccgcggcgggaacggccgccuccuccccgagccugcggcccagcccugccggcgcccccgccccggccuccggggagccgagccaagcagagggcgggaggacggcggccgcgaggcgggggcgcuucgcucaccggccccgccgcccccuccggcggccggcgagaacugcgccugucggccggagaaacgcgggcuccuccacccggggccucacuugggccucgcuuccugcccuuccuacccccggcucacggcgcccuuccccguucccugaucaucuugucuacaguucucccgguaucgccacucggcgucuaccgcagccgcggcucgcucccuagccccggccccggcgcacguccuccgccgccucgguuacccggcgcagcgcggccucugagcuccccgcuccggcggcucccuucucggcucugagcgcggcgcccucccccgcucggccgggcacagccgcaacucccucccgcggcggcagcggcuccuccuccgggcgcggcggcggcgcuggggcggcggcugcugcugcugcuguggcggcggcggcuguggcugcugccugcugcuccucgcggcgaaaagcacaaagcacagcgcccuccgccugcaggcagcccgcccgcccgcccgccggccccggccucagcucgcacaccccccgccgccgcagcagccuccgccgccggagcggggaggagggagaagggaggaggaggagcgggagggggggcgggagaagcggggcagcgagcgcguccuuccccguagagcgcacaccgacccccggggagcgagcgccagcccgcccgccucgccggcuccgcucccucccacagccugcccgggcgggcuccgcggggggcagcugggaggaggggcgggcgcuggggggacccgggcggccgaggcggaggcaaggaaggaggggagggggguggugguaguggcggcggcggcugcugcuguugcugccgccggggaaggggggggccgggacagggaagacacgcagccgcccggauggcggcggggcugcgagccgaggcgggcgagcaagcgggcggcuaaagcgaccucgccagccccgcgggggaacuagcaggcuuggccggcgcgggaggaagggagggccgaggugcggcgguggagaggguggccggcgagccucgcgggugccggcaacccugcucuggagcucucuuccaggcucucccagcuuaagcucgguuucccggccuaguccucaucugcuccucucucccgccuccgggagcgggcuagcgaccacccugguccccggagcguggcuaccggcuugggacucacgcucccggaucgcggugcgagguuucggcgccuaccucucgguucccuuaugcuccgcagaacacccgugaaacuuaaaauauauauucuuaguccccuaaacaacaaaaaccucucccgucccuccucacacccgggaaucggccaggagcugccgaccccagcggaagagucacucugggagccgguucaauccagcccggcauggcuauccaggccuucccgggcgcguggaggacggagauuggcgccgccagagagcaaccccuuucccccgaaauccgcggcaccgaggcuuacuuaccgagcaagugggugcuagugagggccgggggcgccaggcagcacggcaagcggaagagccgagccgcagcuccgcagcugccggcgcccgggcagcgagucuccagacaaagcccgagauggcgaagcggagcgacggcuaauggcgagccccacgcgccgcgcuccgcccgccccgcuccgcccgcccgcccgcccgccucggcgcagcgcagcgcagcgccgcuccgagcgcucgcccgucagagcc

SEQ ID NO: 12197 - RNA, 43735 nt, Mus musculus
cccucuucaugaucgccggcaaacuuccuccucggcgcugcuucuaauggagccccaccugcucgggcugcuacucggccuccugcucaguggcaccaggguccucgcuggcuacccaauuuggugguaagacuugccucuugucugccugcggccccgaucucucggccgcacccggggacggugggaggcgcuggccgggucugggcugcagcaggccuggggcucuuuucuccuugcuucccgcuagccccccagccguccaccccucuuggaucuucugcuggugucgccuuccgaauccaacuccuggcuucucagauaaucaccauuuucccugcuacccgccgcagaggcgggagggcucucccuaccccugaaggucucucguucuuagucuucacccucucccaccccaauuugggggucccgaagaaccuucguuugcucacacuugcauuucugugcuguccccgcggcccggccacuccucuucuccauuuuagggucuccguggguaaaauuauccuguccuuuuucgccaccgcaccucuucggugucucggucaagagauuucccccacaauacucgcguuugccuucauauuugagaccuuaagggcuuugggaaucccaagcaggggacuuaggggguauuucaguagauucuccccacuccguucuagauuaauuuugagccucugaagugacuauagaauuugcugauccuagaugccauugcugauccggguguauucguuccuugcuuguccaucccggagaaaagcgaggugggggcucuuugaaaauguacuuguuugggagggguaggcuugcuggguuuuuuugagcgaaaaccuaguucuccaugucaaauucguugcuuuuggaagacggggaagcuaggagaaagggcgagggaagggggaaugcugucccugagaaauacggauacaaaaggcauuuuaguaaauaaggcugggcgagcaggcggaguacuuggagcugaugggugugugaagggauucacuggaagauaaaccgccuuuuggaagccccagcuccagagacuccccuguuuuccaagccucauugcugcuccuccucuguagguccuccgguggaagacacuaaaaccaguuuucuaaauuacaccccagcccucucagucuccagcccccugcauuccggaaaacuuuaauaaaagaacccuccccuccugggcaguggcuagagcccuggggggggugggaggugaggaggaggaggaauuugggaccucugaguaagaaggagacuggccccuggggugaaaguuagaagugcuaccaggguaaagugcugccuacauggcccccucccugccugcuaccugcaagccugcaguaugaggcucagagcuuauaaaauacugggccacaccccaagccuuuuuccagaugcuuuggggugucugaaggccaggggagggggcagucaugaacccaggcacccaagccauggccugcccaagguucuguuuagaggguccaggaguugcuccuuagguugauaaauacgccaaggacagaccaucuuucuuuccuguggacuugggcuggucuggggcuccuguguggagucuauagagccugugcaugcuggggacagccagggauuccacagugagguucugccaauuggugaaagguugccucugccuccggacuuuccuucccccagccaaggccaaacucugccuucucagagacccugcgguggcgggugcauaggaagagagggugccuggagcccuagggauggcauagaggaaaaaggagagagugggcuugcuaguucugugaacuggaagagagcacuuccuggggcaguaccaguagguuagauggugguaacaguagccucuguguguaguaauguccaggaauaucuagguaagguccccauccgacaagaaauauuaggaaaaccuggagggcagagacagguccuaacauaacauacauggccuguuuggggguuaaggggggaccagauggcugcuuuugucugagccauagagaguauguauggguauuuuugagaugggugguuugucagugccuguggcuacgaccucuguguguguaauacagugugugcucuaggucagugacccuaagugucuguguaccuguaugucucuguggguagaagcuguuagugccugagacccaggcaaguguuuugugugaaaccuuuuggugugugccuaggggaucugcggcccacagcaggguaugcuguaucugcauacaaguaucagcaaguggcugguucugugaugugacacagaagucgagaaguauccguugcuuguguaaagggggaccuccuggcuuuugccugugauacuggacauggcaguauuuguguuuggacuugugugcugucugugcaugugucugugugugucccuucacccgcgcaugccuuccugacagcguaagggggaggcccaacaaaugucuuugugcgugagaucgguguucguggcaugaccagccaugguuggaaguaugagagugagccugggaggccuggcugagggcuguguccgggcccagcuucugaucgugaccccaaaugccagugacauaguuuugugccagugguuaugcgucuguggucauguuugcugacaccugacuugugggugugaagaauaccugaaaggggugcuugguggccaucaguggcccugaggggaaagacaggcaggaaguggaggucucagaagguggcugcagacacaaucggucugggaucccagcuggggugggggcagggccuuccuugacaccaucaagccuugcuugcuugaggacuguggcuacgagccuucccuccucuaaggucauuucccuuucgucuuggagcuggggcaugaaucaccuucauggggcuggaaguagagaguggguaggccucaaauucuugauuccccuccucugccccaaggccggcagauuccaggccuuugaguccgugacugccugccaccucuuuggcccacccggcucucacguucacccagaggauuuacaggggaaauggcuuagcugggauuucuguccacaucaccuucagaaaggaccccuacucccaguagcccaucccugcuuuuccuugcaagggccccaacucugagacaaggugaugaggaaggggcucugaggggccucuuacucuaaaaggaagcccugugcuccagagccucccagccuggcaguggcuccauuggagcaggaccagugacaaccagccugcuuucuagaacucuccuucauaguacuaguuagcuccuaguaaagaaaucugucuuucucuuucuugaggaauaagaucguucuacggccuugcccugugccaucugugcuccauuggaagugcccugaaaaaggaggccugguuggcugggugguguuuggcagcucacuucacacuguguggcugaggacuggugauuccuccccacccccccuuuugggggucacuuuucucacuuuuuacccaaccuugcaguuuagaggggaaauguuuugcugagggcuccaagccuguuagggcgccuggguucucauugcaccacuccagagcccauccuccacccaagcaccuaucuuaagcccugccucaguuucucuaugugucacauccugcugccuccccugcucaacgcccacccaacagccuucucuccgaggcuugggaacuaaggaacguguucagucaaacccccgugggggucagugggcugggcccagggaggcaccuggagacugugggggaggaaggccccaggccagguguuaacacuuguaacaggcaggaauuacagcuggcuggggcuagggcuggugagccgagcuggcuggaggcuguugaucccacagacagucagucagucagucagacagacagacagacagacagacagaugggagauaccagaucggauggccaagcuuuagcaggguggucgcucuuccagagaagaucuugccgugggggaauucgucuggggggaaaaaagaaugaugggccccuugaaaaugaguucacagcccaccccuauugugggcggggccuugugcuacaaagggaucgcaauuuggugguuggugguagaagguugguauccuucuaauggcaucacacauugccacacaaacaacaaacaagacaacuggugaaacaccagcuaguaucaggaacuguguguguccuuuagaaaagcggacuggacuuuauagggaagaaggcacgugguugggguugggauagugguugaggggggacacagcugucagaggaaaguccuccccugcccccuccccccuuacaaucuccaagugucuuauuaacagcuuugggaccaagagguaaaagcuggguguggcccacuucuuaacauagauucugaggucuuggaguuuuggaugucuaaacugcauugaauccuggugucagaagaggugaccugggagccuaggccuucacaaagcugguaccugcugcugcuaccccacuguaaacucagcuagagcucucuagggcccacgcucacucacuucugggccucugcuccaaccuccauuaaagagucaaaacgagggccccagguaagaguccccaagggacagacugguccaaggaagauuuccccacccucucagggcagaacucacugcucacaggaggacacaguugccuggaagguuagagcaguauucaugggccuccuaccaaaaccgcgaagagaaggccauacccuacauuuacccagcaucccccuguuuuguuuuguuuuguuuuguuuuguuuuguuuuguuuuguuuuguuuuguugagauaggauuucuucauguagccuuggcuguccuagaacuuauucuguagaccugacuggccuugaacucagagauccuucuuccugcuucugccuccugggugccgggaucaaaggcaccuggccagcacccuucuugaaggcucggccaccacauguucuguuucuauauauucccucuggggagaaauguuucagccuggaaguggagagccacgucugaguucugagcuuaccauccauuggcugugugaccuagggugacucuguccuucuucagcucccugccucucucuugacuauacugagagguguccauucaucuucuuagagccucggggauaugauggggacuccacagcagauacuugggaccugccugaaucagcacaccccuugauuucuguggcuugguguaccugcccuaagccccacuuuccacccaacacugccaugccuucuuaauucacuuccaaaccucacguaagggcucucuauuccucugucucugggcugcuggcaaagugaccucuccccgucucaguuuccccauaggaaaaauaaaguuauggccgcuaccccaugaacaucagugaucaaauucaggccccagaaugcugccggaaugcaggaaguacaguucaauguuugaaccucggucuggcccugaauccagacuugucucuucaaauaaacccuccgagauuggcccccauggcucucauuucuucuuguuccaugugcuuggcacuggugcccacaggcuuguaacuuccuucaaaaucagaaguucggcuuuuuaaaauauuuuuuauuauauucauguuagugguuuccuacauguaugccuaugcaagagagucagauccccuggaauuaaaauuauagacaguugugagcugccaugugggugcugggaauugaacccugaaccucugaaaggaccagugcucuucaccacugagccaucucuccagcccauugaaguucagcuuuuuuuuuuuuuuuuuuuuuuuuugcugccuaggggagguaggguaagguggacagagguggucuggggucuccccuaauccuccugauaccccacagucuucugagcucggaaaccucuguccucuccagcuggaacacagagcucccgggccugguggggagggguaggcuuggggcccuggcugcuggagcagccccagcacgaggugaaguugcuucuggagcugggggaugacucagagggugauuuauagacggaaagcagaaagcuuggcuccuggcagaagccugcugcuuaauuacauucuuugggggguggagguauguggggcgacagcaagggagagacuucuaccucguccccuccgggccugguaccugugauguccuagcaccaaauaggguucuucuuagagagugcguccccuguacugaaugcacgguuagccacugagaagaggaagaagugggacagaaucaucggaaggacagagucccguggggaccaccccagggacaggcugauggggcacacaggaagagugggaugcugagaaggaucgcugaaccuccacccugcuucugccgaagaaucccuaagccaccugggccucuggguagccacucuccacuuccccuucgcgugguugccugugaagaccuucaaguuggcuucuuguccuguggcuuggguccugguagcccaugcgugcaggagaccaggccuggaacucagagacuaaacucugcgucuuuggguuagaugaccuguugcguggaagugugaugacugcugcaaaacugcagcgguucugguagcaucagccucgugcuggagggaaggaaccccacuaacccugccuuuaaacuaacuacagcuagccuggcugcccaugcugaccaguguagugacuccaacacagccccagauacugaauuucugggucaggggucccaaaagguauaggacaggcagggguaaggaggccaaggucugcagcaccuggcugccuguuugagcuugguuaguacagcuggcaggacuuggcaggggucaggauggggacagcagacagcucuccaguucccccugaggcaggccuucucaaaauggccucauuaaugcauguggagugaauuccagaaaugucagguauacucacacaucuaaagaaggauggggacccagaaauguucugugcuuggagacaagaggagucagagugagggaugguuuccagguccgggaucugaacuguuggacauggucuuccuauugcaaagugaugcucugugcucaggacaguggauguuugaguuuucugugccuagugggagacuggaacugauuccgggacagaguagagaccauaaacuuuauaugugagcagcuuugaggugcaagcugaauugccaaccuucccagaccucaguuuucucauccaccaaauggccaauaacaugccuucccugcccaugguacuaaugagagcucaggaugucugucuuaccagagucagcucagcaacuaccauuguuagaaagaagaccaagauccccacccccuacccagaggaggugcaagaguaucuguaguggauccccaaucucugaguagaaucucugggagcagagccguugcuuggguuuaagacccagugauggcaggugugcuccaguuucagcucuggagguccacgaagagcacauaggccugauccccacugagacccgguuaggaggucuggguggaggugagggcaagguaggcagcuggaagcacucucucaaagcccgaggccaucaggaaauccaaacacccccagggaaugccaaggaaacccacagcggcauagcccuguucccuaacugagcuagagagacuugaagagaauguccugugucccuguguuggcaagggggaugggagcaacaggacccugugaccagguuuguugggagggccuuucugccaaaccugccccugggcgcagagucccacuuaucuaucggagccagccgggaucagcaaggaaaaccaaucuuccagagcccgcuaugcaugcaaaugggggcuugugaccaugugaaccugcacaccgccucucucuaguuccuccacacuucauaacguggcuuuccgagggugucauucugucccucugaaaccucucaugguucugaucuagacccccuuuguuuuauuuuggccucuaccugccuauacaacaugccuuucagaaccccucucccacuccuuccucaaaccgaacacaaaauaguacaugaaccucugcaugccuccuuccucugaccuggggaaggcaguaggacuugaccccuagguugaccagggcuuauuucugcucugccaagcacaggaccuggcuggcuuguggcauggagcugacaacccuaaacugugaagggccuuuggugucucuaaggcaaugggacccuccugagcagacugccgcagccgugcuggauacugggaugucuccaccauguccauucccuugggcuuuguugcuccuccucagcccagauugaagaauccuauguauguguuagagcuucuucuacgcucacccagcucgugcuaugcauauaaaggugucaggacccaggggcaggugcccuuacaugcuguguggcugucuuuagagaccuagaagauauucuuccaagacuaacggugagcagcugcuuugcacagaccacacguggugggagaaggguuggagcccacauucugccuccacucgggcucaggagaagacuuccuaguuagaaggaggagaagcugcuugucccuauaagauguuguucuccaaaggaucacuuugagacgagaucucacuacacuuucacccugagagcuguuccuucgagaguguggaucccacucugaugagucuaggaacuccaacugggaucuggcaucugucacuggagcuuuccugcaacuggucagguugcccucgaguuaggauggugaaguguggccaugcaagguuuuugcugcccuugggccaaguagggcuagccuuggucgaucauugggccucuaugcucuuaauugguagauagacaaugaccuauaaggucacugcccacuacccgugcccucauccuccgguguucccuuuucuccuuggcaucugaucuucacuguguguguguucguguguguguguguguguguguguguguguguguguguuggggagaagcuauguaugcauuugugggaaggggguagcuuauucaugugugcauuugagcauggagccagaauacaaccuaugguuucauaucuugggcacucuguuuagcuuuggaaacauagucucucacugagacauuagguucccugauucgucuagguugguuggcuagugagccucaaggauuucccugcuucugccucccuagcuuugggauuacaggcacaccaccacacccaaccuuuucccauggguucugaggaaugagcucagcaauuagauaagccaucuucccucccuagccucagaauucaugcccauagccuagcccugaguugguguuucugggcuguugagucuuuccuugacuuucacagcuagacauucagcacuauuuccugcugagaagccagaaugcucucuccuuucuuauaaagcauauuuccuuuaugcaucagccauuuaggaaccccagagcuagacuugauacucgauguuugcaccugugcugaccuugggugacacauucaucuucuccuuuuccugauccaguguuuucaucuccauucugccauuuauccagaaacauuuuguauucuaaacuccuugcgggcagaccccaugccuggagcaucuagaguucaccacgcuuggucucuguguagcggcuacugaugcuccauaaauauguuuuggccgucagacaggacguuggcugccagcugugcugaguucuuucugaaaagaggcaaggcagaggaaaaugagaacgaaaaauucauuuugucagcauggcagcgguaugccugugaucccugcacuccagagacugaggcaggaggauugcaaguuugaaaccagcuugggcucuacaaugagagucugucgacacaaaagaaagaaagagggaaagggguggguaggggagaaaaaaauggcuguuucugagaagcggcucugagcugacaguuuugaguugggggaagcgcauccuguaucuuccccagaaaccuuaucucuagggaugcuguuugcaggacugacggugcuuuagucuaagcuugaaggugucaucccaccucuugggaaucucaaacauuguagccaaggaugaccuugaccuuuuccuccucuuucacugccccagugcugggcuuagcccgcaccacugugccuggguuuauuugguguuagggauugaacccagggcuucaugcaugcuaggcaagcacucuaccaacggagcuaugccucagguuggggacuuugugucugccauggcugugccuucucuuuguuugcuccccccaccccaugccugucugugguguucuccuugggagaugacuaauugaugcucuugauaccacuuccuaggugacacacaaguacccaagugcccccuuuccaucuccccagcagcuauugcagaacuaccacccuguaaaaauucagggcggcaugcggaugagagagagagaacacaggagaccacacucaggaccacauaggguggcuggccucucucaggccagacguucccauuggcaaagcuguggggaagaccccaaguagaccuggacuaagccacaucacugcuguggcaggaaccucacaaaaaggagaggagaacacucaaucgugcauuguggugccuuugaccccaacacuugggaggccaagacagguagauuucuauaccuucaagaucagccuggccuaugcgggaaguuucgggacagucagggugaugagagacccugucucaauaaacaaaaauagaaguagagaggagcuucaggguaggggagcacagcccgccaaccaccuggcaaggcuucaguucaccucuaugcuccugcccuuaguuggcccuagacccaucccagucccuugacuucagccaaaagagcauccaaaucuacuguagguggaccuccauaagguccagaacuuuccaaggaugaccaugacucuggcaugccuuugaagcuaaagcugcacccugucuccagaaagugggcagccagggagcagauuuuaaucaucagcgaggaauccaucuguccuuuuugagguuccugccucagccuggugugcacagagggaacacaucaccucugucagccuuagaagcaugcucuuguucuccccauucuacaggugacaaacugagcccuugagagaaccacuucagggccuaaggcuccucaggcuguggacugaaacuccaauuagaugcugacuguaggaagccaggcccuccaggguucacagccccucacugauagccaggaagcucccucaaggucuaucuagacuuaguccaagcccagacaauuucauuuggucucugggaugugaacaucacugaagggucucaaucugcccuugugauuggauauguuguuccuggaguccagggcaguccuuuggagguaaccugaaagugccauuagcccaaguuaugagggggguccugcccaggucuuuggggcagagggcucugcaccacugucugacaauugugccccuuucucuggggacaggaaucugaaaucccagggccaacaccccuagggcccacacccacccuggugaugcuccaggcaucccaauaucuggggaauccuucccagaugacuguaggccuccugagcucucuggguuucuaccuaaagucuguucuauuagagaagaugacaguacugaugacccaaaaagaggucagggcaggguauuugcaggggcuguggguaccuggaggguuagcuagguguccagcauggugagcccuguagaggcugagggcuauuucugcccaugucaccauuuucuagaaugaacuccuuggaaagacugauuuugcuuacuauuuaaauuuuguauuaguaacacacacacauauacacacuuucuggaagcacauggcaagacuaaaucaagaaagcacauguguccuguggaaguccaggacaaggaucucaguuugaaugaagaguauugacauuuguuaaccugaggugaggcaguuacgucucugguaccugacaaacacucagccuucauuuaauaaucucgucccacacacucuagccaggaugaaggaguuggauggggaaaugggucugucuagguucucccagcacagaaaucucggagaaggcuugaccaucuuggugucccccgcccccagcccccuccagccuugcaacaugggcucacccuagcaggagaggagccccuuguuuagcagcaguaccagggacugucccagcuguguuccucucaccuucagggcccucuuugcuucagggccucaucuugccacucucggucucagaggaccuucccugugcuuguggcuuuagaugaugugaccagaagggcagcgacugcaucaaggaacacacccaccugacuguaguguucuuuaaccccaaggccgaccuugacccugcaccacccugcaccuuccagccccagccuggcucuccuccuggcuacucucaucucuaggaugacagucccgggcuuccaucuauguagcugggugaccuuacuuucucugagccucaacuuuucccucuguaaaauggggauggcaaggauuaaaggauguaacauuauaugagacagacaaggucuggcgucuacacagugaguaaugcucccauuugccaucauuaaucucgcugucuauuuuguuguucucgccaugcaucaccgcucugcgcuuuugugcucgccccugccuucuucuggggagguuccgaggacuccuguccgcucugugaagugagguugguaccauugucucaccagcaccugcuccaccugagcuccucccggggucucagugggacuccuucaacucuacccaccuugccaggcagcacgggacaccacgcagcaucuggggacaggucuuaagcugaggggcacugcugugugugcccugcuuggcagaggcccagucuuccugcuccaggugucuuccuccucccaauguccuccuccuccuccuccucaggaagacugacugacacuugucaucuuucuugacuucucagucacaucucauugguaucuaucuuauccuuccaaagaggggaccagcucuugaggacaugaauucugcugugugucuuggugacccaacugagcuucauauagcaacucuggggugcagagcacagcuuggggagcacugucguucuagagauuguugagccggugacucaggaccccuccucagaagcuccggugcggcuuucgcugcuucccgugaacuggauagcagcucccccucacccaugaucucagcagggcccagccuggagcuucuagccuuucguggacacauagcucucucgcugcauuugaagaagagcugucuguggaaaauggcacgucucagacuuguuggcugguggcucucagacuuucagagccuccauuucuucuauguaaaacggcggcgggggugccguguugucaggaaaaguugugagguccugcuacauaggggcugggcugacagggacugaucaugggugguaugcaggucauuccaguccagcgaggguuguccagggacucaguaccgggaaagaaugcaggucauccugcccuagagaaagggccacgcuuggggaaagcuauacgccuugugauggugugccccaauuaucaccuuauuugaaaaccaaaaugggaguggcucagagcaggaugcaagugauucagugaggacccuggucugacccuguguccugguguccugcucagcuccugggaagagguaggcaagucagaugugguggcuucagggaguuuuacuggggcuccugggcuggccugugcagguuuaauauggcugaggcaucggucauuucaucccugagaaggguggugaguaagccuugccugggaggcuggggccgcuguacacaucugucuuuuagggaagagggcccugcugugcugcuuaaagugucacagacaagaauggguggccugugugugacugauaugcauccuacacagacaccagcuguucugcugagaauuggagaaugaauaugcuuuuuauuauauaguacuuuaugcacacaaagcaaacacaucaucuaugggaugucauaacaagaugaaaccuugugcuuccccacacccggaagaaccagaacaucagcaucuguccuuaggcuucucccuccccaccccaucaccaucuccuuccacaugugaccacauccugauuuucgccauuuuauaaagagagacagguggggggggggugucucucacccagucuggaacucacuaauuaggcuagacuguccagaaagucccuaaagauucuccuguugacccuuccccagugcuggaguguuaccaccacacuuguuugcauggcugcuggaaauggaacucaggucuuagcuuacaaagcuuacugauggagccaccuccucaggcccugcacagggauuccaugacugagauaaaaagccggcuggauguaugggcccacaccuuuaaucccagcacugcagaggcagaggcagguggaccucugaguuggaguuccaggacagccaggguuacacagagaaacacugucucaaacaaacaaacaaacaaacaaacaauaacaaaagauaaaauguaaccugagauaagaaugcccacaauacauuuuucacuuugcuuguuaaaaaaaaaaaagagagagagauaguuuguguguggucuucugugguuuccucuucuuugucuuauuuucgagaugggggggggggucuuaugauauagacuuagcuggucuggaauuuacuauguagaccaggcuggccucgagcucacagaggucucugccugccaagagcugggauuaaaggugugugccaccacaucugucuuuguucuuucuauuuuuuguuucuaaguuccucauuguuccugagucuuucuauauuuccuucauuuuccccacuguagaguagucacugugucugcuuccuucuuuuuguguacacaggagucucucugugcccauggaggaaagcucucccuccauacacuugccuuggaguggagcaguagguccuggcuguugaauguucuuagagugaugccuagccauucccaaacaugcuccuaucuccuuccucucuuuccucucuuuccucucuucccucucuuugcccaugaucuuccaaagcuuuuucaaacucagagcccccguugucccaggucucuuaccagcuuggcuucugccucgcccccacacugcacauccuccagcucuucggagcaucauuuggauggagcacuaggucucaaagugugucucaucacacuggucuuaugugauccugcugggaaaggcuucuagggacaaguaaauuuagaaguuagccuugcuuguuggaaucucaaugccaccagguacaccacagaggugacccuugcuuucauuugucuagucuuuccccaaaauagcuagcccaggaaauccuccugccccuuucaaaauucaguuugguuuuuauggucuuuauuuucccaacugggaggcugcgauuuuuugcaauguauauuuuuuuuaacauucugcaugaauugaggaaguuuagucuaguaucuccaucgcuugggggucucgagaugaugaaugaaaaagcauaaguggugaaugaaggcagcaguuagagaagcaguuggcucguugcucugugguccagcugggucucuuguccugaggagucagaagcuauggacaacuugagguuguuuggcccguguccaacccugccuacaguguuucuacccagccuuccuccaacacccacguggaaugagucacucccauuaagccuccugucacugguuugggggcaucuguuucauagggaggccugaaacccuugcaagggcagaggcucuguuccauuugcccccuagguucucaagaguggcugcuuacccucuggcugguggaugagugcagucggaggaggucuccuguguauccuugccagggacuagaggguacuaugacagucugcaggcucuggagucagaccagaugagcccucauagaccugccagucuccacgccucagcuugggaacugggcaucuucucuucuuuccacccacaauuacucuacugacucugggaacagggucucacuuuguagcucuggcuggccugaaacucauuauguagaccaggcuagccccaacaauuaugacaaccucccgccucugccucccaaguguagucauguuccacugcccuggcucuuuguuugguggaguucuguuuguuuaaauugagacaaggucucauggagcgugggcuagccugggacucacuauaccguggaggauaaacucugaucuuccuaccucucucuacaaguucugggauuaagggagcacacuuaguuaaugugaugguagagacagaacucaggguuuugugugcaugaggcaugaauugagcuacagccccagacuguuugucuguuuugagacagggucucauauguagcucugguugcuugccaaguaaauaagacuugccuugaacuuguggugacuccccugcugcagcaucccagauacugggaugugcaggugugcaccaccaugugugacauugcuggguuuuauuuugauccuuuguucaucccuacaaacuagaacccauaacagugcuugguuguuuugggguugggaauggagggagcgaaccuacagguaggaacuugggaagcccaaggguagccaggacuuucauggcugacccaggaagcucaguauccugagaccaagaucucuuugacacagcguggcuagagcguccugugcuguagcaguguccuagaauggagggcucacagggcguggcuuacugccgugguccucagccuccugcacaggauggugugcgcugggagaugcuugcacacagaacauuugaaucacuuuucccugggcuuagagcgccaggaggucagauagcagggccugaggaugcuagaggcccacuuaccauucucaggcauacaccacuuggccuugaagucggggaagcuccucagaccucauuaaccuccuauuguaaggagccucaccagcuccagagcaccugcucucuucucuucgcacuggucagccuuaguucuagaucugucuucccuggccucccaacagaagagauagaucguggggcacugcagacaggcugaggugaacgucugaugugacacacggaugccuggggacguucacuggggagcagagaaaccugggcauuuauuucaucccagguaacgagcuguaguccccuccacaagggagaacagagcaggggugguucagagggguggaggcacguaggugagauugccaauuggguguccaagaggcaaagaugucauugaaaugacagagccagagaaucuaguagagggagacugagaucuuugcggcagaggaaggaagacauucaaagcaauucacagaccacuggucuucugagagcucggguagugugagaggggaaggggagauggagguggugguaggcuuuauccuuucugcagcgguacaagcuagaacgcgugguaacagggugguaugaauuuccccagagguguggaaggcuccugauuggucugauuccucagccuccucgugagacacuccaucagguuggaccugaaaguacucagaucccugccaaccgccaucuuucagacucacagacagucuccacauugcugccugagggaucugaacucaguagcugacugucaccccugucucuguccaccuugacccuguguguugguguccuacuuacaucccuauguccaaggcuccuuccuuuugagagcagagaaauguacacagagcauccccuuuuaccuccuuccuucuugguccaggucccacccacugggaauacccuggauauaccucuuuugcccccaguguguguaauacaucaaggguuacacucgguuggaaggaaaaaaugauuuuaaagcaauaacagcaacaacaaugccaaguguggugguaucuaccugucaucccagcaucucggaaacuaaggcaggguaauuuccauaaauuagcauagccuggucugcauagugaguuccaggccagccagagcuacacagugagaaccuaucuuaagguaauauaauuuaauauaauauaccacuccccuauguguuuugcaacccauccugccauguggccccuuucuguggguuuucucagcucugcuuggaaguugccuguguccuugcuauuguccuuuagucccugugugcauagcccuguuauuagauuauacaguccuccgggugaggggccaugacagcguugaguuagugugggacacauuuugggugcagaauaagugaauucugccagaaugagucauuagcggagaguggauggaggccguuagacacaauggcagcagcauaggaggcgagaugaagccauucagaccccuguaccuucugagucugccuucucguuggugcagugcauuagccugaaccccuuggagcuuuugaaagaauaaaucucaaugagcagguucuggaaaacagcuuugcagucucaaagguggccagcuccccugagaagcccacauccacacugguuccgagaacccucaccuucugggcuugcuaucuuggaagaggcccagucaccuagaauucucugugguuauuugaacccaugugucaacccuucugauucugggacagagcucuuuugucucuugaggaugccugggacauggcccugcuuugauacagagacauaaacaucaaggguaggaaauccacaucaacauucaagagagaaaauaccaguaagaaggaaggcuccagugugaguccagcacucagccugaacaacaagacaggcugggugucucagcucuccacugacacacuguagagucucccaccccaagaagucccuucuugcuuucuuagcagccucaccaucaccagcuguaugaucccaaacauauuacccggccucuagaaccugugucaucaccugucaaguggggauaauaaugucguuggguuccuuggcaaauuaaaggauguauuucauguaacgugcuuuauaugaugcugggcacagagucagggcucaauaaaugcuggccuucacaaauaauaaccauugugagugcccuggagaugguuucacccccuccacucccuuacaccagagaacaggaaaucauuuccucacggccuucuuaacaacugucuccccagauaagugcacccuauauuaucuuauucacccugagugugcaccuguaaagcggccccuuuauuccauuuauagcuguuuccacaaagaggcccccauuaccucaucucccucuguuuugugggcuccuccugucuguggccacucagggccaguguggguucugagggagccuuggccacaggucuguguuggcaucugcccucacgcgcacacacacaccuuuguagaaaagucuauaauuucuucaagcuuuguggcacaugccuguauaucugucaauucaaaagacugagacaaaaggauagaaaguuuaaaaugaacuauaugucuuuaaucccaucacugaagaggcagaggcagguggauuucugugaauucaaggccagccuggucuauauuguaaguuuuagaucagccccgacuacauacauucucaccaaaggggguaagaaaaugaaagcucagagugggucggagagcuuaguaggacuaucuaucucuaucucuauauccauaucuauauaauuggaaagggcugaggaggaauagccuugcaguucaguacuugccuagcagugugaagucuuggguuuaaucuccaguacugaaagaaaaaaaaaaucuauuggaauuucuuuauuuaaauguguguguguguguguguguguguguguguguguguguguguguguguguguguaugagagagagagagagagagagagagagagagagagagagagagagagagacuuuuguauacaaagcuuguucuucuccagaagaaauacaacaagacaucagacuauagaagcagaaaugccugagguaucagcugggcccugcagccuccuggggugacaagauugggcacagugagaggacaugggugaacagggagggcucagccugcagaauguauccuuuccccgcuggguuaugcacaggaacucagaaagaugugggucccuguaagaggcacaucuggagaccuugaacccaaaacuucuguggacagccagcaugucugggagcuccuguacucaccaacauguaaaccccacagcaagacucagcaaucuggguguagaaauuaggagaagggaaaacucucggaggaagagagaugcaaggaggaaugugggcaaggggguggggucccccaacagugccaaagacaagguuucuuuugaaaguuuuuucauggugaccuuccuuuucgaauggauguuaguuagcgagcgguuagcagugaggcucuuaaacuccaagcuuggagccgccugugauuuauaccuggccuauguagaugagggacaugcccaaacacuuuucgcucauacugcugaucaaaaacaguuuggcugcugcggcugucaagauggaggcuugagaaaccuggagagcuagaaugaggaaaacaccaggcuugggaagaaaggaggcugauucuggguaccaggauguacggcguagggcggagcagauagggcccagcgcuggagccccaugagcgguccuagucuccuuuggcucuuggcuugcuccuugaaaugaagcgaagacccacugagcacccagacuucuccauccuauggugcagacaucagacugugaauucuguguguagccagcauugaggcugagcugcccuucucugagugcuagaauaccuagcgggagucccgcuagcagcuaggaguguggagugggcacucacaaacccagagaagaaaggcuaggcuugguggagaaacuggaagcaggagcccaagacugguggaugugaccgugugggugcggggcagggggugcgcaggaagguguugaggcucgcucccgggaaugggcccgggagggaggagcaggcagcgcuuugaacuugcgcucagccuccagaaggagggcgggggaaguccaggugccggccgggcugcuuucaccugcggauccuuggcgcuuugggggacgaggcgcaaggaagaccuccugggaaugcaguggaaauacccaccuugaaaggcaaggagcgggaacauagcccugagcgccggguguggcgcugcucccgcccccaucccuacccgccucacgcugcagcgcgcaccugcugcuggugcugguacuggugccagugcccauuccagggccuccccgaccuguuggugcucccagcaucugagccaucaagguuccugcccacagguuucaucuagaaguccccacaaaugaguugggaguuuucuauuguucuucaaacuuuuauuauggcaaucauuaaugaaggcuguggaucuugcuuggagauuuagggcuggcagagcaugcuacaagggccugauguucguucaucaucacaaagcagccggggaaaugaacuaggaaagucgaaaggggggcaggagaugucgcucaguugguggagugcuuaccucagcauaccugaggccaugguuuugauaaaccccauccuacuuggauggggagucagaaagguuauagcuaguccugggucagucagcuuauucuacauagcaaguuccaggccagccagagcuacauaacgaaaaguagaggaaaauaauauaaggagcaagaguuuacacaccuuauagugccaccauuuaaaaauguuuuaaacgugcacguuugugucaaacaauuacaaagaaaauucuauuccgcaugagcgcugagauuccgauauguaaggcugcccccaccccaucaaaccgccaugcugguuaacaagacgucuaagaauucccgaugauucagguugccuagguguccuccucucugccuuuacccaaaggguuuucaacgcaggcuccacucauuucuuuucccuugucuucauuuuaaucucaaaguaauucauucuccuuaugcccaauacacuggcucuucagagagcuaugguuugcagucuuugaucaugugaccuguucucagaucaucugccugcuucuuuagagucauaugacuugugcuucugucucucgucuuccugacaacugaggguuacuuaggcgaacugucuuuggcuggugagcuuuauggaggagguuggguaccccacauugcgccaucuccagccauccagcucuccugcuucuuuggagguguuuaauaggguuucugagucucuuucccagaugggcugguccagcggguuaggacuggaguccaugugucuggguuuugcaaaucugccccuuugcuggcuguuuaagugucucaccugccuuccuggccucagcagucagcugggcagugcucauccugggcccuccaaagggcauggggagggaggugugggaaaaggugaguucucauggcucuggcucagcagaucugaaugucuggaucugggaguugguaguucuuauagauuauaaccacgccuauaaacaucuguaugcucucaacaucuagcacacagcuggcccaguguaauugucccugaaaugaagaucuccaccaggcugguggcccucaaugagccccuagaaagaugguuucuggugugagcuuccagccaauaaauagcucagcuuucugcauuugaagacucagagaaagacuuccccagggugugcagcaguugugagaaaaguccagagagccagcagggugucuucugcucucagcuugucauggcaguagccugaguggggaggaaagacuggggaggucagugggagccucuggguccaguccaaggggguccugggcccauuagaaaagcagacucuccacuuaaguagucaccggugagggagggaaguuguccucugaaaaaccucaacuuuuaguggagagaacggcucuguagacagcucaguagagaauguucaagaucuaucuucuucugacaagcugaagagaugaccaggaggaacaguuucaauccagaggggauuuuucuaaccucagaucuugaggggugacuaggagcucaccgugagaugaauggccagggaagcuguuuugucuuucaccagaacuuggcuugaagggaaagcucuaugagaacugggaaugguucugaccuaggaaccagcugucugcuuucccagaaccauuagccaggcccugccaagcccucacuucacugcacgugggagacugcccugccggagagggucagcagggaggaagugguacgccgcucaaaggaaccaaugaagcacacugggcuuaaggaacguuuauaguucugauuggcaggucaguaggcaaagaaauaaauggcagagcccggagagaaaaggaugugaccuaaucaagcugagcuugaauuucaagccgaaagcacaggccagccagcucucagccucucuccccuaggcacuccuggcuuuuagaauuccuaccccaaacgggacuccucacacuuggucaacuacagauugccucuucugcguagaaugggaggccccauccaauguauacagagcaggagcugugcugguaacagaaggcguuccagugugcugacggaggcucggugaggcacagaggaguucugugagguacgaggagauggggcucuggcucgagguucaaaggccuggaccauccuccuuucaccuugaaccagugaaggacauuggaugaguuacaucacuuaaggggggggggggugugcacagcuuccccugagaaaaagaaguuaauugucccaccaaccuuuggcuuugacauuuuaugacuugaugcuuucaugaguagccucucaggcagcuggcuaugggaccauuuacaggaggcuucgaguggcuuuccagggccucuuacauucugucucuccuccagcaagacauaggccagccagggacacuuuucaggcagaaacuucugcucagcaagccuuuauuauugaucaaccuucacgcagaaacccccguucuaacuaaccaucgcuucagggaggguggacaugcccccacuagaaaagacuaaaugcagucuagcacagucauuugcaacugcaagcaacccaagcaggccuuugauccuugaucaucuucccugugaaacagagccugccuaacuguggccucuggggccacaaaggcaaggaucagaccugcucaguggggguggggaagggaagaacauggggacucacuugggaacugcuugguuagaggaaaugacucaguccuugcccuaaccuccuggaagcccugucucugagacagcuggcacuucucagagagaccuucuuggggucugaggugagaggccccugaccuggaccugcuaucuggauguucugggcugaguuugcuucugguaagucuuucuagagaagguagacuaggccaggcugcagaagccccugucuccuucuuucuugccuuccacucuuuccccuuccaauucucuggaucucucccucucuucguacaguuaacuaauucccuuacauccucuuuaggacccaucagccugcuucaugcuccaaccccuaauuuagccaggagggacaguccuuccuccguucuccacugugaucaacucccccuuccuaugaaauggggugggggugguggcucaugcucaggacaccucaaaaaacagguuucaacauuucacagguuucaacauuuuucaggcggacuugucacacaucuuaucagaucagagccuugcaagcaagcccucuucggcacagaguagaugccgguacauuccagucaggcugggcucccuuugguggaaaggguccacccagcuucuuagauggaggcaggaucgauaccacuucccucugauagggucaccccuaagagugacccccgacugcauguuucuuuccauaucaucuucuucgucccauagaugcccagaaucccgucucuuugggguccccagcaagugcacugcuuccuauaaagguuccacugggcccugaaaggagcuucuagaaguaucgggugaagaugagucucugggguuacuuccagaguguagacagucuuuuggccagcagagccaguaaguucuguugcuugagcuccaccgggaccucaggaagagaggaagaaggucacccugcccugcucaauggcugcuuccuuccagaaggaauggcuuugacauuggauuucccucuucacgccugagaguuuugccccaugguguggguugccagccugguaucacccucccuucauguucuccaaaagacucugcuucccugcuccugccaugauaaugauagccuuggcgacguggcgaagacgagccaaagcccagagucucagaguucagucugagaagcacaccuggaggcugguccccaggccacagagagcggcugagaggccacccugggggcaaacuccacucuguuugucagaaaggagucuccacgggaggaccuggcugugauggcaagagcucucaccuagggaggaaacagacaaggaacagagcagagggagagauauugugauggcugaccacacgugcaggcuguuugccucuguaagugcugaugaaacgggagccaggaacacaggcuucagcccuagccgugugagguuugggcacaccaugcuguuccggcgucacuccucccugccugguauaugauaucaacagucccaaccugagauuuccagcuagcucagcuuucccggggaccuuuuggaaucuucaggucuagagugccuuuccacuguaccuccugagcagcuauccucaagaggaaaugccugccuucuggguuccucuuugggcucugcacuuggccauggucuucagcugucacuguccccaaggguuccuuuucccauuguuucuagccucuuacagaugccaucuccauggucacccucguucagaccuucuacaucccuucucuuuguccuuauccacagccuucucucuguucccugaagccuucaucuugcaauggccagugggcccauccaccgccauagccuguuagccucucuggcucaccugaggccagcgacaccaaggccucuggugguaucgauguguugccagguccucgaaucuccuuagugccaacugucacaccagccuuccaucuguuuccuagcuuuugaucucuagugcugcccuugucccauuguaggugggagauagaucaacaaaccaaaguccagcucuggaugcuucgagcucugccagcuugcccagagugguauaaaaccuggcagguggggccccuugccagccccccuccuccugaauaguccaagacgucaggugagugauaaaugguaacauggguacaccagcuguuguccccagccuccuaguucgaggcugcucucuguuccaggugcuuaagugagcccagcuuuaaucaccagguguguagcugcuccugaucacagcaguggggacuuacuggccccacccugggagacucaguguucuucccuaugcuaugguaacgaugacugaggacauaagugacaaguagccaaagaucaucuccugcucacguguggcauccacaguacccugaucugguaggugcuugaagagggcucguuggccugccguugacagaugucuccuggccugggugcuccuccguggggcuucauucaucucuguguuccuagcaccuggagcucugccagguuuggagucaucucucaguaagcgauguugagugagcagucgcugagugacuguguuuaccaaggaaggacuugagcccagcugccgagaccaaacccuccaguugcuuauccucgcaggcccagacucaggcaaacuggaaacucagcccugcccugggcuccacccuuuucccuucagccccuguaaugugagcuaaaguuaucucuguucccgauggauccagaaaggcagauagauauaagggauggagagaggucugaggacuucccaugacugugaagggcagcaucuagguucccuuugugaacugacagccauggugucacucggaaacagccccuucuuggucauacggugcugggaaagguguaguuaugugcagagggcccuguguguuccagaucagcauggauucuuaggaaagguggcggcagaugcaucaugggauuucucccuccuugcucuuuauugaagcuuccugccauggugccagggcucacacagggcccguagagacucuagaagcugagagaacccuggcccaccagacucagcuccuucccaguccugagcuuuguccucucccuuguaauaaucagcagcucuaauuucccuaaguggaacggcgauacuuggguucuuuuuguccauuucucaugauuuucuucuggcuucuagaaguuuccauauugcccaggagguagaguucuacuggaccaaaaguggguugggcuucugucuagcauugccuagaagucagcagacagaauaccugguucugugcccuuaugggguuuugggaaacccucuaccuucgucucccucccaaugccugggcauuuuauuucaugagagccuaggcuuuuggaucagaaucuugugguuaucucugagaucagguggguggcuacuuaucacuguaagaaagagaagggcaaagaauccggugcucccaagaagaguaagacucauccaaacucaucccaagacuaauagaugagccagagaccuucucccugugcuguggccuggaaauacacucuguccacucugccaagucccagagaagcuucugaaaaugugucuuuaucacacccugggauucacaggaagggacagagaaagagcuuguuggcaucgaggcaggggucguggccauggcugcugaccuuucuaggcaacugagcuuccccgugacccuagcucagaccagugccuuucugaaaguucucugaaauuaagggauucagagcugaagagauggcucagcgguuggggacacugacugcuuuuaaagaggacccagguucaaaucccagugcccacauggcucacagcugucuguaacuccaagaccugacacucucacguagacauagaugcaggcaaaacaccaaugcacauaaaauaaagguaaauaaauaaaaacuuuuauagaaaaaaaauugagggauucagguagacucgguccuggucauuucagcuauuacuaauuguauaaaucagugcauuagguaaguuccaaugucaggcaacuaccacuauuauuucuagaacauucucuucauccuaaacagucauuacuguggaguaugagccuacgccgagacugcuggauccugugguauauaacaaauucucuuuuuaaauguuguauauagaggaaaaggagggaguuugugcuugcauccguuuccaaacaaaaauaguucaccauuaaggcagccugaacuuggugacacccccaccagcauucaccaucucccuaagcucuaagagccuguugggaagcucaaaacuuaaaagcaaacaaaacaagcuaggcugggauacagagaaggcucccugguaggaugagccugguguaagcagacagagccagccugaucucagcagggacucagucaugcagagggauggcagagucugugggucucuaaggcuccaggacaccucuuuguaagucccugcagcagcuaagcugcccugaguucucugacuagagaugcuggggcuagagaugcugguagacugccuucucagcaggcacaaaggccugaguuuguuccccaguacugauuuaaauaccauaaaaucgugagaaauggacaaaaagaacccaaguauugccuuuccacuuagggaaguugguacuaaacuggaugugguggcccgugccaacaauccuggcacucagguagagccaggaggcucagaaauucaagaucauccuuggcuacguagggaguucaaagccagccugggauacaugaaauccuguuucuaaaacaaaaacaaaacaaaaaaagucuguauuucaugaaaagucuuauauauguauauauacuucuacauuugaaugaaguacuaacaagccacguaugcauucuuucggaacugcugcagaucuuuucuccauuuuccuucuaauuaauuacaucuguaaguaaaaaaauaugaaucaacccauuggaaugguuaugucgagguuggaugagcacaucugcaguccugguacucaggugucugagacaggaggauugcaaagccaaggcccgcaugaaccacagacuauggccaugucucagagcaacaauaucuugggcuguaguagcucagcaguagagcccuugccuuagcauggguaaggucccaggcucccucugcagccaggaaaacugucugaucuugucaccaugcacacccacccacagcccuuugcagaacaggugacaaagaacugggugucagugggaagcugacagggccauggggauguuuacagucuggccuaauuggacaguggcauuggucgcuaucaucagccuaagccuuccugacaucuauggcucauccaccuggcugcuugcgucugccugggccuggaugguaggugguugggaugaagacgagcugucccuggggcugaagacaacagaaccuuggguagagcagggcaagucggggacagaagcuggguauaaauagucccugcccagcugggcaggccuggcaagcccuccguccucccccucaccagcugccagugccagccaugccccgaccuccuuugggagccuggucaccaucucagauccucacuggaggaagucccucagcggaacugaggagucuuguccugugugugggcgagaccuccggcugcccgagugggggcaucaggcaggcucuucgggguguccucuauuuucuuaacuggaaggccaagugugcugguguaugugugugaaaaaucaauagcuauuccucuuugugugugugugugucaugcugcaaacaaaugagccagccuucuguggugagaaggggagaagaggguacggggacacuagcaaagguuacuucuagcuugggagcucacagaagucuuuagaagugauucagggaaaguuugacuuggguaugggcugcagagaggcacucaaggagagggcucagcaugcgugaagggugugaagcuguuucagcuggccucaaggcaaaucuaaucaaagccucucacaguggggagauggagaagaucaggagccucuccuguugacucucccaggggcacaagcucuucuguaacggggacaagaaguggguuacacugauaugucugcagcaauggaaugucagccauggugugugggcacggcucagggccggcagggcaugucaggggggacagcuguccugcagaagucaaucccaaggccauagccucaaggcuguccauagaucugagcccuguccccagaggcccuagcuaauuaccacaggauauccagauagagcuuguugagaccucugaccggagcauccuggaaacccucccaugccccuuggucaguuugaacaugcauccaagucacacauggcuuugcuacgcucagccugucagucacagagggauuugcuuggccagcccugucaggacugcuggugaagagacucugccgugucuuggagccuuccuccucgugcuugaugggaaguggcuuuagaaauucugaugugcuguaucaagucagggaacugaggcuccgggaaaugagguuggcgacccggcagggaccaaguccugagagcauggaaccugagguggcugccauugcuugagggauccugaugugcauggcacugagcuguacauguuuacucuucccgcaagcucugucucacaguggaagaaagugugguguggagaaguuaaggaaaucgcuuggauuggcagcuugaggcaggcagagcccgaugugagcuggggugaagagacaggcuuggaaggaggagggaaccuaacucugggugacaagugucuacacugaagcccuugcugggguuuccuuucuagugucaguagggcuuagggaugaguggcaggccagggcuaagugcuggcuuagugugugagaaugagcuugaucaacaacacugcagagaaagggccugguugggggcaggggucuguagggaaggaagagaaaagacaaaagacaugccaagagggaggcucaacucuggcacuuuacgacccacagguccaggcagcuuacuuagcucccuugccucuguuuccccgucugugaaaugggaugauauugaugaugacacucucuuuaccucauagacugguugcgaggauuaaaucaguuaaagacguaaacauuucaaacugugcccagcucaggucagauauacauccauguuagguguuuuugcggggcuccccuaugccuuuaugugcuguguggcuucaggcgcuaggcucaccauuguuucucacucaaacgucagcccaccagcggguaggcaggccaggccugaagccacccagcucccuagggacccagacaagcauugcccacgaagcagagggaaggcuugccugggagccagguagucuaguuucuaacagcagauagaaacucuauaaucugggcagcuaguaaagcccccacugugugcuggguuguuaucaagcaacucaaggaaguuagugaagaguugguagugagccgugauggugugacacuaaugcuucaguggucaccucauucuuuuucucucacucuuggccagucccaacaggagacagucucuuguagcccaggcuagcuugcaccuccugacccucuugcuucuggcucccaaguguucagggauuacuacccaccuuccuagcuuucccuugucaaaagggcccagggcucugguuggggagagcucagugggagaucaguugucuggcaagcuugaggcuuugagaggugggguuggggacucuaagcucaggacaagguucuucaaggccaccaauucaaacccccaguucugccuacucgcacucucucuucccaguggggaaaccuggacuucauccccugacagcugaggccagaggcugcuggaaguggugcugcugugugccauguuuugcuggagccucugagcagagcaaccgaggcucuggguguugagugugggggaaggguguugggaggcagcucacagcauacucugauuagacucugaugagccauauaccuguucccaagaagccuagggcaagcuaguuuguucuggaaacccagauuccucaucaggggacagagaugaucaaaagcugaucaagucuguuacauccaaaguucuaagcaacuacagagucccucaauggccgcguucgguucacccaugccaacgaagcuuuugugucucuucugaccuaccccagaguuugccccuggcccucuuuccaaggcuccugcauccaggacuugaccuuagcuagugccuaggucuccuucuuccaggacacucugcccuuuauuaugagccuggaagagggaaggaaaagguagaguuucugguagugccuugcuuuuucuacaguaguuaacccuuucccccccgaguguacuuaccggcgcuguaaaaucccaaggguugaaauguaagagguacaauaaugggguggcuugacugaagugagaagguuggggggaugccugcugagaguuuccuuuugcucuugaguuaaacuagucaucaaacggagccucugucgcuagugagaggggagguggcacucuagaaacuucuagggaacuauaaagaugguggcggaggcccuuguagacagagcacuugaugccaucagagacaaacaggcucuugguguccucuguacucuuggggaagaggcuaagagggcuuuguggggagagagagagagaggggggagagagagagagagagagagagagagagagagagagagagaacacugugcuaagacuuaugcuccccccccccccccaagauggagcugugaucacaauggccucugcuuccuuuguccuuuauauuuggauuccuucccaugaauggcuguuagucuccacaugacccacgaauccuggagucccugggagauugcucugcaggagcccugccaucucuaccagggcaccggggcccaggcacugggcagaacuugauuccugcuccaauucuucauuuccaacccaggguuauuuuuguggcacaguacagaccuacacagugcccccucccccagaggcucugcugcuccacaugcccaugucagagggacacugcuugaaccggugccgugcccuuugugggacaccguguccccaaggaaagucagaaagcagcacacaaggugccaggcuucucagagccacggaucaucccucccccaccccagcccauccucugggaagaagugacauccauacuaggccacguguucugugucuacagugccaucuccauugucugccugcaggucccuggcccugggccagcaguacacaucucuggccucccagccucugcucugcggcuccaucccaggccugguccccaagcaacugcgcuucugccgcaauuacaucgagaucaugcccagcguagcagaaggugugaagcugggcauccaggagugccagcaucaguuccggggccgccgguggaacuguaccaccauagaugacagccuggccaucuuugggccugucuuggacaaagguacuugccugagacucggugggagguggcugggagacuggggguggugggaaggguucugggacccuguccccuuccucccacugugggaaacccugaguccaaguucucccuaggaggguaauaaagcugguggaaagugggugggguccaucucuggacaggacaggcuguguccacaucggcuacaucuuuucuagugcuacagggggguggguagcccugaggugccccaguguccugagauuggagggcaggcaccaaggagcccggagccuuccuucccggaugacacagugggggcccagucuuugauguagacaugugugacauuucccuuaugcuguguuaagugcuaugcaaauacagcuugggggugggggugggauggugccaggccuagguguugugccauggaaaaagucucuaugcucugucaaagcugucuggugcugguagcacuacaugacccccgaggguccccugagaguuccuguugguucccauagccugaaagcaagacgcguccauuaacccugauguccuguggaucacgcucggugaucuggaagucugaccagcugugacccuaguggaugaaagccggcuuuugacuuugcacauggggcauaggagaggguugaaugggguaacugcuccuaagaaggggacuuuggcucuagaaccucuccuguccaggaauuuaacggccuuagcugggcuggccucgacuggaguuuugccagccgaugggggcgagccugcucugagaagguucguaaaagcugcauucacagccaaaagggaggaguccgagagcuagcgggagggugggcgcagaguuugggagaggggagcuauccccccuccuuuggagaaagcccucucccccuuuaccugugcuucaagugcaaagugucuguacaaccuacaggcagaaaacgcaggcuauugucgugggacaggagggcaauuagcaaaucaauggaugaugauucuguuuacgcuucuaauaccaaagcuaauuauuccuuguuuacauaaaagguuuggccucuaauuggggccaaguggcggcggcggcuggcuuuucaaaacugaucucgcccgccuguuggucucaccgccuuccggcgccccaccucaguccagguagcguuuaaucaaacugccaggcgucccgacgccucccccaaagcaacacuggccuucugaucacuccucccacccaggauaguguccaucgagaccuuucagcaugauacccgcucgcagugggucugauguuuagauucgcagcaguggguugugccacaugccuccgucccacagcaagagggcaguuugugucccagugugcaaggaaauauggggcugagacagugggauuugaugaaggcaguggggugagguuccaggaagauguacccgcgucccgguacccugugggcaggcgguggguccuggccacuuuugcgcacguccuagcaggugcggggugggcggccggaaggcgcaaggccgcgguccuccgcggcucccgaggguucgagcgccgccccccgccgcgcgcccgcugcggucgccgcgcaauucacacgcccucuggccgccgccucccggggaucgcgcugcccggcgccggggcugggggcgcggcccggccgcgggagccgcccguugcuacgcgguggcggccggcccggcggcccgggcccggcggccgcauuaugcggguaaugcggugugacaccgcgcgaacaaaggcggauugagcggcgcagcgggucccgccggacggggaccggcacagcggggcuggcagcgccgcucccaggcuaauccccgccccgcccccgccacccccacugccccggcgcugggaacugagcguggcggggccgggucgccggaagccaggggcgcccuccccuggggcgagagggccgggaggccuggaucaccgccgugcgcagucccccccggcuuggcuggacugcugagccagcucucgcuccgcgcuccccgccgggcugcgggaaaagugggacgcgccccugcugugcagguggcgcacgagggcuucgugucugcaaaggcugcuguggcucugaguaucugguucccugcauauucagcacgggccacgaccuaggaaaggagauccggcucugaccaccugugcaguauagcacgacccgcucugggaaccuauaaaaagagauggcccgggccguuggccucgcccggcccugucuguaaaauaggguuuagaacauuguagggaauaaagcacaggaaagacagaucugcgcguaugcaguacucagggaguggcucucauuguaacaaggcuggugaugcccgcugagacucucaucucugaacccugggccugaggccgagaaacugccuugucucgacccucguggcuucguaggaggagggcaagaaaugggcagccauggcugaagaugcugcaccuacuuuacagaguguacugugaggcacagaugagaaaucugccuacggggaacugagguucgaguggaacgaguggauuaguagguuuuaggcugcagguuccagucuccagaauggaggacucagaacuguuaggaggaguguuucugaaugugcaagguuggaggccaagagcccaaggacagggcguggccaaccuaacucuucagagagcauuccggucccaccauagaccccuccaucuuaguagcccugcagcucugaacucagcuugcccauccacaaagagaauacuaacuagggucugaacucuuuagagcaacaggagggcaccuggcucucuucccccaaugacuggugagccuuugcgcucuuccccagcccucagggcaaggcuguguauguacccuaaggcuccaggcugaacaucuucucacaccaucccucugcagccacccgugaaucggccuucgugcaugccaucgccucggcuggugucgccuucgcagucacacgcuccugcgcugagggaaccuccaccaucugcggcugugacucacaucauaaggggccaccuggagaaggcuggaaguggggcggcugcagcgaggacgccgacuucggggugcuggugucccgggaauuugcggaugcgcgggagaacaggccagaugcccgcucagcuaugaacaagcacaacaaugaagcaggccgaacggugagacagcgacccacaacucgggggcgggaggcacucccuggaccccugccuucacggccagguucccauccacaccccauaguaacccccugaccacccuccuuccucucuuccagcuguccuuugaauagguuuuuuaaaguauauuuacucauucucaguguguguauuccauguuguguauguggaagucagaaggcaaccuguaguggucaguucuucccaccauguagguuuccaaacuugaaucaugcuugaugcuguuccuggaucuuuugagaaaucugccaaggagugcaguauggcugccccauaggaacaacacccauaggcuacacugguuggcaggcugugccuguguacgucugugaugugguuguggguuggggacugacucugaauccaaaguaggguuuccauagcauagcccuuccuaugcucguggaacacuuagcucucggccucaguuuuuccaucuguucaaugggaauaacagucccuaguuugcaccacuucuauggaugaggugaaugugaagccugcuggggccgggggugugacuagggacacugguuuccacccauucuuccuggcaccaaguaagaguagaggagggugugguacagaggggaagcuuucucccggugugucagucugaacuagcugcugccccucuuucccuagaccauccuggaccacaugcaccuaaaguguaaaugccacggguuguccggcagcugcgaggugaagaccugcuggugggcccagcccgacuuccgugccauuggcgacuuccucaaggacaaguacgacagugccuccgagauggugguggagaaacaccgugagucccgaggcuggguggagacccugcgggcuaaguacgcgcucuucaagccacccaccgagagggaccuggucuacuacgagaacucccccaacuuuugugagcccaacccagagacgggcuccuuugguaccagggaccggacuugcaaugucaccucccacggcaucgauggcugcgaucugcugugcuguggccggggccacaacacgaggacggagaaacggaaggagaaaugccauugcgucuuccacuggugcugcuaugucagcugccaagaguguauucgcaucuacgaugugcacaccugcaaguagugagccagguagggcgcggggcgggacgugggacugcccucuccucccauccgcuaggccugcucuucugauucucggcuucccaagacgaacaaguucccaaagcugaagucagaaacuaggcuucccacgcuuccacgggaauggucuuggggagcgacuugacguauuuacacgaggcucagauaaugacugagggugugcacgucagccacaagcaauugauuaaaauucuuacacaaauuagcagugaugagccagaccagauuuguucauggcugcuggcugucauuagugagcaucuauucggccagaagagagguugaggucuggucccagccaugccccuaaaagugucauaucucagggccucaguuucccuacugucuaaaggagagguucaaaugucagaaacaggggcaggguauggugggacuggccuuuaaucccagcacuuaggaggcugaggcaucuggaucugagugugaggucuggcuggucuccauagagaguucuaggccaggacuacacagugagacccugagacagucaccuaguaagucucuccuaacccuggggcagagucauuucacaucacccaugaacugagagggcaagcuuugaccuaacacaaauccuccagagcuugggaaggugggugggggaagccagaucugaagcuuggguggagcgggagcacucucaccaaguuuauggagggagacaggaaagaggagagcucccaguucagagcggcuggggugagugaccgugggauaaaagccugguggauuaugcuuccaagcuucccagagguggccugcaugcgugggaggaccccaagaaaggucagccuggaagcagagugauccuagaggcucuggcaugggccagugugacccuugucucuguccccuccccugagagggcucugcuagugagucugacucucaacuggcuuuucuuauuugucaaccaacaacucuggcuucagcaucuguuaccuuccccgagcagcugugaggaacgugggaaaccacauugguuccuggaaaagcagcuuucuguccaucuauggauggccagcgcaguguguuccacccagggaccuuggagcuggugacacaccagagcugguggcucaugucugcgcucuguaaggguggggggguaccugacaucacaagcccaucuaagaaguuccuuguggggcuuagguuccauucccagggucccucuagaaccauacaggaggcguggguuuucuuuaucaaggucaaggcuggaaggaagacagcggcgagcuuuagcgcuucacgcgcccacugcugaaccucgcuccucaucugcgcagugauggcaguauggggaucuugauggauuuuuauaaagcucaaguuagugggugugaaugcugcucuaagugucaggguugccaucagcguuagcacgggguugcugcaaaggaagaucccaugggcguucuuucugcuuuucaaagggaugggagaaaagucagcaaguaggaagguugagguggaaggaagcagaccaugacggccgccuucucugguauucacucugacaagaguuagcccugcaccccccaauaucagauaguacauacauagcucuggccguuuugaggagcucuugguguggcuucuuaucacucagcuagaagggccauuuguccugaccacccaugucacugaagguuagacuugaguuaauggccuagauagacccaggggucugcuuccagaagcuuccuauguaggcuugcauaggccucagcauugccaacccaagcuugauacauggggcaguguggguccaagauacagagcccaugacuccacuccguccuugcccaugugggcagcugagaucuuccaggcagggaaggaggugcagggugagccuuuguuguccagcaaaucgcuccacuccaauccuugccuaaaaaugaucuccuaagaagaauuggguguagcuggguaguagaacacuuacaccccugaaucaaucuccaguacuggggagaggggaaagcagcccccuuuccucacauuccuaagguagacacuugcuguuuuucuaguaucaugcagacauguuuuuaagaagcuaugcccacagaguucacagccuuaaucccuucccauggggugggggguggaggggggaggaggacuggacucucaaccucacacuuccugauaagaaagaucccucccacugggauguccuuugccucucggagcccagguuuccuccugugugaagugauaaggucugugcccugcagggcugcucaggagccagacacagccauaaagagccugcucugggcuccugguuuggagccauaggccagaaggugguugagaccugguuccuuccuguccuuucacccccgaaggcgcugcuacugauggaagccaagggacaaaugggcagggagacagcaggcauagaaggcucuggcuuuuuucuugcacaaaggggccacagagcagagcccagcaggccacaugcccuucucugagaagaguucagcacagugguagcauccaguccucccuaaguggggaagacaccuucuccauugcuugagguuuguccacugucuccacuuagccacuagcuugguauccgagugcugguaguuuacaaauaucugauuuauucuuuuuaucccuaugucggaaaggcuaugaaucuagucacccccucuaacuggcccuguguccugggucuguuacuagucuuuugugggaccuuaggcauauccaggucgucuugcuaugccugguucagcucugccagcagcaccagagaugaggguuggcuggggguuggggggugccuggggcguggcucaguaccucagaucccacgggauagggcuguacagagugaucaugcucaggaaagcacccugggagggaguucaccauaacuagguagaguccguuucuuuuggacaauucacggcaguugugcgucugauggcaggcacuagcccugcugugacugguggcucagacuggcaggcuuuuccgucuccacguaggaagggcaaugcucccuugguuaccuacagugggcuuccucagcuaggaggagguuugaguuguguggaugcaggcucuguucuuccugaggauggcauguccucccucaacagcaggcucuggggcgaggagggaggcagggcuggcagcguaggcagccugugaucuuugcaucccagggggugauguugacagcaguuaugagguuucugauucuuccuguuuauuucccaaagggcacugggaagggguagauugugcggcuggauccauucaucgaagucccaugagaagcaggaucuagauccaggccagccuucggcacuggccagcaaggagcauggacuguugccagcugcaugugauaaacgaccuggacccagccggccucggacggacgggcggcuucuuucucaacuaacgucucucccccugcucuggaugguguacggcuuuacagaggggcuuucuuuaugguuuuaccagggucugcuggggacagacucgaggcuuaccuuugcacauguuaaagaaaauaaaaaugaaaaaaaaaaaucuaccgcaacagaacaggcugggcuagugugagcucuuggccuggugggaaggacaagaccauggcgagauucuguguccaagcugccucuacucgugacauuccaagaugccucugaggugggaacugugaaguaggacagagccccgcaguccccucuuguccgucgacucccauuuaaauuggacauaccuugucguucugagaaaagccauagauagguguagcugggauguagugauggggaggccccuggccaacagugggagcaagaucuugaguuuugaagaccucagaguucugggcggccugggaagccaucugcagaacagaguuccuugugggcuccuguuuucgcuagcccuguucugcccuggagcgacagucagaucuccacgccccuuucuguuguucuacaguguccaccuuuacuacgcguuuuuuuuuuuuuuuuucaugaugaccuuguaaauaggucagauguggaggcaggucucuucuggcuccauccaccacacccagaaagaaugggcugcucugcccuucucagccuugcuaaccagcagacaccgaggagagcagcggggcaccuuagagagcaaucuaaacaugguuggcagguggggaggguaaagagucccacuuccuuuguguuagaaggcagacuacccugcguccuuuucucccauuggcugaaguaaccagaaagacaagagauccuuaacaagcccuucuucccacuuguaaaagggauagccuaucucaguucccaaggaucuggauuagauagauauucaaaagaggcaagcagcgaauggaggcagcucccagcucuguucccgacgcaugaugguacuggcuggguuuaguaagguggguggggcugcacggaucaauccaucaacuccgucuuaaggagaaucagaaagaggagauaaaaugggggaauggggcagaacaaagaauuuguccuuucccgcuucugucuagggucugcuaaugcuggcuugacgaggggucagccacuucuuuccuguugugcaguuggcuugccaagcaggcuccaguaggcccuugccugcacucucuaccaugugaccaugagcacugcucuagggacaccucccaucccuuccuagcaccccaaaugccccuucccaucucuccuuccagaaguuggaaaucaagucaacuggauaacgcuugugugaggacacuugagcagaacggauacaacaauuuacaagucucuucauaucuauguauucuauauuaaaagugauaaagucauguuuccggggcguauucaaguagcugacaaguaauuauuuaauaauaguacaugagcgcauuguaauuauccucgccauagucagguaauagcauccaaugggaggucccuaccaaccugcuguauccaaaguuuuguaaaaaguuguagaaguuguugaucuuuuugauuuuauauucaaaaagucucuuuuuauaaauauuauuuauuauacaauguauauaccuuugaguuaacuaagauuauauauuauauaaauauauauauauu

SEQ ID NO: 12198 - RNA, 12634 nt, Mus musculus
agggggaggcgugggcgcguccccggcccaggauuuauaaaggcgaggucuggaccgacgcgcgcucucgucgccuuggcugucccggcggcgccaacccaacugccccgcccgcugcagacguccgacaugcugagccgugcuuugcugugccuagcccuggccugggcggcuagggugggcgccgacgcccuggaggaggaggacaacguccugguguugaagaagagcaacuucgaggaggcgcuggcggcgcacaaguaccugcugguggaguucugugagugcgccgugggccugggcggggggggaagggccccuuguccacggacuccuccgggccgcccucugcggcacccagcacuguccugcgcggccggccccucuugaguacgguggcccguagcccucagcuugccccacggaacacggacuggccgguccagagcugcaccucgcggguagcaccuacuguaagcuucucugcuuccaguugucccaagagcauccuuccuacccaaaguagaagucguuguagucagagcucauugagggggacugcgggauugagaaucaagaagguaucuuugugcacgacguccacauggccagaaccuucuguuagcugggaaaaacagagugggcugugugagcaguuagcaguuccgauagaguagaucaaacgcucuuuacuaugcccacccuaccuguaacuugccguauaccgggaagcaagccagaucuaagccuuuacuucugcuuacaagugugugagcuccaacacagcugccagguugccuugacagauugucacauucccauaguagaaagaacagcuuuggauaggcaucuggacacguacuugcuacauauagugcuggcccagcaaccuuuuaacuuuuccuagauucugagugguaaaccccagguauacacugacccugauugcugggggcaguacgaaguuacaagucaaggaugauuuuacagugcugguggucacagggcaaaguagggauugggguugguuugucacucguggccucuguccucauauugcccaagagcaccagcuaucagugcagucucuugacugcauuaagagggguuaucuugguaugcugauaagguuuuuaugaaaggaaguacaaagggaagaaauagaccuggauagaggacuaccuuccaauguccugguuucuuuuacagaugccccgugguguggccacugcaaagcucuggcucccgaguaugccaaagcugccgcaaaacugaaggcagaaggcucugagauucgacuagcaaagguggaugccacagaagagucugaccuggcucagcaguaugguguccguggcuaccccacaaucaaguucuucaagaauggagacacagccuccccaaaggaauauacaggugugacccuagaacugcccuuuaauaacuguguaggcuuugggagcaaacccacaggugggggaaaaaaggcagggagaggcccuguucucaaguggguucuauaucaacucuugcaugugggagcuggggaaaguuccuccuuuggaguacuucacaggaagugucacaucugugaugaccugaguagccugcuggcugaguuaucuggugauugaccaaugaggaggaggaggcaagugcuuugcucaacacacggggcuuugaacuauuggugcuuccaggaaugcagugcuuccagauaguguaggcgugacacuugggugacgcuuuguagcugucacucacagggugucaguaccaggccagguauucaugauucucacugcauuuguaccuuugggaaccuuucauaguuacagcauucuaguuguuggugacuaaaugcaaauccagguggaucacccagccaccgcuaaaggaauuuuuguggagccuggaccuugauauaggcaauucaguuaguuacuacaagcaaaagacuugggcuucagcuggaggcgguggcacagaccuuuaauccucccguuuggggguagaggcugguggaucucuuuaguuugaggcuagccugguauauagagauacauacauacauauacucaugcagacauacacacucacauaugucauauaaaguaucuauauaucuccccuugagagcaguagugugccacucuagucaccuuccuaggcuaucugugguccuuuuuaauaugacuucacuauuggaguagaaaguuccuguccaccaggcagugguggcacacacccuuagucccauuacuugggaggcagaagcaggcagaacucucgaggccagccugcucuacugcucuacagaucaacuuucaaaacagccaaagcuacacagaaaacccugucaauuaaauuaaaaacaaaaacaagucgggcguuguggcgcacgccuuuaaucccagcauuggggaggcagaggcaggcguauuucugaguucgaggccagccuggucuacaaagugagcuccaggacagccagagcuaugcagagaaacccugucucgaaaaacaaaaacaaaaaccaccaaggcucuuugcccagaccuugcuguacuggcucgcuugugagcagcagcugggaaacagaggugugagcaucguccaagugugaggccauccuggugugggucucagccaccugggucugcagaguaagaccucaucugaaaagcacgcaguuugaucggcagagcacuugccuaacaugaagacgcaauuacagucacuaccacuuuauaaacuggguacggugguguuguguuuaaucuggguuuguguaugugugcaugcgcacaccugaagcauaguguauacuuguuuaucuugugcauucuuccagaagaguauguuggaucuccuagaacuuacaggcaguugugggucaccuaagguaggugcuggcaaccagacccagguccuuuuagaagaguagcaaguguucuuaagcuauugagccaucucuccggcccccuguccccaguggaaaauuuauuuauuuauuuauuuugguuuuucgagaaggguuucucuguguagcccuggcuguccugaaacucacucuguagaacaggcuggccuugaacucagaaaucugccugccucugccucccaagugcugggauuuuuuuuuaaagauuuauucauuauuuauuauauguaaguacacuguagcugucuucagacacaccagaagagggcaucagaucucauuacggaugguugugagucaccaugugguugcugggauuugaacucuggaccuuuggaagagcagucgggugcucuuacccacugagccaucucaccagcccccaagugcugggauuaaaggcgugugccaccacugcccggcaccagucaaaaauuuaaaggaaaaaaaagcagguuuuuuucuuagucaguaguaguggcacacuuuuuuuuuuuuuuaauaaagauuuauuuauuauuauauguaaguacacuguagcugucuucagauauaccagaagagggcaucagaucucguuacggaugguuaugagccaccaugugguugcugggauuugaacucuggaccuucagaagagcagucgggugcucuuacccacugagccaucucaccagccccguggcacacuuuuuuaaccccagaaacucaggaggcaggcggaucugaguuugagaccacauaccaagcuucaggacaguccggguuacacaaaaaagaaaaaaaaaauuuuuuuuaaagauuuuuuuauuuauuauauguaaguacacuguagcugucuucagaucucauuaaggaugguugugagccaccacgugguugcugggaauugaacucagaaccucuggaagagcagucagugcucuuaaccgcuaagccaucuccagcccccaaaacaaauguuuuuaaugaccacaguuacuuugauguucagcgaggcucuggguucucugagugagcugugucuuguuuggaaucuggcagcucagcuucuuguuggcacuaagcuguagaguacugguaaaucuaauguuagacgugccuugauuaguccaaaaggcacaguccaggaggagggcgucuucugucagccucucccuuaaggagggagcaggcucucuuucucaccgugucugcuuugacuagcacucaagcacacaauauuuuuccaguucauauccaucugggaaguggguagggcaaguuccagacaggaacaccuggcccaccggaggugucagagucaagucaauccuguuuuggggcagcagagcuagcacugagguuggcuaaccccacaucucuagggguguagccucuugugugaguacuguaggaauaccugaacaagaguguucaaggaaauaugggaaugcgaacagauugaggagaaaugcuuagucagcaggacauauuuucagaugugugcagucuuuccuccggugaguaccacgguguccucuucuggaauccagaggcuguagccaguucucuauaggagaauauuuugcucuaguaauaggcugaccuauccugagccucacgggcacagcucagaagagggaugcagcggcaggaugggugauacccuguuucacaggaacuugcauuuguuugggguauagcuggcagggaagcugaugacauugucaacuggcugaagaaacgcacgggcccagcagcuacaacccugucugacacugcagcugcagaguccuugguggacucaagcgaagugacggucaucgguuucuucaagguagagcuuuaagaauuccauuuucucugucuacuguccgcacagagggaggggcccugcuguuuuucaggagcacugcucaggguuggccaccucuguuuuucccuuccuauucuaggacguagagucagacucugccaagcaguucuugcuggcagcagaggcuauugaugacauaccuuuuggaaucacguccaacagugguguguucuccaaguaccagcuggacaaagauggggugguccucuuuaagaaggugagugccccuugggcagcugugcccagggcaggucagauauuggucugcagggggugguguugccugcucauauugggaaggaccaagugggcugaugggguggauggugaucaaggaucucugcuacaucauuuuggaguugugcuauggcaaccacuucacacuguggccuuuggaacagcuuucuugaccaccgacauacugggucuccugaacaauacaaggugguuguuauggcaagauaagagucuuacacuguagcucuggcuggccuugaauucacuguauagcccaggguggccuucaguucaugguaggucuccugccuccaucucucaagugcugaaauuacugaucugagccacauaccugaccuuaaacuuuuuuuuuuuaauuuuaugugcauuugugggggugccagauccccuggaacuggaguuaaaacagacaguugugagcuccucuguagauaugggggauugaacugggaucagcugagcuaucacucuuuaccacugagccaucucuccacuuuuaaguuccuagucuagugguauuauuuccacagugccaagagacuaggcuuuuuccucagcccagacaagagcucuagaaucuuuggaugugugaccccugugcugacucccacccuuauuccccgcaggucuccuaccuaaacaccuguaaauuccaguccuauugucacucuucuguagacaguguguguccuugcuauguauuccugucucagggacuaagcagacucuaguguugcugagggggccgagggcugcuuugucuuuugucccgagagccagggugauaccuauccgugguuuugcaguccagcuguaccaacguggggauucagucugggcagugguagugcaugacuuuaaucccaucucccaggcagaggcaagcagaucucugaguuggaggccagccucauguauagcacuagauccagcacuagucagggaggaguacacagagaaacccugucucaaaaaaaacuaacaaaaagccaaaaagauaggagacucucaugucagccagguagguuguguaguggacuggugaggacagaugaagcauagcugagagggucugauuggucuggagccauguuagccuagcaucugacauuguucuacguguauguguauaugugugugucugucuguugacauuguucuaugugugugugugugucuauaugucugugucugucugaaaagguuucaccaguuugagguugaaugaauuugaaggagaagaauaguuuggacaucugcaggggcaggggagcaacaacccccccucagcucacgucagugcuucugucugcugucuucacccagcagaggaccuaaugagagcagaaucgcuacauuauuagaugucucgguacauuuguccagaaacuuuacaguaucuugucugaugcgagguaugagaaaacucugggugaagucuugacacagcaaaagcucuuuucggguuuuagaaauuuucauucaagccaggcaugugaucacacaacacaccuuuaguuccagaagcagguguaagagcuauaaagaaaccuugucucaaaaaaaaaaaagaaagaaggaagaaaaaacuugauugcucuugccuuuaggugcagaucugcuguuuagacuguguauuugggaagggugggucguuguuugguucuugggugguuuuucaucuuuuuaaagauaaauuauucuaauaauauauacauuugaguauuuugcccaugugucuggugaacuguauguaugccugaugccugcagaggccacaagagggacauuagacacccugggucuggacaguuaugaucugcgauauagguccugugguccucuguaaaagcauccaguccuuuucaucacugaggcacacacacacacccuuuuuuuauuuuuuauuuuuuucuaggcaggauguuguguagccugggcuaguuuuuaacucuauagcugagacugccacccuugaauuucugaucuuccucuccugaguauacaaagacacucagugguuugggguuuguuuguuuugcguuauagacuuacucucuggccaagucugguuuccuucuguucccuucuuugggauauuagcucuacccacugaaugagcuggguuuuccucucuaccucagggaacucucugaggcagacuaguagggccagauagguucccccgugaggcaagccagccagcuguggggugaagucaguugcuacuugcuuuguguuuugccugaaggaugacaugcaaccuggauugaggacagagcugaagaaccaaggaagccagccagggccacuugcauauugucugucaugaccugguggggcuacuaguucuagagaaguuauggcaucugggugagaucuucaaaccaggccucuuugcagcagcccccacugagcaagagcuguuuucucauaguagacugaaggaauacugugugauguugucaagaggauagcaggccaaaccagauggucaguuucgcacgcugcccuccagugggaggcgggagggaggcacaggaacauuguucuauagaaggaggaaccucguggguggugaugcugacucagcaucacaccuggagauaguauuugagggcacccuccuuacuuguaucuuccagauagcacgcaguacauuccauucgguauccauuguggcuggcgagggaaagaugguguagaagccaguacccuauaggcucagucggaauuuaagagcacagcgggcucagccuggcuauucacauuccuggcugugaccugcuaugaguguuuaaaaugaguauugcugugcuccucccacccaccuaccccccuuuuaaaaugguuuuuacuugugcguguauuugugugucuguuguauggauuagauccccuggaacuggagugguaggcaacugugaacugcgugcuguggugcugagagcaucaccgugcuccuggaagagcagugcauacucucugcuuccuuuuuccuccugaccuggagagguauaggagaagauggccaaugagaaagaugagcagucagugcccacauccuugcauccaaguaucuuggcucagaaguauuuggaauaagcuggguuugauaguacuugucuguaauccuagcauucaacaugcugaggcaggaggaucacaaguucgaggucagauuggaauacagguuaagacccuguuucaacaaacaaaccaaaaacugggcaugcagugguaggucucugagaccagccaggguuccaugcauggugagauuggaaaacaacaguuauaccuguaucuaacaggagcaggcuuuuaccccuugucauugccuaaaccauacaguguaacaacuaguuguauuugcaguguuaugaauugucagcagccagcuuuauuuguuuuuuugugguuuuuuuuguuugguugguuuuuuuuuuuuuuuuuuuuugguucuuugagacaggguuucucuguguaacucuggcuguccuggaacucauuuuguagaccaggcugcucucaaacucagguccucuagaagagcagccagugcucuuaaccauggagccaucuccagccucuuuguuuuucuuuaucuagcagauagccugagaggucuggaucccucucuucauuguugcccugacuccagccuuaucccuagugaaccacuauuuuuugaaacaaguaccuacccucucagcauuuagcucuggagauuccugcuccauucuguaagagcaugaagccucuguagugaugucugcugccuuggccuggcagagacgacauuaguucaugccugugcaguucagucagagcagcagaaggaccaugagccaccagacauggggugugaaccugccacuggcuugugggcaggguguauccagcuuaggcuguugggggacaugcaaagcucacagcccccuuucuguccguaguuugaugaaggccgcaacaacuuugagggugagaucaccaaggagaagcuucuagacuucaucaagcacaaucagcugccuuuggucaucgaguucacugaacaggugggggggcccugagguagaguggggggggcugggacacuggguguauagcagaagacagaugcaguauugcuuccuguuccacagacagcuccgaagauuuuuggaggugagaucaagacacacauucugcuguuccugcccaagaguguaucugacuaugacggcaagcugagcagcuucaagagagcagccgagggcuucaagggcaaggugagcuaccucaggacaccggguucuuuuacaggggcuagcagucugcugguccucuguagugcuacccacuagggccagcccuguuggcuagcaaauacuuguuacucuaauuaagcagccccagacuuaagagcuguuucaagggugugagcauauggccagaauuugucuaaaugugucuuuucucccccaagauccuauuuaucuucaucgauagcgaccacacugauaaccagcgcauacuugaguucuuuggccugaagaaggaggagugucccgcugugcggcuuauuacccuagaggaagagaugaccaaguacaaaccagagucagaugagcugacggcugagaaaaucacagaguuuugccaccgcuucuuagagggcaagaucaagguguguaguuggaccugaauugugguaacaccguuaagcuugcaaaggagguuccacccgagggaucccgggccuugggcuuccuauaguaccucuuucaaacgcugaagaugacagcgcacguuccuuagcaugguuccucugaugguuugaggacgccguucuugucauauaccaaggucaaggcgagggaaccauagacagacucccuccugguguacuagccuagccaugcaccaagguagcuucaaagccacuaggacacuugaucugcauuuuaguuggucagccuugaagacuuagccuucucuuaacagauuccuggcaacaucagcucugguuucuggagggcagugugucucagcucuuccggaguuggaguguggggcaauguuguaccugacuguacuuucccucucuccacuuuagccccaccugaugagccaagaagugccugaagacugggacaaacagccgguaaaaguacugguuggggcgaacuuugaagaggucgcuuuugaugagaaaaagaacguguuuguugaauucuguaagugaggaucucuggguucccagcuuggcuccauaagggggcuggcaaccucaaacgucggugguggcucuguccaggacgggcucgcagcacugcucucuuucagaugccccuugguguggucacugcaagcagcuagcccccauuugggauaaacugggagagacauacaaggaucaugagaauaucaucauugcuaagauggacucaacagccaaugagguggaagcugucaaaguacauagcuuucccacacugaaguucuucccagcaagugcagacagaacgguguguuuuccacccuaugggcuggugggcaaacaguucuucagacacuccugcuauacggcaggugcugaucuaugcuaggcccaguucaacccucuucacuucccuuccugcaggucauugauuacaacggcgagcggacacuggacgguuuuaagaaauucuuggagagugguggccaggauggagcaggggacgaugaggugaguguggccaccucuggguccaugugggagguccuagcucaggcuuugacuuggacuuugguggccauguaacaggcacagcugugacccuagacuuugccuuugguuugaaagaagugcucgaugguuaccacuuagacagcagggauguuaaaggugccuuucaaagccguccuauagccuucucuaacccugcuguccuagaauucacucugcagauuaggauugccucaaacugagagauccacccuccucugccuccugaaugcuggaaucaaaguuguacgccagcacugcacagcugauuccuguuauuguguacuuaaacuucuagccaauugucuguuguuugcucuguggauaccacacacuaguuacuagacuagagaguagacauaggcugccucccacucaguagaucuauaccuaggaagcucggcuugcuuaugacuguuaaccuugauguugcugauauggaggaagcagaaggcagaucaggauuugauaggguggagcuugagguccaccuagaaauccuguugaagugagagguauacuggccccaagggaccuauuggggaguagaguaagugcugccuucuguccauaugcaguacucugcacuccacacacagccuggcaaaguaaccaacggcugcugugcugcagcuugugcugggccuguugucccugccugggcuggggcucugcagguuccuagcaccauuccugguuggcugggguuccugacuggaagacaugccgugucuugccuuauacacaaccaggccacugcuggugaugguggccagguccuuggugaucagcgagugcugguuucacugaggacagccagaguguagcuuuguuccuuuaacugccccuuccuucauccaggaccucgaccuagaagaagcuuuagagccagacauggaggaagacgacgaucagaaagcugugaaggaugaacuguagugcagaagccagaucugggcgccugaacccaaaaccucggugggccacgcucccagcagcccacaucuccggagccugagccucaccccaggagggagcgccaucagaacccagggaaucuuucugaagccacacucaucugacacacguacacuuagaccugucucuucuuuugcuuuucaauuuuggaaagggaucucuguccaggucagccccucuugaagggcuaccuuuuguuuuaauuggugguguacuuuuuuguauguggaauuugucccaugugcuugcuaaaauguuuggggaucuccucacacugguaaugucuuuccuguuagagagguuuaugcuaccacuucgcauuucaucugugaggcauuucaucuuuuagacaugucuucauguccagcuacuuguuucaccauggcagaccucccugagccuucuuccugcccuggguaggaaguguggcucugggucuguggucacucuccaccuuguccuaguguugccaugguagcauggcuuuguaguuugcauuuaaccuggggaucuaugcauccugucaagaggguggguccccauccccguguguggaaaagagacaguguggcuugcugccaggcucaggccaggucuggacagcucucacucuccucaagccaggacuaccgaccagccggcuaugggcacauuacucuguggcugcuggauucuuuuccagcauggccuguggccugugugaggcagaacugggacccuugauucccagauugggagucagccaaggacacuggggcugaaugaaaugcccauucuucaggcauuucuaccauaauauuggaauugaacacauuggcuaaauaaaguugaaauuuuacua

SEQ ID NO: 12199 - RNA, 5196 nt, Mus musculus
gcggcggauucugagcccgguccggcccggccuucccagcgcgcuuggcccggcccgcgcaggcggccaguccuccuaagcccccggcccggacccuucgcgcccgccccagccccgcgcagccccggagcgcgcgcgcgcggccccgccccagccccgccuuggcccgcccgggcccgcaguguggugagugcgcggggcuggggcgggcggcggggccuggccucgggguugcggcgcacccgacggcagcgcgugccuugguuuccccgccagccggcuguucgccugugucccccuagagccggcggaccgggcgaccgcgaggcuggggacgggcgugcgcgcggcggcggaccccgggugcccugcggggggcgcgauuuaagggcgagcugcgcgcgucugcccgggucagcgggguggccgcaccgagcugcugacucaucagguguccgucggcuuccgcgcgggcggggucgcgcgcgggcccacaggggaggcggcggggagacccugcugcgcggcuugggcucgccacgcgggugcgagcccagcggagacgugcugagucaucagcaugaggucacucggugcuccugcugacgcugggccagggcggggggccggggcccgcuaucggccggucuagucgggagacagggcucgauccggguggugaaggucgggccgggauccggggucguguuuaaguuugacagaccugugaguuggaggcaaaggcuccgaaggaggcauugcaggggcgcgccgcagguuucucccgggguggaagguaaagccccgggcgugcgcauccuugccugguucuugggcuccuggcccgggucccacaacuggggcaguuccccaaacccggagaccgaucgguguacgcugaggggaggagcuuaggugggccgagccagcucgucugggaagcaagcuuuccuucucugugacccugaauggccaggcuucgucgguccuagauggggaagaccgggaggcagggggagaagggucuguggcuugaaagaagcuggggcagcucuaaccagcuaaggagagcagaguguggaucuaggcagcuggugagaguuuuugaggugcaaccauggaguagaagauguaguuuuauuuaucccaauguuauuccuuucagaagaguuuggggucccacuguugccuggaguuaccaaaaagugugugugcccuguugggugucuggagacucuugggaggugacaguuuugugggguguggcugaauggcuguuuacugacuuaucugucgugaagguucuugaacuccauccuacugcuuuccuugcccagggauucaugucuagacugugcuuaccuugugguuugugcuaagggauguccccuuaacccugagcccugaggcugcucauaggugcaguguuuuuuucauuugguguggaacuugcccuaugaaacuucaagguuccagaaaauuguuaaacuccggaggcacugugcuucagugaacuuaauguuuuccguucucuucaaacaaugucaguaccugaaggagagaagaccuacguagggggucuccugcauugagguuuacaggcaagguuuagcaaggaagggucacuaucuugcuugagacuaauguccagauugucuagugugagaggacagaggugcccaaaccccuucuuuaagggucagccugaaugagugguccagagccccuuggugucuugagucuguccauaacugugaguacuuggagggcugaguuggaggcagcagguccagaucagcuucucugagcuucuuccucaggcucuggaaagcucucuaaacuguaucccucagcacagcugucccccccagaacugucugccuagucacugugucccuagguuugcagaagccaggcagguagcuggaagaauuggcuuuccugagaccugcccuucccccuuaagcacacaugcguauaaacauguacacacacucgcucuaacacacacacauucucucucucucucucucucucucucucucucucucucucucucucucucucucucucucucucucucucucucucgugcaccuuugaucaggaggcaguuggcugcacuugugcugaguucaggccuuugguggagguaaaaucuguugagaaggcacuuuucagcucccagccgccacacucugcacuuuccugugcgaucucaggaagucaccguuuugagcucagcagucuguauaagggaagcuccugccaggacuguccccucaccucgacuuaugcuccuagugugaguauagggccaacuuguaagaaagacagaugcccuucagaccucuagaucugaguucugccuuucucuuugaucuagcaguacuguugccucugaaaaugcuccuaaucuaguccuguagauuuaguccugguuugcuugcucaguguuugcauguagccacaccuccuguucaaagcuaaaagcaguaggguaaagcuaaugagaauguguuaguuccuuugauaagaugaaccaacuccccauccagcacauuuuugccugaagugcucacagaccugcagcaaccucacuucccucauuucccugcaccuaaccuggaaaggagaggaugugccugugggacugguggguguugggcuaaguggggauucccagccuagguacacaagaauguccuuggcaaggcuuuagaaagcugaaaaugagguugagcccggaggggcggcugacuguaggagggaccuguuuugcuuuuguucccuggcccuguggucacugacccuaggcagagagccaaagaccagucagugaccugaaggggcuggcucuugccugcuuccagcuaacagugcucuuccucugcuaauugugggagcccuugugaaacacccugugucggguggggcaagaguacaggaugcugcaaccaagccacaggaugguuaccccaucuguaaaggagauggacggggaggacuggaggggccugggcucagcuccucccagccggauugccugcuaccuggaaggugagaggauucccagucagccaguuagaacaaaccuuauccucugccagacugaggcaggaagcaaccuccuaccuaaguccuagagggagaaagggcuuucuuuuguccugggccagcuuagggaacauauaugggaaguaggaccuuggaauacagggucccuggcugauccuugcuugcuguuggucccaguagugggucuccuggggaacugcuggcuggccaaaggaccgggagaacggcucaggaagggagggaggcgauccgcugagucagcaugacucgccaggaacagggcgcucuggggcagcacugggguuauuuuuaaagcucagcuuccuucuaggcuugccccuccugcagcccagaccuucuaaucucucucugcucccuuugucuucugccuucacauugcuccugcuucuucccugggaaaaaaaucucccgaccucccaccuggcucucuagggacagggccuucugaagcagccaagcucaggucaggugaggggcaagguucugugggcugagcaccaggcagcaagcuuccuguugggguguaaaagagucucaggguccugaccuaugcucugugucuugcagagugccugcucacugugucccccggguuaugacgacccccaauaaaggaaacaaggccuuaaaggugaguagagaggcugggcuuggggugcgucgggcugggcaugccuacucugccaugacccugugugcugugccacuccaggugaagcgggagccaggcgagaauggcaccagcuugaccgacgaggagcugguaaccaugucggugcgagaguugaaccagcaccugcgaggccucuccaaggaagagaucauccagcugaagcagcggaggcgcacacugaagaaccggggcuacgcggccagcugccgcgucaagcgggugacacagaaggaggagcuggagaagcagaaggcggagcuccagcaggagguggagaagcuggccucggagaaugccagcaugaagcuggagcucgaugcccugcgcuccaaguacgaggcccugcagaacuuugccaggaccguggcccgcagcccuguggccccagcucgggguccccuugcugcuggccuggggccccugguuccuggcaagguggcugccaccagcgucaucacaauaguaaaguccaagacggaugcucggucauagggacacgugcaguugccaggcaggucuuugaggggccacuaggugcguggcagaguuggcagccccgucccucuuccuuucauuucccuuccuuucuccucucccuucccuguuuccuucccugcaaagcacaaccugcacccaggggcacugggcugagccccuugaucaucuucguugucacgccuguguuucguacguugggaucagccaguucaacagugauguuggguugcccuuaaccccuuuguaccaaggccgugcaggcuaggaguccagagugggcgcugugggaguggacgagagugcacgugggcaaguguacuggucuuggggcugcccuugucucccugguggucugcagugggauuugagcgcuuuccuuucagaaguccaguggggcucucagcuuaauccagaaggaagagaugggcucugcccugaaaagugguuaugucuugacgccccugggugaauaggccaccagccugggcacuggggcaggaaccauggugcuggagccuggcacagugcaccggacaagaccgaaucgccgguuaugaguguggguggaaggugugucuguguguccgauggguccggugucacuguuuacaugaccuauuugugugguuauauagcccuuuauuuaaaagagaaguuccuuuuacggaguuauuaaauuauauguuuaagagcuaaaacgaaaaaaaaaagcugcagaguauuuauaaaauugucuuaaaaaacaaaaacaaaaacaaaaaaaacauuugaccguauacauggaaaagggaagaaaguauaguagaaacuuugcuaguuuaaaaaaaaaaucccuuucuuguaaaccuggggacagcgcuguggcuguuggaguuuaguuuuuauacacagaguuaucagacauuacuuauaaaacuuaguuuaaa

SEQ ID NO: 12200 - RNA, 18591 nt, Mus musculus
guggaaucgcagcgacacggaccuguccccccgcguggcccugguguccuccucagugcagaguuuccagugugaccaagcacgcccgacccacacugcgcgcgcacagugcacaccuggcaccggccgcgagggggugggggugggaggacagagaugagggcgucgggaugagccccgcguggcccgcgcgaggccgggggcggggacggaagcaggcgggggcugcgcguuccuugugcuccagcgcgcgcccgugcagggucccggcugggggcggcgcgcgcgggcaucaccccaccggcggcggcgcgccgggucccggggcgcagccccgacgcucauuggccugggcggcgcagccaagcugucagcccauguggcguggccgcgcggggauggccgcgguuuaaauagcgccggcgcggccuagagggagccagagagacggcagcggcgucccguccaguucgccugccgcgcuccucgcuugucgucugccuccagagcccagacagguacgccgcugcguucgggguuccggggcggcaggccggugucgggaugccacggcuccaguggaaggauaggcgggcgcccauccucggcaccccugcgcucacaaaagcgccgccgcgccccuccgacagccagccaccgggcugagcuccgcgaucaggccgagaggggcgcgggaggggugugcggagagccagcgcggcgggccgcugucacgugggcgccgcgccaaccgggugcaggagucugggcgccucguggauggggccggggccuucacucgcacugggcggcuuuggcagggcgcaggaggccgcggugguacccgggcuucagcuuggagaaggcagaugcgggucugggugcgcacgaggccccaggggccucagcggaagucaucagaccauccaggccucaccggcuggguggcacggaagccuucucguuggacuacgguugcaaggccugaacugcccugggcaagugccuuagggacaggaggaucuagcagauccuucugcugccucggccagguuacaaaguguucgaccagauggcgagaggcuucaccuuuccccuaaccgcaccaagcugagaguaguauuccaggucggaccuugcugaaaggguccauuggcaggggaucgguuugccucagcccugcuaggccugggcacucacuaguugucgggccuguucccucuggguccuaaccaagccuggcguccuggcuggcacugaacggcagucagucuccacccucuucgugaaagggaagcgcgcuggcuuccccguggcuuaaggugagagugccccagacccuguuucuugaagccccacuucuguuugcaaguuccugauuugacuagccugggauggagcauccaguaggcaacuggagauccuauggucccagguagcucuggcaaaacaugguagggucaggccaggucaagugucuacccuggaagggcugacaaucucagaaguagcuaucagugcaaggagaccuaagcacucagcucauccguuguuuacagcugaguucugcuaguuuccacugggggcuuucugagcccuugcucucagaaagucuugaggugugcuaccuguggauuuagguggcuguagcugggaaugacugugagagacccaccaugcuaucuucccccacagagaagagccauggaggagguggugauagccgguaugucggggaaguugcccgagucagagaaccuacaggaguucugggccaaccucauuggugguguggacauggucacagaugaugacaggagauggaaggcuggugaguguccccucgggaucaugcagcaggauggucugagaguuuaugaccaaggcacuucuggagacagggaacucccuguagagcuagcugugagguugagaaccggucagaaugaaaagggacaggugacuugguugaucccucguggaggacaccaaagguggaucauagaagggggcuggcccuuuggauaucucaucugcagccugugcccugagcuggcagauggugucuaagaugacucucacacccaaugggcucuaacagagccacagagcagcucuaccugauggacaggugugagucagcauugggcuggccuggccagccugggagcaggcagagggucucccagucgccagccucaccuccuacaggguuggcucugggucacccacauguggcuguuuugggacuccucacuagcagugagucugggucacucucugggagccuggcuucagaggcugugauguuccucagggcucuauggauuacccaagcggucuggaaagcugaaggaucucuccaaguucgacgccuccuuuuuugggguccaccccaagcaggcacacacaauggacccccagcuucggcugcuguuggaagucagcuaugaagcaauuguggauggagguggguuguuggggaauuccuacccuuuuuagaacauacuguaaugagggcuggggacauaguucagugguagcgcaacuugucuagugugugcaagaaccuggacuucauuccugguacuguuaaaaggaaaaggagaugcaacaauaauaucuuuuuggcucuugagacaucaagggcucagagacaggccuggcaugggucucucuagcuauguccccaauccugauacagggccgguggcucaggaggcgggggcccugagcagggcacaguuucacaaccgcacacuagaagugucccaggcgcgcccuguuacccuaguuuccucacuccccaaugucugguuguucuugggcugagggcggggcuuacagcagguagcucugcaggggcucagccucgagcuuuggcaacaacccugucccacuggcugucucuuauucuggauccuacugcuugggacauggaugugcccccagggauagaaggcccuauagugggcagcgaguguggguugguauggugggggugcgcuucagguugggagauguuaauuagcccuauacuugauagacagcuugaugcacaacugcccugggguaugguauaagaccagcgagcccuuggugaaaaugaaggcccucaccucggaccugucuggcugcccaggcucuaucaaaggcugggcacagcucccaggggguuacccacgguccucugcuuucccggcuuggacacuuggccuuuguguuccuguaucuccuuaucacagccugucccagggcaggcugcccuuggcacuagagaacucauuggccagcagccucuugagacccaccaguaacaccagaggccaagggaguugccuucagacaaugcuguucucugucuuuccuauggccuccuauggguugcugccugacccagaccuuagagguucacuguggccccugauggcaucucucucacccaagccuguguggcucuugcugcccccggcagguaucaacccagccucacuccgaggaacgaacacuggcgucugggugggugugagugguucagaggcauccgaggcccuuagcagagaucccgagacgcuucugggcuacagcauggugggcugccagcgugcaaugauggccaaccggcucucuuucuucuucgacuucaaaggugggugggcagcccagccuugggcacgggcccagcugcaugagugcauucaccuagacaacccuuuaggacuuccuuauuccugggggaacgcugagugggguacucaaggccccagcggggugcggggggugcggugugggacagcaucugcccuuguccacaggaccaagcauugcccuggacacagccugcuccuccagcuugcuggcacuacagaaugccuaccaggccauccguaguggggaaugccccgcggcccuugugggugggaucaaccugcuccugaagccgaacaccucugugcaguucaugaagcugggcaugcucagcccggacggcaccugcagauccuuugaugauucagguaaggguggccuggggagcgaucauuaggcucugcuuugcagggcuccagccuguacccugaguguggugucuuggcuucugaugggcgcacacauguauagacucacaacacacacaccccaucaccccagagcaccuagcugagguguugaccuacccuagggaguggauauugucgcucugaggcuguuguagcaguucugcugacuaagaagucccuggcucggcgggucuaugccacgauucugaaugccggcaccaauacagauggcagcaaggagcaaggugggcauggagggaaaagaaagagcauggaucauaagaaauggggaagaggggcaugcaaggcuucauaccauaccguaccacuacccaucuaccguagguguaacauuccccucuggagaaguccaagaacaacucaucugcucucuguaucagccagcuggucuggccccggagucgcuugaguauauugaagcccauggcacgggcaccaaggugaaagcccuuucugacccauaccugugacuccucuacccuuguuagagguccuuccggcugcagccuuaaccuacucuguccccugcaggugggugacccccaggaacugaauggcauuacucggucccugugcgccuuccgccaggccccucuguuaauuggcuccaccaaauccaacaugggacacccugagccugccucugggcuugcagcccugaccaaggugagcagacugggcucugggucaagagucccuguuauguggauagcuguguaguguaaccauuacuuggccuaccuuggggcuccugccugccuaccagcuggcccuuugacuguaccgugggagcauggggcuacccuuauggcacguucccugugguagaugugccgacuuauauagcuucuggccaaagggaaaauuugguugcaaaaaggaaagguacaguucugaagaaguaucuaggccuccuucugaggugagggaggauugagccaacaucugcuauggcgugcccuuuccugcugggugaccuugcacaccugccuguccacuuguugggaccuucagcuugcuucuacauugggggaugugugguugucucgaugacccaucuguuugggcuucugggccuggcuuggggggguuguguguucaggccuacggcuccucaacuuggagacaugcacccuagaugacacaaaaaaacaaggucagaggacaagggucuuggugcucaguaccacacacaggucacgggcccaggggagguagauagccacacuuggugggaacagcugcccaguaacuguguucuauugcaggugcuguuaucccuggagcauggggucugggccccuaaccugcacuuccacaaccccaacccugagaucccagcacuucuugaugggcggcugcagguggucgauaggccccugccuguucgugguggcaacgugggcaucaacucauuuggcuucggaggcuccaauguucaugucauccuccagcccaacacacggcaggccccugcgcccacugcacacgcugcccuuccccauuugcugcacgccaguggacgcaccuuagaggcagugcaggaccugcuggaacagggccgccagcacagccaggaccuggccuuugugagcaugcucaaugacauugcggcaaccccuacagcagccaugcccuucagggguuacacugugcuagguguugagggccguguccaagaagugcagcaaguguccaccaacaagcgcccacucugguucaucugcucaggugagccugccccuguguucccaggcugaccuuuaaaggaggaggggggugucccuuuuuuugagggugaggcugauggguggccaugcuguggcccugauaagcuuucugucacagggaugggcacgcaguggcgcgggauggggcugagccucaugcgccuggacagcuuccgugagucuauccugcgcuccgaugaggcugugaagccguugggagugaaagugucagaucugcuguugagcacagaugagcgcaccuuugaugacaucgugcaugccuuugugagccucacugccauccagguaugccacccguguggugcaggcauccuggggcacuugugccaagguccugccuuccgcaccaguaucacauaguccuggaccagucugguguguaggcagagccuuauacugguacgagccuggggaaggguaggacuuucucagaggucucugagagaggccugguacccuuggccugcugggcuuuacgguuagggauugucaggcuagugaucuaggggcugugugacauggccuggguccccgcuucacagauugcccucaucgaccuacugacuucugugggacugaaaccugacggcaucauugggcacuccuugggagagguugccuguggcuaugcagauggcugucucucccagagagaggcugugcuugcagcuuacuggcgaggccagugcaucaaagaugcccaccucccgccuggauccauggcagcuguugguagguauccuccaaagggcucccaaccucauuaggcaccagaaucuuccuggaagggguuucuguccuggguccuccaaaauaaccugcugcuuugguguaggacaugggguugcaaagggagaggucacucuguucagguuaucuacaguuucgaccccacaggccugagcagagucugaaacaccacacaugagaugagggccagggaacugaggagagcuucucacuagcccuggguguucacugcccagcuccucagcugcucacccugacgcuucccuugagaucagacacagcaagggggaaaaugcccuggaaggcggacauuugucauuucaccaacaacauuggccccagguagugcucauguccaggaggaugggcugggcucugaggccagccacucuguuugcagguuuguccugggaggaauguaaacagcgcugccccgcuggcguggugccugccugccacaacucugaggacaccgugaccaucucuggaccucaggugggccugcaguccuagcaggacuucuguucccugcauuuugcccuggcccuaccuaggaggccaggccuccucagucugugucuaggcccagcuggugagcuccccuugucucaggcccucugggugaaaccuaagcugggcggacugugugugugucugaccagggagggccaguccaggugcccugaccacucuccuugaugccugcaggcugcagugaaugaauuuguggagcagcuaaagcaagaagguguguuugccaaggagguacgaacaggaggccuggcuuuccacuccuacuucauggaaggaauugcccccacauugcugcaggcucucaagaaggugaguaccuggcuguaugaguagaccugagggcgggugacaugacuucacgugcuaacccagcuccugugcaggugauccgggaaccacggccgcgcucggcucgauggcucagcaccucuaucccugaggcccaguggcagagcagccuggcccgcacaucuucugccgaguacaaugucaacaaccuggugagcccugugcucuuccaggaagcacuguggcacaucccugagcaugccguggugcuggagauugcgccccacgcacuguugcaggugagcaccuggucugccugggauaggggcccagcagccugccagucacuggagaaggcgaguguggcacggaaggggucagagcccagccccucuuugcucuguguaggcuguccugaagcgaggcgugaaguccagcugcaccaucauucccuugaugaagagggaucauaaagauaacuuggaguucuuucucaccaaccuuggcaaggugcaccucacaggguagguccgguccacucuucuuucuacuacucgcuuaggggaccacaucacccaccaacccagaagagggguugcugucagccuagcucaguucuggccaucgguccuggggccagguaugucacucagcucuuuuaucaccagcaucaaugucaacccuaacgccuuguucccaccuguggaguucccggcuccccgagggacuccucucaucuccccucacaucaagugggaccacagucagacuugggaugucccgguugcugaggacuucccaaacggcuccagcuccuccucugcuacagucuacagcaucggugagccaggccucguggcgggcagguuccuucccaggcaugugggccagugcugagccauuuguccuuacagacgccaguccugagucgcccgaccacuaccugguagaccacugcauugacggccgggucaucuucccuggcacuggcuaccugugccugguguggaagacacuggcucgcagccugggcuugucccuagaagagaccccugugguauuugagaaugugucguuucaucaggccacuauacuacccaagacagguaagaggccccuucggugggggcugcggagauugauugucaugccugcucugcugacccuccuucuuccucugcaggaaccguggcgcuggaggugaggcugcuagaggccucccaugccuuugaggugucugacacuggcaaucugauugugagcggugaguagggccuggcugggucugugggcgagggaucccagcuccuggccugccccaugcuaaggcccuccuguugcuuugucuccuacaggaaaaguguaccugugggaagacccgaacuccaaguuauucgaccacccagaagucccaacacccccugagucugcaucggucucccgccugacccagggagaaguauacaaggagcugcggcugcguggcuaugauuauggcccucaguuccagggcaucugugaggccacccuugaaggugggcaagagcaaccucugagucagugagcaugacugccagaagccauguccugcuggggauggggaagacagggaggaaggacguagaggcgcuggagcaguugaggccuggggugcugaccagccccucugcugcaggugaacaaggcaagcugcucuggaaagauaacugggugaccuucauggacacaaugcugcagguauccauucuggguucuagccagcagagucuacagcuaccuacccgugugaccgccaucuauaucgacccugccacccaccgucagaagguguacaggcugaaggaggacacucaagguagcucuggcccuagcucuaugcccuugcauccugggcugggcauugccuacacuaaccagcgugucuccauaguggcugaugugacaacgagccgcugucugggcauaacggucucuggugguauccacaucucaagacuacagacgacagcaaccucacggcggcagcaagaacagcugguccccaccuuggaaaaguucguuuucacaccgcacauggaggcugagugccugucugagagcacugcccugcagaaggagcugcaacugugcaagggugagggucccaagccuucuccccuccuccuucacucucugccucugaaacucgccagacaaggccuggacaguggggagcuugggguugaugagagcagccuaccuuccaugggccuccagcacaaaacuacugcauccuuccuuuuuccuucccguggcuguuucugcuguggacaagcuaggaagugggcccuggaaguuggcgggaggccuuagagagagaacauaggccuuucuccaucccaggucuggcacgggcucugcagaccaaggccacccagcaagggcugaaggcggcaaugcuugggcaagaggacccuccacagcacgggcugccucgacuccuggcagcugcuugccaguugcagcucaacgggaaccugcagcuggagcugggagaagcgcuggcucaagagaggcuccugcugccagaagacccucugaucaguggccuccucaacucccaggcccucaaggccugcguagacacagcccuggagaacuugucuacucucaagaugaagguggcagaggugagugcuggaaagaagguggacaggccaugugcaugcaucuggggcagucucgggcccgaacccgaaacaggcagucgugauguagcagcuuacugugccuuugugcuuugguuuguuccacccuaaaagacuggaaauauuuucacugcuaccagcccaggggaugagauaucagaaguaaggcuuaugggaaagaauccugggaugcuuugggcucucagcuggggugucauaggcagagucuacaggagaguagaguagagcacugguagagccuccuggcuggcaucaacaugagacugagcagcacgaggggugcucacggcuggcauugccacgagacugagcagcauagggggugggggaugcucacccaguccccaggguuucugcuuccuagagacaauagaucuaagaugcccucccaccccaggugcuggcuggagaaggccacuuguauucccgaaucccggcacugcucaacacccagcccaugcuacaacuggaauacacagccaccgaccggcacccccaggcccugaaggauguucagaccaaacugcagcagcaugauguggcgcagggccaguggaacccuuccgacccugcgcccagcagccugggugcccuugaccuucuggugugcaacugugcauuagccacccugggggauccagccuuggcccuggacaacaugguagcugcccucaaggaaggugguuuccugcuagugcacacagugcucaaaggacaugcccuuggggagacccuggccugccuacccucugaggugcagccugcgcccagccuccuaagccagguacugcgccuagguacacagggcagguaauggcuggguaugguucggccagcucaguacuuaaugagacuucauacacguaggaggagugggagagccuguucucgaggaaggcacuacaccuggugggccuuaaaagguccuucuacgguacugcgcuguuccugugccggcgagccaucccacaggagaaaccuaucuuccugucuguggaggauaccagcuuccaguggguggacucucugaaggucagacucuggggcuggguaccuugccuugccuggcauaugaacagcccugaggcugacccuccuuuauccugcagagcacucuggccacguccuccucccagccuguguggcuaacggccauggacugccccaccucgggugugguggguuuggugaauugucuccgaaaagagccggguggacaccggauucgguaggaaagacucugagaggugccuacccuuccuccuccccucccucccuccagucuugguauccuuacucacuuugccccacagguguauccugcuguccaaccucagcaacacaucucacgcccccaaguuggacccuggcucuccagagcuacagcaggugcuaaagcaugaccucgugaugaacguguaccgggacggggccuggggugccuuccgucacuuccaguuagagcagggugagcccacugaugcccuauaccugacaggccaaggaggaggugggggacaaagagcuggccagguaggcacugugacacacauauccuugcuuucuuuucccucagacaagcccaaggagcagacagcgcaugccuuuguaaacguccucacccgaggggaccucgccuccauccgcugggucuccuccccccugaagcacacgcagcccucgagcucaggagcacagcucugcacugucuacuacgccucacugaacuuccgagacaucaugcuggccacgggcaagcuguccccugaugccauuccaggugccaaccaggauggggucuugugacugggucgcuguggaaguagggaaugugccugugccauagcagcccagcgagaaggaaguuguccugcacagcuccuggggcagagaggguccccagcaccagggcuguacuugcacccugugccccugacaaccuguccuagaguggggucuaacgcgagccucccuccugucugcucagguaaaugggccagccgagacugcaugcucggcauggaguucucaggccgggauagguguggccggcgugugauggggcugguuccugcagaaggccuggccaccucaguccugcuaucaucugacuuccucugggauguacccuccagcuggugaguggguggcugcaguugggagaugaugugaucuugguugguggccaggcugagucgaucuugugcuguguacccucaggacccuggaggaggcggccucugugcccgucgucuauaccacugcuuacuacucguuagugguucgcgggcgcauccagcguggggagaccgugcucauccacucagguucagguggugugggccaagcggccauuuccauugcccucagucugggcugccgcgucuucaccacuguggguaaggccccuuaccucucccaaacccuuggagcuucuugagccccgugccccaaacucacuggggucucuccccugacaggcucugcagagaagcgagcauaccuccaggccagguucccucagcuugaugacaccagcuuugccaacucgagggacacaucauuugagcagcacguguuacugcacacagguggcaaagguacguacgugucccccgggccgcugccugagacuggaccacacagucaaucuggcccucaggacugagguaugggugagcccacccugaccgagugaccuguuugccacuauaggggucgaccugguccucaacucacuggcagaagagaagcugcaggccagugugcggugcuuggcucagcauggucgcuucuuagagauuggcaaauuugaucuuucuaacaaccacccucuggguaugacugguaguccagggagcagggcugggggcugguguuggggccagaggcguccaucagugaacaugacucuccucuucaggcauggcuaucuucuugaagaacgucacuuuccaugggauccugcuggacgcccuuuuugaggaggccaaugacagcuggcgggagguggcggcacuccugaaggcuggcauucgugauggagucgugaagccccucaagugcacaguguuucccaaggcccagguggaagaugccuuccgcuacauggcucaggggaaacacauuggcaaaguccuuguccaggugaggugaggcgagguccucgggcgcccagcccgccuuggccuuucuuaguuuguuacuguguguggcgggcgugugugggagggaggacagcgugguguaggaguugguucucuacacacgcacgggucagcaggcuugguaccagcaccuucagccacugcuacuuaucugcagguacgggaggaggagccugaggcugugcugccaggggcucagcccacccugauuucugccaucuccaagaccuucugcccagcccauaagaguuacaucaucacugguggccuagguggcuuuggccuggagcuggcccgguggcucgugcuucgcggagcccagaggcuugugcugacuucccgaucuggaauccgcaccgguaagcaaguaggggcggcugguaauuaauguaggcuucccuuugaugggagguguucuaggaugggcugcaggccacgcuuauccucuggugcagcuccauagcccugugucccauaggcuaccaagccaagcacauucgggaguggagacgccagggcauccaagugcucgugucaacaagcaacgugagcucacuggagggggcccgugcucucaucgccgaagccacaaagcuggggcccguugggggugucuucaaccuggccaugguaagaaaggcaggcaggacucugcguaccucuagagccugagacccaggguagcugcuaagugggguuagaaccucagagccgcagcaagcacuaaaaccucugcuuccagguuuugagggaugccaugcuggagaaccagaccccagagcucuuccaggaugucaacaagcccaaauacaauggcacccugaaccuugacagguaggcugucagucccucuguugaguuuuacgcaugcucgcaauguguauugguuccugcugugccaccuguggccuucgcacugcccuggggagguuaugggcuuagggacaugagagcugucugagcugucagacugacacacgcacccacagggcaacccgggaagccugcccugagcuggacuacuuuguggccuucuccucuguaagcugcgggcgugguaaugcuggccaaacuaacuacggcuucgccaacucuaccauggagcguauaugugaacagcgcaggcacgauggccucccaggugggcuucucuguccagcccgccccugcuuguggucucacuccccaaagcaccucaccugcugccucccuugcucacaggccuugccgugcaguggggugccauuggugacgugggcauuguccuggaagcgaugggcaccaaugacacagucaucggagguacgcugccucagcgcaucuccuccugcauggagguacuggaccucuuccugaaucagccccacgcaguccugagcagcuuugugcuggcagagaagaaagcuguggcccauggggacggggacacccagagggaucuggugaaagcuguagcacacauccuagguaagccagcuuugggguccugcccagcccaguugacuaaguaucagcugucccaucuguagaagcagaggacagaguucuguggucugaaugcuuggcugggugauugucaguaaugcuggagagccacagcauguaccugguccccauguccccuucuacauaauggccacuuaucuccuucggcaggcauccgagaccucgcagguauuaaccuggacagcacgcuggcagaccucggccuggacucgcucauggguguggaaguucgucagauccuggaacgagaacacgaucuggugcugcccaugcgugaggugcggcagcucacgcugcggaaacuucaggaaauguccuccaagacugacucggcuacuggugcguaccaggcagcaggcugagaaaguccugcuaugucccaucaggggcagccaguaguggaggcaacagcucugcccuuuuacaaagagcacuggggccugugcuuagucugugugcauguccucacgagcccacaagccaaggcuacccugucuccuccgucuuuacagacacgacagcccccaaguccaggagugacacgucucugaagcagaaccaacugaaccugagcacacugcuggugaacccugaggguccuacccuaacccagcucaacucggugcagagcucugagcggccucuguuccuugugcaccccauugaggguuccaccaccguguuccacagucuggcugccaagcucagugugcccaccuacggccugcagugcacccaagguacugugcacauugcggagcaguacucacugccucgggccuugguaccccgcuaacugcuaagcuauucugcuuguuguucuagcugccccccuggauagcauuccgaaccuggcugccuacuacauagauugcaucaagcaagugcagccugagggacccuaccgcauagcuggguacucauuuggagccuguguagccuucgagaugugcucccagcugcaggcccagcagggcccagccccgacccacaacaaccucuuccuguuugacggcucacacaccuacguguuggccuacacccaggugagagcugggccaacugguccuaaguguugcuaccugugucuuggcuuugaauucacuucugggaggguccugguuccuucagcacuugccacagcaaucucuccuucccugacagagcuaccgggcaaagaugaccccaggcugugaagccgaggccgaggcugaggccuuaugcuucuucauaaagcaguuucuugauguggaacacagcaaggugugccuggagacacccuagagagggcagggaaggcaaggcugggcggaguggggucugugugccuuuaaaguggaccagggagaucugagugccucuucagaaacccaucugcucaugaaggcagggcagacuguguggccccgccccacaugcucagaacugucaccccuaggugcuggaggcccugcugccacugaagagccuggaagaucggguggcugccuccguggaccuuaucacuaagagucaccacagccuggaccgccgagagcugagcuuugcugccguguccuucuaccacaagcuccgggcagcugaucaguauaagcccaaggccaaguaccauggcaacgugacacugcugcgugccaagacaggcggcaccuauggcgaggacuugggugcugacuacaaccucucccaggugaguggcacaggugaggcagguguacucgcacaggugggcugcuuggugguggucacagaaugacaccugaguauuuucaggugugugacgggaaggugucugugcacaucauugagggugaccaccgcacacugcuggagggcaguggccuggaauccaucaucaacaucauccauagcucccuggcugagccacgagugaguguacgggagggcuagaccugccgaccaccaugaagccacgcuccacaccugccaccagagaugcuccgauccccaccacacccugagugcaggaacuggggaggguccugcuggugggaccccuccccccaguggcccagcaccacccgcuccccugguggcugcuacaaacagaccaucacgcguguguuucccagccgcguagugggguucccagagccacugacuuggagacacccuggucugugaagagucaguggaggcaggagccaaacugagccuuuucuaccguguggcauuugccacgcuggucguuucuccauuaaauucucauauuuauugcauugcugggaaagacccccaggggugacucauuccagaacccccuaaaaugggagaagccauguggggaagauuucugggaaaguuucuagacucaauacacaggcugcuggcuggagccccuuuuugucuuguccugucccugcucacugcagggcaggauauggagagggcugguucccagggaacaaggaccccagcagacacuguagcccguggcccuugguccccagcauccccggcugccccaugaugcagggccauccugacucugcggaccgcaccgggcacugacugucuguuuuccaagacgaaaaugaugcuuggguuuugacuuuucugcagcugucagugugaagaagugucuggacugugucauuuuuacaccaaccugguaaaaaugcugcucuugaugcucuccugaucccacaauuaaacugcacgugagcgagcacugccuucgguucagucucuuuccaguccaggcccggcuucaggcucugauacuuauggguauuccccacaaguggccuccacagcucuuccagugagacuccuuggagggugugccauucugucaguauaaggggaguaugcuaaaauguguuucagcauggagggcuggcuggaggccuugccacuguaguacaagcagaauuuguccaccuuuaaguugcccugagggcaucagcuuagucacagccccgccccagcgguagagaauagcaucauccucuacuuguagucaacugaguguuggugcaagcccucuagagaaaaacguaagcaguaugugaccacugugagaagcaugucccuggaaacaggugacaugacgagagcagagggccugagucacacagaacugaccauguguguaagcagaggaguggagguugcuuggaagaggaggaucaagagaaaaguaggcucaguuuaguggacccacaguagcagccaauguaauuacauuggcuuggagcuaaggcaugguggguccugcaggguggcuuguuggacuaggcaaaguccccuggcuugaggguccaggagagacugucacaaggccgcagcauucgaucacauccagagaggagcauccagaggacaacugcauugguaggguacaaagguguucagaggaucccagucugagugauuagccuaagacugaagcaucugguuggcucuagucacacuuagaaaaauucuuacagcacucgucaugaguuguccauuccuggaaaggaccugcccaaucucuauagugucucuaccuaguuagaguuuacugacucaagggagcagauuuauaaacuugcagaaaggcccgacucccuuacgaggcugugugguccuuagaauucauggaugagaggcaauaaaaccuugagguuccuuccuguucuuugugauugccuaacaagacauaaacugggugugaugagauugcucaguggauagagcgcugugcagccugaguuugaucacuggaacccaugcagcaguagaaaagacuaaguuguccucugaccuccacacaucuguugaguggaacaagacugaaaua

SEQ ID NO: 12201 - RNA, 2228 nt, Mus musculus
gucgucugcgccccuguacccuaggucuagagugaacccgccccgggaaagaagcuaggccggguccgcagcaucagccaucacuucgcacaaagcagcgcagcuccgggaccgccgaggaccacagcggcgcggcagcggcgcggcgacacucagugcaccguaugccccugcgccccugccgaggcaaccggagcgccccgagagaccgcgccgccgcgggguccaggugcaguuagcgagccuagcccgcagcgcgcagucgcgggagagcggggagcggcaagcaacagggagcgggacggcggcgaggcgcucgcgggccccuccugcugcccgcgcccggcgagcucauggcggccauccgcaagaagcuggugguggugggcgacggcgcgugcggcaagacgugccugcugaucguguucaguaaagacgaauuccccgagguguacgugcccaccguguucgagaacuauguggcggacaucgagguggacggcaagcagguggagcuggcgcugugggacacggcaggccaggaggacuacgaucguuuacggccgcucuccuauccggacaccgacgucauccuuaugugcuucucgguggacagcccggacucucucgagaacauccccgagaagugggugcccgagguaaagcacuucugccccaaugugcccaucauccugguggccaacaaaaaagaccugcgcagcgacgagcauguccgcacggagcuggcccgcaugaagcaggagccagugcgcacggaugacggccgcgccauggcggugcgcauccaagccuaugacuaccucgagugcucggccaagaccaaggagggcgugcgcgagguuuuugagacggccacgcgcgccgcgcugcagaagcgcuacggaucccagaauggcugcaucaacugcugcaaggugcuaugagggacgcguccugccucacgcccuugccagcguggcucccccuccuuggcccggucgcccacgaaccgggagaaagggagacccaugcccccaaggacaccaccagacugccugacaucugcugguggcucuggcuggucacgcugagaauuagcgugggcaccgagcucccccuucccagugucuguguguguccagcuguguggcacaggccugggcacccugcugagugccaagggguuccugagcauccuuuucuaaagagccaggccucaaagugugguuguguguguguacgacucccuacaccccacccgacuccugccccacccccgccucugguuuccccaggggcacgcagagugguugcgcccccagcagguuugcuuguaaccagcaagccacuacuguugcuccaugucuguaacauagaccccuggaauggcgggaggggagggcuggggggaggauggggcuguuacauaaauacagauuuuauuuucggaggcagaaugguauuguuuagugguguguggggcgaccagggcccagagcagcuccuuucccaggcugggucaggcgcccacccauccaagcaugaacuggacuuggccaucuuuccacacccuggggaagacauuugcaacugacuuggggucgagaggaagcagcucagacagugucuccugggccaacccccagcgaaccuccggcagaggauccagggugugcaguggggucacuuuugccauaagcgaacuuugugccuguccuacaaaugaacauuguucagcucaagagacuauuguuacugaauuuauuuaaacgcugaagcuuuuuguuguugaugaaagaguucuuugcacaauugucccauuguuugacacccaguguacuugucauuugcauaagacagcauucugaccacacuuguaugcuguaaccucaucuacuucugaugguuuuuuuaaaacuaugaugacucuaagauuacaaaaacaacuaacuuuugcuuuguuuucuugaaaaaaaaaugucaacagugugaauuuuuucuuuaaauuuguguagcauacgcaguuuugguaaaggaaggcaacagguauuggggucuauuuaaacccccccucccacaagacaagucucuucugugugaaauuuucuguacguuccaugugcagagaaaagccuccccccucucccccccgccagcccagugguacuucuaaauugucuuguuuuguuuuuguuuuauuuuuuuuaaauaaacugacagaugacaaa

SEQ ID NO: 12202 - RNA, 5745 nt, Mus musculus
cuugcaucauuuaauugcuauuuauuuucauaaacaugagguauuucaaagugcucuaaggugcagcacuaaauauauacauuuugaagaaauuaaacacagaacuuugccauuuuacccaguucuaugcaccaaacaugaacaaauacaguaaacaaggaagaaacaggcuaggaaaaaaaggaauauauauauauaguaaaauuucuuuacaaaaguuucuuaguucaaaaagugauaaaguaauaucuacucaaaacuuccacaacucauuuucauacgaaaauauaaguaucaaauuuaguuauguaucagcgucauacuaaaguauacaggccguguaggaauuaguacaguacauaacagauuaacaauauauuuguauacaaaacaugccccucaaacauugagguauucuuacaguacuuaggugugaacuuccagucuaauacuggccgcaagagccaccucucauuacccaggacguauacaaaaggcggguguaucaaugguauuuacacaaguguucccaggggcaucaaauggcaacccccccuucuguggcauuugcuggaacuuaagcaccauuguaaaaagaaggaaugacucuguuuggaaucuuggaccggaacaaggugacuucacagccuccugaagcuccuuagugucccgaacuuccacggcugucaccaggugauauggaggaggaaaacaagccacccagcaucccauaagucaguuuuuuuuccaaggucauggcagaaccccguguccugcccccuacccagauccagacucgacaggggaccaauuugaaaguaaaccaacauucuuaaugucaacacaauguuuguuuaaaaaaaaaaaaaaaucaaaaugugcaaaguggcagugacuguccgugugggaaacguuuagcaaguccgagcguguucgaucuucuuuagcaacugcugcugccucgccugcaguuucuccuuuuccagcaggagcuggugcucguuggccuguagggcgugcacguacucgguggccuuuuucaagaugaccaccuuggcggccuucucguucuucaccagcucaggcacauggucccugagcgucaggaagcuggagcgcaggucguuccggcguugacgcuccaggauguugugguugcggcggcgcucgcuguccuccgagucugaguuucgggggcucaggcucuucgcuuuugcuggaacaacacuuuugagggggcguggagaagccucgcucuugaucuuuuucugcgggggcgcguccucgcucuccacguagggugagggugcagcauaguugugcugcugauggaugggaacacagcgcuugaggaucagcucgccaggcugugcucgccccaggcccagagcggaggucuugggacgcacagugaucgugaaagugguuaccgccuuguuguuagaggaggaacgucucuucucuacggugaccacaucgauuuccuccucuucaucuuccuccucgucauccucaucaucugaggggaaaaauaguuucugguuaauugugcgauuaacauacacuuguuauuuaagucagcuagguuugcugaucacaacgcggacaagagguacgccccaccccuuuccuucccugggugguguggggccagcagggcacuugucugauguggaagggcccaggauucaaccccuggugacaaacuugaggauguggcagaaacucgaggaacccaacuggagucagaacgagccguugucggcaugauccuggaaaaacucuucaguguccucagcuauucaauggggguaauaaccacaguguuugaguuuggcagacacuauguagacuuggcgacagaugcucgguaauaggggcuuuuagcauaaucaccagccagucugccccauggauuuacuuauacacacuuccacagccgcccuucagaccggaggcuccuccuuugguaaaacccauggcuggguuugauucugccauccuuaaaacucuaggacaaucucauucacuacgacaacaaccuuuccuggugcgaacaugcguuguacggaguaagcaguuuuucaucuaggcagagaucagaucucaauuauaaagcucuaauccacaguagcucagagucccaaagggggcggugcacgagaaaaaaaaaaaaaaaagccuguaucguccuauguguauucauucugacuucguuuacugccaggcuaggagagaaaauuauggcuuaaaagaagaaaauaaaagcaagcacgaaaaccaaaacacaucgucugcuuaaucuagggaggaccggaaagcggaacaauugugagguuucuucuucuaaggcugaaauguuaggcugcuccagccgguaggucccuuuaagccaguguuuugguuuucagccaagaagacagcuguuggaaggaacugcuuccuaacagaaagcugucaaggcacagacauuaaagggacagagcccuuucaaagugcaggcuuaucaccaaguuuccucccaggagccuuagagcgaucccuccacagcccaggaggaaauuuagacuuuuuauucuuuggcauuuugaaaacacuggcuuccaaggucuaauaggggggcuggaccuacagcucgaaggacaagggcagacuggauuuggguaaagugugguagguacuuucacagccccauggaaaaaaaaagcuuucuucuucuuuuuaacccuuucuuuccgaggacagcgcagauaaaggcuuacaauagaaccaaugaauccuaagggugcgugcauuccuuaggagcggcagugguagggacccgcccucaaccuucaagggcaauggguuauggaacacaacucagcucaauuaggucagaaauuccagcuaggaaacacaacgggacuaguacucaaucaaaaccggaaagaggcucucugaaaacguacacaaccacuaaugcacuugcugccagcugcugaacuggagggagggggugcccccaucacccccagucuuuuugauccugccugucuugcgucagacacaacgccgccugcuggccacgcaccaaacgcaaacagcccaccacccacggagggcucagaguccuaggggaggggagggaggaauugccaggcauucucuuaacuuuugcaagugggauugugcagcccucgucuugcagggagucuuuucccuuccuugaccuggcuuaaagguuccuuuccaacggacuaacagauuucuguacagguaguuuuuuggacuccacagacugacugagcuggccaccaacuuuugccacagugagggcaugccuaccgcaaggauucgcgaaaaaggggauggcaaauuuaagagaagguguagcugguguuuccagccucuucugucccgggaggcuggugaacagaagagaaucacccgcacaaaucuaugauaacaaagggaacgcagcacccccaccuucccaguccguaaggagcuagcaagaacucuacucuaggcuuuaccugagucgcucaagguauccucuccggaggugcugagggccuuggccuccccacugcuggcaggacggccgccugcacgagcaggagcagccaccggggcaguagcuggaacagacacacuagugaccgcagcgcuggucgccggggcgcuagugggggcagcgggcaccgacgccgacucucgcuuguucaccgggaaggggaagaccacggcgggguccacacauucggcagccgggugggagaggucgguaggcaggguggccccgguguggcuagcacucgacgacccaccaagggcacggcccccggggcugcuggcacccacuccgggagccgagcaggcugagcugacgcccgggggcccguggccgugcuguaguuuuucguucacugcgcgcucuagcuucucgcgggcagagaagccgcuccacaugcaguccugaaggaugaccggauuaggagugaggccacccaggcccccgagaccgaacgcauccuccucggccggguugccccacaggucggccuccggcagcagcaucuccguagcccaauucgaaggcuccgggcugugcucugggaaggcgcggcugggcgacaacgggggcgugggcagcagcucaaacuucuuccagauguccucccccgguggggucgagucgggaccgccgaaguagaagucaucuucguccggguagaagcagggcugcagugagucaaacucgaggucuggguucuugcagaucauccccggcaugguggacgcggugcagcugggcauggguucgccucucuuuuaauaucuccgcucuuuuuaauaugggggagugcuuccuucccguggagagcagcagagucgcgccaaccuccaacucuacaaccaauaggcaaaccaagagagaaugagccaaagggguggguugguggggacaggcagugggagcccccaaucucuucugcaagcuccccacagcucuggaaggugggagaaaguugagcgucuccccuacucccuccuuuuguguacaagcugucuaagacugggagugggagggggcuugcagaugcagggggugguguggcucucugcaacuuuggaaacugccguuucauucacacaaggcacugccugggggaggggggcuguucaagcugcagaucucagcucuuacuagcgcgacuaccccacuugcacuaguugcuuaaaggaaguccuugcucucuagcccagcuaccaggcaugggauugaaguaccuuucauuccccuuuugcagaaaugcgaucacgggagcgcaaacgcuaacgggguucaggaaacuuuauuaauuauuaagggccuuucuccagucagaccaacaacaggcaauuacauacaacccucuccaccuagaccuagagccucaaucuuggcagauacccuugguacucaucgcugccuauaccuauacccuuuccauuccccuuccuucagagaccucaaccucuucaacaggcggggggaaaggcugaaccccaucccuaggaauggugcagggucgccggcgagaaucgcgucuccuaagccggagcagccgugaccuacauuaucacucaggcaccuagcuucgccuaaccccuuuuccuucuuuccccgcggcaccuuuuggagaaccccagcuugggguggggacgcaccgguucccagucaccucacacucagacaaaucuuguggagccgggcgaauuucuuuucgcuaaagcuauuucucugccugggccagggcuguaaaagggauuagggcgggucucuuccagccagggugccuucgggugcugaauaggcuuuucaggaaaaaaaaaaaaacaaaaaacccagaugguuuuguuucggaagcagacgcgguguguugcccccuuacccccucccccagaaaagcccggcauauuugggugcagggugcggagccgcguccaggggcuugccuagccgcagcgcuccgccguuccccgggcgcucgaagcuucgcaaguaccgcuucuuaccucccgcagacugccggggauccggaggcgacucggggcuggggucuccgggugggcugagggagcggcggcgggaggggguuguccuccggcggcugcagugugugcgcgcuuacgccuggcuagcgcucguucggcuccaacccaguucccaggagccccccgcauccacccagcgcguccagacagaugacugucacu

SEQ ID NO: 12203 - RNA, 25060 nt, Mus musculus
cacguaaguaacuauuaauaccgccucgcccggggaugcgggcgugcuugagcgccgggauuggccuagggcgccguggccauccccuuuaauuuuuaaauacacgguccucuccuacuucuggguggcaagaaaaaaaaaauaauaagaaaagaagacaagccgucgauuuuuauuuuuccugcagagcaaaccccgccgugcaauuuggucgcaaggcaucgggagacaagagugguuugcaaauuguuucaaggcucaagacccaguugugcagcggaaaaggaacgccgcggguugacggaguccggggagcaucugcuggcagcuccugcaggacccccggaaagcuccugcugcugguaccccccaggucaccgcccgcacuucuugcuucaucggaggaggaucugggacgugagcagcgacagcaagagcuagugcugaccgcgcgggcucugccuugggcuuugucgcgguaccugugccugcccuacuccgcgcacucccuacucagcuuuugcaaucuuuuguugccacugcugaccgccccaaguuaaaagcgccuuugcaauuuuuuuuuucugucuuuuuuuuuuuuucuugagagagacagcucugcgauuuuuuggaaaagccucagacgccaucuacaguuaagacuuagguaacugcccucucuagcaccccccuuacacgccccccacccuuuccaccaaaaagaggggggugcagcgcggauucuggcugccgcgcggcgugagccgguagacccgagcuuauuuccuuuuucuuuuuguuugguuucuaacgcguggagggcgagccggcgccgcgcgcucccugaagacugcacaaacuccacgcagggcuucuccgcccggucugcggauccucagcuggggaucgcucagaagcccggcgcugcagcuccucaccccagaggcacgcucacucguccagauccacgcugcgaacagagacccacugaguccagcgugcgguucugcaccgcgcuggcagcuucuggguaacaaaaggacccgaguuguccgcagagcgagcacccccgggagcggggcucgcagccggggaccagcccugcagcgcccaucugggggcuaguucuuaacucuuccuccacggagccccagacggguccccucccuucuugauccuuuuaagucgguagcaccgaggcgccugcaccggcgcggcucauccaucucuccagagggguuuuuugguuuguuuguuuguuuugucgugugcgauccucacacucaugaacauacacaggucuaccccuaucacaauagcgagauaugggagaucgcggaacaaaacccaggauuucgaagagcugucgucuauaagguccgcugagcccagccagaguuucagcccgaaccuuggcucuccgagcccgcccgagacuccgaacuugucgcauugcguuucuugcaucgggaaauacuuacuguuggagccucuggagggagaccacguuuuccgcgcugugcaucugcacagcggagaggagcugguuugcaagguaaccagcccagcuuugcuuuugcguuuuguuuuuuugcuuaaaaaaaauuaaaauuuuuuuuuuaaaaaauuaaaaaaaaaucauccugggucuuuugccaggggccggggacggugcgggaggucggaaagcucucaaguccaggggcgaaagacucccgggaucauuaugcguggccucguuaagaggguuuauuugugugucuguccacguucgacuaguugcgaaguuuucagaccguuucagacaaugaggcgggcugcagcgggggcguuuuggggagauccgggaagggagggcggcgaaucugaacuggggcacggacacgcgugccccuuaggaggcucguagagcucgggugcaccgggcugauuccccuugccugggcauuucucucucugagucgauuccccuccccucgcugcaaggacuagggaauccccgguugguuuucaaacgcugcuccucugguuucuuuuguagccauuguucuuagcagccugcagguguuaaaccuuuguuccaaagguggccuuuuaaaagagacacaaaaaguguccccucuggcugagaccaaggcucuagccggggaaaagaggaguuuuaaagcucuuucuucggcuugaagccuggaaaggaagguugggguggaaauucgccccuugcgcaccuuugggugaacaacgaauccuuugguucuuuuugucuagguuucuucgcgucuucagacucccugacugcacacccccauugcuacuccccugcacccacaaggccaccuuugccuguuuagagacugcccuuuagagcccccugggcuaguacuaagaaggacacuucaauuuccuuuuugucuuugacccugaacaguaacugguuugugucucuaugugucagugugucuuugugugugcuaaccgaguaccagacaagaggaccaaggaaggauaauaacaaaguauuugacuacagucaguuuccuacugcaguggagaacaggacuuccccagauguagaucaagaauacauuaccacuuaaauuuagguucuucuuauuuauuuauuuauuuauuuauuuauuuauuuauugagguggaagugcgacugugcugccuuuaaaauggguaaugugcacagcugugcuacaaauacuguauuacacuuuuccucaauuaaucacuggcugcuuugugaaaucaccuucuuucgugcugacuuggagcgcuuccuugcaaaaaccgggugggugaagaucucagaaggcaguucugagauuauuuauuuccgauuuuuagaggaaaccagagacucuuuaaaugcugcuguuugcauguacuaaguguuggggguuuuugcaucuucuccaaguuacuguaaucaagagcaacuaugcccagcuaaagcauuaaauuuaguaggcaacucagagccugauuggagccccacacacugcacaauaggacagucauccuuugaaaugaaugaauuccacugagcugucauucuccuaugaaauaugcaccaucaucggcagagagccccucccccuccuuuugcucacccucaguccagcacuuuaauauauuucucuuccaaaggcuggagaugauuuuacguaagaacugucuguggccaaauucugcaagagcaucuugcuauucuuucuuuguuuaaaacuagggcuaucucuggucucucuguucguuuuccuuucugauccuucgagacauauuucacucuaggcugaccuuacagugucauuugccgacuugcucccuggccccaaacuguacuuaaucuguugguuuaguuauuucaaagauugaaucagguccucgccaauuacagugcggcugcaagcggauuuaagugugguaucauuguuuuguuugacagaggucaucccuuuacgacuccacagcuucuguucuccugucuuuuuccccugaggugaugugggugacuucugagcacagcugugugccacccucucuaggagaguuuuauuacggugaugcuaugacugccccaauauacacacugugggcucuuuagcucgcuacaggauucgaaaaccuccacauuugaacccaccuccuuuuggugucuuaacaugggguuccuguuuccuaacuucauguuuaugcaaaaaaaauguacaaaaccagaaagguuguauuuauuguggggguucauuagaguauucuguaggacacucugugguggggaggaggcggggaggggggaggggcuuccaggggcauaagcaaaauucccuagccugauuaucaccuccacaagccuacuuuaguuagccaaaguaggaaaggaucuuuagggggccuuuagcuguuuuuacaaaaauucuuguagcuacugugcagaauaacauaauuacuaucuuggcagaaugggcccucuuucuuuuuuuucuuuucagacaugaugaauguggccugaucuuagggccuuaucugaacugucacauuauauaaccaagacucccaauuaaacauuuaaaaggagcuggcacccaggcucagggcuugauuuuugcacuugagggugaugguuuaaauaccagcccaagccuauaaaugccuguuauagccacuaauaaaacuuugacuccuuccuguuuaggaaaauguaagcaauucuuuuagcuuuucauuuucuguccaccauuuugcauucuccuacaaagggcacggccacauugggaggcugccacgaaucugcuacuuucauuuaguucucuguucauucaguuuuucagcugugcgauggggaagagaacaggcuaaccaugccgagcaaaagguuacuuuauuuuauuuuuugaaaggcaacuggaaacaggaaauguauuauaaauaaucagaccgguaggcccuggugacagaagccacagccuggugcuucagaacaaaucaugccacuuauauaaugcagcuuguugacauuagccacuacggugugugaguguguguguguguguauguguguguguguguguguguauguuugugugugugagugugugugugagugugugugugagugugugugugagugugugagugugugugaaugugugugagugugugugugagagugugugugugagugugugugugugagugugugagagagagagagagaguguguguguguguguuccuugaugaaauugcugaggcuuccccgauucuguggccugcagccuguaagcuaagguugacucgagcauuucagauuccuaauugagugggccacugaggucacugcucugaggucaucauuugacaguaucagggugugauuuguggucuccggggaggcugaagcauucauucuuaaauucaaggguguaguggcaacagcugcgccacuuuccugagguaccucauuaugccucauucacagcugauuguugacuuugcuuccucagccccaguuagcaccagccucagugaggugcuuauugucccuguuugacucacagguuuuuuuuuuuuuuuaaaugcucaguuacuuaacucuuggaauuuuauauugcagccuguguuccuugaaugggcuacagaaggcccaggaauucccucagaaggauuuuaggguaacacgugcauuccggacugggccuuguuaacaaagcgaagggcgacagagguuccugggugggaucgggacccacaaaagguugugaugccuaagucaggguacuuaugauacaaaagggagguucuuugugcacuuuaucuauccuauucgggugaaugguggccuagugagagcgguaagcacccccagguaggguuuuuuuuccugcuucucuccuacugcacuccaaauacugaugaggaagaagagcucacugccacagaggauggcuagaccuucuuuuaaaugaaccucccccacccccuuauucaccccauaccauuuucaaacagccccuccccucccugcacauucucccccugagcaagggaaacccguuccagcccuaggugcugcccuagcugaguaacuacaggcugugacgugaaugaaaagcucccuuuccacccuucaaaucuuuguugugcguucguucguuucuuaggucuguucagaagguauugauggugcauuuuuuucuuaagcaacagugagguggcauuucgcaggcuaacucugauucauagaaaaucguugcauaauugauucauugaguuagauaucuguggagggaagagggaagccagccuggcucucuacagagaaggccccugugcuaauccuagagccacccuggggggugggagugaggacaacagcgaugagaguuuaggcuuguuuucugugccucaguuugcacagcuguaaaacuaauuuaucacacauaggaaaccauggaagaaagccuugauaguaaaugaauuaauuguucauucauguaugucuuccaugcauuuuuaaaaaguaaagaguuguuuguguuuuuccugggcucacuuaguuuuuuccuucuauuaguauuuuucugcauccauuucuucuauaaauauguaacuauagaaacuauagggaagaauaauaguauuugggcuuagaugauagcccagacaguaaaaugcuugccauacaacuguaaagaucugaguuggauaccuaacacccacauuuaaaaagcugugugugaugcaugugauaucagcucuggaaagacaaggacaggaggauuccagggcucccuggucagcuaggcucaccacguugguagguucaagggcaaugagagaccuugucucaaaaaacaaguggauaguuuccucaagagcuguaccugagauugaccucugaccucuacauagacacagggauacacacauggauacagacagacagacagacagacagacacacacacacacacacacacacacuaguaaaacuuagcauuuuacuauuuuuccuagacuucucccaacauggaaucguuucauuuauccauguuaugccauuuaagauuuggagguucagaggaggcaagacaugguuuguuuguuuguuuguuuguuuuuccccugaacuacauuacacagcugguagcagacagaacuggugugugggguguaaguuucauacucuuuaugccaugucaaagcacgagccugugggaggauucagcauucugcaguuugggucauaggagguaccucugacuggggucuugucaauucuguccuagguguuugagaucagcugcuaccaggagucccuggcccccugcuucugccugucugcccauagcaacaucaaccaaaucacggaaauccuccugggagagaccaaagccuauguguucuuugagcgaagcuauggagacaugcauuccuuuguccgcacuuguaagaagcugagggaggaggaggcagcccgacuguucuaccagauugccucagcuguggcccauugccacgauggaggccuggugcugcgugaccucaagcugcggaaauuuaucuucaaggaugaagagagguaaguggggcucagcccaugcagguguguguuugugugugugugugugugugugugugugugugugugugugugugugugugugcucgcgcgauaggguaucugcagggaacuuguggugaugccuguuacccaggugaggguuaaggcaagcagaacaaagagagagcauuguggugucccaaugcccuuggcaaacaaggagccauuacucccgaucaugaaacauucaaaggccaggaggcagagagaguagucugugaccugcugaaugccugugguuuuuaugaagaauucugaagaaggcugcaaacuaguguggcaguuucaaagucaacaaagacagguuuauaaaggcuucauguugucagaacacugagaaccuagaggacuuuguuuauuuuuuauuagauauuuuauucauuuacauuucaaaugcuaucccaaaaguccccuauauccucccccacccugcuccccuaccuacccacuuucacuucuuggcccugguguuccccuguacuggggcauauaacguuugcaaguccaaugggccucucuucccaaugauggccaacuaggccaucuucugcuacauaugcagcuagagacaugagcucuggagguacugguuaguucauauuguuguuccaccuauaggguugcagaccccuucagcuucuuggguacuuuuucuagcucccuagaguaaggaauaaaauacccauggaagaaguugcagagacaaaguuuggagcuaagacgaaaguauagaccauccagagacugccccacccggggguccaucccauaaucagccaccaaacacagacacuauugcauauaucaggaaguuuuuuucugaaaggacccugauauaacugucuccugcaaggcuaugccagugccuggcaaauucagaaguggaugcucacagucaucuauaggaaggaacacagggcccccaauggaggacuuuguuuauaguccuuucacgcccucaauagcucuuuccuaugcacguaguagguaugaaccacaggcuugcaaguaagccucagaaauagauagaccgcagaccugucaaaagcuagaggugaguccugggucccaugugauguggagggggauggggcuugccgguucucacuagaucuugaguaaccaagaaagguuucaaggagagagaaacaugguagccugggaagggcuggcuugucaggugaggaguugauggugugagaccagccaccaaggaugccugguuaucucaagaaacaucuguugaagacacaggcaucuggacuucauucauggauacaccauuaacucaucagguuccauuuagccaaccuggccagaguccagcuuucucuucacuuguaaagcuucuuuuuaagaauguaguuuuuuagagggacacaggcaaugucuucagucagugucaccuacguguuccuugugcccuauuggaaugacccacaaaucaaaagccccagacuagugcuccagggauugguuaagagacuccacacacccaaguccauggaguccuuggucauucuggacuggaaaagagggcaggaaagccucaaggcugucaucuaggaccaucugaugucagucugcuccacuuccuucaaucccucacccugcugacauaucuuugguacuuucugcaaaucacacagaccuuggggagcaaaccuuucugcuuucuauugccuuugacauccagcucagugggcugugauauuuucacacuauuguuuacagaaacccauuguccccuccccccaugaacuggcgcuagugaauuguacgcuuuugucuucucucucucucucucucucucucucucucucucucucucucucaucucucucucacucuccucuuucuccuccuaccucucuuucuuuccaucuaucuguauuccuuuuuuuuuuuuccuucaugguuugaacuaauuggagacuuaaugucuggcaaguacuuggggcuuagcaaaggaaaagggccuguuguuacuuaagucaaauggaauaauuucauggguguuuauaauccugcuauguauacagcaugcagaaagcuucuggacuuccugugccuauaaagguugcuucuuuuguauauuauacccauggggguggggucgguggacacuagcuacucuggcagcucauaugcuggucuuugauuagaugacuucauuuuuaaaaacaaagugaagaagcaggcucuucgaagauaagaaugugggcaauuuguaucuuuuccuucuccagcucagauacuccagccuucgaacuuagacccagggauaugguccuuauacuuuuguccuuaauaauuguuaugaccuugggcugccgccaucucucaaccuuauggcuuuaccauaaacacucuucacucguuuuuaguuuucacauauauaucuccucuuugaauguucucauuuggaagaugaauauggauuggucaaagauauuuccuuuaccaucuuuagcuacaaaaguaagaggcaguguuuacugaccuccugcaauacaguuguaggucagccugccuaauuauguguguguguguguguguguguguguguguguguguguugcagcagagcaaacucucuuugugcauuuguggcuggcacuccaccacugagcuaccucccagcccaugaacauuuuguagccagugccucugaacgcaggaaugugaaggucucagaaucaacaccaagaacaugcaguagguggaugagcuucucuaggaagucaacccaacugucaaggacuccuuucuucugccagagcacauggccccucgaaugcuguagccguaucucacgggcucugugggauuaaagguuacuuuagagaccuagucaggcaucagugaguaucaggguggcacaucccaaggucagacccauggcaaauagacauuucugaagugagccaaaggaauguagauaucgucaugugacagaacauuagagcaugacccgaaggcagucuuugucugauuucuaacacuuucuuccuuggucugauggacaaaacucugaaacaacuaacugcaaaagacuacuuugguggaguccucguuuacuuauucaaccaccaguuucucucucucucucucucucucucucuccccccccccccagcccauucuuccuuugagacaguuuuucaauauagauguguuacuuugcaauuuaggauccuucugcuucaaccaccuaaguaugcaagcauaggcuccaccccugacucaaccuucuguuuccugaucuaccgaguaguagaagguaaagcuguccuguggcagaauuggcugagcccuaccuguguucuguugacugaauccagagcugucuaugaagauucuuaguggagcuguccaugcucuacacauacuaugucauuuagaugucacccaaggucaugugcaaacucaaggccaggauaccuacgacgguugcauugggaucaucaauagcuuggcuucaucugauucccuuuggcuuugauuuagguucuagauucagguccuggucucgaauuucucuaaagguuuauaagcuguagcuuccucaagacugacagaaugguugcuucccuggaaggugauuagcauucagcaaggugauggugugaucugcaugcagagcuguacuugaaaucauugugagaaaacaaaacaaaacagugucuuuaugcaugaacaguccagaagccuuaguggguucgugagugaugaagucacucucucuagcagucacaguaguuccuucuagugcaaaguugauuccacccagacuggggagggggcgguguuuuucagaguagacccccucuucuguguucacugugacgacccaccaucacugaaccuuauuuugaagaaaugaauccuaagccuucauugaacuugccuggggcaaauuucaaggaaccuuuugcacccucaguccugcagaagccugugugacuuccuccagaucugaaagaaggcagaacauuuacccauaaugacacagggucucucccauaccuccuggccuauuuuuccccaugggaccugcuugaucacaggaccauauugcuagagacccuguauauuucuacugggccuuaaagaaaggccugagcucagaagugagccagaguggcugucuagauuccagccccugcuguugcacuuauuaagaaauuucacuuugacagaacaccuaaccuguacacuccgaaagccuccacuauaaaauggacugggaauacucuccuuacagaaggaaggugauuaauguugaccuuggcuucuuccacagcugcuuuccucugcccuuuuguuucuuugcacccacaggcugcuaaggaaaguggugcaacauugcucugucagugaccuuugcuccguuuuguccugcuggaugcuucuucugggacacaucuucuugccaucuccaggcuccacccccuagccucagaucaguguuuacaucucucagcacugaaaugucccaugugaacucagaaacuugccuuuuuacaugcugcugcucugcuccagagaucuuuaucucuuaaggugguugcuuuuuagcugcugugaggaagcagaucuucuuucugggcucugagaccuccuguaggcacucuguggcuaggggaggggguguggguggguuugguauaagaagugcagcuuguaccccuuuguuggggaaagccuuccugccucccccaacagcagaagucaaggccaucucucuggggugcugcugucuguuggcucuuuagaucuucaaguugcucccuccuucacugagguugcuauaucuaauaaaggauucagggcaggcaucagagccccagaggacaggcacagcuuuucgcucacuaauaucuauauauauaguuuugcaacuuguagguacucuaguuuagggauguuuucccucucugucucucagucucucugucucugucugucugucucucucucccccucucuuucagcuuugaugagacaaagcuuucaggaaauguucauauuuugguagaccaauuauauguccuugugccuauggcaacucuugggcaaaguugucuuuccauuauagucuuaacaagcucuccaggaugccugugaaggacaaagggacuuuggcugcugcuuuuugggagccagaagccaggagcuguccaccuuguuuucugagagagggucucucacugggaccucaggcuuguuaaguaggcuagguugacuuggcaguuaucccagggaucccugacugccucuaccugcccagaaucggaauuagaaguacaccccacacugagguuuuuagaacucagauucucaggcuuguucagcaaacacuuuaaggacugaccuaucccccggcccucccuacucuauuuucaugguccgaccucaauaccccuuaccaagcucuccucuuguugcuuugccauugcuccugcuggacggcugaguuuccuggagacagaagugggaucucauucauggcuuccagaacaugguaggcauugcuauuuguugaauaagugagaaucuccuuuuuuggguaggaacagcucagauugaauucuaauggcaggaugagagagacagggauaaauagaaaucauugaaauguaggucguugccuagaaugggagccuagaaaacuuauggauccccauggagacaccuuucaaagagagcuauuuucaaaguugcacauugagugagaaauuaacccauugcugcugucuugguuuauugauuuaugccuaaggaaggcuuauuuaaguccuuguuuucagcagacuguaauuucauuuaggaagggcuuuguucaucccagugagaauuggcccgucuucccagggcucuugcccuagaagcagccuggcuccuagcuaugcuugguagaauguauugcugugcuagacuuaguccuucaacugaugggagugucugaggaccuaggaaaguaggaaguuggcacaguggugagaaacuaaauucuuccacuuuguccuaugaucucagcuuccucucucauuuuucauaagucuuauuuuuauuuuuauuugugugugugugugugugugccugucugugccugugugugugugugugugugugugugugugugccuaugucugugccagugucugucucuguguguauguguguguguguauguguuuuugccacacguguuuguguauccccugagaccaggagaggacacuggauccaguggaacuagaguuacaggugguugugagcaacccaagugaguucuagaaaccgaaauggguccucugcaaaaauaguaagugcucuuaaguuuugaaccaucuuuccugcacuuugaacaucccccauccccaaaaggguuuugcuauguaaccuuggcuugccuccaaucugcaaugaucuuuaugccucugccuccuuagucuucucuguaauuaauuagggaugguguauggaaagcccccaggacugagccuauugcacuggcugaucugaaagaugccaaugccaucccugcuuccagccacugucuaugggauugcacuuuauaaaucugaaacuuggagacucaccuguucauucaaggaacacuuguuaagcaccaguuaugugcuaggcacuucuagaggcuauuaugccaaugaagccagugucuuguuuuuauaggauccacauggaucagaaugacucuauccuaacuaccgugcuuaaaucaacucauuucaauuuaguuacucuuuuauuuguuuguuuguuuguuuguuuacugagugugugugugcaugcaugcaagugugcacauguaugcauucaggcacauggauacugaggcacaugcauggaagucagaggacaguuuguaggagucggugcucuccuaauaccaugcagauucuugggauugaacucaauucauuagacuuggcagaaagugccuuaaccacugaaccaucuuguuggcucauacugucugucgaugugugaauugaugaaacuuaaaaccaccuaguagagacuuuguacaucugcagguaaggaaguugaggcccauuauuuuccagccagguuucugcaagcuuugaagccagggaagcuagcuguaaagucuucccugugaaacauaauggcagcuucagguucuguccuuuaugucauauguguaagauacugccucucaaacccaacucccuagaaagacucuugugacacaguuagacagguguacacuuaguggagccagcacccagugucuaccugaagcucagauuuccaagcaguuuugacauuuauggaugguaccaccaauuaagcaaaaccacaggcaguccuguuacuccauggguggcuucuguuucuuucacagcacuguaugauauggacuuagcauuuuaauuauauaaugagugacaguuggugaaauggauguaucaauagucccucacacccaagaagaugcauauuauaagaaaaaucccugucuguguugaacagauauagaaggcaguggauagaaacauuuuccaaaugugcuuuuuccaguccuugugggguuuucucuagccaauggaaaaguccaaucuguuugaaguuucucugggcuccagacauagcucuuaauuauucuuuaagaauccuagauaugaauguuaggguuggaggaagcggggcuuagauccugaaaucaucuguccucgcaaauguuuauuaaguauuuauuuugucugcuugcagugcuagauguugguggggcaagcaucaguaaaagaaagcccagaaugggaaagacaaugggacgggcaguucacuauuucagcagcuggaguguggaacaaagaggcaccuggggauagggggguggggguggggcagaagagcuguugugggguggggcucaucuagagaaccaguaaugagaaugacaggugacuagggccuuggauacauucccugaucuuguucuugaccugaagcccacaaauggacucucuagaccaauuguuggaaccauauucgaauggcgagaaguauacaaggaagacaaccagggauagugagacuggaagcuauacucucuacaucugaaacacgucaauacuaaaacauggccagacuuuuugguucccugaacuuguugguuaagccaucuguagggaucccuaguuuuugggcugccugccaggggaagcauccucuucuggcccagggaaugcccaaggcuuagagaggagcuuucagguagauacccagccugagcgguacaaugucaaaaccaaagggcaugcucgcucacaagcaccgauccuggagaagcuuuuccgagacgugaaucaauccauugcucugggguaggacagauccuucaggagccacuucuaagugcaggaagcaaguggugaauggggaaucaguguggcuuuguguuccagcucggguuucccugucuguuuccauggugacaagagucaggaagcccugagggcugcaagcugugguuucuguggaaucuuccaagcaguagaaugacacuccagguggaauggcuucccuuguguauccgguggccucagugagucagaggugugcccacaaugccggaggcuccauugcaguggguguguuacucaaguggcuuccucauccuagccaugucuugacagguccuuuaccuuucucagcugcuggggucuuuccaauugucuugagcauccaauaugugcaaacaaccaguccuggguugugugcugguacaagauacuguggcuuagcuucccuggcauuugccuuccuuuugacaucugucuugcaccauggaggguuuucuugacugugggccagcugccauccgucgugagcucuuccagacaggagaaccacugauacuggcccuggagcagaaguggcucacaguugauuacuggaaaaaucuguacauaccuaaaacaagauuaaaugaaggacuguuuugugccauguagcagccugaccaggucugguagggcugcagaguuugagccaugcuaccuacagugcuagaugguucuuuccugggcaccuucugugacucacuauaguggggauuuuucuugcacaguuggccugauuauggaggguacacuuucaggaacagaguaaggccagccuggcaguagcccaucuuuucuucuuggcucuuagucugcccuggacccugaggcugaccuagucugcagcucuggaugaucugcgcccggauuuccugucccugucaggcccacuuugcugaacuccuggcugagcuccacucuguuccacccuguccucucuucuuccugccaggagcucagggugaggcuuaaggguuugaaagcaaaacaugguuuguuguugggggcugguuucucucucucucuccuuuuguucuuucuuuuuguugucauagguaggacacuauaauagaggguaaaaaaaaauuuuuuuuugaauaccagcucugcuuuuacuugccagauagcaagucuccucagcuuuugauagcuuagccuuuuucaucuagaaaguauaugggucuuuccaucucuacaucucuaucuacaccauguacuauauauggcacugaguuaacucauaggauggcuuuguaugucaauaaaucugggacaggauaaaucugaaacuggaagagcccugucuccaucuacuuagcaccaugucuuugcaaacaucuucagcaccuuuaguuuuugaucaugguaccaugauguacugggaggggacagugacacccgaaucuuccugacaugaauucaggugagcuucugauucaguuagcuugggugugccuugggguguuuaauucuccccaccucuguuuccuuauuugauaggaaucaugcauagccuaagcccagucuuucuuuuuuuuuuuuuaugagacacaaaaaggcaggcuguugaaucccagcgucuggcgauucuugucugugcuacauggguacugcugcuuuucagaucaucgcauugugauuguaaggguguccucuaggaagcauaacggccugacagcugcagaaugauuaggaauauagaagcuagaaaagcccuuuucauaguaguuauuacaucauauuucaugggagagaaacaauugaaagagccuuggguuacuuugcgaaauggauuugguaguuggaggaucuuuggggccugugcuggagaugggugaggggaccugguuuuugaggggggaucuugcugccccacaggcgcugggaggggaauagaauucugcuaguucuggcuucccuacucggcccugagcuaugaugauacaggccuggcacuagguugccuaucauugaguacacagguuacccucuugugagcaucgucuaucugugacgucuaaagcaacucaucuuguuaccuucucaagccagagacaggcagaagugggcccagggagaucuagcuucccugguccaauguggucuguucuaggcuucugccuuccuuggaguuuauaguuauucaguccccauuguucuugucucccccuccuaucaccaugucacuuucauaaauguuuucgucauaaaucaucccugucuccuccaacacaauaauggauagccugauuaucugagagacaaggcugagcuaacccacauacuaggcaagagcaucucaagcaagggugaacaaguacagaagucccaauggaaaaugugggcacagcaucuucucuggucccaucugcccagccuugcauuuauacuugcuccucugucugcaccgcucagcucugggguugagagcaggaaucucaguugaacauuuggaucuguauaguuacuaccaugcuauagucagcucuguuacacugggcucuuugggauauccugucuugaguuacuuuaauccucagcaaaacagaggggaugguuguggccuugcuuguuauggacacaucccuagugccuaauuugggaguucuaucagaguaagugcuccugaaugucuuuuaaaugccugaaugauuagugggcuauuugaaucaccagguccacagaugcucuuguugguuuuuauggaaaucaacuucuuugccugggaaauucaucaccccccagacuguuuaggagacuucaggaaaagucuauucauucaugucuacucugaaaucuguuugcaaaggucacuucccugaacucaguccuggaaaaagaagcagagacagcuccguuccugagaggagauaaagggucaggcuuggaggcacuggguagcuccugugguugcacaauaggaccucaggcacuggggcuugcagcccaagucuccugucgcacuucccucugucccagcacauggagaacaucccggaagaucaguguuuaaagauagaauccagaccacuugccucgacccuuguuaggagugauauaaacaagccgaggauguuccggggaggagcaaggucagggagagccucuggggcugcauuucuuuuccacccugucuccaggcugcucuuccccucuccucuguccugacuuggaugcugaugcuguggaaggaaguagaagcuggcuguaccgaccuggauggagccuucugaguaucaguggcugaacgggcuccaugggauaacugagcacccagucuggaugugacugacuuggccucugugccuagggcuccugguacauacacacacacacacacacacacacauaccauauacuccacuuaugucauaauguaaagaaaacagauccauaaacacauggauugcauuaggcauguagaugacauuugacauuuguacuuaguacuuuuuaaagaacgaacuugagcuugaagcugacuucgguaugugcuuuguuaucugaguugcccugguuccuaggacagcucacuggcuucagcacaugauccagagucagagugauccagcugcuccucacugcauccucagaccuugccugauggagcucuggaaacagugguucucaaccuuccuagugcugcgacccuuuaaugcaguuccuccuguuguggugacccccaaccauaaaauuaucuucacugcuacuucauaacuguaacuuugcuacuguuaugaauuguaauguaacuauuuggaaggauaacgguuugccaaugggguuucgacucacagguugagaauggcuaaagggaaggagguugaaguccccuguagauuggccaggagcagcccagccucaguuauaggcuagugguuuuaguaaccuuauucuguugcguuaagcaucugcauaguuucugaguucuugucuugagguacgggagagagaggggaacuucacuugggggagugguaauggacaauguggugguccuggcuacaguccaaagcccuaauuauggggccacacacgggucuccaugaugaggggucagggaacuuuaaauauggggguaggaguaaaaaauaaccagaauguacaguuaugaugugcaagagauaaacagggacuacacuacagguuuaaagauuuggcauagcauaaauucuguggaguuccucccgagaagguggagggaggguuucauuccuguugucucuccuuccccaucacaggccugguuaauagaccuguccugacuucuacauaauucuaguuagauaguagaacaggggcuacuauuucuuuacagcagagcugaaacccccauagucagcaucugcuugucuguaucauucauauaagccaguuggugccagcagugggcccaggcauguaagccacagcagcaacagguagcaagucucucccucuguauccaaagucacucuguuuugcuuccacaagcuccuggaggcgaggaagccaggguucauccaagaugaccaccuagcgauuuaggaguucugaauaacaaacuguguugauggacaugagcagcauugccaaggcugaucggagcggcagggcagcuuuguguagggcacacaggugagaccuacaucaugucauuuaaacagaggccgacucacagugaauuguaccucagcagaacauucuaagcaggggacauuaugaguccucggagggacugagugagacauugccuuugaggcaaucagaagaguguguaacacagauagauuaggcucggaggguagggacacagacaugggaucaaucagcagacaugacaaggacacuggccucuauguggaugaccuagggcacuccuagagggauuuguaaugagaauccugccccaacuugaacccucugucuccaacuuuuccuccugaacugguagccauucacacagaaguaggaauuacuuccaagguuacaguucauagcuacaucaacugcucugcugccgaaucaaggaagcuagagguggaaggagcuguugagaggagcccugguauauguuacucagaauccccucccucccucccucuuuuccucccucccucccuguggcuucauagucuccucucugggcaguuuggaacaucuggugagaccagugggugggucacugccaccugccaccuccuauuaagagaaauaagcuggagaaagaaagauuugucuuuaaucaguucaauuccagauuaacacagcuagagccuccuuaguuucguaggccauuaguuucaggagcauucgaaagcaggcaugggguagggguguuguagaagauggcucagggaaugccagagggaauuacauguugcuguguauugcggaauguuagaucuggcacagagacagccuugugcgggugggugcauggugauuacuggauaucaugagugaacuaaauggaugcucaaaaaugguuaugauggugaaucguuuaauguaaaauuuauuguauuaaaagaaaaaaacagcacccucaaaauaaaccauacagagagagagagacagggacagagacagacagacagacagacagacacacacacacaacacaacacagccuucugcaguauuccucuuuaaagggagauugagugacuuagcuggagcuacagcugaaguuggugagagauacgccugacugggagucugcaccccuaaagaccacacugucuaggaaagcaaucagugcuugauuuuuggaacauguucauagaagauccuagaagcaacccaucuuuugucaucuucucuacuauugagcucccagcagcucuccuuaacuaguugccauaggugacuuuucagacuaccuugagagacugagaucuguagguacagagaguaaaaaaggaagaagaugagaggaagauggucuugggcuacacgcugugagugaugaccaaggugaccccauuguaguuuguccagacacuuucuguugcuaauuugaacccuuuagcuuaugcacucaagcaggaugaaggccuggauguaugcacugagagacaaggauaagugaugugaauuuaugggucuuuuaaguaccccagaggcccaauuccagcuccaacuguccuuagcuaccaucuuagcaggacuccaggagugugguaagaacuaccuacucaaaggguugugcucugcucugucugccuaagagaaaaggguuuucauuucaaacacagggaaggaguauguuuaccagucucacaaagcccaggcuggcuuccaauuugcuguguagguuaaucuugaacugcugaucuuugccucugccuuccaagugcugugauuacagguguguaccaccacgcccagcagcaguuuguuuugcacuaauaugauugaucuaagaagucaucuuaguuucuagauuuuccauuuccauaguguauaucuuuauuucacacucaaugaugaagcguggugugugugugugugugucauauaggugauguaagcuagguguuagggccagaaauucacauguauuucuccacuccuucuagcacaucuagggcuugcauauuuguauagauaaguugcugaguucuugaagagucgguggauugggaggugggauaaauaguuugagaagacucuuggcaacacacugcuauugucacacccaucuacccagacacacagucacaugcgaaccaugcaccuguaauuagugauaggugccaggucaaggacccaaggcuuuggggguaugacaggcgggccagggcaggugaaaaucuggaaaugaagauggacuugguauuuggaugcuaggcuuagaugaguaggucguggagaccacuugagccgaaauucucccugccuuucuucuugugucccaagaaaaguggcggguacagcuaaagaacccagaaggcaaaguaaggaauucuuguccacgcuagaaggcuucaagaaaauuacucaaacccccagcuucaguauucugugcuaugagugacauccagcuuguuacagggauggauggauggauggauggauggauggauggauggaugcacaaacaucagcaacccugauauaccgaugggauggaugugucgauggaugugucucccucauccuuaggagcuucugucuuugucucuuuccuacaggacucgugucaagcuggagaguuuggaagacgcuuacauucuccggggugaugaugacucacucucugacaagcauggcugcccagcguaugucagcccagagaucuugaacaccagcggcaguuauucgggcaaggcagcggacguguggagccuggggguaaugcuguacaccauguugguggggcguuacccuuuccaugacauugagccuaguucucuuuucaguaagauccgcaggggccaguucaacauuccagaaacucugucucccaaggccaagugccucauccgaagcauccugcgacgggagccgucagagcggcugaccucgcaggaaauucuggaccauccuugguuuucuacagauuuuagugucucaaauucgggauuuggugcuaaagaggcgugugaccagcuggugccagacgucaacauggaggagaacuuggacccuuucuuuaacugagcucaaggcccagggacacauagcagguaccaggagcaagagagagccccagaaaggaguucugggacacagguggccuggcugagaagcaagacggacauucauauuuacacauuucuugguucagagaaggaauauguucuaggagcugacggaacacguagcaugggaacaagacgugugggauggggguuggguucagauggacgggagccccuccccuaagcuucucuucccugggguagccugagagucccccuuaccaguagggcuauucuaccccacuuuucauuuuguucagaaauaguugcagaucucgauagaauccaaacucuucugccucaaacaccuaccuuggcauugcacuguuagcauuuaacuucuuguuacgauucagggaagggacaauugaucgaagauuuuuuuuuuuuuuuuggaacagaccaaccaccuauguaauaauuaauaagauucaccuaaaaauaauaauaauucggugcacacagacugaccugaaaccugggugcuaaacuaaaagaaaacaaaaguuccaguugucgucucucauucgcacuuuccaauucauuucuucuaaauaaacgauguccuauucugguuaggaaguaacacauuaacgcuuugcucccugaacggggagggggagucuguuccuccacagacauuucuguuuuguaucagcugguuuuuguagcaggaaacuaucagaagucaaacuuccagauguauuaucacaguucaggggaagaagaaaggaaaagaagaaaaauccaacuccuuucugguuuuuguucuuuugaaggaagaggguucacauuguagacauugcucucugcuccaaauucagugaggggcucccagagggcaggcgccuccuggagucagaucuuuuugaugaugcugaucucaacguuuuguuuuugcuuuaugggaaacuaguaaaacgagacagguugucccauguguauaaaauacagggcagcuauuuccuuuucuuugcuaagaaugauccuuugggcuuggaaaggcccucugguuugaacagaaagaguaaacgggcaauaagccaaaagccaggaugauauacauacaaacagcucucugucccaauacgcaccuuguauuuauuaaggaaaaugucacauugugauguauuaagccaguacuucaauuacgggucaacgggaugacauguuacaugcuguaguuuaacauuuauaauuuuguuccccuguuuugaguauuucugucccuggaauaaccuuuuauuuggcuuucucuagauagccuuauuugauuuugaguggcaaaauguuuuuccuuuuguacucuggcuuuucuauugcuguaugauacagaacucuuuuggcauaaauauuuguguucccaguaccucagucguuuggguuuuccugccugcaucuguuuugugaaaugguccuguuuuuggguaggugacacguggacucuaguguguaaauguuacuugaaucugugcuucacucuaguauguggcaugugugugcggacucuuggaugcuucacgccuacuccacuggagccccuguccccaggaggacagcuuccccacugauaaucaggagaccaagcugccauggauuuacccuugauucuauuuugauaauggaagauacagagagaggguuuuuacauucagaagauggugcuguggcaagaaggaccuuuuaucuucccucuccccuguuuuuaaaguccucggugggaggaaagauuggaaacaugcaugauggggacuaauggccucuggugcuuuguccuguauuugguuuaauguuuuuguccuaaucucuucaaucaauaaaauugugcguauuuaacuaaa

SEQ ID NO: 12204 - RNA, 2162 nt, Mus musculus
ucgcgggcucgccagcaccggcaccggcugcgccaggccggaacggggcgcgcuugcggccgucgggcgccuucuuuuuggaccucggggcccuccacaccguccccucccccgcccgccucccuccccgccuccagcgcccuccccgcggagguccccccacccccaucccgccucccugcguccuccgggccgcaccgcccgggccggcgccgagcgcggggaagcuggcgggcuagggcgccccgcuccucugcucuacccucccccgucccggcuccgcgaggccgcacgucgccgcccgcgagaugaugcaggacguguccagcucgccagucucuccggccgacgacagccugagcaacagcgaggaggagccggaccggcagcagccggcgagcggcaagcgcggggcucgcaagagacgcagcagucggcgcagcgcgggcggcagcgcggggcccggcggggccacgggcgggggcaucggaggcggcgacgagccaggcagcccggcccagggcaagcgcggcaagaaaucugcgggcggaggcggcggcggcggcgcgggcggaggugguggcggcggcggcggcagcagcagcgggggcgggagcccgcagucguacgaggagcugcagacccagcgggucauggcuaacgugcgggagcgccagcgcacgcagucgcugaacgaggcguucgccgcccugcgcaagaucauccccacgcugcccucggacaagcugagcaagauucagacccucaaacuggcggccagguacaucgacuuccuguaccagguccugcagagcgacgagcuggacuccaagauggcaagcugcagcuauguggcccacgagcggcucagcuacgccuucuccgucuggaggauggagggggccugguccauguccgcgucccacuagcagcggagcuccccacccccucugcaggccggagaccuagguaaggaccggcuccagggaucgaucgggccaggccgcggguccccuguucaccucgccaccgugcuggguaucccccccccaucccccuccacucuccucgcugcccuccaccuagccaggcaccgccaccucauuccacccgcaucccuggcaagcaguucaguccccacaggggaaacagguccuagggucggggagaaccagugugcccaggagagguguaugugugugugcgcgugcgggggugugcaugacagaagauugagaaagucaagcauaggggccuugugcccaaaacgccaucccccaaaccccuuucuuucuucuuuaaaauucccuucuuaaaacaacuguuuccaaauuccacccccuccuuuccgcccacccacuuccucuugcccuugggcugaaauccuuccagguuguucagcgaaaauucucgcugguagugauaacagggcuuagcggucauagaaaacagccacagagacauccucaauaaccgacuuuccccucuggguuuuugcagaugucauuguuuccagagaaggagaaaauggacagucuagagacucuggagcuggauaacuaaaaauaaaucuauaugacaaagauuuucauggaaauuagaagagcagagaccaaauucacaagaaucagggcguggggcacacuuuuaaaagagaaagcgagacaggcccguggacagagauucccagaggggcagcagcagaccccccacaccucugcauucugauagaagucugaacacucguuuguguccccccaccccacuuuuugacgaagaauguuuuauuuuuauuuuucaugcaugcauucucaagaggucuugccaaucagccacugacaggaaaggcaucccuguggacuggcuccauuuuaaaaugguaacaaucagaggaauuuuaacaccuuuagaaauaaaaacgcugggaucaaacuggccugcaaaaucauagucagugaauuccuuaaaaaccauacuuccucugaaggaaaagaaaaacauaaauuacaaaagacaacauucuauuuauuuauugaugacccaugguaaaaugcaaauagauccggugucuaaaugcauucauauuuuuaugacuguuuuguaaauaucuuuuguauauuauuuuucugcaauaaauaaauaugauugaaaaauuuuaagaa

SEQ ID NO: 12205 - RNA, 5491 nt, Mus musculus
uuugucguuaacaugugauuuauuuaaauuccuuaacugcaaaugaucaggaacauaauccacagauuaaacucuuguauuauuuuuguuauugaaaucaaaauaucuuaauuacaaaucacaucgauaaaaauuaacaucuuaauuugucaauuuaaccaucacuuaaagcaauuucggcuguaaagaaaaggaguaaaccaugcaauaaauuaacauugagaaggcaaagaggaauaauaaugaaacccguuugucuaaaacuaacaccacguccaacuguggaaagugcauuaacacuggaugagccaagaauaggauggcaagaacuaaaauggccacaauugggauuuuggaauucgggaccaaauuuugaaaugcauuucuuauaacuucucucucaauaguaugauacuuccuuuuuucccccuggagugggggugggggaauccuuuaaacgguauacauacacaaaagcuaauuuuauacaugugaccucagcaugacaugaccaugauggcucucugaaaagcaagagcagaauuagggaggaaggcaguuccugaagaacuggauuuccagcguagguggguagagaggacaaguguggagaggcauccuuguaacuuggccagucaggcaauuuuugaaaaugucuaucaccuagcuauuaccucuacguguuaugcaaaguugaacgaggucuucauaucugggcaugauauuaaguccauagacauguauauucauuucacuuaaggacguccgagaucugaaugcauccagaauguaaggugaaagcaaagggcuccaaugugcauaaccgguuuauaccuuccugcauaaaggcagcacugccuuucaauacucucaagagccccuacugucuacuugguuucuuuaccacuuccaucuuuacugaguuaagaguauugccacagaccuguaaacucguguggugggccuaacaacaacaacaacaacaaaaagagcacgaacaaauauuuuacaaacuugaccaucuucuuuuuaaauaagcccugcaggaacuagaauguguccgcaggggaaggagugaaagggagaaaggggaggaagauuuucuauauauacauuuguggaucauuaaauguugccagaaaaaaaaaaguguugguauggagucgguaguauuugugguaauacacacaaugaguguugaauacaauaauaaaguaacaguccuuugaacuggggaaaauugugcgugaaaaauaaaacuauuuggaauuuuauuaugugguugguuuggugugugugugucugugugugugugugugguuuuguuuguuugcuguugguuuuucucuccugcuaccagguuggccaugcagacaaaacccucaguucugggagcuaggaaguauuuagcacgggucuggaauacacaccuugguaguaggcuggcuccagggcugagggcucgauggggcuccucguggccacugaggcgcugccaaggggcagacuggcgggcaagguagcgccauaaggagaguacugcagcgccugcucguaugccuugaaguccagcuugugcuguugcucggaggaggacaugagguuguugauggagaaggggugauuaaaggaguaguggggauccccuuucagaugcagcugagauucguggggugccaggccgugagccgggugagagggggguacagaugcuagcgccccuggcccggagcuuauggggggcgcagaugaagacgcuggagacuucaacuccgaagcgcccccugucgccguggccccgcugugguccagagucugggggcuggcggcgggcccuggggccggcgcgcccucuagcuggcuagccuuuccgugcacaccccggugaaggggugacucggcgcugggguuccccgggccugagggguccuugcgacuuucugggcccccuuuggagccgccgcccccacucccaccuccggcccccggcugcuucucacacuugaagcgcuuuuggcggcgcaaguagcagccguucucgaacauguugccggaguccgggugcagcguccaguaggagcccuugccuggcuuguccggggaucgugccaccuugacgaaacaaucguugaaggacagcgaguggcggauggaguucugccagcgcugcugguucuggcgguaauaggggaagagguccaugauccacugguagaucucgcucagcgugagcaucuugcugggcgccugcuggauggccaucgugaugagcgagauguaggaguaaggcggcuuggcgugaggguagcugcgcuugaaugucuuggcgucgccgccgccccccgcgcggcugcggcccagguuggacggcgcguacgccaugggacucaugcacggguucauggcggcggcguagggacccaggccguucauggagguggcgggcugcgcgcccauggagcccaugccucccgggcucagcgccguacccauggccgugacgcccgccgcagucaugcuguucauggcgccugcagaggccccuggcaugccagccacagcaccgggacucaggccggccccuaagcccguguuggcguaggacauguugaaggaagccggggucauguugccgcucguggucaugguguucauggucauguagguguucauggaguucauagagcccaggccggaguucauguugcugacagggacagaggaguaggccuggagcggagacagcgagggaagaggccccgaagggcgggguuaguagugugccccagaguuuggcuggcccagggugagcccggggcgagcuaacagcauuucugcaaagcuccggaacuccccagccagggcaaacuguuaggcgccuuuuccugaccacgcaaagauggcuuacauagcgggggcgugggggagaauccuagcgcugcaagcaggaaagauuaaugcucacagaaaauauguccccgggaagaugcauaaucgccuuacaagccuggaucaggggcuggcuuuuaaggucccuucauuucauccacggcaggcuagauccaaggauccaaucccagaccagccuagacaacuugccuuuuggcccggucaauuuugaaauuccgaaaauagaauuuaugucggagccccugcuucuucacuucacccacacaggccugcuugagugaucaaccggguaccagcuagacacccacccuguggagggcuggcaggcaccgcugaucgcacaucgggaugcaucgugcuggcugcuguuaaacucucacccauauuggccuauuugucaauaugacccucccuccgucccaauuacucaucucccagcaacuggcuuugucuuaagaguuggugccaaagaugacuuucuguuauuauauuuagaaauguuuuccaccuacuuguaacaaugauaguauuuuaaaaaagaagcaaacuuaucaguuaaauaaaguucugggaaaaaaaauaaaaugaaaaaaaaaaaaaagcugcacaccagaacaacgcggugcauacaauuaacuuuagcgugacuuugcauguauagcucuucacgcuauacaaaaccucgcguuaauucuguuaccuguuuguaguccucuggcaauugaaaacuuugguaacacaauucacacacacacacacacacacacacacacacacacacacacacacacacacacccuguaaccgauaguugcugcugcucacaccaaagccuaggcuuuagagcuauaguucggaccaacuuaaaauucccaagugaaacucuacuugcuuucucuuaaugcuauucugcuuccuaauucucagcuuugagauguaagaaagcucuuucuaugggggucuucucuggugggccgaggugauugcaucaaaauuaaacuccugaaaguggucugagcgccuacuaaaaguuaucgguaagcgaaaucuccauccguagcagucgagauaauaacuagguggcuaaaaaacaagaguccugacguauaacugcuuauuugguaaucuaacagaaaauauugacguccuuaaauuuauguucaucagcaaauguaacuccaugugaaacuauaagagaugaauagauuucaaaaagaagacucaaaaaagagaugguucccaaagaaacacagaaacgaauaaauaaaucgccgcgaaggucuuuucggacucuguacuuuucuguacagaucuuaaaguacuuugggauuuauuucuaguccucucuccaagaucgcacgaggcuuucucgguaagcgcuuucgauaacgguaauuacacuuuugaagguaaucggcagcuguuucuagaaaauacuuucaauagguaguggcccugccuguaccugauucuccucgcaaugcuuuugugcacaauguaaaauaaacccagugaacaugccaccaaggggacaaugaagagaaacagguucuuggccccgaguucuggaaaaagauucuguucgcacuagcgccacccagcgguccuagagacgaacgaauagacacuuuucuacaaauggcuuuugaagaauuaaguuuuauaaaauuuagaaaucauucuuuacgaaaaacuccaacuucugcaacagaucauuuuuauccaaagacgucggcuaauuacauggugugaccgagaggccucccgguaagcgagcaccgacucucucaguuauucuuuacucaagccagagcccgccugcccgcccgcggcucccggggcugggcuccagccccggcucucuagcgggcaaagacaagugcuucccuuccggagcccguguuuucaaagcccagaguuucccaaaacucuccgcugguugcaagcgccaggacccagcgggcagcgggcugaucgagaggucgggugggggccacacuggaagccgcgccucgggcgagccgcccccaccccgcccgccccaguccgggcaggagcccaccucgccugagucuccccggacaccgacucuggggacgccccaccgccuccccgccucucaccuccugcguguccgcguaguagcuguuccagucguugcucucaugcccuuccaucuucacagucccuaacauccuggagccagcccggccgacacaaccauccaacccugugcggagcgacgggcgggugcgcugcucggggcgggggaggggcgcggagccgcugcggucaccggagcgcucgagggcccagcgccacccgggcgaggaggaagcccggcgcugcggggcgcggcgugcgcggcggcggcggcgcggcgcggcgggagggggcagcgccggggacaggaggcggccgcggagcgcggcgcccggcagcgccuccgcgggaagugagcgggcggccugugcgaagcgagugcaguugagcugauguggaucuuacgucgccggagugcccaccuccucguccucuccccauuuguccgccgcacaaagacgcucgcaccuacaaagcc

SEQ ID NO: 12206 - RNA, 38863 nt, Mus musculus
ccugguccacagaagauguuuauuugauauaacaaaacaguacaguuaguguuagacccaaccacaaagagcaagggaacgaaaaauuuauacaguauacauagaaaaaacaagauguuuacuaugacaacucuauauuccuaaaauaaugcuucuaaaauuacucacuuauugaaaucuauaugaaaaaaggauguuaauagcgacaaagugcauaaaaccaaacaucauauuuucaacaaaucaacauacuaggcaauuuuacuaacaaagcaugauuuuuuguuuguuuguuuacaguaugcucaaaaugucuuuauaccaacagggugggcagaacauuuauguuucauaaucaauuacacaauauuagcauaagcuuccacaacuacagagggacuguuuugaguugguaaagucaagaaacaccagauaacuucucugaauugagaauuuuauccaaauaaaugccacauaccuuccagauauaagcauauuucuuuauaucauguaaauggcuuuacccauauaaagaaaccauacaguuuaagaaucauuauaagaucaacagcuucaugauccaggcuuaacaauuccauaggccaaaaaaaauuucuuaaaaacuaguuuuauaaaugcagaauauauugcaugaguaacugcugguuuuuuaaagaaaauauauugugcaauuguggcuaccauguacugcugacaaagcauuauuuucauguaaaacaugaaaaaaaugaguaaaaaguuuucaacugccuaugaucaugaugagaauuuacugcuuucuuaaaaaauuauauuggcauuucauuaaaaauaauucaauaagggacaaacucccucaccaaaaauaaauaaauaaaaaggugcauuuuaaaugacacuacagcaaugcaauggugaaaugcugaggagcugugaaugugcugugaucuggcauuaaaagaacauauuaaaaagagcauuaaugaaaauuaaguagaaaggggaugaaaacuaaacuaucugaguuugugcaguauuguagccaggcuucuaaaauuagauauagaaaauauaaauagacugcugagccaccaguguccaaaaauaaccaacagaaacaaaaacccaacaaacaacaacaacugaacaaaaacauuaacaaucaaaaggaaugagauuaggaaacgcucaguuaacuugauccaaagcucugaguaauucuucacccugcaguagguuucugcugccuuguaugggagcauuaacuucacaaucguaacuggucagcugugguaauccacucucauccauugacugccccagcagucugcaugcuaaaucugaaaaacaaggagaugccuaguaucauuaaauugauuaaacacuuauuaugcaguagguacuggguaaaauaaauuuucuagaagggcuuuaguccccugggcaaacccuaagcuauguaaauaaguaaguguaaucaaguuuaugucugcugucagaauguuaacacaaagugugcucugaaaugccuaaucccugaaugcaggcagcagacaaaaugcaccgcacaucuccuuuccuuuauuucucuuugaggcagcguuuuacuauguauuuguaguccuuguuggucuggaucucacuuuguagaccagcuggccucaaacucagagauccaccugccucuggcucccgagugcugggacuaaaggcacuaaaggcucauccaccacuucacuucuuaaucguucuaaggaaccaaaaccacugucccuuggagaaaaacucgaaaaaaaauuuuuuuauauucaaacuuuucuuuguguuggcuaagagcagaaagaauacacuaaccggaggguauuaaaauaauagucuuuugcuccguuccauucuguucacuagauaugaauccuuucacucguuuccaggaaagugacauaguaggugcacagucaccugguugcugcaauaauguucccuaaaaagaaugaaguuaauauuuaguauguugcauuuucuuuacaauaaaaaacuuuguaaucaguauauauuuaauagcaaccaaaaagccaguuucuuaaacaauccucuaaaaauuuuuucucuuaaauaaucuuucauuuauucuuauaauagcaaugacaaagguuauuucuuacccauuaacaauccuauccauaaaacauauuaagacauuguuaauauguuuuauaauacuuuccacucacucuguucuggcaauaggcuagccucaacuaucucuaaaacacagugcuucuuuuaaaaauacuuuagauuuauuuuuauguauauggguaauuuugccugcauguaugccagcagaggccagaagaacauauuagauuugcugcaacuggcauuacagagagagggcugugauccacauuuugcgaacugggauuugaaccuagagucuucagaagagcaaucagcacucuugccugcugacccaugucuccagccccagugccucuauaaggaggaaaaagaacucacagagaaacgaaugagaguggagggacacugaggguauuuccucuacauuugucugucauguuugguuucuaacaccagaauuuagucauuaaauguaaguuaaaaaagaagcccaaugauagcuuugaaaguagagcuuuauuuuuaguauucauuuggaauacaaugcaccacugauacuuacaauuccugcugcuugaaaaagggagccaucauguuccauuuuucgcuuccucugagcauucugcgaagcuauugucuuuggguuuaauucuuccucaggaacaguauuucuggaaaagaaaaaaauauauaaaaccacuguuguucaguggacuuauauuuuggggacuacugaaauacaagaugauucauuucuguauaguauuuucaacuuauaaauguuucagcuagacacaccuauaaucccuguuugaauccagccuggcuauauuuuaauuuuaaagcuagcuuugacuacauagugagaccuugccucaaaaacaggaacaacaaccaaacaagauuuauguucauuuuaaccucacuuuaccacucagggaugauaugacagguacucuguaaccacuuuauaaaugagaaaucgauggcaguuugguaguuuguucuaagucccaauguuaauucauuuuagcuauggaaauacaagcccagccuucacauucuugucuccucagugaccuuuguaaucugcuacuuugaccucaguacugaucaauaugucuaacugcuguaucugaaauuaauagcaugcaacaaggaaccacuuucugaagucacuaaguuugcuguuuguguuggucuuucaauagaaagccagguaaauggcugagucacagucauacaugauuaacuccucugugaauguggcuuacaagccaugcaguguauagacaagcugguuuuaaauuuuuauacaagcauguuauguucacgaaauaugucaguuuaucauguaaguaucaccucugguuguacaucuauuuauuuugugugugugcacaccacuacaccgagucuugguuuuaagcuuguaauucuccugacuuagcugccugagagccaagacuaaaggaauauauuacuauauccaacugaaaauacuaaauucaucuaaagcccuacuccuuuuuuuuuuuuuuugacucaagaaaaaggcaggccugucccagugcuucaaguaggauaggggaacauggcucccugcaguccuuccuucugcuaucagccacagcuugcucugucuagauauaauacaaaaggaguccuuuuucuucuacucaccaauuagugaaaaggauuuuccuugcuuuaaaacaugucaaauacuauuacauauuauauacagaaauucuaaauauuugcucaagcauugcuucauucuaucaaaacaauacugcaagucacguuaggacucuugguagaucuaauaaaagcuuucuuuuucuucuuacaauuauacacaagauuucagaaagaaggccuacaaauauccauauuuaccaaugagaacucaagaucaccagcugcaaucugggaugaaaaagaaccauguggcugaaggguuuuucuucagguuaauuuacaaaagucccagguuagaaagaucuaagcagggaagacagcuauuucccauucuuaacagcagcaugaagagauuccuggcauuuauagaacuuacuggcuggacuuuauuuuuagagauucaauuuauaaaugacagacagauguuggaaaacaucucugaccuccuauauuuagacaguugauaggauuguuugagagagagaaguuagaccguaacuuagaaacuggcuuuugaguguuuguuuuaauucagacaaugcaugaaaugaacuuuacgauguuccuuaaagcguaugucagaaaguuggcucuauguuuagaaaucauuuaacauugcauauauacuagaacaugcagaauuauguuccauacaaauaccuuugauucaaaguggcagacagguuaaggcuccuuggaugagcuuugucugucuguucuaugacucucuuuccugcucugucuggugaggcuguccgacugugagugccacuguaugcugaugccuuagcaguggucguuucuugagguacuuggguagaagauggagaugcaaucaguauuuuaauaucuucuuuauuguccuucgucucuguuuuugauucaucagugguggcaguugugguggcaguggcagugaugguagguuucuguaacugggucugcuggaacccaguaacugugcucauacuuggagggcuuggagaauugcucucuaauggugacaacugaucaaaggaacguaacuggaaaucaucauccauugggauauagggagccagcaucuccaaaucuaaaucaguguccuuucaaacaauaaauacaagaggcuuuauaaugaccagucuuguaaaaggaauaacaaguuaaacccagucacuuaaaguacaaaacaagcaagguaauaagcauaccugaguugaaaauggauucuuugccucugugucuucagcaaacaguuuuuccaccaguuccaacuugaauacauugaccauaucgcuauccacaucaaagcaauauucacugggacuguuaggcugggaaaaguuaggaguguuuacguuuuccugaagaagucucuguuuguuaagaaguuucagacacacaaauauuacauagaguuuuagcuaacuaaaaauuacaaugaaaaaauguguuuaguugaugugguggugcacaucucuaaucccagcacucgcucaagaagcacaggcauuagaaucucucuaaguuugaggccagccuggucugcagagugagugccaggccuaaaagggugacauagcaaaacccugucucaaaaauaaaauaaaauaaaauagaaccaaaauaagaccagccacaaauguugucuacccucaccccagauuuuuuuauucuacauaauaacauucaccaaacaauucaguucuaacuuuuuuguuuuguuuuguuuuuuuggagauaggguuucucuguguagcccuggcuguccuggaacucacucuguagaccaggcuggccucgaacacagaaauccgccugccucugccucccgagugcugggauuaaaggcgugcgccaccaugcccggcaccaaacaauucagaucccacaaugguacauaaucauccaauuaauuagaugauauuuucaccauaaucuuaaaaugccuauucuacuggauauuuuagaggauacucuauugugcuaggaguucaagaauuucaguaaugaauaugguagcuagacugagcauaaaacuuuacuuuucuucauuuuucacuacauuuacuuuauaaaaucagugacaaaaugaaucacacacuuuugugcugggcaaagcaucagagaaaagaauacauucucaaccuugguuuugagauuccauacuguuuaacuuacacuuggcagcuuuaaucccuaacaguuuaauggagaaucaauacuuauuugugcuucacuaacuuaagaucuaagcuguucugcuccuaaguacagucuuaauaguagaaaguucagagauggaauugcucuguauuuggaaacagcguuuuugacacuuucugcccugguccaaccuagauaugaugaguuuugaguucuaucaauuucaggcauuuauuccuaaccuuuucuuagaucaugguaccaaccucaggugaacuuugucuagugcuuccaucagaaggacuugcuggcugaucuugaaucuggggcaugguaaaagaaagucccagugacucuggacuugauucuaauuuuaaugcaaccucuugauucagugcaggaucagcacuacuucgaaguggcuuuggaguuuccgaugaagguaaaggagacauugccagguuuauauuuaauuuuucauuagaagagggaaacauuacaucauuauauaauggaacaucuucaaguuguugaucuucaguuucugugucugcagaggaaagcguuugucaaucaagaggacaucaggauuuuaacauucauagaugauuuucugauuuuuagaagaguugugauucaaucaguuucuuuacuugaaaguuuauagauauuauacaaugaccacuaaguaaguguaaguuaucuguuauaguccaccacugauaggaguaauacauauaccuucaaccuuuuuauauauaucuuaauuugaaguaacaauuuucauuuuucauguuugcuuugaugguacaguugcuuuguacaaugccuuuaacauuuacccaacuacauguacugcaauuuaacucuacugaauggugcagugagguggcugagaggaaauuaacacggcaucaagaaauaccuucaggauacucugagcuacaauucccaaaaaaaacauaaaaauaaaagcaggaaggcugugauauuucagaaacaaauauuagacacaauacuuuugaggagacuauuaaaaacaaaacaugugagcaucacgugaauggaugagccaagagcugaggcugcggaggcauggagcagcugagcagggacuggagugguggacagaguaacuaagcacugaccaucgcugccaaaauccagagagaugauggugucgccggcagcuggagccagcagagugagagcaucaggcuccuucuuaagcuuaucaaaaaggcagcuuguauccucugauucaacuuuggugaacagcugagucaucuucauaucugaagauucaacugguuugagcacagauucuguuuguugaagggagaaaaucaagucgugcugaauaauaccacugucaaaaaaggagagauuaguauuuauaaacgagcacuagaaacaaugacaguagggggacuauggaaugaccgugucucuuaaaauaugauuuauauaguaaaagcauuuuaacaccccugagaugaauaaucuuucauguauacuugcaacauuucucccccacgcccccagugcugaggauugagcccuaagcaaguguuguacuauugagaaauauuuauuguuuuaaaacaccaauaugaagauaaaaauguaaacaaaauuuacuaacuauucaacuuauuuaaauugaaacaacauugagaagagaggcggugacaagaacaugugcaguuaaagugcaugaaggacauaagcaggaaggacuucugugcugaugcuacaaugaaauaggcacaaaauaacuguucagcauuaauacgcaaggcauggucuauggguaaucuuagauacaauaauggccacagucuuuaugagggguaucauauuuucuugguggaaauaauauagugaugucauuuauaggauagggaagaagaaagagaaaugaugaaaaaccacucagcaucaugucuggcaucaagguacucuagauaacauauuacauauucaauaaaugaaaugcacuaagaguacaaagacaaaagcauaaacucuugucuucaaguaguuuauaauucagugugaaauagauaagcaaacaauuucaauauacuaugaucacugauaaaaugaagaaaggauguuucagagaaaggcuaaugagcaaaacuugggaucaaguaacaaucaugaggaaaacaagaaaaauaguuuuauagaaaggcaaaaaucacaaaagaacucuuuggcauuaagaggauucuuugcaauuagaagugguaaggcauuaaguuugauccuagcacuaaaaauuucccccugaaagaaacaacaaaaacuaaaaguuuuaagaccccaaaaauggccaaaguaggguaaccuggguuugguggcaucuaugaaaguugugcuggagacuucugggcagcccugcaaucccacacaguagguaggcugugaauucaaggcuggacugaucuacagugaguuccaggccagcaaagccuauccagugaggcaggguaaagagcauggaacauaagaaaaugagcuaaccacaguagagagcucugccuggcaagcagauuagaauguuucgguaaugaagaggaacugaacuaaaauaacuuauagaguucauaaacauaaaauaaagucccgggucauaugacacagccugucacaaaggcggucauuuaaacuucauuagaaucuuuuuggccucaagaaacugaacuaggaaaauugauccacagacugauaaauaaaugauauuauuuugugggaucaaugacacaguuggcuucagaagguagguugggguauaaaucauaauccaguagaaaaagaaagguaaaagcaaaacucaguuuuuauuuauuuauuuuucuuuucaagacaggguuccucuguguagcucuggcuauccugaaacuuauucuguuggccaagauggcuuugaacucauggagaucuaccugucucugccuccuccucccaagugcugcgauuaaaggugugcgcuaccccugcuagguaauuuuaucucuucuuaauaaaggcacaguaaauccaaagaguuaccacuuuuccucacaaaagugucuccucccaagcuuaccuuacaacauaauucacacacacaaugcacuguggcugggaguucuucguauuauauaugacaguugcuugaguuucaacccagacauauccaccucuuuuggcaagcauccuguacuguccuguggugacuuguccuuuaguaaacacuggggauaagaaagcaccacaaagaaaauguagcugaauuuucaaucaaguaagugucaaauguagauuguuacauuuuguuuuuuuguuuaaagacaaggucuuucuguguagcccuggcuguucugaacucccuauguagaccaggcuggccucaaacucagagacccaccugcuucugucuuuggagugcugggggugucgggguagguagggguacugguaugugcuaccaugccuggcuggaucacuguuuuguuuuuaaaaaggaaagauuuaaauaaucuuuuauuauuuaaaauaguugugacaguuuaagcugauagagaagcccaaacccaccugaauauaaaccccaaaauaaaaccccuaucuuacuguaaaagaaugaaagccagaaaugaggaacaggguagcugcaguuccuucaaugagguauggucacacugucagacuagagacuaagcacaggacacauucaagaaaaugauacaaccaaaccacucuacagaacuuugacuguaaguggauaucauacuguagccuuccagcaguucaugaagucuaaaucauuuacugauugaggagaaugcuguaaaucaguaaagacgaugcuauugugaguauccaugcucugacuauaauuugggcaacucauacuaauacagugauauucaauacccucagaucauauuuggaagucauuuuuagguccagauuaaacaagcaagugagaaacuaugaacuuuagcuuacuuugagaucucagacuucaucauaugucaagagugucagauauuacauguguguaauacucaucccauucacucacugauucauggaacaaaugcucugacuaccuucuauugaccaaccauugauuucaugacauguguauggagauaaucuauaauauuugacuuuuauuuacuucuguauuuaaaauucuagggaaguuuuauguauuauuaagugaacagcuguaacauaacaguaauuucaugaucaauuugucuuaugaagagucuggagacuggguggcaauuuuagaaaguuagauagaacaguagagacugcaggacuuaagcagugagacuaucuucuugaguucuuuuuuuauuuuuaaauuuaauuuuuaaaaaaaguuuuauuuauuuauuuuaauuauguaugugaguacacuguagcuaucuucagacacaccagaagagggugucagaucuccacuauggaugguuguaagccaccaugugguugcugggauuugaacucagaaccucuggaagagcagucagugcucuuaaccacugagccaucucuccagcccccuccuugaguucuucuauuguacuuacuaucauggugaguuuuggucagaugaucagaauccaaagcaugauaauauucauaaauugagcggcccaaaaguucuuccggcucauaacccaucaacucaguaauucuguuacaaaacaaaacauuauuccucacuuaauaaauuuaaaauucacccuuaacaauucuauauuuaguauaauagccagacuuucugugucauuuagauucauccuugauucuuauccuuucaacucaaaauaaugaccuaucuuuaaaaaauauuuuauuauacauacuguuacuauuaacgcaggauauuauuaaauauugauaaugcuaaaugaaaugacaaaaguuccaaagacagucacaaauacaguuuaaauugcuagcaguauuuuucauagagcuaaauuguuuaccuuacaauuuuuaggcccauuggcaaggccucacuuuaaaagcuccacuaucauuaagccaaggauauucauacuaaguagaaaguaaaggaauaaccuuugucauuuuuuagaggauaaauauuuuuacuuggcuuuaauauuaauuuuaugagaauuuauuucagaugaaagaacagcaucuaaucgaguaugggcuggaaucuaauuccauagccugucuggucccuggcaguuccuuuagggagggcacucaagcugauucugcaugagccugcaggaagccaugaagacacacuuuaugaggaaggcaaagcugugcuugauauacuacgccaacugcaacuguuuuccucuaaagccuuucugggaacaaacaugaagcaagggugagacugcuaggcuuagaauucaagggacuuuuuuuuucuuuuuuaaacugaggugcugguaaaagauacuuacaucuuuuauccaaaauauaagcaaaacagaaaacaccuaaucagagaauaggcauaagcaagguaugcucauacaguuuguuaaauaauauaguuuguuuugucccaguuuaagaucugcuauuuacucuaaaaccaacaaaacagauuuuuuaaaacauaaacuagcacuucuucacaaagggaccaagacacauuaacauagacggcagcacuacaaaugaaaagaaacugcuuuaaaaauauuuguuuuccccucuauucaagaaugguaauaggggcagaaucuagggacucaaaaauacuaaagaaaaucccucccuacccccucccccuugugcugguacugagugauggauccuagggucuucugcaugcuagacuuucugguucaauuuuuucucuuucuuucuaggaacuucuugcauccauaaccccucagaaugaagauauggaaaaaacugccuaauuaugaaaaucuuacaugacauuucuaauaucuagggccagcagguaaaggcaccugcuaccaaaccugacuaguacaggcaaguggagagaaagaauucaagagaugcaggcaagaggaucagauaaaugaagauuuuguauacugagacucaggacguuuugacucaaccacauaucaaccaguauuucucaaacugaggaauguugacuauuaaaggacauugagaaaucaagauagaaauaccagacaguuuccuggcagacugauuucauguauguugggggaagcaagaggaaacagacuaaaguuuagagaacuacauagaaagucaguaccaaaagaggguaagagacccagaaaaugaguuguuuccaugcugaguacugauccccaggccuugcacacucugugagcacuguaccagucgcuucuccaauucuuacaaagguuguucuuauuagauuagaaaacuuguguucuaaagcaacuauauaguauggcauuuguccacaucuuaaggggaagaaucaucauuucuaugaacacaguaaauacucaaaauauaugugccaaaugauuauaucuuacauuacuaaguacaauaaacagcuauuugcggauagucuugauauuagaaguuuagacaucagcucuugguauagacagguggauggaucucugugagcuggaggccaucuuggucuacaggguaaguuucagaacacccagggcuguguagacucugucuuaaaaaaccaaaaacuaaccaaauaaacaaacaggaaagugauaccauaaaaggacugaugugcucaucguuaucuaggugccagugucagaauuucaguuggcuacagaacaucugccucuaauaacaggcuauacugcuugcagaaaaaaggaccaguaagacagcagcagaauaaacacugacagaagcaugugcaagggauguugccuaagaugcucuuaggcauccuuuuacagugugugcaaaggcacaagacauuaaaaaagaacaugaaacucuuuguaaugaguggcuggaaccauauccagaucggugauucucccaacuccugauuaauuuggugaacugagaagggacuagacuguaaauaccuuuccuugacauuuuaauacauuuagauuuaacugcacaagucuguuuuacuuucagcuuuuaaaauauauaccuauuuuaaauuuuauuuauuugagacagacaggcaggcauucauauguaguuuuaggucagcuuugucucaauucccaaguguuaagaucacugacauacaacaccacacccagaauguacagcuaucuuuugacaaauaaaucuucccacuuacaguacuacaagaagcaacugauguauuucuaagagaagggcacaaucugauccucaccuugggaagcccccuuuggauacaguggacguacaaguaaaaagguacaaauccguugguagaaaugcagcuuaggaguuuaugguaacaauucaggccaaagggaaugaaauaaagaauuuaaugacaggagcacaagguagauagaacgaugggagagacagugcauuuauuuuauuuuauauuuugguuuuucgagacaggguuucucuguguagcccugaauguccuggaacucacuuuguagaccauaccggccucgaacucagaaauccaccugccucugccucccgagugcugagauuaaaggcgugcgccaccacgcccagcugacaguacauuuauaauauuuacuacaaacuacuacuaaguguaguauguaguaaaguuacagucagguuucaacagugcugugucaacaacauuagggaucacaagaggugcaguaacuuaggcugucugggagcaguagaguaguuuaguaacaggaguauuuauuucauuauuaagaaaaugguguaggcagaaacaucaaguugacaauuacacacaaguaguaacagauuagggaaauggugacaggaaccaaggguggaguugaugaugcucaagaagaacauguggguuacagaccaaaacuguugccuacucuacauaaacuauuuaucuuuaaaacuuacuuucugaauuuaagcaaaauucccucaaacaaaagaacuucaugacuuuuguguucacugcuugcaguaccacagcaagaagucagugccuuuugcauguaggacaagugauccaccucugacuuggaaauuacccuccuccugucucagucuccucauagcuaagauuacaggaggaugccacuagauguagucaagaauuucaucuuaauagauuuuguauaauagcuaaauacaguauuuauaguauaaaagcuaaucuuacauuuuuggguucuaggaugcaucuucauauuuagcuucauggacauaucaauuaaguuuuuauuauagugauaugaaaaggcuacaaaaaaucuaaauuuuaaaaauauaaaauaguucauuuaccuuucaucacaguaagaaaauuucauaucgaggcugugucgacugagaaaugucuugcuaucuaaaggaauuucaauauuugacggaugaggaauggguucacaaaucagcaccaagcacgucaugggugguuucuuguacccacacugagguugguuacuguugguaucauagacaugaauauggcccgugcagugaagcaccugaauaugaguaagaaaauaaaguuaccuuuuuaaaauagaaagagguaaggggagcuggaaagauggcauagcaguuaagacauuaugagauaaugagguauucuaaaacaaaacaaaacaaaacaaaacaaccccacaacauugugaagguagggugcuagagaugagacagugguuaagcuuacugacugcuuuucccagaggaccuagaucugauuccuagcacucacaaggcagcuuacaaccauuuguaacccuauuuccagaggaucugacaccuucucauuucuucaggcaccaggcaugcaugcccugauauacauggaggcaaaacauucaugcacauaaaauagaaacuagggaucacuuauaauccagaauauggaucaaaugccuucuuuuggccucuguaaacacaugguaugcuuacaugcaaccaacuaaaacacuaaaacacacacgugcacacacacacacacacacacacacaaugaaaaauauuuaagucuuguauuaagucuagacuaucuuuccuucuucacuaaucuggucauuauaguugauuuugcucuggugacuaugguucaacacugaacaaaaaaaggaaacugagauagaaaauuauacuuauauuaggauuuaaauacuaguuggcaaagccaacugauaaguuagcuuaguauagaaauauugugggcuggagagauggcucaguggguaagagcaccgacugcucuuccaaaggucguugaguucaauuuccagcaaccacaugguggcucacaaccacccguaaugagaucugacgcccucuacuggugcauuuggagacagcuacaguguacucacauauaaauaaauaaauaaauguauguauauauuuuuuuaaaaaaaagaaauaucguauuuccaauaauuuguguuuauauaucucaaacugucagauuauuauacugucuuuaauggagauuacauauacugaauauaaaugcaaauaugcaaaagggaauaauuauacuuuucccucguaagucuauuuugaaauugauuuuuauuuuauguggguaagugcucuaucugcauguaugugugugcacuguguguguaccuggugccugaugaggucaggagaggauacuggaugauuuccuggaacuggaguuacaggugacagugaacugacacaugggugcugagcaccaaagccagguacuuggcaagcaagugcucuuaauuacuaagcacuuucuccauuccccucauaacucuaagcaaaacucuuuuguuuguuuuguuuucugagguaaggcuuguguuccccuggcuggccuggaacuugcugugaggacaaggcugccuucaaaucuguagcagaugaucuucugcuucccaagugcuagggucagcugacuuucagcacuccuagugaaagcucuugauacuagcauguauguguauagguuuauuuaucuauaaucaagugcacgcucagcuugcguaccuuccacguugcugacuugauguucaucguccucccccggcuuguuagggugcacuucauucugagaaaaaagcuccgcuguguguuuaguucuuucccuuuucucacugggccuaacgaaagcaagaaaccgaguuuuaagucacagcuaaacauagaaauuuguuaggaugagagcaucaaagcaaggcucucagcauuaacacaaccaugauuugcucccucuucaccuacuccagcaugucaguaggucugacagcuccauccagggagaguguguguaagacggcagugacucccuggacugugggaggagaguccacacuucacaggauuaauuauucaucugugcuggugaguuugguccaaguaaagaaaauaagaaaaugguguaaguguacccuauaaaugucugucaguauacaaguauguccccuucaaaagaacuuguguaaauacuucaugucuuuuaccaacugugauaacucaauuuugaauaagcagcaacguguuuacagaacuuuaaaaaugccaacuuaccuuuuguaaguaaauagcaucugaguaugaaagccagacagaauguucuaucagaaguuacagaaaucagccaugaugguacauaccaauacucucagcacuagggaggcugaaggaggaggauggagauggccgaccugagcuacauaugagaccuguuuacaauuuaaagucacaggaauagggacugggaauguagcucaauggacgaggacucccuuaguacauacauguaggccuggcuuugacacccagaacaacaacaaaaaagccacagaaauaaagcagaggaaaaucaauucacgucuaauuuaaucuuaaugucaaaccucauaacuaaaaaauuagauuacauuuagaugacucugaaacaacaucuugauuuccuuuuuuauugcuuagucugguucaaaacaaauguuuuacuuauuugaaaugcucagagaaaguggauuagauagauauagaacuucuuuuuugaggcaaugacauuuucuaaaauggcugaguguaaugguacaugccucuaaucccagcauuugggaggcagagguagguagcccucuaugaguucaagaacaacuuggucuacuuggaguccuaagccagccaggguuacauagugaaacccugucucaaaacaaacaaacauacaauaaaacaagacaauuuuaaaaaauaaaauuagagguaugauggugguuaggccauuucuaugaauaucuaaaaaaaucauggacauuuaucaaauggauacauuuuaagguauauaaaauggaaguauuagggaaaaaacaaacaaacacaaaauauccauuauuuagaaccgaguguguauacuuagagugaugcagagaucaauaauuagaugcaaugcuauuaagcauguaauacauaauacaguagggucaauagcaauacaaugcaaaguagucaagacuuaauaagacugcuuucaaagaacagagacuagguccugacagagggaauuaagaaagagagaccaguauacucuguuuauaaauuacuauuuuaaaaaaauuaacuguuaagucucuguaauucaacaaguacuucacagaacucucuugcaacuuuuuaaaaaaauuuacuuuuauuuuaugugcagaauuuugcuugcaugucuaugggagugugucagaucuuggaguaacagaccauugugagcugccaugaggaugugaauuugaagugggguccccccucccgaagaacagucaguggcccuaaccacugagccaucucuucagcccuucucuuacuucucuuuuugagacagggucucacucuguagccuuaccuggcuugaaacuaguuacauaaaccaggcuggccuggaaaucaagagaucugccuauaucugccuccuaagugcuaggauuaaagguguguacaaccacaugugguccaacacaacaucauccuuccaauuacagucucaaguuauugaaaacauccuuagaaguuaaagcaucuuugugcucuuaaaaucuuggccaccccccaauccugcuucuuuaggacauuaaaaaagccugaacccaaacugucacuguguauucagucaucaucgaaaaucuuauuaccugucauuuguauuauaacuucuugccuuaauacugcauuucuacuuauaauugucuuggucuuuuaauuaucuuuccuuuuuuucuacucguguauguaauuacuuauuaauucauguaacuacuuauuaauucaaugaguuuuaaaaacuugugaguuuucuaaaauguagaauaacagcuuuaacaaagaacaguauuaacauuaaaugugaaauaacauucucucuuaaaucaguacauuaccaaaaaaauaaaauuagaaacaauaucugacugaaaaucaccugucauauuaaaucaaacaauagacuuucuucucaccauuucuguguguaagcauuucucucauuuccucauggucacauggaugaguaaaaucaaacacacuguguccaguuaguucaaacugcaaacacauuaaaaaaauuagaucuauaucauauaaccauaaaguacccauuagugcucuucauauauggggacuuuaccugaguuaaccccauguauuuguucacguuaucagaaauguaaaccaugucgccgucaucuguuagcaccaucacaaagccaucuagggcuuucagauaaaaacaguccaucugugccuucaucucaucuucacugucuagaccaccugcagggcacacgggaaaagaaacaaagucaggcuuuaucucagauacuuuuaaauuucuauaauacauauauuuauuucuguauacuuuccaguuguuuuauauaauuguuuaaaauaaacaaauuugcaaacaagcaaaucaccaaggguguaaaaaagggugauauuuuuuaaagauagguuaugccuuuauacccaguccuaaggaggaagcagcagaugggucucugugaguucaaggcagccuaguuuacacagcaagguacagaucagccaggguuacauggugagacucuaugggggguggggguggggaggagaaggaggaggaggaagaggagaaggaggagaggaagaaggagagggagagggagacagagagagagagagagagacaaagagauacagguagacaggaggaaaugaauagaugaaaugaagcuuaaaagcuaguaagaaaaaaauugcugucauguggaagaaucgagaacucuucagaaugaaacaaaguaccaggggcuauaaaguuaaugaauuuuauuuauguguuuaaaaaauaaaggauuaaaaaaaaaggguaaaccaaaacaacuuacaguacaaaaaggauuauuccuacaacuaagaaaagcaaagcuugauaaaaggaguaaagaauacggaaagacuuaauuacuuuuaaaaaauacuuuaaaaaaaguauuguguuggggcaguacuggaaagauggcuaagcaguuaagagcacuaguugaucuuuccgaggaccuggauucaauucccagcacugaaaacugucuguaacuucauuuccaaaaaaaauccucuucuggcuucuacaaguacuaggcaugcaaauguugaaggcaaaacacccauacacaugcaauaauaacuuaauucauguuuuuuuuaaagagcggcguuaugggucuagagagauagcuccacauuuaagaaugcuugcugcgcaaccaacaggacuacauuuuggacaccagcacccacaucagguggcucauaaauaccuguaacucuagcuucaagggaucugauacccucuucuggccuccauaggccccuucauaagagcauauuaauaugugcacacaggugcauggacacauacacacaccacucucuuaaaagaaaguauuguagucuccugcuaaaaggaacuucuagauguuuuuaauuucuaauuuucagguccauuauguuuuuguagaacucaccggcauccagaaguuuucucacacguaaauaacugauggugagccucauaacagaagcuuuaucaagaugugagcucacauuguggggaaguggcaacugaugagcaagcucauaaaaaacuucagacucuuugcuucgccgagaucuugcugcaucucuagacuuuucuuuucgacguucagaacucauccuacuuaacaaaaaaaaaaaaagagagacaagaauguacauguuaguuugucuuaacucgaauaaaauuaauuuugcauuucccuguuuacuguauaaagauuagaagaaaccauguaaaauuauuauauaggacuuguauggaacaugaacaaaguuuuauauaagauagcuuuuauauacaaauuuuagaucacugaaaacauaauaaauucuuuuaaaauguccaagcuuuuauuuaacauuuccaaagcagauguuuucauccccaaauuuacaguagcuuauguaucuaaugucucacaaucauuccaaaguaucucaguauagaaaaacccuaaauaaauuugaagaaacuaaaguauauaauaauuugagaauagguaauacauuuaugggcagguuaagacacuaauaguuauacaugauuugauuaguuucuuuugacaucaauaccuucccaccuacucucuuaccaugggcuuuacauuagcugcuguaacaagcuacuacuuccaggugcuuacuuccuuagccacugguuaucuaguacuagaaauaacggauaccaaauaauguaggaauguguuucaaaugaaggugagucagagugcugauccgcaggugggcuaguaaagguaauaaaaguaucuauagaaugauacacaccgagaauucuuuccaaaccagucagauuuguuuaagcuuuaucaaggagagcugucuuccuuugcugagccuccugacucuaaggcuagcccagcugucagcugcuucucuaagccugccauuaucaauauuacuuugcacugggugcuuacucucgcauaacaacccauaaauauauaaacagugcccucauuugaugaaaauaagcugggguuccauagauuaaaaacagcaauuguaugacaaauaggauaggaacaucaguguuuuaagucuuuccuuuucuacagucugcucuauuaauggagaaugcugccucuauuuuacuccuccauuccaaucuuacuagguuagguauuugcuaaauguugaaaacagcucuuagaauuuauuaaacauuuaacaauauaacgggauuuuuuucacucaguucuucuuguauuuuaugaacaaagcacacaauuaucuuuucuuuaagucuccuuccuuuuaauguaaggcugaaagcuacaagcagagaaacaacuuucuuagguaacugucaagaguucucagcaacucucuuauacaguuuucaaaguuuaguaaagaauguguacauuuguuagauucuaaacugugauacaaaaauuucaacucauuuaguggguguguccaacuuuugacaucgcacacagcacugucaucaacugugcaauugaguuacaaaaaauguuucaacaggcauguuuuauguaggcuuacaauuauuuguguuagccauauuugucauauuguggggcauauguggucuguaggucacuggcuguauacaccuaauuauagagcaauuucacucaagaaccuuaagauuuuaaguagggcuauuaagaaacuugucacaaauaggggguuaggucugauacacuguauauaaguguaaaauuuugaaagaauuaaaaaaaaucacuuggagcuccuuauauaaaugaauccguauauucuuaauauccuacaauaaaaaauagaggccauaugagaguaccuuaaugccaacaguuugaaauuuuuuaaguacauuaaaacugcuuucuuuuccucacuauuuucaauuugaacuuuguaaugaaauaguuuugaaacucauuucauuuauauaauacucugaaagggagguaagagagagagcagagaucugcuggguuacaaugaacacuuuauauacacacacacacacauuuugacaggguuuuacuauauaucucuggcuggcuuggaacuugcuauguaguccagacaugccuugaacucacagagcuccaucugccuguuuccaaagucugggauuaaaaauaugaacugucacaccaggcacauuuuucuacuuuuaaauuuuugugcagugguggcugugggaagcagcacacuauuuaaaugauugcuauaucaucuuccuuauuuuguuugcacuaauuuuuacuucuuuacuuuauaaagcaaaacuaaagaaaaaaggcuaaggcuuucuuuuuaaacacaaagcaguucagacuuccuuaagauaauaaacacaauuaauuaaaacauacucucaaaagaaguguauccugagacagguuucuaaguaaggggucuguuguucuaacacugaaaaauaucccuucuaagauuuuuagcuuucauaggaaaacaaaaagaguuuaccaaauuuuugauuuguauuuuacagcacauuugaggagauuuaaaaaaaaaaauaccacuaggccuagaaagauagcucagugguuaagagacagcauugcucuugcagaggaccugaguuugguugucaguacccauggcaggcagcucacaaugcuuuaacuaguacaggauaucugauguuccuaaccaccaagcaucucaccaaaaaggagguuuacagacaaaaggagagagcauagauacugaaacaguuugugaaagagggccaauguauaagaaguuuccuggcuuaaucauuuccacacucugcuuuuugauuuguuuucucagagacaagguccugcuguguugaccaggcuggcuucaaacucuaggacauccugccucagcucuuuaaugcugaaagacacacacauacaauacuuaagucguucacuauuuuguucuuagauaaugugauaaggaaaaaguacaaauuacaauguuaaauuauucaaucaaccgugcguguguguugagcgcauacaugagaaggucacaggauaauacugguguucucaucuaucacucuccugagacagggucucuuacugaacugggagaucuuccuaucucuaccucacaguauugggauugcaggcacgugcagccauacgaggcuuuuaaaguagaugcuaggauuugaacugaggcccucaugccuccacaggcguguuauucacuaagcuauuuccuuagucuacugaaucaaaaaucuuauuauaaauauaacuccucaaccuagcccagaaugauuagauuaacuuuguuuucuacaaucuuuuccaaaaaaguguuuuuaguuuucaguaaaucgauuccauaucaauuuuucacuuuaaaaggggguagagguuacucuuaaacaauauuaaauauuuuauauuuguuauuaagaguacuuuuacuggggcuggagagauugcucagugguuaagagcacugacugcucuuccagaguucaauucccagcaaccaucucuaauaggaucugauguucuguucuuguguaucugaagagagugacaguguacucacaauauaagauaaauaaaucuuugaaaaaaaaaaagaguacuuuuauuauuaauaggcucuuuucaucuguuaauaagacuagaauaucucaaccuaauaucauuuaauaagagaaaaaccacaaacuggaaaagccagaaaaaaauugauauuuuaauauagguacaaauuguaguuuugggacuauaaucuaaaguaccuccuaaagucuaauugauaaacuuaaaaaugaacuuuuagcuggggaugaugguguauaccuuuaauuacacacucucaaggccggcaaguggaucucugggaguuugaggcauagcaaguacuaggucagccaaggguucacagugagacccugucucaaauacaaagaggacuccugacugaguuuauuuuccuccucuaccaccaucaccaucaucaucaccacuaccaccaccaccaccaaggaaaagaaauaaaggaggcuagaaagauaguucagcaguuaagagcuguacuuucagaggacacuagaucugauccuauacucaaaucuagcuucaggggaucagacgcuucaggccccugcacuuacauauagacacacacauacacauacacacacacauacacacacacacacacauacacacacacacacacacacaaaauaacaaaaauaaaucuuaagaaggaagagugagacauuuuagaauacuucuuuaguuacaucaaugugaagguagaagaaucacuuugaguucaagaggugucgagccagccaggugacauagugagacccuuucugaaaaauaaagagaacuaaccuaaccuuuuacaucuuucuagaaagacuagaaacuuaguaauauaaguuuaagaucuugaaauuucuguauuauuuuaaacuaaucucaucaacuauuuaaacgagaaaaaaauaagugguuauauaugccuaacaucaaucacugacuagacuuccaguacuggaaaccgaaagguaaggucuagauaucuuuuuaaagaauuucucaggggauuguggaauauauuaaaauuugguaucuugggcuagugagauggcucagcgguuaagaucacuagcugcuccuugcagaagucccagaguucaaguaccaacacucuaguucaaagggauccaauaacuucuucuggccuccaugagcaacacaugcaugugguacucacacauauacaaggcaaaauaccuauauacauaaaauaaaaauaaauccuaaaaaaauuuggugucuuucacauuauuauaaaaaccauaaacauuuucuauuuacuuagcaaaauaccuuaugauauaccaaggauaaaagauucauugagugauucaauaaccguagaucaagaaacauuuuaugucauuauuuaguaauaaucuaaaaccaaaaauaaucuagcaaaucaaauuucaacaaggauaaaacuaaagaggugauuauuaagccauagaaacuagcagagaaccaucaguagguuuuauaacaaauuuuacaaacauagaacaguaauuuuugaaaaaugacaaaaacauuuuugauuauagcaacuaaauauacuauaaaauacuagguagugugagcuauaauugaugaaaauaaacuauaaaaacacucaacaaaaacaauaauacaugaguaggauucaaagacagucaaaaggauaauuuuuuugcuuccccccacccccuaauuuucuguaacucauguuguguguugguggggauggaagcgagggcuuuacacauaaagaaguuuuuaaaauaauuagaucaccuuuaaauaccuucaugaaucuauaacuaucagaguuaagaaucacugguccaucaguacugguuguguuaauggcuuccccccaaaucauaguaacuacucccaccgaacagugggaguucagagaugcuauucuccccuccucccaauguuucaauuccugguuggcugaaucuauagaugugugcccaagguuacaaaggguuaacuacaacauccccucuaccccccacaccccccauaccccuccgccacauuagucauccuucuguauucuaaggaugcuccccaaagcuccucccaccuccacauucuagauaccaauaucugcagaaguuccugucucauauaaaaugguaauaucuagaugauuuacacuauuuauguguuaaaauacucauguuuaacuaguuguuaaacuguugaagaaagaccaauucugugcuuguucaacagaaaugcuacucaucccccaacaaaauguuucaaucccuaguuggcugauagauauagcacccaagaauauagaaggcaaacaguaucuccuuucaguuugauuauauacuaugaauguaauggauucaaauuuagagcagggaaacuaaacuuuguguauauauucaaaagaguguguccuuuaaaacauuucuuugaauaauauggcugauuagguuuguacaaggucagaauaaaaguauauacacagaaaucauaccuugaagucuuuucccucuuuaguuuuaaaaguuaaccaugaugaagauacuauaaaugauaacaaagaaguucuuguaauuuaagagucucuacucaccgucuauauuaguugcuccuaaccaauguuaacuaauuuugaguaauaacccucugaucuuacuugucugugaaaaagauaauguucucauaaguaguaggucccagacuccauguaagaaaaugccuccauuuuuaucuuuuaaaaaaaaaaaaaaagauuuauuuauguauaugaguacccuauagcugguugcugggaauugaacaagaccucuacucgcucuggcccaaagauuuauuauuauauguaaguacacuguagcugucuucagacacaccagaagagggugucagaucucauuacagaugguugugagccaccaugugguugcugggauuugaacucagaacuuucagaagagcaguuaguguucuuaacugcugagccaucucuccagccccaaugccuccauuuuuaaaaugguuuaugucuuucuauacuucagauacuuaauguguaauuuaaauuaaaaauuaagaaauuauaggacuucucugaacaacaauaagaaacgugaaaguuaccuucagacauuuagaagauagauuuaucauuuaugcaauuucagagaauuguuagcagaaauuauauggaaguuacaucccauucaaagaggucaaagcaguguuaaagguacauuuuaugagaacuguaaagcuuucauguuggugucaaguauauucuagauuauaaaugaucucuauuuuuuuauuuuaugugcauggauguuuugccugcaugcauauauacaugccuguugccugcagagacgagaagguuguguuaagagucccuggaacaggaguuacagauagcugggagucaccauguggacgcugggaaucaaacucaggugcucuggaagagcaguuauuggucuucacugcagagccaucucucuagccugaucccugcauaguuuuauauuccugcuacaagucuguaucugaggugaucauauugguaacaaauaacuacuauaaagguuacucuguagccuaaaguauccuugaacugguggcaauccuuagccucccaaaugcuaggauuacagauacgaccaucuacauccagaguuuuuaagaucguaccaugccauagcccagguuauucugggaucccuacccucauucuuuugaaauaguguccaaguagucaaacuacaauuuguaccuauauuaaaauaucaauucuuuucuggcuuuuccaguuugugguuuuucucuuauuagaugauauuaggucgagauauucuagucuuauuaauagaugaagagagccuauuaauaaaaguacucuuuuuuuucaaagauuuauuuauuuaucuugagcuugauaagucucccagcucagcuuccugagugcuuggacuacagucaugaaccucuggacuacagucaugaaccucuacacucagcucaacauuaccuaucuuuucaaaugcaguauacuuaaacugaagccuuugggcauguaccaaaaauucacaaggauuauuuuucuuccagaggauaccugaacaugggucagaauugauaacaaugggaacaaacuuccuaacaacaguuuccaaaaauaagacugucauauuaggaagcuuuaaauaucuuuaagaaaauaaauucuaauuaaagauucaacaaauuaauaaauaugauuauugacaauuuucuccaagucuguuuguuuaaacuuuuuauggauucuuugcgaauuucacaucaggaacccuaauuccuacacgguugcaaucgccuucgacuccaucuguccuucccuaucucuuccauuggguccccaggcucaguccaaugguuggcugugaguaucugcauaugucuuacucaggugcuggcagagccucucagagggcagcccuacugggcuccugucugcaagcaguuccagcagauaccaaacccugacacuauugcugauuccacuuuauuuauuaagacaaaaucgcagaaaaugcuugauaaauuugccaauaauaaaaaauuuaaaaauggcuacagaaauuucuguagacuauaaacuggcugauuugcaacaaaaaccuaaagccuguuauggcagugccaguauuggucacagucuugcccuaugugugaggugaugauaaucucagagacaaccaaaaaccuggagcgagacacuuaauucauauaaccaaaaaucccauucacaugguuaauaaugaauaacucaagaagggcaaaauggagguauuccaggaaacuaguacccaaauauuagggaauuucuuuuaauguuuuuaaaaucacaaacuauauguaugcagauguuagaaugcuacacucucuaauucuacauagguagucugugaagggcagagugacuguagcauucaaauacagaaguauacaugcuaaguaacaauuagauaaagcuagggauuacauuauuugacgaaauuugagauucucaacuuagcuguugcuuaaaccaaagcuaagcugugugagcuacaacugcauuuuuuccuuacauuagucugagguuucaaauuaaauauuaaagacaauaaaauucaagaaaaugacacucuuggagcuagaaagauggcuccacaguuaagagcagucauuucucuuagagagggccugggauggauuccuaacaccuacaagacagcucauaaucaguuguuaacucaguucuaggggauacaaugcccucuucugaccucugcggacaugguacauuaacauguacacagacaaaacacacauaaaauaaaagguaaagaaagaaaauggcacucugaaauacugggcaaaguauaaaauaauuuaaacuucuccaagguaaauaaucaauaguauuaaaaauacucaaaaauuacaugauuuuaaacccagugauucuacuucuuagaguuaagaaacaugaauuaaaggguauuauuaaucuugccuguguuaauaacagggagcuuuagacuuacuuuaaaugugccaaguaggggaaaguuucuacaauguaaugccauucaugccuuguauucagccuuucaaacagcacuauuuauuggcaauauuuaaauguuuacaauauacaucaagacaaacauuuuuaguuagaccuuuaauaauccccuguaaaaaucacauccuaugcaugaugguauuuugagaauuagcuuugcaauaaaggugaaacugauaagcagaaaaguacacuuggcuacacacucuuguuuaaucuccacuaaccauacacaauucuaaagucgucuccacuuuuaacacuggacaaaauacagauuuuuuuuuaaguagguugaaaacaauagauucacauauauuuuaaacacauacaugaacaaggaucucuagguaguaaaauaauaggugcucauaauuucugcauauguguauacuucucaaaucuuuuucauccaccaaaacuuuuaaguuucauuaagcauuuuuaaaauggcucaaaugauuuugaauauauccagagaauuccuauuuaaaugugaaugaccaaacuccacuguaacuuuuuaaaaaaaauaccuguccccaauguccagaguuuucuauguuuucgugugugcaggugcacacugugggaguauacauguauguagaggccagauuguaaaaucuuaugguucccuaaauaccauccaacuuuuuuuucuuugacacauggucucucacuggccuggaacucauaaguaggccagaggggcugacccagcaagcaucaaggaucucccugucuuuguuucccauugcuacuauuacaaguaugugcuauacuguagccagcuuuuaaaacagggguucuaggaauugaauccaaucuuucuauaaacacuuaguacuaacuaaacuaucugccuaacuguccauuuaaguuaguuuuaauuuuaaaaggcacaguaugacuaggaugacaaauaaguacagccaucuccaugacuaguuuaaaugccuggaacaguuuauuaaacaaaauccugaagccagccaugagaccacugggcaaaagugaugcugaugucugcugugaauaugggaggaggugguugugccagccuugcuacuguuugcuacuguuacccuuaccaagguguaaguaaguuuuguggagaaaauaggaagagaauuuagguaucuaugaagaacaaucaaagaguauuaccuuuuaauuuucuucuuuuuaggcaaagaaaaggaaaaaugacagaaggaaaaaauacaggugacgcgaaacaaagaauuaaaggcaaccaaaaaaggcucagaccaaggagugagaugucugaagaagagauccuccagaaugcaggaacuccagacagggaauagcuuguggacuuuucguggugauagacaaucaaucaaaacaggagaaucguuacacuucagcaguugcugaggccaugugccuucauuuuugucuuuagagaccuacauuacaggucuuaagcaccuaauguucccaaguagaaauauggcacucugauagcauucaaaagaagauuuauauuacuauauacauuuaauggauuuuaaacagacuccauagauuuuaaagcauuuuuucaccauagauuauguuuaccaucuguaauuuauauucaucgauaaaaacuaaucgaucuccaacuaaaggucaucaauuaugcuuuaaauuaaaacuucaacauuaaauucauuguaggacuuaaaagcucaaaauuuaaaggaagcaaaauuucauuagacaucaaaugauauuuauuuguacuacuuaaagcacuaugugcuuuuuaaaaagauauucucaaaauuacaucauauuaauucaagaagagaggaaauucaguggaucaaauacugaauguuaguauuucuuggggguaacucuguucaagaauguauaugcuucaggauaaggccaaugauacauuaaucuccacuaaacaaauuuuguucuauuucauguuuugauuuucugagacaggaccacuauauagcccaggcuagccucagacuuggcaauguucuugccucagcuuccagagugcugaauaauauaggcuuguaccaccacuuccagcuuuuaauaguuuuuuuuuuuuuuuuuacuaauuuucaacuuucucauaucuauaagccaaagucucucuaucacauagauaaauucauaaucaucucaaaggccuucuaaaauuaaaggaagaaaugauuaggggauuaucucaaaccaacuagucuuugcauucuugguaaugaauugcaauuguuaaucaauuaauaacaacaaaaucuaaaaaacaacaccuuacacaaggaacugcuaguaauaccaaauaagaacagcaaaccuauaauacaaauauuaggucacacuagcuaauuaguaguaaagcugaguuuuaaauuuaggcacucuuguuuuguuuuucuuugagacauggucucucaaagcugucuauccuggaacucacuauguagaccaggcuggccucaaauuuccagagaucugccugccuuugccuccuuagugcgaggauuagagcugugcauacuaccugcauaaacccaggcgcucuuaauugaagugauuuuacucauaaaaaagaucaucucuuuagugccccauacacuauaaaagcacgugaucaaaauacaaacaggaaaugaacacagaaugugaaaaaggauaugaaaguauacaaaagaguauaauuuuagcuauagcuagugaaaucuuaucugugugcuaauauuaaaaaccagauuugggggcaagagggagaugguucagucacuaaagugcuugacacauaagcauaaaaccccaauucaaucuccagaaaagucagguuugguauugcacucuugcaaaaucagugcugggaggcagagauaggcagaucccuggagcucacugaacaucuagugagcccuaggucccaagaaggagacccugccucaaaaacauguugcauaguuucugagcuaugacacuggaggauggccucuaaccuucacauacauacauauguauaacagcaccugugcauuuguguacauacacauaaacacacacaaggcaaauauuaaguauuaauaguaaucuuuaagugacaaaauuacaagcauacuuuuuguauacuuuuagguaugacugguaugcuuuugaacaaucauuuuuaagauuacuuaaauucagggcuauuuagugucuuguucauaauagcauauauuaugguaauuaaaaggaaugaaguagcucuuauaacuaccauugaaagacagucaagauaguauuaaaggaaaaaagacugaaugaagaaauacauauaaaacaaggggggcagaacacauagcagucuacuuauguaaauaggaaauuaugugaauuaaaauuaucucagagacacauuaaacuguaggaguaauugcuuucuuaagcuucaguagggaagugaacuuucaguuuuucuuuuauuuauaauucaggauuuuuuuuuuacaaugaaacauaaauuauauaguaacuguguauuuuuguuuguuuguuuguuuuuuaagaaaaguuuaaauauucucugagaaggcuuggauuguagucuggccauaaaaaccuaaaggcuggaucugaaguuuuauccaaauuuuuaaagagauucuggaauguucuuuguuuacuauagcagaaccaaauugguuaccuucuuuaaggcagcaaacagaacccaauagcagccuguaaauucuaagcuugcaacacuaugguugucccaaggaugaccuuuccaguaggugaacuuuuuaaagcaguauuucuauuuuaaucacuguuauuccaucagcaaaaugccuucacaguuaacagcuaucaucaauauuuuauuugauauguaucauauuuucauaaggauacauauauuuaaugcacauaacacaagaaacaaacaugagaaguaauuuacccauuguuacagaguggaaucuuuggcagucagacuucagagaacaugcaguuccccacuugagagagacaggugaaacacacauauucaauaaaugaauaugaaauauaaaaaugaaacaaggaugaauacuuuccacuuguuuaucuagcagaucuuccacagcaauacccagaugcuucauguuuccucaggguucugaacauagaggacugagaggcauuuuuaacauaccuuaaaggauacuaacugacuucccaggccuugcacauauuacacagccauguuuaucaauaaaauauguccucuagucugauucuaauaaauagaaaaaguaucaaaaaggugacagaaauuaaaauuuaagauuaaaaaccuaugagaauuccaaagcauaagaacaguuuuuuaugaaaaaauagccaggggauacaggaaaacuuaaaaaaaaaaaaaagaaaaaaaaagcauccuuuaaaauccucuguauucucuuugcucauccaauuguacaucaguuguuugauuuguucacucgaauacuuagggcucaugugcaucaguauucccuauuagauguucuucaaacucagucuauuuaggacuuugccuauagaaacacauacccaauuuuagaauggaaaacaggagguaucucuuuauagaaacuugcuugauaucuaaauuuauaagaaaaggcccauaagaaccaaaacacuacuuugagacuccaaguuuccccuuaaccucugcuuacuuuuaccaguguuuuuaguugggcaaacuuaucuucacaaacuauccgggggaaaaaaagggcaaauacauaacauuuguaauucaucagugaaaacagcaccauugaagaacacuuacuuugucuaauuaugaugauucuaaacauaagcuauguuccaccacuagcguuuuccuauuaacaaggaaaauaaaauuucaaaaugauaccuuaaaauaaucuuuauauuuaguauuccaaccaaguagaauuuaauaagaaaacacuaauaaaugauaguagaguugggcagaacaacuaaaagggauuuuguuuuauaaaaugauaccauuuuaauuacuaucuuaaaugggguuuuaucuucaauagaccaggcauauauuaguugacacuaaauauuucugagaaaauuuuaagagaccaacucuuuccagguuacuagaaaaauuucacuccuacuuuaaagguauuuaacauucuuuuuuaaagcuuuuacuuauaaacuguucuuugacauuuuguucuguuuguaaaugaaucaucugaggugacuuccacaaaggcaaaaccugccaugauucuaguuacaugagguaucucucuagaguacucagguuuaugauucagagauucagaaugguggcaccacaagcuaaagcuagugggaaacugggagcuguaaaaugcccauagauucuguuuugcaagaagaaaaaguugguuacaugacaaaauuugccacagcuaaaauuuacaccuagaaauggcuagaacagaguagguuguuaguuuuuuaaacaacuaaauaagacaaacacaaucacuuuaaacacuauaaagucauguaguaaucucuuuugauuuuuguuuuacaauuuggaauucuuuauauuacauuugucuaaaagacuaugcuuggcaaacagaugagucuuuuaauuuuuauuggagaaaccaugaacuuuaauaucaaauucaauacacacaacaaguaguucauucuugaaacuucaagagauggaaacaaaauugcuauaauuaaaauuuuaugauuaaacauucucacuauacuuuuaccaaaaaugcugagcaaugacacuuuggcuuguuaaauucuuuuucaaauccuucagagucaagcagaaaacaugcaauaaauaccuauacuacaagcaagaaauggcuagguaaaaccuaccuauugcugucuagucccaaagggagggguacugaaacaaaguaaccuuuuucuuguaaguuaaaaucaguuucuugguaggaagguacuucaacuccacagauauauuuagguuacuuucucuuaaugaggagacagacuuuaaaaaaaaaaugucaugaguguuuuagauauccauuuuuaaccuaaaucuguaauauucaugaauggaaaaauuaucauacaaccaacaucauaaacuguuuuaaauucuugacaacaacaaaagucaagagacuaaucugccuuagccuccuauauaccauccuuggcauacaaaacacuggaauguaagaacaguaucuaaaccuugagccugcacaccaucagaaaguugggacaaucucuagauuucacaaggugcuuuuggaguggacuggaacauguuaaaauauccugacaacuaaauaacacuagauaagaaaguguacuaagcaccauauugcuauuaaauuccugcagacaauacucagaaugugagcaucagaacaagaaaaaaaaaaagcaagcuacuaccaguucuaaaccuacauucccuuagguccuggucucucuugcaugauuagcauaugcuuaugacuagagcccagaguagauucagaaugaccuauuuagggagaaaacacugggauggggaacuaugaugaggugccuagagucuaucauaugcucagucaaacaacugaugcuagaugccaugguccaaggacagggcuucagcaggaaagaacucuuuccagccuuugaauucagagucagucuucuuguuuuuugauaaggaaaaaaaaaaaugcaugaaggcacagaagaaagguuugaagauuaugaaagucugaacuacaacagacuguuauagauguuuuaacaguuaacaucuauuuucaaguauauaaaauguuacaagccucccauuccauaggcuggccuaagggcuuuaaauacauuaucuuauuuucagaaggguaguauuauccucuuggguuggggguggggggggggcauauaauccacaaguauucaguaacuugccaaccaucacaaguggaaaggcuugagacuccaauuuguggguaucaucugcuccugaauuccuacccucuaagucaguagacuacugauuccucaaacaagggggacagcuuaauuuuauuaauaaaugaauuucuugauuuuuagugaucaaaacuaaaaggugaaauuaagaaaugucuuuaagagauuuuacuuuaguggcucaauuuuuugggggggggggggcuucgaaaaguucagcuaggaacaaaacgagcuugacauucuucugcaaucuaagaguccauacacauacuaggucaaucacgcuuagcccuaacagcuaagagucaacagcacauaccuccuauuaaaucuauuaugcauuuucuguucugcuuucuuccaaaucuucaagguuugaguuuucuauacucucuauuuaaaaaagccaaauccuuucccccagguucacuuuggaggcucauuuaagguggaauaauuggagaaagaaaguuuuuacuucucaaucuuucaaugaaauugugauuacaaaaagacauauuuaauaaauggcaccuauaaguguuguugaguggcccaucacucauguuuauuaucuuuuagugauauuaagaaccucuauauuaagaaauauaaucccaucugaucuaaagcugcuaacaucucaaaugagaaaaaaauuaacagauggcucugaggaaagccuaaaaaccauuuagaacugggcccgauacacaacuagcuuacuuauccauuaugaaacuacuuuugauuuaaauuaaaaaaaaaucagcguauaagaaagagaagugauugguguauaacuugguguaguguauuaauauaauuuagcauuuaauaaggacagugaguacacaauggcaaucugccuaagguuuagagaauagcagcccaucauuucaucaaaagcauuguagucaguucugcaaaauuaauugcaacuaauucugguaacucguggaguuaagucuagacuugcaugaacacuuuaaaacauuuccaaagugcuuccuuugggugcacacaaacuaagaccuggaccuuuuauggaauaaagaccaagacaaggaagggguguccagaacagcaggaaaaugaguaaguuuaucucuucugcugauauggauaaggggaauuaaucucuuccagaagacuagaaggacuuaacagcaaauuaagccagccuuguaaccacagcucuuacuacaaaccuucaacuccuuaaacugauuuucucaagguuaaaauaucgaaguagacaaaauugugugcuggcggcaggggucgaucuuaccaccacuagcuguacucaauucuaaaauguucuccuuagacucaaaccacaagauguuucauaaacuuacacugaauucucauggaagauuucacacuucagauguaugguuuuuggaaacaauucuuuucagguguuccaauaaauuuucaguauuuuaaccgacggcuuucaucauauauagcccccacuccaugaaauuaccggccuaaauuuaaccaaaacuauccguaaguuauuuucaggagugaacgaggcagccacauauugauacauaacgucugggcucuccugacaggugaugcaaacacaaguuuguagaaauuggaaguuguuuacaaugaugccauuuuccuaaauucccguuacucugauggaggcaaguuuuuccagauuacaaccaaacccgcacgugcaaacuagaaaguuagcgucuucgggcccccagaagaaacucccuaaccuacaaaggcaacggcggccgcggcgcagcgaggcggcucgggggagccccgggucggccucggagggccucgaccccaggaagcuggcagcgcgcacaggguccgcccggggcccgcugcucgcggcuaacgcggaggacggggagggaaggcgcgggagcuagaggcguacucggcccuggccggcucggccggaugggcgcgcggggcaggcugggcugcgacggcgcggggcggguguccggggcggagaccccagccccgccgagcgcagggcccgcgacucccacccccagcgccaagauggcgacguggaccgcgggggagcccggcgcgugaggcugggggggacggaaggggagcggagacaaaaaaaaaaaaaaaaaaaaagccaguccacggaacgcggcggcccggcuuacuuuuucuucucguucucgccgccggcgcccuccauggcgaaucggugcccgcguugucuucccggccggcggcccccgggcucgcucgggccuaaacgccggcucuguccgcgcgcgcggagaaagagacaaguccagaggcggggugggaggcgggacgccccccgggacggcgaggcgggagcugcaggcugcgcucgcugagcuccggcucggguuccuaggcgcuccuccggcuagcuugucaaggccuggcuagacacugcccgcgacggcggcgaggacaguccucgcgu

SEQ ID NO: 12207 - RNA, 35174 nt, Mus musculus
gaggggcggggcggagaucgcuccgaggcggcgggcguccgcgccagggcggcgcgcgcggugagugugcacgagccucggcggcgcucccgggguuggagccgggcgggaggccgggagcucggcaggggcgggugucgggcgcggggcugcggcgucuuagccucccacgacuugucucgcgcccccugaggcuccauggccggcggcucuccgaccgccccgcgcgcaucggagcggcgccagugaggcuugaagcgcuuccagucgggcgggcggaucuuccaagccucuggcgcggccaccguggcgguccugcccgcaucccugcuucugucucgguggcggcgcccucgcugcccgccucaugcuuaccuccccuccauccucgcuucugucucgcgggcucccuggaggacagugcacccggggacaucccaggccaaacgcuuucagggaggcaguugacuuuuccgagggcgguggcuugagugaggcugucagccuccgaggguccgcgggcuccggugcucagacucuggcuccccugccuggagcgguguggcgggggggggggggggggaucguugguccccggaucuagguggcaggugcuuggcuccagccgaccgccagguuccuguuaguuaacaucgcccacauccucuagugccugaagucccauugcugcaaguugcauaaaguugcaagcacuugccucgcacccggguucccgaggaguaguacuccauccaguauucuaguugguucagaagaggaacccugugauuaugucuucauucacugagcgugagugagucauuacggaagacagguauuguggcugccuugucaauaggcuugggagugaagcgcgguucugcuuuaucacuccgcuucaaauuucauuuaacauuuauuuugaaacaucauuguuagaacuccuccuccccucucucuagggagaccuuaguuacuaagccccuaacuguaaggugacaucuuugaccucuaaaucucucuuuucccaccucaucccccccccagagggcgugguuugugugguuuguaaauuuugcgguuagaguaagcaaguagauuugaugagagaccuuggaaaccguuugaaccuucugcuagcacggcuauggccuauuuugacuauauuucuggugacaugccaugaacuuaugaguagaaucaccucuacaucauguaccuucccuuagauaauguacauuaccucugagaagcaaucuauaaagcaccuauugcuaacuagcagaaagggaguaggggcauuuucugucauagguauguauauuuagacuuuuuauuuauuuguuuguuuguuuguuuuacaaaaauugguuguaaauaaaagccagucccacauuuaccauuugaauauacuucuacagauuaucucagacauaaaauuuugacuuaaaauaaaagugucuuuguuuauuuuuuucaccguuauuuuuauuuuauauauauggacguucugccugcaaaucuaugugcuagguguaugcagugccucuggaggccagaagaggucguuggaacuugaauuagagaugguugugagcugacauguggaugcugagaaucaaaccugggaccucuggacuagcauccagugaucuuaacccagagccaucucuccagaccaucacccccucuuuugagauccagccucacuauguguguuuuccuggacuagaacucucaaagaucugcuuuccuuugccuccgagugcugcaauuaaagauguggagccugggaacguugcuucuuaacauaugcauagugcuuuucuuauuuuauuuuucuuucccaaaacagaauuccuccauguagccuuggcucucucuguagaccaggcuguucuggaaaucacagagaucagccugccucugccucccaaaugcugggauuaaaggcaugugccaccacagccagguggcagguuuguuguuguuauuguuguuuugaggcagugucuaguauacagcuucggccuucuaggaacucaagguguagaccaggcuagccuugaacucaucugccugccucugccuccggagugcugggaucaaaggugcgcacugccacauuagcuaugcacagugcuuuaaaguacuuauaguuaauuguauuuuaucaaacaaauaauguuuuugauauuacaauaaaauuauaucguuuuaacucuuuuuaguuguuguuguuuuugcuuauuuggguuucuuugaggcaguguuucucuauguauagcccuggcugcacuggaauucucuguagaccaggcugaccuuaagcucucugagauccccugccucugccuucugagugcugggauaaaggugugugccaccaccaccuggccucauuuuacucuuuugugaauguuuuauaaauuaauuuuuauauuaaaauuuaggguguaaauauauaucaaauuucaaggucuaccuaaauuuauugauauuucacaacccuacucaaaaaccauuuuuuaaaaaauuaaaauauaaaacauccauuccccuccccccuuuuuauuccauucagcuguaaccaaccccauaucccccuagcacuuacuuaucuucucucucugucucugucucucucuccccccuucucuuucugguucguggcuucuuuuucuuuaacuguuggugcauauauuuuuaauuauauauauguguguguguauguguguguguguguaucuuauauauguaaccauauauuauauauauagcaaauaaaagcaacaugcucaguucauauuauguuacuuacuuguauguauaugaucaagaugaggccaauagacuugcuaacauggcagggagaaaucucacagggccccuacccaacccuagacaagcacuacaggcaacuaagggaugcugagauugggagaaauagucuuacccagggaagaaccucccauugguuacucagucccagauggucagacaugaauauauauuuuaaaacuugugaauuuacucucuacaugagucuguguguguguauauaugugugugggcaggugaguguguguaugaauauguugugugcauaaagucuauucucuccuuucuggguucugggaauugaacucagguugucagguuugcauagcaaguacucuuauucacagagccaucuugccagcaccauguguaaucacuggagaaaggccaagauacuucauuuugguagaaguaguucuagaaacuacacuguucuccaccaaagaacuggguauuguuauucagucagcuauugacaagaagcaacugauagcacggaguaugcaguaggaaguuccucuucagaagcuuaucuguuaucauuuccuucugggauugcugguggguagcuuuacuguuaaguuucagggaaauacuuuguuuuaugaauuugcuuugucucauuguugggaauguuaaaugcuuuuaagacauaagcuauauaguguuuuguugacuggggcuuguuaacuuucuauguucaauccuuacaguucuugguugacacaggaaugaagaguguauuggcugaaucuucaagcagaggcgaucauuaugacccugguaaguagacuauuuauccagauguagguaccaccucagcuagcuuaaugcugaauuuguacuucagaggcuucuggguaggaauuguuuguuuuauguuauuccugaauuugaccaccuuuugccaaaagauuuuuuuuucuuucucaaugauuguauuauugucagaugucaguucaggauuauuuuguaucaaaauuaauaguauucauaaucuuuucuccagguguuuucauaacucuuuaaucauuaguuaucugugauuuuacugggcuuuacuuaaaauuuuuacacugaaaacauuguuaauuuuauuuucaugaagccuuuuauuuuauuuuauuuuauuaugguuuuucaagacaggguuucucuguguagccuuagcugaccuggaacucacucuguagaccaggcugacuacgaacucagaaaucugccuaaauaagauagcuuaucgccucauauguucacuauaauuguuuauuggggcaguauaaaccccucuccaauuaaugguguauucuuaucuaaaagacugauuuucaugcguggcugagaaaagaccuugugauuggggcgggaggagcaguugcaacagcugucucuggaagguaauuauuguagcucagucaggcucaaacaauggagaauggaggcugguccugccagauucauuuugaucuaaagccacaguuucauuguacagagugagcguuaugggcaguagugaucugcgugugacgcuguucugaaaggaauaagauacagaaggaagggcuggugagauggcucaguggguaagagcaccugacugcucuuccgaagguccagaguucaaaucccagcaaccacaugguggcucacaaccauccguaacgagaucuggcgcccucuucuggagugacugaagacagcuacaguguacuuacauauaauaaauaaauaaaucuuuaaaaaaaaaaaaaaaaaaaaaaaaaaaaaaaaaaaaaaaaagauacagaaggaaggaauugaguguaagaaagagcuuuacauuucuuuuuuuuuuuuuuuuuuuaaagauuuuuuauuuauuauuauauguaaguacacuguagcugucuucagacacaccagaagagggagucagaucuuguuacggaugguugugagccaccaugugguugcugggauuugaacucuggaccuuuggaagagcagucggguacucuuacccacugagccaucucaccagcccccuuuacauuucuuguaacuagcagcacacggauucuaaaccucuacuggaguuagaggauuugauuugaggacuggaggaauguaugaagaaggaaggaucauaaagaacuuaugcuucacugauggccaugugcucugacuaguguggugagguuugggcugagcccuugaggcagaaggacuucccugccccgacccccagcgugagaugacucuccacacagagaaagucugacugcuugcuccugcuguuuccauuuacacagauuuuuaaauaacuccuugcugaugcuuugauaaaaaucgauuuuucauuaagccuuuuuauuaguuuuauugauacuucaaaugacguauggucauguguuuuugugauuuucaaagcugugucgguugucaaucuuaacccuuucuaccagauaccucuucuguacacuauuaaucuaccacugucugguuagagacauuuuuauguauguacuguaaaguaaguuccucuucugcuuauauuuuuccucugaguauuuaguuacaguagauuguucaauuauuuacuaauagaaauagugcuuaauauucauuacucuuucagaaauguaccugacuuuuauuugaaauuuuuaauuuggcuuugcuuauaaaaaugagcagaauauuguauaacauguaguuuuaaaaguuggauucuuucccuuaaguaauaugaugagacuauuaacauaaaauaaaaaacuucaagggauuuuaaaaaacaguauuaaauuuuuacuacguuucuucuuuuuauugccuuuuuguuuguguuuggguaacucuggaacuuccucgguagacuaggcugagcaguaguucacaaagauggaaucguagugagaccugggggguggggagcauugcccugucuccacugcaugcucccuuaguccguuuggggugcauucacucauaucuaagguucaaugaguguuacccguguccacaugcuucagauagcaaggauuccgaggcccugaccuuggcguuaguuacgucccaccccagaugaggcuucguuuacagcugaguucucucacgcucaccuuauuagguccccucccuuugguuuaguguggccuuggccauauguagugccauaguuaaguuuauuauucgaaacuguuaccuaguugcauuuuaaacuugcccuaugcuuaauguuuaacccuguuaaagacagcuuuccuguggccucaggugaaucagcaguaggcugguuucccugcuacugauuucagaacuauagguggacuucucuaguguccuauccuauucuguuguuuauaauuguuggcaaauauuguccuuuuauccaaguuaaucaguacugcuaucugccuagggggagaauagagagacuuuaauaauuacuuuagggugucaccaggaaaagcaugccugucccuugaacagucugaguuagugucuccagaacuacuuccuugcauuugucuucuuuauucuggaauacccauacuuucuaggcauucauuucccaugagucaccucuucaggugaaugucuucuuuugacucaggauuugccuuggcccuucauccuuuaagaagcccucccaucaucuccgacccccauccuuccccugcuaaccaacucuaaucaucucuuacccccaucgucuuucccuucuaacagcaccaacucucuccccuccuggcuccuugcacacauuucugccagagaacuggucccaacacaugguagccauuaguguacccauuuuucaccgugagucuccccacuaaaacuggugaccuuuguagaucuauacucuagccugaugccugacauauuagacacuuaguugaaaaacugaugcccagcuuucuagaguccagucugggaauggaaacugucuuuuccaccaccuaucuaauauaaaaacaaacccagggaccagagagaugcucagugguuaagagcacuuuuugcucuuguagguuccagcacccagguggugguuaaugaccaucuggaaccucagcuucaucacauacagugcccucuuuugaccacaaacacauggcagacacaacaagguggacacauacacauaaguaaaaaacaaaaucuucaaaaaaaaucaaaauucaaggacuuuuuuuuuugagacaggguuucuuuguguagcccaggcuguccuggaacucacucuguagaccaggcuggcuucaaacucagaaaucugccugccucugccucccaagugcugggauuaaaggcgugcgccaccacugcuuggucaaggauuucuuuuuauauacuuauuuuuguuuguuuguuuuuucgagacaaaaucuggccuuuugagcucaugcuggccuugaacugacuguuaucccugggugauuucagacuugcaaucuucauaucgcagccucucauucucaaaccacaggccuguucuaccaagccccucuagaauuuaauuuaauuuuuaaaaaaaauguacuuacgggcuggugagauggcucaauggguaagagcacccgacugcucuuccgaagguccagaguucaaaucccagcaaccacaugguggcucacaaccauccguaacaagaucugacucccucuucuggugugucugaagacagcuacaguguacuuacauauaauaaauaaauaaaucuuuaaaaaaaaaauguacuuacucauuucguguaugugaguacccuguccacugucaucagacacaccaggagagggcaugggaucaccauuacagaucaccaugugguugcugggaauugaacucaagaccucuggaagagcagucagugcuuuuaaccgcugagccaucucuccagcucccuagaauuuaauucuuaauggacuucuacccuaugggcuauuggugcugcacaccuuuaauccccagcacuggggagguaggaacaguaggaucuccgaguucaagaccagcuuggucuacaaagcuccaggacagccagaacuacacagagaaacccugucucauggcggggagggcagaaagaaacuucugcccaauggacaauaauucuguugguuaggauuuagcaauucuaaaaguaaacaaaccaaucauguaugcagaaaaaaagguggagaaguuaagaguaaaagauaaagaagagaaugaguuagcaaaaaucuccucaguuauaaaguagcacagggugacucauuugugaagcaaggcuuguuucagaagggcuggaccaggagcaaagagcaaaggcaauccuggugcuccuggugaacucaggcacucacagcaaacaggcaggcaggagcuggugaguacccgagggagccggggccuccugcauuguaggauccccuauucuacaggacugggggacugaggaaugagcaaaaggugaggcucuagaaggcuaggcauggagacuaguguuuggucugguuguaaacaaacgugacacacucaggaggucaaggcuggaggaucugaguuagagacuguagcagaauacaaacaaacccaaacugccguugaaaagaccggagcaggaggugggaaugcaagaccugguaccaaagauuuaaagcaacugaagaggcugugcuggggagagaagagaaugagcaagagauuauugaagagaacaguucugaaaagagugggcuuagauauauugugguguucuucccagucuguaaaaaggaaacaacggucugcauuauuucaaguagcagauaaagccugaugcauuggacaaaaugaaaccuuugugugaucuacacacuugggaagauagucuguccuuggcucauggagcuguguccuccagaguggggugauuaauccuguggaaaaagucaagcuccugaacuguguuaaauggaccuagagccugagcuguagguccgauuuuaucucuucagaggauuuauccagcacucuucagaguguauuauccaucuuuuagcaauaaguacaucagaggcaaaaaucaaaacucccuguggcuggggagcucacguggggauggaaguggagaaagggggaguguggagauagagguagacugguguggggaacaguaaaggacgcacauugggccagcugaguuagaaaguggcaugugagcgaaggcuguuaaaaugugacugagcaagcugugcaagccggucacagggaaggcagugcccuccugugagucccacauggcaagcccuucuaaugccaguuucaaaaucaccaaacuuaaagcaacaggugaugccagcgguguuagaaggcagggcccgagggcagaggacaucucgagugcacacuugcuuucugaucaacccuuugccugaccuuuuacuuacacaagugugacucugcaguuucucacuccguggaaacagauacugcguguguuacccccuuuuaaucucuucuggaagagagcaaauguuuacucagugagauguucgcuggacugguuuauggagccuacaguaauauagcaaaucugagugaccccugaaggggcuaagugacacacugagaaggcuggugccugggccucucagagagaagagagagaccaaguguuggaccaaaucugaaacagccgggcacgguggugucugcuguuaauuacagcagcgggacucggaggcaggcugggcucuucgaguucaagcccagcuaagacuacauaacaaaaaaccuuaugaaaaccgcaucucuguuuucagcuuuuuaaauuggccugcgugacccgcccacuugguguaaaagaagaaccggccaaagggagggccugaaggagugaguacagagcuggucaggcugguugcuggggaugcaguugucccugugugggauucuggaggauuuacaguucccuuguuucuuugccuacacaguagcuuucauucuuggccacgggauagaguugaaccuugguguucaaauagauauucaaacugccauugcuguguguuaguguaacuauaguucuuuuaaauaguuuuaaacugcaaaugcaauugacuuccauuugccuuacuuuauauaauguaucauuucuguggagaggaguauuuugauuaaacaaauccuaaauuguuaaccagggagagucaucauaaaccuguauacugcaaaccuaccaaguguucuguuagucaucuacgaaagauagagggccuggaaaauagccuuggucucaucuugugaguuaaccagcaguugugacuuaacacagaaaaauguagaaaugaaagugggaucagaagaccguuuggaauaaauacauaacagcugacuaagcaagacuuaaccguuggaggagagcugucaggaaaacguacggccuaaagcuggagauagcuggaaaugucuggagucauuuuuugguuggcacauuuggcauacuaggcagagguggagugagcucucuaugggugucuagugaguacagaccagagaugcugcuaaacaaccuacucuacacagcacagcuuaugacugggaaccaccagccagacgguagugcucguuacagguuaggucagcuacaaguccucaaauaccauccccugugguuuucuuuuucuuuucuuuuuuaagauuuauuuauuuauuuauuuauuuauuuauuuauuuauuuauuuauuuaauguaugugaguacacucuacagaugguugugagccuucaugugguuguuuggaauugaauuuuaggaccucugcucucuccagucagcucugcuugcucagucccugcucgcuccagcccaaagauuuauuuauuauuauacauaaguacacuguagcugacuuuagauacaccaaaagagggugccagaucucauuacgggugguugugagccaccaugugguugcugggauuugaacucaggaccuucgaaagagaagucagugcucuuacccucugagccaucuugacagcccccauuuuguuuuuuauuuagugucuaucuaggaaaaaaaaaaaaaacaauguuuaaagcaaccagguagacuugguuccauuauucuaaugaaugcuacuacuuuagguuucuucaauugagauuuauuuuauuuuaauugugugugugugggugaguacuugcaugagggugucagauccucuggaucuggaauuauaggcaguuacaaacuacccucugagcaugcugggaacugaacucagguccucuguaagagcagggcauacucuuaacuucugagucaucucucuggcccugcuaaugaggucuuuaucagagacuucaagaacauucacaacuuccuuuaauggcuuugaugcacuaugaugaaaaaaaacuccagcuucuuguacauuuuaaaaugucaauaauaauaauaacugauaacaguauaacaauaauaauaacaacaaauucauugucuccucccauuccccaugucagucuagagaaagauuagaugauauuauaaaaaaaaucuuuaaauaauacuguauaauuuaaaaacagaaaaccacauaggaaagaaaacagaacacuggcucguauucucacguuagagaugaggcuguggaggcucagaggcuaagggaaagcaccaggcuggcgcucaugacugacugaacaguugugcucgauccacugugucagaugucuuuaugcuagguuuccagcagcguguguaaccuaacccccaccguacacaaauucaaagcaaaugauuaccuaacacaucaccguuuuccucuuuucugagggcacauuucaaaauacaguugcuuaggccaggugugguggugcacaccauuaaucccaguccuugggaggugcaggaaggugggucucuauagguuuguggucaguccggucuacagagugaguucuaggacagcuagaguuacacagauccugucucaauacacaccuuugagacccuacaauucaaagcaaggugugggaaaauauccuuuagauuccaguuuccucuuggaaucagauacucuucagaagaggggcccagccugugucgcccuggccuagccuguuguacugguuauucgaaauacaucaggaacaccucagagacggguaggauuuccauaaggaguuuauuuguuggugguuuguuuguucaacauaaguuaaccguaaacgccagccgacauaccuguguaucuuuguuucugaagccuccacaggagugugagcagcacugcuucagcaacaaagccucagguccacaucuugggaagaauauggccacuuccuggggggcugucuucaugcugaucauagccugcguuggcagcacugucuucuacagagaacagcagaccugguuugaaggugucuucuugucuuccaugugccccauuaaugucagugccggcaccuuuuauggaauuauguuugaugcgggcagcacuggaacucggauucauguuuacacuuuugugcagaaaacagcagguaaguacaucugggacccuuugcaggcugugugaguccguaccuuagcaucuucucccagaaacagaugcugaguguggcauguggauguagagauguaacugagcacauaguuuaguuuaguguggaauuaagagagacuugugugggaagacugaggcuuagcucaguuaguagagcauuugccuaacauucacaaagcccuggauuugauccauaguuccacauaaaccgggcauggaagcacuuggaaggugaaagcaggagaaucaggaguucaagguuacccuuaucuaccuaggauauuugaggccaguguacaauacaagcugucauaccaagcacugcuucuccccugagauggcucgagagugcugccccuacaccacugugaaaaggcagagccaaguccaaagcgggagucacacagugguucucagguccccucucuggguaccuaagggcagagagagggaauugagaaccagggguccaccggucugccuuucccucuggacagcugucuaccaggcagagaggggaaaggcagauccccagacgguggaaccccaggcugauuuggagcaagugccaagaguauggagaaggccuuccuugggggauuuagacccaggucuuuaagacaaaggucuuccuuaaugaagagaugauccuggcuuguucauacugguuuauuugauggugggugugaauguguacacuuuauuuggggugaaccagggauuaaauaccuuuuuccagaaagacugcccaggaagggaagcucauugacugaaugguaucuagauucuucaugaguauggagaacucuggguguuuaugcuaugugaccccgugcccacgguccucaguggggugucaugguuacaugcuccaaaguagacaaaggcagguagggaguggcuucccuccugcaguucucaauucugagauuccugcgguuugaacucauccagccuuaucauuuuuaugccugucugggaacaaggucccacaugcccuacaacaggcauugucucagaaaggaaagagggggaguuuuuggugcaaguauagcugugauuuguucuucaucuucucuaaagguuaauaccgcaaaagucuagaguauugagaguguuggagugauuccgggagaagcauucuuucacugccauccuuggaaaggggacugacgggucuuugacuuaacuuuuucugaauuaucuggaaagcccagggagcccaggcaggaggacuacaauccagcuugcguagggaguucaaggccaguuugggccacauauugaaacccugucucaaauuuuuacuaacaguuuaaaaaauacagaguugggagaaagcagugagagcuaaagucccagcagagaggccgucacagccuccagggcugcacggcagccuguguucuccuuccuaaugcugcagcaaagcacuccgcagaccaugggcggggaucacggggaugaaacagcucuggauggagacugugguagucuauuaaaccauguacuaaugucauuagcaucugaagcagucuacccucugacaaucaucuccucuuuuucuucuucuucuucuucuucuucuucuucuucuucuucuuccuucuuccuucuuccuucuuccuucuuccuucuuccuucuuccuucuuccuucuuccuucuuccuucuuccuucuuccuucuuccuucuuccuucuuccuucuuccuucuuccuucuuccuucuucuucuucuucuucuucuucuucuucuucuucuucuucuucuucuucuucuucgcccucucccucucccccucucccucucccccucucccucucccucucucccucuccuucgcccucgcccucucuucuucuccuucuucuuucuuucucuuucuuucugucugucugucugccuuucuuucuucccuugucuguuugucuuucucccauggacaaaauaggacagcuccccuuucuggaaggugaaauuuuugauucugugaagccgggacuuucugcuuuuguggaucagcccaaacaggugagucuuacaaucugauggacuuuguuucuauuuuauguaucugagggagcaaaccccggagggagugugugcucuguggcugagcucuguccaugaacccuuuccauuuuuacuugagauagcaucucacuaaguuggcauggcuggcuuugaacucacucaguggcauaagaaggucuuauaauugugauccuacugccucagccucuugaauagcuguaauuaggccaacagaaccaggccuggcuuaauuugauguuuaggguucugaaucuuaauaagucuacaacaccccugucguuaaacaucuccugguguucaggaguaauacugaugagaggugaggucauuuucccuucuuggugagucuucugaaugaccauaacuguauaucccagacucccaaggaguggguagaaggccggaaaguagauuuucaaagcugagcagaugccucccugaguaagaguguuugcugugcaagcgugaggagcugagcucugaucccagcaccgucauaaaaagcuggccauagcguuucaugaauguuuguaaccacagcucagugggaaccaggccagagaauuacugggccuugcuagcuuccagcguagguagggguggugauucauaccuguaaucccagcacuugggaggcugaggcaagauuauuaucaggaguuggagcccagcuuugacugaaauagcuuggccuuugugugauuugacaucugagagaccuugucucaaacaaacaaaugaccagaauagugugagccugaagaacggagacacacuuuccagucuagcagguggaauggcaaaugugcuaaggacugaccuguugaaagcaguuacaucagcagaagacggucugacauuuagggaaggugauuauacggugcuugcuaaggggagaguguggcggcucacaccugucaucucagcaugguggagucugaagcaggaggaucaggaguugaggguuagcucuggcuacauaaucacuuugucucaaaagguaggggcagcuuguuaccaggauacauuuucacuuaggaaaacuguggguuuaaaucuuuuucauuuuguauguguauggguguuuuuccuguauaucugucuguggucaugugcauacaguguccgugguggacggaagagaguaucagacacccccaggaauggaguugcagacaguugugagcugccaugugggcgcugggaaucaaaccugggcccuuacaagagcagccaaugucuuaaccacugaacuaucucuccaacuccaaaaacaauccaaaauaauaguuuuaaauagucauagguuggugguaugcugagugcccugcauguugguauuagugauagugaaaaaaaaagaaaagaaaagagaaaagaaggaaccaacagagagauggcgcaguuaagagcacuuccacagguccugaguucaauucccagaaaccacaugguggcucacaaccaucuguaauggaauccgaugcccucuucuggugugucugaggacagcuacaguguauucuuuaaaaaaaaacaaacaagcaaaacaaaacaauaacaacaacaacaacaaagaaccuaucacacuguccuagaaauuacauaaccgcuaugguagcauuuugugagcaccgugccucauccaguguacacagcaguuuaguggcaauaugagacauagcugccaacccuuacccuagaaacccaagcccagggaaagcugaguaacccacacuaggucauggcuagcgagcaaguccugcgacuccagcucuugaauucucugucugacuuucuagcuuaaaucuaauuuacagaaacauaaaauaacaauuauucaaaauggcagcucuguaaaagaaaugggggucuccuccuugaaaaugcuccauuucucuagguuuugcuucugaagagcagagggguuggaacacuuggagcacucguucuaccagagagccguguugcucccugccucucucuugaaggaagagaccagugcugcuaagugggcugccauggguugacugugccuucuuucuuacagggugcugagacuguccaggagcucuuggagguggccaaagacucgauccccagaagccacugggaaaggaccccggugguucugaaagcaacggccggacuccguuugcugccugagcagaaagcccaggcucugcucuuggaggugaguuugaagcuggaucuuggauaacgcuugucuguucuuuuaaggagcccgucagaguggcagcugcuuucggugaccccucauugcucagucaugguggugaccaggauaguaacuagucauuuccauuuuaaaugaucacccuugaauuuaaaguguuuccccaaaaagaucaaagcacuuccuuccaugauguuuuuauugcaucuauuuguuuauuuauuugugugugugugugugugugugugugugugcgcgcgcgcacacacuuauaugugccaccgcacagcuugccacagaggacagcuuacaguucguucacuccucccaccaaguggauccugggggucaaacucaggucaucaggcuuggcagcaagcgccuuuacccacugagccauuuugccugccccccuacauagucuucugccacagaccaccccagccggguaugggggucccuggaaugaggguccucgaagcuagguggguaaggauucggcagugacaaacagaaacaaacacaggcaguuugaaucugaguauauuucgcagcucucaagcaggggauuuuauacauuaaaagaauucuuagaagauguguucagugaagcaaucacaaauaccaucauuaucauuuggcacaguaaagcacacaaaucaagcaagcauuacaacucugaaaagauguauucagugaaucacaaacagaacaggugacaucaugauuaauagagaucauccaaguguaacaacgcugaaaggguguauucaguggggcagucauccaaggcuaggggcauauuuccaagagcagacuaauaaaucuuuauggucaauuauuguuuaauaucuaauaccugauuuuuuuauaaaucuucaaugcagaaauuuaaacuauuuuaauucuuuuucuuuaaggcuuucuuuaccauugucuuagucaggguuucuauucugcacaaacaacaugaccaagaagcacuuggggaggaaaggguuuauucagcuuacacuuccauacugcuguucaucaccaagggaagucaggacuagaacucaaacaggucaggaagcaggagcugaugcagaggccauggagggauguuccuuacuggcuugcuuucccuggcuugcuuagccugcucucuuauagaacccaagacugccagcccagaaaugguccuacccacaaggggccuuucccccuugaucaccaauugagaaaauaucccacagcuggaucucauggaggcacuuccccaacugaagcuccuuucuuugugauaaccccagccugugucacauaaaacgagccagugcaaccauauaccaaagcccaccucugaugauacacguguagccauaugaaauuuuauuguugggaaaguuuuuauaaugucauaauacuauuauauaauuuuguaaaugauuuauaaaguaaagcguugguuucuccagagauaagaucauguuaguggccccaucucuagggaugguuucuuacccauuauccuuacuuaagaucuuggccuaggcugccaggaacauguaaaugagaaaaagaauaagagaaaucaaaacauaaauugccaugagaacuaugucucaauauuuugcuccagccaagaguuccacaaccaggaggccuuccccuuuugaagccaaccaccucagucuguggaacuugucacagauucuacugggguuggugugguauucuucauuugaauuuucuaacaguauaauauagaaaugguuuuaaauaaacucuaccaaagaaaauguauguacagugaagggcuggggagauggcucagucaggaaggcgccugucaacacaugccugagcgccuggauuucauccccagcacacaugaaaacaccaggcacgguggcacacacugugcggggaaugaaccccaggucccggugacagaccuugggaaaagaaacucaaaguuucuucuuacguuucauacaaguggaauuauauagcuuauauucucugguuuuguaagucugcuuuuuuuuucucucagauaaaauguuuaaacuauuuuuaaaaacauuguucuucaaauaaaaaaacaauaaguauaguuuuucaagcuuaauauuuuauuuaucauacaaacuuauaaacauauuacaagauuucauguuguaaagaacauuuauagguagaaucuuguuauaauaaaaacaaaucacagcaaagugggauucugcccucuaaacuaaagcggccaccuaaaucguguucuuuucccacuuugaggugaguuguaagcacagucuuacugucaacagguuuucugugacugucaacagguuuucugugacugucaacagguuuucugugacugucagcacagaggguuuaagucccuuguccagcaucgagcaucuagcauguuugggagaauucagaucccaacucuuuuuuguuuuuguuuuuguuuuuaaagauuuauuuacuuauuuauuuuauguacgaguacaguauagagcugccuucagacacaccagaagagggaggacaucagacuccauuacagaugguugugagccaccaugugguugcugggaauugaacucgggaccucuagaagagcagucagugcucuuaaccacugagccaucucuccaggccccaacucuuauuuaaaagcuuuuucuucagauguauuuauuuuuguuuuaugaguguuuuacccguguguguuucuguguaccgcaugcguaccucuggccguggaggcgagaagagggaguagacccuugaaacagaggauggauuguugugacccucaaugggguaauggguauggaaccuagguugucugcaagagcaaugagugcgcguaaccucugagccaucucuccaggcccucauaccccaguucuucauccucauucacucauucacucacucauucauucauucacucacucauuuauucauguguccaccaucugagaagucccuggggauacagacaaggagcagaaaggacacagccagggcccauguugaacuuauguucuaguuuuaggaagacagaaaauaagcaacgaaauagguaaauacagagugcuucgugcccuguagguucugugaagagccauaagcaggcucaagcauguggggagugcgugaagucaggaaccgcuuccgugaaguccuguggccggcucgauaagaggaaaggaagcagucaggaagugaucaggaagcugggucacgggggauuugucaugugagcauuaaaagacaaauagaaagucuucuucuuuuuuuuuuuuuuuuaaggaggauaccaggaaauuuggaacuaaagagaaauaguccguuguccacuuuaaaaacaguguccuggaaacagcacaagcaugagaacuucaguuccacuuccuagcaucuacacaauacugcaggcauagcagcgugcaccugugguuuccaccccccucccccgcccccugcacugggaagacagacaggaaggucgcuagggcuugugggccaguuccucuagccagucaccgaccuccagauucagcgagagacacugucucauugaauaaggaggaggugauggaaaagacaccugagguugaccuuuggccuccagacacacaugugcucacacacaaauacguacaaauaaguaaauaccaugcuccgugcuguguugaaaauaaacuuggggcagacggggguguagacuguaggcuuagguuuuucaugaccuaguuuaacaagaguucuuaaacacuucaaccucccgucuagcccaccacccagcagaggucauaggaaagaaugguuauuagguuauggaggaaguggacuuguuuagaaauaguucuuuggggugacuccagucuuuguugucaggauaucagcaguucaguuuccuagcaaaccaccaaacacaaagcagcagcagcagcucuauccaggauaaacugguuaggcgcagguccggcaagccgcuggacuaucacuggcaagucuuuggugaguuacucucuacgaagucacaacaaggaaagucagcaaccugguguuaaggccaaccagugccgaguguugccaguggagaccagugaaguguaacaaggcaaaccaaagcacccggcuugccccaccgcauguggucauauuuauauacuuuccaaacagcacguguccuuucaugugucuacuucagcaagacauuuccccugugucugcuuuagcaaaacaucacuugucauaacugaguucucaaagaaaccagcaauuuccacuucagagaaggcuagagcagaguuugcuuauuucuguuugcuugucuauguucuuuagagcuugucuauagaucaccugacgagcugguuucguugcugaaauagaggcuguagggcacugcuugauaguccaguggcuugcaggacucagucuauccagguuaucccaucagaccagagaucagcaggcuggagagagcccuuuuacuuauauuuggagaaucccucaccuauaguaguaauguaaaaauaagcuauaacaucggucaguuagaugagucacccuuagaggugagugccaccauucugguaacauggguuuugucccuaggacccacaugcuagaaggaucaaacugagagcugaaaguuguccucuagacucuguucaugcuguggcaugcacaggcacacaugagugcauacauaugugcacagucucacauagaauccauacguguaaaaacaccuaaggccaucaugcaugugucagaggccuggaucgguggaaaaucggaagcacgagugucagguugugauucacaccuccugaaauaggagucuauccauaagcuaggccugaggccucccuaagugucugugggccagccgugacccgaaauccugcagagggggagagccucagcuccucuacuguggccggcccgucacuuauccaagagguggcauggcgacagguccucgaagugguaaaauucaucagggugcuaacacaaucacagagucuugacuccaguuggaaggcacaauuacguguucuuccuuggccuaguugguaguaagcuagaugggcuucuuagggaauccucacgcuuguguuuuuguaagaaaauagcaacuccaugucgaguuccuucucugguuucccaggaaaaaggaaugagugcugcuaguguuuuaccucgggaagugaacuagagugacuuacagaacguaggggaggugaacuaagacguacagaaagcagccaagugugaucauuuguuuuacugcccccauggaacccagauuuuuguaucuuuucucuagguagaggagaucuucaagaauucaccuuuccuggucccagauggcagcguuagcaucauggauggguccuaugaagguggggcagaugaugagauacacacuuguugggaaagagauggagucagugcaagauccaguuaaagggacuggggguggggaugcaucaugagaggaaggggcgcaaaguaaauaagcggggagaccgcgagagacgugagccccagagagaaguagaacagaagaagggaucuggaguguaaaccuucuuuuucucuccuguaggcauacuagccuggguuaccgugaacuuucuaacagguaaaacaacccuugaaguuucucuuacaaccuuaacuggcuuuuacagguagaccaggaggguaaaaaaaaauccacuucucuuuuccuguacuguucuuugauugagagaaggggguggggccagagaaauggcgagcaguucagucuauuccuugucaguucccagcaccacucggguggcuuacagcugccugugacucgggcuccagggccuuagcucugugcagccacacucggcuguauagacccauacacauacccagaauuaaaacuggaaaaaaccccuucuuuaaaaaagaagaggggagagagacaagcuaauucuacagucugcauucaaggccucagcggcucaagaggcucugcguuuacauuagccugccagccuuuggguucagggggcagugggucuucacaagacagcuuuggaguccaguaagcaggagagaaccugcagagaauggauggguagccgggguacucacucaucccuugcucucauuaacaggucagcugcauggucguggccaggagacuguggggacccuugaccuggggggugccuccacccaaaucacguuucuaccccaguuugaggugagucauuuuuauccaggccuuucuggcaacacacuuagaaagcuaaguaucacgcugcucugagacaacagcucuacagugacuaggucacagagucgauaaaugacuggagaaagucucucuggcuccuggagccuugggagacauggcguuuaaucuuccccaugucugguuuaggggaggguuguggauggcgguguuauaaucuucuuaugauugcaggugcugaauagucuuuuugcucuuucugauuugcagaaaacccuggaacaaacaccuaggggcuaccucacuuccuuugagauguuuaacagcacuuuuaagcucuauacacauaggugaggagggguaggggaaauaacaguucacauuaugucauuuuccuuacuucucaaagcauuuuaauauuugucacuguaucuugccagccucagaaagccucugccaguccccuaagcccugucuacugaaaccuaauccauaccaaaccugagaaaccuaggaggcaucuccagucugggccucaagcguaugugauguaagagucaguuucucuuuaguugauugcaugugaagaaggcucagaccucagccagcgcucuguaccaacucauucaguaagggcuucugggcuucagagaccagucugcaauggauaagagcuuuucuggggauggcucucaggcugggccaccgggaacaaucucauuccucgguaucacaccugugagcaggucuuacugcacaucuuagcccagacuacagaagucuuccuuuaguguccauugagcaaauacagcacagagauggggcaaagcuuccauccuucccagggagucagagaaaccacgucacauuugaagaaggcggcugugggcuaaaaacaucuaggacagccugaaacugucaaccuuguguuuuucaguuacuugggauuuggacugaaagcugcaagacuggcaacucugggagcccuggaagcaaaagguuugucagucccagucuguggugggagacugggagacgccaaaacacagcucgcccucuucccuugcuuggcauucuuccuauggagcaaagggcugugcuggccugggaaguguguguugcauaacagacauaaaagcugccggggcuguggugugcauucaucaccuuuagagcaaagguuacuacacaggaguaaggaccuguagcuacaaggcuggaaccuccaccgugucucguaggaacuugcccaagccuuugucaggaaaccaggucuuuucuguuugccaaguggagugacugagcaauuccuuuucugucuucacuguugggcacaggcagaauuggcugcagucccaguuguguggcuggggacaaaucagugacccuucugugcccuguucuucaccuugcacaggagugugugucuaaugcacccagacagugcucacaguaaguggguucugggcugaggcgcacagagcacuucaguuugccggguuaucuucaagcgugucucuuuuaaccucucaacuaccaguggaggaauguuccuccauuacagggaggaacuuacuuuacuaugggguuuuuauuucuuugggaugugauaagcuuuauaauuccccuggcaaaugugcaugaaguuugccucuggcucuagagaguuuaccacuaccacaaagccugugaagacuccaugucgcaggacacagccgagggacuacucugacaagauuauaaguccccuucaccccaucggccacaagagcuucuugcuucuaucucccucucacagaccgccuucuccuguuguguucuuucagggacugauggacauacguuucgaagugccuguuuaccaagaugguuggaagcagaguggaucuuugggggugugaaauaccaguauggugguaaccaagaaggugaaugguguuucuucacugguuaaaauuaccuuccuagugccuguucugggaaguccuauaggaagacuccagagcccaggggagauuugacuuauucuagagguguugguauguccagggccagcaagcaaggcagcucccgcucugcauacuguucugaguuccaugguagcgguaggagucuguugucaccuguugucuuaggcaggguuucuauuccugcacaaacaucaugaccaagaagcaagcuggggacgaaaggguuuauucggcuuacacuuccauacugcuguucaucaccaaaggaagucaggacuggaacucaagcaagucagaaagcaggagcugaugcagaggccauggagggguguucuuuacuggcuugccuccccuggcuugcucagccugcucucuuaucgaaccaagacuaccagcccagagauggucccacccaccaggggccuuucccccuugaucacuaauugagaaaaugccuuacagcuggaucucauggaggcacuuccucaacugaagcuccuuucucugugguaacuccagcugugucaaguugacacaaaacuagccaguacaccugucuaaugcagcagugacaaucccuguuucagguccggggaauguguaacaauuucauuuauaguaaaacucaaaauugagauaagaaucuuucgucuuagauauuaacaucaggggaaauuuuguuaccccagagaaggaaacaagcuuucuggaccaugaaugguaaugccaggccgagcacgguggcugaggcuacagcuguggcuagagcugguuuugaugaagaacacuuaaggggaggggcuuccacgcacaagcggugagguugaagaaaguuacauagcuguuugugugugugugugcgugugugugugugugcguguguauguguguguguguguguguguauuuuauacauugccugcauguuuguaugagucuaguacccauggaggucagaaggagucagagccccuggcaauggagauacagacaguugugaaccuucacguggguugcugggaacugaacccagguccucuacaagagcaggaaguuggcggggggcggggggacgcugaagagauugcugcucuuucagaggcccaggguuuaauacccagcacccacauggcagcuuacaacugucugaaccaacaguucuauggcgucuggacuccgaaggcaccagauacgcauauggugcacacacacaugcauguaggcaagcagacuuuuuaaacgagcaguccgugcucuugauugaugcaugucuccggcccccaggcuuugggcuuuguuguugaggcagcuccaggccucagcugcaugcuugcacggaaggugugcacagcuguuuuugcugcugcugcuuggccucaguuucucagacuuggugagcuggcaguaccuggcucuggucuuccuggaguacagguccaggcauuuuaugccuugcccauguggaauuuccugaggucuucucucugaguacaaugacagagaggacacagucaugcacuuguggacaacucauaucuuggacagcuuggacagcauuccaccugucacuuuaaguguugugucagcuccaccucagauugcccugcuguuucagagcuccgcccccaccuugcugugaggguaccucagccauagcuaacccgcucccaccacugcugcucagaggcuaagagucagccuccuugcuuucucgaucuucucucuguggcuccagcagcuugccgcugagagugauuguugccccauccuuagucucaugugauguauacucuugcccugacaggggagaugggcuuugaacccugcuaugcggaagugcugaggguaguacaggggaaacuucaccagccagaagaaguccgaggaagcgccuucuacgcuuucucuuacuacuacgaucgagccgcugacacacacuugaucggugaguucaugccuacggucagccauggaggaagagaacgggacuaagcucaggaagagaaggaaaggcuguguugguugcaguggcuucccaguucuuucccaguagacgggaaggagaaugagggugcugggcucuuugggagguggaaaaugaccuaacuguaugaaaagucuguuggagguagguuuuuacuauauauccuucacugauacugaagucacuauguagcccagguuggccccaaauuuguagccauccuuuugcccuagacuucugaguuauaggguuacacaaugugcccccgugucugacuuuguaugugaagucuuuuugcauuuuuuuuuguacugggauugaauccagaaccucugcacaugagaguucaaaguugcccaugauggcuuugagacuuuguagccugugugugccuuguacuugugaucccccugccucagccuccugaggagcuaggaucucaguugugugcuaccagaccuagccugcuuucuguccucguugagucauaacuguacuagcucuuuuguaaaugugaguaaguacugagaggauugucggaggacuaaggguuucucccggaucacaguuucagaggguucagcaaccucuuguuucugccauggugaggcgaaaaauaaugguggaagguccuggaggagcaaacuugcuuaccuccuggcagacgcaaggagaggcagggggaugggcccuagagcaagauggagcccucaacuacacauucauuccuauugggccgcuccccacccaagcccuagguccagagguucccacuaccuccacuacacuaucauguuagcuguaacuuaauucacugaaggcagauaccccuccccgcccccccccccaaccccguggaccagucaccucucagugacuggggacuccagugucuggagaccaagccuguaggaggcauuuccuauccagaccauaacaaguugacacacaguaaaugcauguguuguuuucauacaguuugccaaaccuugcauguauguaccugugaaaccucaccacauucaagaugauauacccaucaccccaauuuccuauucuucuaggacuuuuuuucucuuaucacagaagcuguguuuuuguuuauaugugagaguauacacaagacuugagagacgauuuccuguccuguuuacucuauuuuuuaauguauguguacaugccugcaugaguucauaaguaccauguauguguaggugucugcagaggccaggggaguuccagguggguguaaacgaccuaguauggguucuggauccaaaccugagcccucugcaaaaguagagagugcucuuuugucuuuccuuucccucccucccucccucccucccucccucccucccccucucuuucuuuccuccuucuccuccucccuccuccucuuuuuuuuuuuuuuuuuuuuuuuggguuucccuguguagcccugacuugccuagaacucacuuuguagaacaggcuggucucgaacucacagagagcugccugccucugccuucugagugcugggaguagaggugugugccaccacugccugccuacaguaaaugcucuucaccacugagcagucucuccagccuuuggaauaacacuuugucuguggcuaaauauguaauacaaaaugggugccaugcauuaacuguaaauaaaugagcagcguggacuuauauuguagagaggccgugagucucuuguuggaaauacugcauauuucuaguuuguauuauuauguaucccugggauaaauguccuuauuuccuugaagcguuugauacuaucuauuguucuguuucauuuuagauuaugaaaagggcgggguuuuaaaaguugaagauuuugaaagaaaagccagagaagguaagcgugggcaugagguguggcugagguguggcuggguguggaagcucucgggacuggcucccuucugcuucuggucugauggaagaugcacuaggugcugccaaagaaggacauggggaugugagacacuuuagggaaaugguucaaacgaacaaacuucccacauuucuacagauuuuccuauuauuauugccacauuacuauuauuuguuuguggggacuuuuguuguuguuguuauuguuuuggguuuuuggggguuguuuuuguuuuuuugguuuuguuuuugagauaaggucuuauguagcccaagacagccucauauuugcaguguagcugaggauaaccccgaguucugguucaccuuucaaaugcuaggauuacaggcaugaguuacugugacugaucuaugugguaguggggauggaguccagucuccuggaugcugggcagucauuguaacacccggacucgcugcacacucagcuuggcaugcucucucggcuucccuuaaaauugaaacaggcuuaugagcaguaauuaagaccugagcaguggaauggacugccacauggacauccuugagagaaugagucagaaccaccaaugaucucuuccagggaccacaagagaggagggcuaaaggacauuucucuguucucuggguuuaccuggggacuugguacuaaguagacacagcaagucauagaaauuugaaaaucggggugcugagagugaaccucccuggugugugccaggcccuggccugguuucuagcagugccuuuccccugcucccuuaucuccccuaaguggcaaauaagcuaagauguauguaaaaugaauagaugauuucauagcggaaaugugcagauccuaaagaagggagcacaccagcuaguuuccaguuagcccgggcagcaccuagagacgucuuggccuacccagguccuaccucuaucuagggaagaaaagcccccaccccaucuccuaucugcaagugaaugcuguccucucacuuucagugugugacaacuuggggagcuucuccucgggcaguccuuuccucugcauggaccucacuuacaucacagcccuguugaaagaugguuuuggcuuugccgacggcacccucuuacagguaagaaagaggcagagcacugccguugggaaacacuuugguaaucggagcagcagauguucuuguuggggcuguagccuaggcacccugcuagguacagcagacacugggaugggugcaguuuagucucugaguacaguacaagacaugaguauccccccccccccauuuugcacagaacagaaagacuuggagcccagugaagauguucaagucccguaguuuaugaagucaguuuagaacccagugagaagcacugagaaagauaaagacaagagaaauaagcauccagaauacagcagaggcaaggcgggagagccacgcuucccgaaucccagauuucucauccuggguugguacucccucaucugccacugaucauguggcuauaagaauaucaguuugaucaagagagcacaagauaacaagaagcuggggccaucacacagauuuauauucagagagccccugaggcaggaauaccuggcuggugacauuggcauaccuuguuccauuuugcacaguggugcuaacacugagugcuuagugcauuagugucucagacauuuguagugcauccuguauauucuaagucugauagauagcuaguuuacucucuucuaauagacucuaugcugcuugaggucaagggucagacuuuagccuuugugaauacaguuuguaaucaacaaugguauagaaaguaagaacacuaacggugugaaauucauaagcuauguuuuauuggugcuauagagauggcuuagugguuaagagcaguugcuguuuuugcagagggucccuguuugguucccagcuuccacaugguggcucacagccacuuguaacuccaguuccaggccaugugacccugccuucugcucucugugggcauuaggcacacacauggugcacauacauaccuguggucagaacauugacacacauaaaaaauauaaauaccuauuuuuaacuauauguuuuaggggucuggagagauguccccacaguuaagaauacuugccgcucuuccagaggacuguguucaauuccuagcaccuaggucagguggcucacaaguaccuauaacuucugcuccaagagauccaaccucucuggcuugcauaggcaccuguacucgaagggcacauacucacgggaagacacuuacauccacacauaauuuuaaaaaauaauaaaacugaaaaucuuuuaaaaauaucuguuuuacaauaaacagcuuaucacagagccugaauguacugaaaucuauggggagggacaggaaggagucuaaaggaaacagcuuuauagacaguaaucuaaacccuuuucuggaaucgagggaucagcuguaaacuauccagaaccaucgggacaaucgagugcagaaugcuccauuugguuguuagugcucgagggacaguugcuuacauagagccagaaagcugagugugugcuucccuacccuaaacacccccagcucuugccagguccguuccucucacacccaugagcacuguguuaugauuggccuggucagaaacugaccugugauucagaagacaaggccagaggugcuguucuuuuuguugaguuuaaggggcauccauaagcccgucugacaaaggcucucuagaacugucuggauagcaccacuuccugagcuugcagauguggggcaguuagggcucggcccacgaucacucuuuauagguagcggcuguccaaagaccaugcuugcauauuuugaaacugcaugagagugugaagacuucuuucuucuucuucuucaacagcucacaaagaaagugaacaacauagagacugguugggccuugggggccaccuuucaccugcuccagucucugggcaucaccagcugaggccaagcuccaccucugaagccugcauuucugaacaguuuucucacaggaaggcguggacucagagacauuuucugaccucucuggaaaagccuggcccgaaacccguuaacugguuuuauaaggagggagggguuuuuagaugagucuugcucuugagccuagugauuugggcuucaaugauuugcacaucuaaugugaauagcuccuaaccacuuggugggugcauggcuggcaccagacuguaaaucuuuugggauucuuuguuacagaguccugcaaaggaaaaaagagaaaagguuuggaacuccaugcuagauugcgaguucagagacaggucccuggggaccaaagaacaaucucguuucaacccuuggaugccucauugcuuugaauggauucauuuuugcuuauaagcugauuuacugaaaucccauaacccaucaaugcuguuaauuuuuuucuuccuacccuuauuacauucccuacccuaaaagccugggggaaauaccugguuuugcuucccaucuauaauugagaaagaggggggaaaagauacuguauuagaauuugugugauccuguggcacaauagaucaaccaacccauuuaaagcuuagagcuguccucaguauuuuauuuuuagacaagggcuguguuguguuuguuguucaggcuggccuggaacucaguauguaacccagguugccuugaauuaccaauucucccgccucagccuccugaaccuugggcuugcaggagugagcuguuaugcucaugucauggcccaucuuagcaagacggagagaguagcucuuaacugccuagaguauaagcaaggagaccgucgggucucaagggauagcuguugccacucuggacguaaugaacauuccgcccuggagaugcgugccuauccagugucagucagcacugccucccaagcccauguguuuauagaauuaaacacagcccuaaacugugugccuuuguauuuccgugaaguacaaaugugcccuuguuuucgcucugcaguuagaaguuaaugcgugagcucuuugugucuaaagauuaccaaugcuuucaguuguccuuugggggguugagguguggaaagugcugggaaucgaacccaggacuucuugaauguuaagcacaaugugcuagcacuaugcuuguauaguccugcuuuccugccuaggccccugcugaauuuggcuauuuucugaauucguugucuagcucaggaucucagaaccccuuuccagugauacccaaauuugguuugguuggcuauuuugguccauauugguacaggucaggacagugaguagcauuagagaaccauguuuucucucucaggacguuuucuggguugugguugaacacaggucaugcaugcgaggcauggguacucacucuacugcauuauuuagcucuuuaaagucauuaccugaaagaucuuaaacuucugucacuaugucguuucuaguauuacaucacuggccacagggucuccugucgcuuggcuccugucacagcacuuugcccuccucuucucuuuccagcccaggaaguuuucaucuccccuaauguaauuuuuggccaccuacuuuuccuucugcucuucacaaaggaugugacuaugccugggcccaugguagucccuggggaaccuuguuuuuuaagccauuacaucgagucaauaauauaaagaaaaagguauucgaccagucauaguccacuaaaugcuaucacaguugugagaaaccaagcugucuccccaagaguaagcaagcaaugcucauuaagaugccuuuauaacaggccuuauggcgcaggccuguaauccuagcuaccuugaagcugaggcaggaggacugcaaguuauaggcuugcugugggcaacucagugcaacacucaacaaauuuuaaaagggaugaguuagaagacaguguucaguggcaaagcuaguuggcaugccaggcccuagauucaguccccagcacuaaagacaaagcagacuacugcucucuacacagcuggucucugacaccucagacacaggggcccuagcuauaaaguguguauuguuccacagacaccuaugguuaccuuggauacugccagaacuccuaaauacaugaacuuuuaccucagaaauuuaucugcuuauguccuguuaaucuucaaggcuuuuuguuuguucuuuuggagacaggguuucugucuguguagcucugguugcccuagagugggucucuguagaccaggcuggccucaaacucauagaucugucucugccucucuaguauuagaaugaaaggugugcaccaccacuacccggcaacguacaccuuuuuuauuaaggggcuucuauuguguucugaaguuccaucucugugacaacauuaauauacuuuaaauaccugggauguggucugguacauacaugguggaugcuguguguguauuauauauacuacuauauuaugaacaccugagucauggaaguccuugcaaagugugccuuaaaauccucaaccuuuuuaacuuuucucauacaucgaagucaguauucuuaugaaggcccccauauugaaaaaagucaccuuguccugagagguuguagccaucaucauuuuccagcggcugccaucuuuuauucugggaacguuuucuggguucacugacaucauuacuuuguacuaaguuuuccucguugcuuaaaaggcugcucuguagcaacaacugucucaucccuucaaagcuuuuccaaagcaguuuagcuuauuugaaaagggggcuuucuuacuucaucuuuucaaaauaaacugcugggcaugccguuucuguaguguuguuaucuaacacagcucagggucucuucuggaggccucuuuggcacuuugcaguacacacacacuucaaaaccccaaauaaugaagcacucagccacacaaggaggaccugugcagcagcugagccccuucugacugguugcugaggccucugcagcugugcgugcgaugagaucguguauuguuuuauuacuggacagagaaugguaucccagagaggagccauaaauaaaacugaacuguggagccgugauaaggaaggagaaauagcaguacuaauaagaucuggcuguuauuuaucuucgugucccccuuaaauccaguguacuuugucaaagcaauuuguauuuaacuggcaugccaguguuaauuuuaaaacaacagucuaacaaaaauguaucagguauuucuaauucuuacucugucaagauaauuauauaaauuuaugaccagcauuuaaguacuuuauuuagaaaggucuguugccaagugaagugagggagaacaucuuggagauuccuuuguuuguguaguaauaaaaagcuccuuuuaauuaaauaguuuuccuuuggguuuu

SEQ ID NO: 12208 - RNA, 3370 nt, Mus musculus
gcagcgagcaacugagaagacuggauagagccggcgguuccgcgaacgagcagugaccgcgcucccacccagcucugcucugcagcucccaccagugucuaccccuggaccccuugccgggcuuuccccaaacuucgaccaugauguucucggguuucaacgccgacuacgaggcgucauccucccgcugcaguagcgccuccccggccggggacagccuuuccuacuaccauuccccagccgacuccuucuccagcaugggcucuccugucaacacacaggugaguuuggcuuuguguagccgccagguccgcgcugagggucgccguggaggagacacuggggugugacucgcaggggcgggggggucuuccuuuuucgcucuggagggagacuggcgcggucagagcagccuuagccugggaacccaggacuugucugagcgcgugcacacuugucauaguaagacuuagugaccccuucccgcgcggcagguuuauucugaguggccugccugcauucuucucucggccgacuuguuucugagaucagccggggccaacaagucucgagcaaagagucgcuaacuagaguuugggaggcggcaaaccgcggcaauccccccucccggggcagccuggagcagggaggagggaggagggaggagggugcugcgggcggguguguaaggcaguuucauugauaaaaagcgaguucauucuggagacuccggagcagcgccugcgucagcgcagacgucagggauauuuauaacaaacccccuuucgagcgagugaugccgaagggauaacgggaacgcagcaguaggauggaggagaaaggcugcgcugcggaauucaagggaggauauugggagagcuuuuaucuccgaugaggugcauacaggaagacauaagcagucucugaccggaaugcuucucucucccugcuucaugcgacacuagggccacuugcuccaccugugucuggaaccuccucgcucaccuccgcuuuccucuuuuuguuuuguuucaggacuuuugcgcagaucuguccgucucuagugccaacuuuauccccacggugacagccaucuccaccagcccagaccugcaguggcuggugcagcccacucuggucuccuccguggccccaucgcagaccagagcgccccauccuuacggacuccccacccagucugcuggggcuuacgccagagcgggaauggugaagaccgugucaggaggcagagcgcagagcaucggcagaaggggcaaaguagagcaggugagcagcgauucuggaccuuugugggcugggggggggggggggggcggagacugacgcacagaccacacaacagagaagggacgcuacugacugcacuuccugaccaggagcuguggcugcuagcccuuucccucccuugucagauuuugacaguuggacccaagacaaacucuagacaguuucccugacagcuuccuacuucauucucuagccggggagcuucuuuguuccccugcuaaagaucucacuuuaaaugcaaaucacacucugccugccaacugcagguuagaaaaacugcuucaccgagaggugcgggugcuguaggagccaguuucacuggggugacugaauggaggugacacuagacaaccuuaacugaauguugguccuuuucuucuauagcuaucuccugaagaggaagagaaacggagaauccgaagggaacggaauaagauggcugcagccaagugccggaaucggaggagggagcugacagauacacuccaagcgguagguugaaccagcugcugcuccugaaacuuuauuaaaguuggagcuugggacuaugggcgcaggguccuugagcaugcccgugucuuaugcuuucuuauaucucucccuaugcaggagacagaucaacuugaagaugagaagucugcguugcagacugagauugccaaucugcugaaagagaaggaaaaacuggaguuuauuuuggcagcccaccgaccugccugcaagauccccgaugaccuuggcuucccagaggagaugucuguggccucccuggauuugacuggaggucugccugaggcuuccaccccagagucugaggaggccuucacccugccccuucucaacgacccugagcccaagccauccuuggagccagucaagagcaucagcaacguggagcugaaggcagaacccuuugaugacuucuuguuuccggcaucaucuaggcccaguggcucagagaccucccgcucugugccagauguggaccuguccgguuccuucuaugcagcagacugggagccucugcacagcaauuccuuggggauggggcccauggucacagagcuggagccccuguguacucccguggucaccuguacuccgggcugcacuacuuacacgucuuccuuugucuucaccuacccugaagcugacuccuucccaagcugugccgcugcccaccgaaagggcagcagcagcaacgagcccuccuccgacucccugagcucacccacgcugcuggcccugugagcagucagagaaggcaaggcagccggcauccagacgugccacugcccgagcuggugcauuacagagaggagaaacacgucuucccucgaagguucccgucgaccuagggaggaccuuaccuguucgugaaacacaccaggcugugggccucaaggacuugcaagcauccacaucuggccuccaguccucaccucuuccagagauguagcaaaaacaaaacaaaacaaaacaaaaaaccgcauggaguguguuguuccuagugacaccugagagcugguaguuaguagagcaugugagucaaggccuggucugugucucuuuucucuuucuccuuaguuuucucauagcacuaacuaaucuguuggguucauuauuggaauuaaccuggugcuggauuguaucuagugcagcugauuuuaacaauaccuacuguguuccuggcaauagcguguuccaauuagaaacgaccaauauuaaacuaagaaaagauaggacuuuauuuuccaguagauagaaaucaauagcuauauccauguacuguaguccuucagcgucaauguucauugucauguuacugaucaugcauugucgagguggucugaauguucugacauuaacaguuuuccaugaaaacguuuuuauuguguuuucaauuuauuuauuaagauggauucucagauauuuauauuuuuauuuuauuuuuuucuacccugaggucuuucgacauguggaaagugaauuugaaugaaaaauuuuaagcauuguuugcuuauuguuccaagacauugucaauaaaagcauuuaaguugaa

SEQ ID NO: 12209 - RNA, 5361 nt, Mus musculus
uaucuccucuguauuuaucuuuuaaagcagaaugugauugggcacuguuauuuccauucacaagccuugcugaguuacaagaccuaggaaacuuaggguuguucucgggacuuuggaaaacaagccacuuggggaauuccugucagguuguuuuaacuuguguuuacuucuaagacuaauacaugcagaauuaacuacaggaaaugaaaauuuuaagauguaauuuaagccaucuuaauuuggucuccuaaggaauccagcucaacagcuaaacacuucagaccagagcaaacaugaacaguagguuacguuacgucuuauaacaaacgcucuaucaaccucuugaguuaaaccuauaguaucacaguaucacauguagaaauuuuaucuuccccuuaguuuucaugccacacagauguuuuaaauguuaacaaaaauaaacaaaaaucauggaaaauauauuaucagaaggaaugaagguaagcaaacacauaguucuggugacuuagucuacuucuuccaugcgugaugugucgucaucuccuuccaggggaggcauuucuucaguuacagcagcacuggugucauccacaguaggaucauccucaucaauaccuuguuuuggaaauaaauguuacaguuaauguccgcuaagggaggcggagacuugcuuuagacauuaacaccccauccaauccccugaaaggaaacuuuauucauagggggcaagccaaguaugugccuauaaaccccagcacugggacagaggcagaaccagcccaaagccauccucaaacacaaaggucacuguucauuucauucaaacccuuuagcugaggcuuccauaacagcaauaauccaauuguuucaauagcuacaaaagucaacuucguuuuuuuguuuuuaaagccaggguuaguauauauagcuuugguuuuccuggaacucuguaggccacacuggccuaaaacucaaagggccuaucugucccuuuacacccugaccccagcacuaggauuaaaggggaguugcaacagguuucuuucccuuauguuaguuacagguagccuguaauuuaccuagaccaagcuugaucauccuguagauccuguuagcaugggucuggggaucuuccagacugaagccagaagauaggagugcaguuucauacagcaagaugaccagauccuucacagauuugucauucuugucagccucugccuuuugccuuaagguuucaauaauggagugaucaggauuuaucuccagguguuucuuugcugccauguaacccauuguugaguugucucugagggcuugagcuuucaugauucucuccauguuugcuguccacccauaugugcuugugacaauacagcacggggaugucaccagucgguuugacacaaccaccuaaaauuaaaacaaaaacuaagugauggcuuaggccauagaagaacuuaccagaaagaaaugauuauuugaaacuguaggcauuagcagugauuuagucaaaacucagauaaaaggaccaaacugacuacgagugauguguaaccauucacauaccuuuucaaccuucuucuccaaaauaucuuucauaauuuugcagagguucucaaauuuugucuuuuucucuuccuguuucuucuuuuccucuucaucuucuggaaguuccaguccuucuuugguaacagacaccaaggucuugcccucaaauuccuucagcuguugcacacaauacucaucaaugggcucaaucauauaaauuacuucuaagccaugcuuucggagacguuccacaaaggcggaguuagcaaccugguccuuggucucaccugagacaauauauauauuuauauuguuaaguuacuuuuagaaaugguuucauguauucagcuuucccuuagguacaggcuggacauucuugccuccuuaagugcuguccaacagguagagaaaacaccuguuuacuugaccauuaccugugauaaaauagaugugcuucugguuuuccuucauucugguacaguaguccuucagagaaaccaucucguccccagaagcagauguguaguaccgcaacagcucugaaagcuucuuccgauucugagaguccucgugaauuccaagcugaagcacaagcacaggaaagccauuuaugaagcauuagccuuuaauccccacacuugggaggcagaagcaagugugugaggaccccucccccaaucaaguuaguuuggaaaacugccaguaacaagaaaauguaccaccaaccuuuauauuuuuugagaacugcucauaaaacuuuuuguaguucucuuuaucuucugcuaguucaguaaauaguucuaagcauuucuugaccaaauucuuucugauaacuuucagaauuuuacuuuguugcagcauuucacgggaaauauuuagagggagauccucagaauccacuaccccucuaaugaaaucuggggaaaaacaaagacaccuauuuaaucauucugaaaccuaaggaaucuuuuuggcuuuuuuccaaggggacugagcccagagccucaaacaaguuaggcaaaccccgucuccacuagguuacauccucagucccccaccaacacagacccaacgaaugggauuuucugucugucaacagugccgauucuucccaucccuacuuacucagauacucagggauuaauuccucacaguuauccaugauaaaaacucugcgaacauacaacuugauguuguucuuuuucuuucuguuuucaaacagaucaaaaggagcgcgucuugggacaaaaagaagggcccggaauucuaauuguccuucaacagaaaaaugcugcaauaaaaugaaacaaccuuuuaaugccauggacaaaaugaauuggcuuucucuacugggcuaaguuacacuucgaagcuuuucuauaggugaguauagagguuuaaaaagucaaccugaaaaccugcuuuuaagucacucaccuuuacugccaaguguucuucccaaucguuaguuaagcucuuguagaacucuccauauuccucauuagugaugucaucaggauuucucguccaaaucggcuuuguuuuguugaguucuucuugaucaauguacuuuuccuuuaucuucuucuuuuucuucuugucaccauccuucuucuccuccucuucuucaucagagccaacaucuucuauuucagguuuaucaucagacuccuuuucuucuuuuucuuucucuuccucuuucucuuccuuuucuucagccucaucaucacugacuuccuuaucucguuccuucuccaccuugaaaggcaaaucacuucauuauaaauuuauacaacuaggacagaucucagaaauguguacaaccaagaagccucucaucaguaguuucucuaauuucuccacaauccucuucagauaccaccuuuccaaacaggcuaaucugucuaguacaacaccagguucacagaacucuaaacagccucaguuaucucaauuauaugaaauuuacccuguagguaacuuacaaagagaguaaugggauagccaaugaacugagaaugcuucuucacgaucuccuuuauucuccuuuccuccaaauacucuguuuggucuucuuucagaugcaagauaaccuuuguuccacgacccauugguucaccuggaaaagaaaagggcaaugguuacuauucaaagccuccaugcuugcuggagguuuccuagcagcuaaccuuccccacaaaugcaaaggucuccaaagcuuuaacuuccuugcccaagauguacaacugagcaaacagccauacauuuuuccuauuuccuagcccagguccugaagcucccuuuagauuaacaauuuuguugaaaagcucaggacuuagcacuaaggcuauguaugccagacugcucuuuaacucuucaacucuccaaguuaacccucucaagcacuuacugaaguuaaccagacacccccuacaauugaauacauuccuuuuggccuaugccuaccugugucaguccucacugugaaggaucccccagcugaggacucccaggcauacugcucaucgucguuaugcuucgugaugacagucacuuucucagcaaccaaauaggcagaguaaaaaccaacaccaaacuggccaaucauagagauaucugcaccagccugcaaagccuccaugaaggcuuuggugcccgacuuggcaauggugccaagguuauugaucaagucggccuuggucauuccaaucccgguauccacaauggucaggguucgguccuguuugcugggaaugagauugaugugcagcuccuuccccgaguccaguuuacugggguccgucaggcucucguaacggauuuuauccagagccuauuaagaaaagauuaaaaaugaaaaaaccgucaagcgcaaaccccaaggugaaauuuucagggaaagcaacguccaauccuccaagugguauacucacguccgaugaauuggagaugagcucccucagaaagaucucuuuguucgaguagaagguauugaugaucaaggacauuaacugggcaauuucugccugaaaggcaaaggucucgaccuccuccuccuccauugguuggucuugggucuggguuuccucaggcaucuggaacacagaggacgacucuaaagccucacagaauggcugcaggcgugcuaacgaccgccccuccucuauagaggucucuuaccgacucuauuuuggacuaagaaagggacgaaauagaaaagggcgacggggcgggggguggaugacaaagggaugaccucauuucagaaugcgguaauuacgaagcgcaugugcgcgccuccgggaggacguucggacccgggcggcuccacgcacgccguuccuaacggccacccucccccaacccgccgcuauggcgccucccucgcccgcccgcgccucggcggcaccggcgacagcccaacccucgcuucgcucgccccgcgcccgccucgccgccgccaccgcuccuccucggcggccauugccgcauccccggccuggggcguagauaugaggcccgccuggggccuagggucggaagccauggccgcccaccuccgcgggcugagggaacucggaugguggccccgcugccgccgcggcgccagcaaccuacggcccugcuccccaagcccccgcuaaguccgccugcgccaucacucaccguggcugaaugaacacgcacgagacgugacgcuccgcaccaggacacugaagcaacuggcgcgccgcccccugcgccggccuuauauagaggcgggcccgcccagcgcgcggcgcuucuuuccagaagccuccggaaccuucc

SEQ ID NO: 12210 - RNA, 20371 nt, Mus musculus
acaagcuugaaaagcaauuuuuauugaauuuggagggacaguuucuuauuauaauaguaaaaaugcugaagcugaauguuguaaaaaacgacauggugcagcaauggccagcgucuggccgggaggggacaggccagggugacggacagcgggagagggaaagcaucuaaaaggacaagugcuaggagaagggcucacgugaggcaggcgcucccaggguacccgcuaagagccaccacgcgggagcgggugcgggagggcaggggcucuccugucaccaagauuaaaauccccuaaaugucucugaacagcaugggacacagcaacaaacuggauucuuguuccucugucaaccucacuugagcccuggccaucccauccagcccuagggcugaagcagcugugaccucuccccgcccagagggagagggccaguuagcauaccacaggggggugcuucuggugccuucuugcuggacuuuggcccuggacccuagagacagguggcggccaggguggacaggccaaugggggcagugacgggacccacccagacccaugagcccacauugcacauggucgcgucaguccuuaauaguuuucuacaugaaucuaauuguucugggcacugaggccacauguguggucucaaacuggaugaaauaaauuaagaaaaaccccaggauaguuuuccuccugaccuggcugggagguaggcugcugcccacaguagaaacauccuccccugguccuggaggcuggcaagguuccuccccagcgcauccgagaaacaaaacaucagguucagaugauccaugcggggcuucuggacucggcaaugcagaggagcguggagcugccagccgcugccccaggccucaggcugugccacuggcugaguaggagaacugggggaagugcggccuccgcucacuguccacacacuccaugcugucaucugugggccacaggagggcucagaccaucucuagaaacagcccgcccaccugacacaugccagaggauacaagggggcccugugagggggcagugacucuggcccucagaacacucccucccuccccgccaagcugcuaccacccuccaaaggguuuguuugauucuuuuaguuuuggggcugagagagagcuuagugguuaagagcacuggcugcucugguagaggacccggguucaguuccagugcccacguggcuacucacaaccaccuguuaacuccaguucccccccaaaaaaagcaggagugcaagccagacacugaggggccauggagugggguggccucaccuugaucaggcggcgugauggugaucaucugagcugugaacuccucaucgaaauaccuggugucagucucagaggugaccuggggcuugaaaggugggcucagcugaggagcaacagaaggccugguuacuacuggguuccaaucccuccauccucucugggcaauacugaccuuaucgggugggcacuagcacuagggaacagcucuaggagauggaacuggguagggcaguguaggcaggggagagcaagcccagagaugcccaaagugacgagaggguagugacugcccaccuccaggcagugggaacuccguucucugguugucauuucccuucugaguuuuuuuuuuuuucuucccuuuccauuuuuugaaacugggguucuguguagcccuaggaacuaccucuguaaaccaggcuggccucaaacucagagauccaccugcuccugccucccaggugcugggacuaaaggcacacaguggcaccaccacagcuguggcaggacucaaagcagucuucaggugagcucgccugccucacugacagcccaugaagaagauaagcugcagagugguguaugcacuggaggcugcuaacauccuuuugggucucacaggcaaggacccucaauugccaucccucccaaaucuggugugagggcaaugcggacuucaugggaucucuaguugagugugggcaggaaaggcaugccauccacacccccacaugcugcuggccccguguuaucuagaagguacacucaaggcaggggguaacagggcacccaacacaucaagguagaguguugagaccaccugcugugucccucaucagccugggccagggguacuuaggagcugaagagaaucacacuuaggggugaguacaaggggcucugcucucugcaguggccuacacugugccagacgggcaggggccgucccagaaugggauuaggcucgcccuagaguuggagacaccuagacauuaccccccacccucggcuagcuuucaucauagggcacaugaggcgaucuccaggcaaaggacaggagcaagcaacagguguaggcaacaggggcacaauugagggccuggagaggccaggugacugugcgagguaugcagggcagcauacuacccucuucugugcgagcgagaaggcugugcacaacccuguggcucugugggggcaugugacuacacaaggcugugggcccagcaugcgugucugagccagcaaaaacaggaguguuugcaugugugcacacaugugauccagagaugggcacaguggccagagugagaguguuuauauguaugcacacacguaugugauccagagaugggcacaguggccagaugcacaccuucuucucauacacauccugccacacgauguuggcaaagaaccggugcugcaugaucuccuuggcauccucggagcccccaccgagccuguggguaggagacagguccagggcucagacacugcgugcaaggugacaggucacggggauacucgcaggguagggauaccccuagcugccugaccaccccacccgacaugugacugagacuguggcggguacagugggcagcagcacugucuagaggcugagccugaagccccggcagcccuuaccucuguguaggguccuucuugagcagcccggagagcagggacuuggccucagggccgagugugcgcgggaagcggaucuccuccaugaggaucagcucgaacagcuucucgugguccugguuguagaagggcaggcggccacacaucaucucguacaugaccacgcccagcccccaccaguccacugcacggccguagucguuguccuccagcaccuagaugggggacucugucagcguugugucggggcgugggaggauguaagggaacacacaggaaguggcagagcaccucaggggccagguacuccggcguuccgcagaaugucuucauaguggcaccguccuugauccccuccuugcacagcccgaaguccguuaucuugaugugcccguccuuguccagcaugagguucuccagcugugugggaaggcgcucagucagugaggccagaccccccagcccccacccgcccugcuccauaagcacaccuucaggucccgguacaccacguucuucucggagugcaaguaguccagggcagacacaaucuccgcaccauagaagcgggcccgguccucggagaacacacgcucucgagacagguggaagaagagcugugggguggagcgcgcugaggaaggccugugugagggcccgccaacccuuacccacaggcagagggaagguuaggaacuagcccccaaagagaacuggagacugcgagacuccaacucagcagaaauaagacauccccaaacgagcagcuacaggcucacauggccagggcuggcagcaccagugaucuguacuacagagaggguucaaagcucucagagggacaaguucacccaucaagugcccaggucugaagcugccuguggcccuaccucgcccccguuggcauacuccaugacaaagcagaggcggucgugggucuggaaugaguacuugagggccuggaauggaagcagggcaagccuaagcacagugacacugccaccccaagauggaucagggcacaucuuggguaucaccguagcccaggcuggccuagaacucagcaggggcuacagaugcaggccacaugccaacugguagauuuuaagaugagagacacgaggucuagguucaacugcagggcaagauggcuuagaaguuaacuauaccaaguucugggguucccaagagccuccagauggggagguugacacaacagcuuaugaacuggugcacugagccaccccggcaccuuuccaucauggaccacggguggaauaagcccaagaugcugacucuggaacucaaucaagcuacuguaacugagcuucacuaacaaucaacccugagggaccagccuagaagacgggucugagaggacugcagggauggagagcuggggcaacucaaggucucagcagagugagaagacgagucucacuccugccuccugcacacuacagcuggggcaugacugcagccccgcccuccaucagccuaccugaugcccaugaagcccuugcccguccguguaugggugcaaaggcaacagugugggagugacccacucuggcccacucuucccuaucccacaggggccagacugauggccacugcuuaccguaaggaagggaugccuagaguucugcaggacacgguucucaguaagcgugugggcaaccucauccuggaaugcagaaccaagugagcaccuaucuccccugcaucccacuccucucagccucccuccaagccugcccucccugcaccuuggcgacgaugaccuccuucuugaggaucuucauggcauaguagcggccuguggccuucucuuucaccagaaucaccuucccaaaggugcccuugcccaguagcuucagguacucaaacucguucauggucugugggcaguagacagagcccgguuagagagagccuuugcucaccacaacuagccuaugguaauaaaccauaugccaccgccuucggcuugacaguguccagagugagcaagcuuccuccaaguuagccaacagcaagagagcuggccacaagccaggcccauucucacaugugcuggccugugcagucagugaagggcucugcacagucuagucagagcgcugggccuugggagucagcgggcaucuucauauuacuuacuuuuaaguacuggggucucaugucucaugcacgcuggacaagcacucugccaacugagguguccucagcccauguccagaggagccagggguacccagacccauacaggaagccaggcaggaauaccaggaccuaccaggucccuccacaaccccuggcagccccagcagaagcagagcccagacucaccacacggugcuugggcuuggccagggacaccuccaucucuucagccccugaguugucacugggugagccugaucggaaguccaucgucucuucuuccugccucuugaguccaucugccacagucugaauggcgguggcccauucuucccugcagcgggucaagugaggccucaggcaccugggggcgcuguugcauggcuuccaccaaccagcugccuggcucccugguccugaagcugcaggccaccacucagauccugggccuccauacacucaagaguaucaggagcaucaagguaccugggaugcugauauuucucccauuaugccccacucaucccacaagugcuccagucuaguucuccagaauggacucagcagaggccucaggcucucgagcaaccauacccugcccacucaccgcuccucaggcguuuccacauggaaggugcgcucaaugacugugguccacugcaggcagcggaugauaaagguguugggccuuggccgcucugucuucaucagcuggcauucuaaagaagucggggaagcaucuaucuguuucuccgugaaacucccccucguaguccucaccagacagaccucaacccugucccaggaaggugaaucucauccucacuuuaaaaguguauuugccaggugugguggugaacaccuuuaauccuagcacagguggaucucugugacuuugaggccagccuggucuacagagugaguuccaggacagccagggcuacacagagaaacccugucucgaaaagcaagcaaacacacacauugauuucaggggcuggagcgauggauggcucauugauuagaaguacaacugcucuuccagaagacuagagguucaauuccuagcacccauauggcaacucacaaccaucuguaacuccagagaucugaugcccucuuccugucucuaagagcaccagauccacacauaaaauaaacaaacacccuucuuuacacacaaaacaauaaaauguaaaaaguuuuaaaguuuuaaagcuuuuuguuuguuugauauagggucuuuugcugugcagcucuggaaaacuccacguagacuggaagucucaaacuauggcgauccuccugccucugccucucaagugcugauuuuacagguucuagccaccaccgcuagcauuucuguuuucuuccuauguaauucagacugaccuagaacucacuauguagucuacacuggucuugaacuugagguaaucaugccucagccuccugagugccaggaauacagcaugagccaccacacccugcuccauccccucuccuugcccuaguuccucucaaagaacugagacccaagaccugccacagcugagaugcucugcucugaaggugaaggaaccagucaggcuagaucaguuagcccuacaccauaacuauccugaaguuccucuguccuucaacugcugaucccuaccucaugugggggccucagggauccagcccacacccccuuccgguacagaaguaucuugcuguuuucccaacaacauacagagucucuggaaaagucacacauguacucagcacccaagccucacacugggagcacacacagaacaaggaugcccagagcaugaacaccugguggccacaccuagaauaugcacaccuuuaaggguggaucaugggagcagcccaggcccugaggauauguaugcagcaagagggcuucacggcaaagcaggcaggagggacugaggggccucccacauuccaucgucuggguccuggcaaugugaggggccuccaggcuccaaugaaugagcaaggggcagccugccaagcaaggggccaagaggggcuugaggcccagccuugggaaaggccuaugucaacauggggugggggagggguggaaaaucacccugagccuugucuccagcacaucugagacagccugucaggcaagcagaugaaaacuagcaccaaaugggggucuuaaccccucccuccagaacccaccucagauaaaaagccugaacacagccccacccugcuuuguccccagcuaggcguaaacugucuaccuccugaggcccaagaccugcuugaaggccaagcccugcccacugcccagcggcccuuggccagugcauauaccuaugugucugcucuagagaggccccuuuccuuccuccugcauaaguaagcugggaguccuuuccuauccaucuguagaggcagcaaccuguguuaagcccuaagaccuggggacuggccaagugcccagagauggaaggcccuaggaucugaggcaggucagacagagcuaccugcagggcaggagcaucucaagaaggcugugaggauaaauggagacccagcuaugcuaggcacauacucuacacuccagacugcagcccaaggaggaccccagaguccacaguuaguaaccgcccgggcuuacugcugucgcuuaacacugucaaaccuauucuuguccagcuccaaauaaaacugggcugugacaauguggcacagagaucaaagauacugcaucucagccccaagcucucagucugucacccucaccaguccuggacagggcugacucccacugacccuccggcaacaggaaccacaagacccauagggcaaagggcuuccgauggccaccuucccagggagaaucacagagacgguccuugggaugucauucacuccuagagccgggagccucuccucccgcugucuacccuagaguucccaaggaaugcccuugaguggcuguuuaauccacagggacccuggucaacccacccccuagaccagguucagucacuacaugcuggacccguccgccaucuagcaaggacucccugacccugccagagcuggccacucaccaguccuagaggaggugacucagggccaguacugcccaguacccuaggacuaacaggaggcucuccucggguuucucagugggcaguuucagccucccugcuggccugccuagccaccccauccaacccgcauggcuaagacacuuacgugccacugagaaguuguugaguggggacucucgcugauccacauccugaggccguuccuuguagccaauaaaggugccaucguucuugaggaggaaguagcguggccgccagguuuuaauauauuccccugcaggggauaggagacauaaggagcugcaugggaacuccacugugaggacccaggcacauaagauccagggagaguacagugugagguggggaagaagggaccugggacacuuccgccuucccagcaagcacuagcgccagggcacaacuggcagugccugcagcugggagcaucaucuagggcucugccugcacagcagacccaggaggugccaccgcuggaacaggggcgcuacgcccagcugagucccaccccggucacccagguacacaggaacacuguucccuccaguuuugcaacaucagccauacgcaggcaccacacucaggaaucggagcagauguccucugugaucucccagcgacugucauuuuucauacugacacccggaaaaaauguuuaauuuacauuuugccgaacaaggagucugaacaacagggaacuaacuaauuaggcaacuucuucaucugaggggacacuagguugagaauaggaggggcaaccuacagggcuggggucccuuagcucugucuaggauaaagccugccugcgccacugggcccuaaacaaggucaccugagggaugugugaugagugacugcuugucuagacccccuaccacugggugcuccugggcacagacccagucacuaggucaagcaccgugaucuugggcauaaggcggugccccagucucaguccauagccccaggggggcuggccagcuuuccuucuuuaaccucuaacggugguguguaccaaauccagguauucccagagaacacuuucgcaggugagauacagucugcucaggauaguguauccgcuuggaccuguccaugcucucaggaccugcaggggcucugggcagcaagcugcagggcucuacccacaaucuaccucccaccaucuagccccuuccaaugccugggaguccuuuccaaacagcagccuugcucugcaugacccuacacccugcacaaagugggaugagagggaacugaagugauggagggaggcuguuggcgaggccgggggaagacgugaauagaaccacuaccaggccaagacucccaccccaggggcgagcagcuccaagagcgagggaucccgucuucuugucaucgcugcagaccaccuaggucugacaaaccgaugcagacccuggccccacaauggaaagcaaagcaagaaagcccuccggauucuuggcaagugcccagauguggccggggcuccuccagggcauaggcaaguuaauucugauucucuucaagggccuacagcccgcaugcaaccucuagagcaccuguaaacccaacccaccucccaucuuuagcucccagaagcccagcucuccagcacagccaccccuuugggcaccagcccugcuucugaccagguggcacacaccugcagguauucacacacccagcagcccugugacagccccuccccuggcacagggccuagagggugccgugguaggcaggggcucugaguaauacagcagagcacugggggguacacagcccaccccccauccuguuccuucccgggccacccgccgugugugcccacccgccagcaccagucuggagcugucggccccugauggaguacccucccaucucaccagcugcugcuccccgggacacuaacugaauacggaggcugaugagcagcgcacccgcgccccagaaauccaucuugauuugccaacugcugcccaucccacugugcccagugcagaccccagcucuggccccgacacauaaaccaccagcaugacccugaaucuccuaugggcucuaagccuacaugaccagcccccaggccuggcagauuccagaauguagacccggaguuacagacagggggcacucaccaggcagaggacaagguaaggacccagccccacauacacacagagggccuaggugcccuuccccucccuggccacacaaagcacacaaaggccacauggccaaggagaacuguaaagugaaguggccucaugaggacuuucccuuucacaguaaagggggggccacagcucugacagacacacacagaucucuuucuuuaaauccugccucaaggucuagccaauuggucacuggggguaccggcugagccagcugcagccugggcuguggccugcauguuaauaaguucagaccagacagaccccaaaccucauucuacugcagaaacgggccaauaugauagacaaauacaagaggcggcuguccugguccucuggggcucuaugguaucuaggaguacuccugccuacccugcuggcgggggggggggggggggaggggcggggggcgggggggggucucuuuugggaauacaaacauuggcaggucucccucaaguccuucauaguccagcaaggagugacugagccugagccauucuggccucuguagaagugcuaggcucuggcccaucugggaucuucuuggcucccuugacccaucuggaugcuugauacccugaacucaggggaguccagcugggcagcauggcagcagccagggcccuccaccuggcuacacagcccuggggauucaggugcacacgguccacaagaugugcaggcuccuccaccugcaggugccuuaccaggcccguguuaacaaacacaugaacagaugacaaaugaccaggcgccaccuccacaaugcaguucccguggcucuugagggcagaagccugacaacagcuucucgacaagaaauaaaaaacagcagaacagaagacacccaggacuaagcccggccucacaccacaguaaacccagcucuccaccauccacaugugcaagcccauucaggaggcgucacagcugcuaugcagagaggacagccaggacccacuccacccaaggaccuguuccaccuucuagcaccaagaccagcaccuaggaagaggcaaggacuccccaacaacuucggggcucccucaggcccaccuccaccuccaggaccagauucuguccaauccuaggggaaagguacccagaggugcuacucacuggugccucaaggucuaggccuuccagcaucugugugggugagccuccgagucccuguaccaggacccccuguaccuaagucaccacacuaggaaagagggaggcaggacacaccuuuaauccuagcacucgagacucaggcucgaccgguguccucucacacuggccuggccuguguccugaucacugugaacauucucuccaaguccccgauucuuggggaaacugcuggauaaacacuuugccgcaguagcaguggcgguggcaggcggcagcuggcaaggcgccaggcggcaccgagcuguuucuccacagcaaagugagccccagcaggccuggggagcaggcgccagcugacagcagcgaccaaacguccccuaccaccaacacauccaucgcaccgacagcugccgggcggccauuuaccuucuccagcacauugagcaagcgguuugcugauggcagcccauuggggccauuagcccagcucuggcugccuucugggcaguggguggucagcagguggcaaggucaucucugaggccagccucccaggccccuuugcagauccuaggacccaugucacuugaccccaaaagacucaaugaccaagcgcugggcaaaggcagggaguggaggggugugcuguccauagcaggugaaaccccaggucugguguuccaggguacagcccaggugcagcccgucugagaggggugcucaugugggucucacagggugggguaccaauggccaguggcacuccacugggccuggguguguuuuuugccauaacccacaaauguaaaaaaucucaccuagcaagaaguaggacgcacuggagccaccagcuuccuggagaaaccgaggcuuagaaaaggggacccuagcggucacagagaggcaggaaauaaccagagcugagggacagccaggacacaaacugcacaggcaggccucagcugagaagagccaagauauagcaaccacgcgacugcaaugcgucccaaggucucucagguuccuggaacccacaguggguggcacaccucuccacugccaccuccaguccagcuuccugagccacagggaguacugguccagacuuuacccuacccacccacaucuuacacuugccuaccccuccacagcaguccccacccuccccguaccagaaaggaaggccggcccacagccccacucugccauacacaccacgcacccccaagucucccguaccauucagaucauccuguucaccuuagucccacaguuuuggggcaagccacagggccaccauccuaugcuggcuuuuagccucccuacaccagcccaaccccucucauccguccuacuuccccagacacacggcagcucacagaccccacaacauuccugugcugagucccaaaagcugugcccuccccuuacccauccucccucuccaccucacuguggcacagcccagggggcccagagagcguccugaaagauggcuuagaggguaaaggcacugcccucaggccugacgacccauguuugaucccugggauccacaugguaaaagaaaaccaacucacagguuguccaaggaacauaugcaugcuggcuacagcacaugagcguuucccccuccccugggugcgugcguacacacacacacauguacacauguacacacacacacacaccauacacacacgcacacacacgcgcacacauguguacacacacacacacacacacaccccauacacuacauuuucaaaggaggcccagacagagcagaaaggaugugccuucacccuacagauaccagagccuacaugggccagccagacccugggccaagggcagggaagccuucucuagaacaaugucuaccaccuccgaaguccuaugccaagagcccaaacaaaccaacaaagcaaaaucauaccaggaggccaggcauaguggcaccacguauauccccagcacugaaaaggccgaggaagggaacucgcuugaguucaggacaaucugggcuacaaaguaagacccuaucucaaaaaacaacuaaaugggggugaggggcgggggcugggggagggggaaccgacacaaaagccacucagaggcaaaagauagugaggcacgcagcuaccugcagacaggccaccgguacuacggggcuccuggcugcucugcccaccagcgugggcuagagucuaggucuuggcuaggcagacucuucuggggaagugcuggguguggguagaucaccagccauggugggauggcugggacagccacagcuacuguuacagggagggccuaaggguuggagcuggcucugggccuggcucgggugugacugggcagagaggauugccagaggacagaacaguucuccccacuaccccauggcacuucuaggaaucagccugaugcaagcccucaagcuacuccuagcagcgacaguaggcccugguucuggccauccacacagcaccccacccccuuccugguuucagugcacuuggcuacccugcagagcuggcaggaccaagaggcugccccagacccagcaguucaguggagucuuauguccccacacuuuuccucaccuccuggugaccuccaaguggcucagccccacugggcaacucugucuagaagauggucgucaggaagccgagaggacugcugcccacucuggggagucaccaggccgggccggacugacccccacaccccaguggaaggccgcccagcuuccucuuuuguuguuuguuuuuaagggagaacucaacacgcucacaaaacaggaaacucagucccagcaccagccaaggcucagcggcagccacacaccgcaguguacuguccccuccaugaaugggcccagagcauucagcugccaucucuguccaggucuccaggaaugccacaugcuuaccucucccucaggaucaguccccaagcauggcacuacuccggucccuagauguugacuugcccacuggguucgggacccuugacucugcccagagaccaugagcucagcacaaacagauccacacccaaagccagagagccccauacuacaugccaguuucccuccauccuuguccaaacugcguccaccugccaggcacuaacccagugagaauagcuugguuucuccuagccugcugggucucucaacuaagucugcugagugagcccaugacguggccccacacaagguggcccugcacgagguggcccugcacaaaguggcccugcacgagguggcccugcacgagguggcccuacaauugucaugugccaccuacucuuaaacacauagcccuucguucucagaccuuuccaugucucaggucuagccaccugcugggagcugggaagacacagacacagacaauggcuaaccuggccaagaaggugagaaggcucccuggcuccagucucuaccagggcagcucucacgcauacagcccggcaaacgucagagauuugagggaagaacccaaaagauuagcacagaugggccuguggccucaguacacagcucauuugcaaccugcaggcugaaaucagaggucacggacaaguucagccacaccugcaacuuaaccccaggcuggcuguuaagaagacaugguucaucgaccccaaaccucugcaucuggagaccagcacugagguucaucagaccagccaccucucaucucuaggagcucaagcccagucucccacgggucuauguuguuggaugcauagggaagcuaacgcccagccacagaucaaugcacaacuagaaugucugcuccuguacugggcacccucuggcccagagcacaaacagagcuccuaggaaguggcuuggggaacacuuccugagaaguaggcaccuaacucccagggaggaggagaaaccuggaccuggggucucuguagccauggagugaggaacauccucucuucuuugcccaaauagcccugaaggcacggucggcccacgggagcuuggggaggagccgagaaccaaugugcuccaagccccuggcuggacaugggagaccuagcaaagauggguucuguucccagucugcggggcuauaaccuacaaaagcaacagagggagggacauaagggauacccaggugucugaaggaucaugggucacuaagggucaacugcaauaaccuucccucccugccuaccccagccaagucauaauggccucagguuagaagucuaacauggcaauccaagacagggagagggcuggaaccccaaacuagugaugcacacagggcucguuguguucaagggagaaacgaggaccaccaagaccuaggcaagcagcagcaggccaagccugggucuuggcugggccagagcaaggcagaauaggaggacccaguccaggaauguggcauagaugccauugcgcgcagcagagccccuacuaccuaggcuggggcuggggcugggggaggaugaaggaccaugaggacagcacaucucucuggccugaggcugggaagaccccccaccccaaagagaggcaguccugucaguuccacggggcagacaggcaggcguugugcccccuugccaucccacagcuaacgcaugcucucacgucuuuaacccaccaccauuuccagggcaugcacggggaaaaucaaggccuaaagaacucaaugaccuucuucuccugaagagggacaaugacagcacugccaaaucagguucaagcacagccucagcguguccauaggaccuaauguccugugccaccuggccccuugagaaagcucagucauaaggagcaauaugacacucccuaggccucagaaggguuccuaccuggggagagaggcccagcaaucucgagguuggcccuaacucugacagccauacaauacacacgugcccaugaaauagacuguguagacuguguauggccuaggguuggggagaaggaggagccaaagaggcagacagcagggcaugacccaggaaugugagcuuaggaggcaggacuccuagugggccagggaaggaugcccuggagaacaaaugggaagucaggugggggcaggagccaaaggucacagccuccuggcaaagcccagcacagaaucugcccugcagccgccagauugggaccucucaacacaucugaccacaucuuccaccccugcgugagcccuccugggucccaaccauccuccccaacuucccguagcuccugugcaccacccucccaccccccaguucugccagagcuguagauacucuaauaaagccccauguccuaacaccaacuucgguccccaccucccaucuucucuaucugaguccuucuccugacacccaaaaguacaauccccucucuagagagccaggaaggagagugggaggagaggcugggacuggcaaggaucacccuagggcuuccggagggaacaggucuacaggaagaggaagucagaagggggugagaugccugcccuggggcaagagcaagugacuauccugggggaacuggcuuugaaacuuacuccuggcaggcuggaggaagaauggcggguuggcuggaggugaggggccccaggccugggaagaguccaucucagucagcuuuucaguucugagcccccugacuucaggaauccgggccugaggugggcaaagggcccagccgagcaacccugcccugcccugcccugccugcccucaggagcccuugggcagugcccaggcuacucgucugccagcccuggaacagcagccacguccuugcugccuuccaggaaagccaggcgugaggcugcugcagcuggccccacccccaagccacucauggcaggccccgcacagggccucagccucuggccaagaggccccaggaggaggccgugaccuccauacuaugggaaaagcugggccugcauacuccugaagcaggccuagagccccaugauggggaggugccccuucugucugcuaggccuagacacagcaagcacuuucugauagggccugcugggucaguaaagaccccaccaccaccaccaccacccccgccccgguuccacauugaagagcuaggcagacccaggccggccugcuucuccuguggagugcggacuuaccucguuugugcagccagcccuccuucacaauggcuacgucguucaugguauccguggcccccagagacagggguaacccagggaugaugcucagagucucuucucgguaggcugagcccagccggccuggccgcagcgucuagaagaagccgagaaagcacgugagacaaggucccacuugggacuagcuuccgugagccccagagggcccacaauuacccauguccccucaugugaucuacccaucucugguucccagguucccuccucacccuuacucccugccagccugccugacgugucuccaaagguugcuauagaagaccucccuccaguaguagaugcuacacacccagaucuaggccugguaguccggggugcaaggcuguggccaacccccaucauccuggucucugcuagaaacauucauuuccagaaggcuuuuccuguuaggcagcuuguucaauuugcuaccccagcagauuaggccaccuccuccaggcagcccugacugcuucugcucugccucgcacuagugaggggugcuuaccacugucucaccacccccuacagucugggaggccuacugcaggucgcagggucccuacggcucacguuaggaacgcgggaaggccaacacuggagagcacaaguagaacaggcacgguaugaagcugagcccaaaguccuucaggacaacacuaaaaacuccucaggcagaaccccagaccccuugggaacacagcacccugccugugaagcuguccccuucacuuggugaguacacacuaggcacauaugguucugucgagccuucacccuacgccugagacagagagacucugagacagccugcugggaacacccaaagcagugguuacgacccacaauuacaguauccgggagcccacaaacagggcagguaacacacaaggguccugcagcggccaacuagcuagccugugcaaagcaaagggugccagcucaccucgcaaagauccccccgccccccaauugcuucucuuccagagggacaccuagguauccuucaaauauccccaagucuggacauucugggaaagugcaccugaacagcccuugaccagcaagccuguguugucccuccaccuggaguucauguggacaauccccaggaaaagacuggaaggccgccguggaauagaucccaacuagggucuacuacagcugacuggcaacccccuaugucaucucucuagcccagaagacacaagcuggcacccagagucucugucacuuugccuuguaugaagcuaaauguggaacaaaagggaggccggcugcuaugugucaaaugccaaaugccaaaguaggaaagaccacaccuggcccaagaaggaaagagcccuucccucagcaagcagguggcgacuaaaagccagaacgaaaaagauaagccaagaagaaaucccagcucagugacugucagaguggguguggccuggaggcagagggcuguacugcaagaucucucucgguggauguccccuacccccacccagccccaaggucugcugaugacagucagcuguccagagccguguaaaaauaaauucauacacacggagugaagaaacacagccauguuaacgccaauguccacaucaagccgacuuaagcaugggacacucuucccaccaugccaugccguaagggcauaugguugcuauuguuaagucuuaagaguucagccccucugggacacuggcccgugagccacacgcccagcuggggccccaccaaggcgacucgcccuucacuuuagugauggcucuaggcagucaaggcuagccaccuggagcaagaccaggggccugggggaaggaggaguuuggccacacagcagaggcccaagguuccaccaccgcccaacuuagaaaccaguccucuuuagacaauuccaucagcucagccaguaucccggauccgggagaccgaguccacgccguccucaaggccccccccccccccggcaccuccagaaaccaccuaguccaggaagcagcuuccgggcccaggaggguuagcaguccuuugugggcuagccugggcacugugccaccgcgcacaacuuucuguccgugggaaaugaguucuccuucccagggcccucccaccgcacgcaggccgcggggcgagccuuucuccuacccucgcuggccgagugcccgggcagccccaggccccagggcgcaccggcccccacugcgcacaccaacagcgccccucucccgcgaccuggccccguggagcggccacccaaggucacgcagcggccgcccgcacccucgccggcgugggccuccugcgcgaccagcccggccccgcgcgcuccccgcccaggccuccgcucggccacuuccugcuccuacuccgaggcgcggcgcggccgggaacaaagcgggguggccgcggcccggaacagggcgcggcgcgggcacucaccgggccgccgcgugcgggcgacugggccuagccgggccgcggccucgggcgcccgccgcuccgcaucccgcgggcgggcgcugggcggggccggcugaaggcagcggcguccgggcgcgcgcugcuggccggaucugggccgccgcggugccggccacaggacgcugcucgguccgcuccgcuggucccgg

SEQ ID NO: 12211 - RNA, 78302 nt, Mus musculus
auaucuguagaaguaaauuuuuaauggcugguuaauuauaucgcuacauuuuuuuuaauaucgcuacauuuuuuauugcaauauaguacucauuuaagcacuuaaaaauggaagguguacaaagauuaaauuaagacacgguaaauugacuaaauauuugguuuuuauauaaauaaaggucauaaccacacuguugacauguaauacuguuauaauacaacaguuaaacuugugagucuacaacagaagucaucuguaguuaaacaggaaacaaaguugaaaaagaccauguuaaaacaaaacuacugggacuaacagguugggauuguaaguagcaacaaacauacucacucagcuccugaguauuucaaguuuuacaguacacauuaaaaaugauuucuuccaucaacacuauuaauucaaacugucggauguuuaugcauuuugcaaguuacacugauugaaugcuuacacaggagcgggggucggaacagcucccaauuuguaguuuacaucacccacaugcuaacacaaacacaacuuguuccauuuccuucccccuucuccccccaacaaagaaggcaggauuuuugguuucuuuuagguaauuguuuuaaaggauuucugaugaucaauuugaacgucugaaauucaguaauauuuaacucuuagacaacuaagagguuaaaagauggaaaauauuuucuccuaacacuaaguuagaaaaucauuugcaucaugcuguaaacuaggaagcaauguaaagcgacaaaaaccuguccccaguacauaauuaaaaaaaaaucuaaauuucaaaucagcagagccggucuacuuccauguugacuguuugccacaaugugagugugagcucuugaagugcauagcuaauguagguagucuuccacuguggcaaaugcacaggacccaacuccugaccgagccaucaggccuagacacuguguggccugucccauggcuagggcaaguggagguugcuuuggcagauuguggguuucuaaggaaaaagaauuagaaagugaaaauagcaauuaacaaccauuuuaaaaaucaucuuucaaucagggccauaaaauauuuugcuacaucagugucugaggaucugaacuaucugacuagcaaagcaaauugauauuucuaagaaagguacuuggggaauggagguacuuuuuuuaauuuuauuuuuugauacauggucucacuuugcuuuccugucuguccuggaauucagagauccuuguuaaauauauauauucaaccuuuuacuucucagugaacauugauggaaaauauguaaccuagcugacaucugagguugagauaaggaaaaucuaccauccaucuacuuaggcauggccagcugacaguaacaagaaaaggcaguaccagguuuucacucaaaguuuccagugaucauaccccacccaccccuauagauaaacuccagugagggcuguuguguugagcugccucuaaggugugcucagaaacauuuuucagaagcaagugaaggccugucagaguacagagcaaagccauccuagagucgaggagguugaccucugauuaguucagauacuuaaauaaauagaauguucuuggguguuaggcauuauuacccucagacauucuguagaccaggcuggcauccacccucugagugcugggaguaaaugugcagucauuacaaaggauggcgugaacuaagggcaacgggacccaacucacaugcuaauauuucuauuuggagaugguguccaaacuuuugaaaaacuaaucaguccucugcuggcaaauucacaggggcaaaaccaguaccaauggcugccaagcccucuauccaauuaucuacaaccucagcucagaguuuacaaaaaacucucaaggaaugaagcauauagaaaauaagagcauggagcagacugggucagaaaauacagucuaauuaaaaguggucugagggcuaagauuauugaaauacucauuuauugauauauacaaagggaaauguuuuaagaguuauaggaaguaucuuugcucacucaagugagcacggggcgggggcauuacuagacugacuaaaggaggccucugcuuuuaaucaucuuuaagcuuuuaagauauauacaacacacaguacauuaugcauuacauaugucugcucaugaguagcaaaaagauuguuuaaauuuaucauuuuuaauacaaauauaagcauucuuaauagauuccuccaccccacccuagguguaacucuguagucccgacuagccagaaagucucuuauguaagaccugcuggcuucaaacucagagaccugccugcuugccuagaguugaagaacucaagaaauuaaaagacacuacaagaaagguagccacucagaaacucauugccuaaaacagcaaucagauauuauuacauuacuaaaaaagcaaucagauauuauuacaucagcuguguuagcaaaaauaagaaaauguaauaauaucugauuauuauuauaaaaaaguucauugccuaaaacagcaaucagauauuauuacauuuucuuauuuuugcuaacacagcugaucuuauuuagccacugaaaauacaacacacaaaccaaauuuguauuauucuacacauaaauccuaauuuaagaaacuaacacaaaagccacuauucuuauacaaauggcaguauugacccuuaucacuggauuaaugauaaauacaagcacuccauccauggcuuccuuuacauuucuguaagaugaauauuagccuucaguccaaguaucaaugucuaaauuacucuuuacucaccuaacgguuaagauucuaaaccucaccaggccaaaauucagcacaaacuucuaaacuggauuggagucucauuuuacuggggaagucaagacuaugaaagucagauguaaaguaacccuugaucuaaauuaccucugaagaaaacagcuuagaaauuaacccugugacauuucauaggcguguaaauacagaauuugcauaaaaguauucaguaugcaauuacuauuuacaucacugcagugacagagaaacuaaccagacagcguuccacuucccaucuacaccgacaaagccuuacuacugacucggccugcaaauguuugagugcagggguugcugguacugcuuaugucuuaagcacaggagcugugacaugggagcuucagcuacccuuacuccuuagggugacuccagcugugauuccugaguuaccugaguacucccuucuagccucacuuuccuguggagcaacuaucacaacucauuggaaacaugcccaaauuucuuuuacagcagccaaaccaaguuuugcucagucuauuaaacauagcuacugacagaaaaguucuguaccuuccuauauugucaauauagucgccuuucucaccugagcuagugaaggucaccuguuaacuugguauuuccuacuucuuccacaacuuagcccuaaugacauacacuuggaaaaacaaaaggcuauuccccaaccauguccauauccucuucuauacaggagcagcagcagcuuaggccagguagaugagagaauuuagaagaagaaugaaugccugugauucccauucccaaaauggauagagugccuuuucaguaugguuuuucauuuagacacaaagaugcccaaacaccuuguucuaaauggaaagacucauuaguauuuauauauaugcaggcaaaaacuuuuccaagauacauuccagaauccaccacuuuaucagaauccauguaaucuguucaguauggaggaaauuuucugcuuuaaaaagaaugauacgucacuacuauuuugcugaaacaaauauuaggacaauauccucucaacuccugagagcguguaccugaagucuaggugacuugcuuuaguuacuuaccuaauauugcacuguuaagagcugagcacacagguucucucugaauugggucaagcugauuuccaacuggacuauuccaaggauccgaauaugcuaguaagcugaaugcguccuguugaaacaaugucaauguguucacagcagcuccagguugaaagguuaagauagucuuaagacacugggugauuauauccuuuaaacuuaugguuuuauguuucagaacacagcaaagucuaacuggcuuccacuuuucguguuuauuucugccauuccuccaccacaagcaaaccggggaaauuaaccaguucugaaggaaugggcuaauacgaagaaggaagagacaaacguccagaugcuuucucacaugugaccucugauaucaauuugacaccaggggauaagcccugccuuauuuuuggacaaauaugggcacugaagagauuucauugacuaccaucucaaguuuagugguaguagaauauuaaagccaagauggaucuuguagacuccaguauauuauuuccagcuauccugaagcaauuugucuuacagcuuuaaaacaacuggcacauagcuuccucuuuacucuccuuuacuuuaccaugggaggcacaugcuagauucagacacugcuucaaguccaagcuguacuacuugcuagcuuuguggcccuuuaccaaaaaaucccagauuguccuaaaugacaguuucaucaucggacugugauuuugggugauuacaaagagaaguuauuacacagaaagaauugugugagaaccaaugaaauuagcaauguccuaugguggucugagugagagugaccccuguaggcgauguuugaaagcuugguacccaguuaaugaacuguuuggagagaguuaggugugcuugcuggaagagguaguuacugggauugaaccuugcgauuucaaaagucugcaccaaagcccaguaucucugcugcugcuuguggaccaaagauguaaggcucucagcuggcacuccagcaccaagcugucugcuucuugcaugaucaugggcuaacccucaugugaaccagccccaauaaaacuguaagaauugccuugauaauagugucucuucauagcaacagaacaguaacuaagacaacuaaggcaguuauaguauuuuuguauuugccaauucaauagccucaccuagaguaauauuccacacacaagggaauaaauacaaaauggacaagagacuguagugugggcuggagagauggcucagugguuaagagcacugacugcucuuccagaggucccgaguucaaaucccagcaaccacaucuguaauaagaccugaugcccucuucugguaugucugaagacagcuacagugcauuuacauauaauaaguagaucuuuaaaaaaauuaaaagugacagcagugcagacagacaaaugaaggguuguaaacagagguugcaaacuuauaaacugggaagcacagcacccugaaaugacgaaugcuacaguuucugaagaacaccuagacuagcugcucaagcacauuucccuuauucagcauuacugcaugucucugcuaaagcagguucgagggcagggaaauacuucuuggucaguuguauucaggcuuaugucuuccacacaguccgugauaaaaucugaaguuagucugaggcuacaaaaauggaacacacaugccucuaaauacacacacgacucauccacuggcuuuuauuacugaauauuucauugagguuagacugcccaaucacaaugagaguucuagaaacacagaaguuucuuaauauaccaguuaagaguuacugguaacuacucauagguauaggauauaagaaagcuucuauguaccuguaugguaacaguaacugcucuuuaugauacuaaccaugauuuuguguccaacagauguaguucucuugcuuaucccacacucaaccuccagcuuacuguuuaaaaaacaguucauuaucccacagagcuaacuuauuagucauauuauuucuaagacucugaucaauacuaauuuacccugcaaaccacagccaucugaugagauguugcauccccacugugcagcuacauuuuaaauguugccaagacuauggccaaugagcaauuaguacauagacucaaauuuaaacuaggcauggaucuauacccugacaccaccaaaaagacagaaauucucaacccccuuuaauauuuaaaaauaaaaacucacagaaaugauagcuguaauaaauuauuguuggccaauauuuuacauuuaaggcacucaaagaucaccucaacugcuuucaccggagguugguauucccauccuacagauuuuaucugaggcaucuuaguuuaagaugagagaugaagaucacacaguauuguaagacagaguuacugucuacacaucaauaagagcuagaauuuuacuuguaguuuggugaguacagacagggcacaaacaucaacaaccagaaccucaucagugcuuuuagcauuauuucaacugacuaacgguaaacugaggcuaagagauaggaaaaaaaaaugcacgguuaaggagaagcuagauccuaaaauacuccaaaaccacaugacgaaaauguuuuuccagccgggugugguggcgcacgccuuuaaucccagcacucgggaggcagaggcaggcagauuucugaguucgaggccagccuggucuacagagugaguuccaggacagccagggcuauacagagaaacccugucuugaaaaaccaaaaaauaaaauaaaauaauaaaaaaacauaccuuccucuucaagugauauacaauuacaugugugaucuagaagggucucaaaauccccaagcacuaaaaaaaaaaucaacucauaaucaaacauaaccccaaauaaagaauaacaaggaauaauuucagaaccucgucugcauuucuguuuuccucauaucucccagacuucuuacagauuacuuaagaugcuuaucucuagccaaagcaaguaaguuuggaaaaacgaggagggaagaaguuagaagugcaauugucuuuaggcaaagaugaacuuuucaccuaauucaguauaaucaagaaauccuucugagauauggucacguaaugacacuuucugaguuucauguuaaaccaaagacauggugagauuaugggaauauaaucauaaauauucaaagacaguagauaaccacacacuccuucauccaguucaguuagcgaagaguucugagaguauacacagucagaugacuugaguguaagaaaaccuaagaauucuugagcacauuucauaucucaaauaucacuuaaaugagacauuuccaauagugugguccagagacaguguuuaggcuacuuucaaugaagugucaagcucaaaaucacucacguuuucccugcccauuucacuuacauugaucaaaugucugauuuauggacgccaugcagaagcagguauaauagacuauagcucaccuauuguauuagggauaccccccaaauaaaaauaaugcuaguucucauuuaaguggggguauauuuucaucaagauuuuaaaaugaguauuuccaguuuuggaaaugugguuuuaacuucuaguaccauauauaccaguagauguaacacauuuaagcaaaaaccauuggaaaacuaucucucucucucccucccucucucccuccgucccucccucccuuccucccucccucccccucccccccuucugugugugugugugaguccaugccuguguaaaaucuggagccuccuccagcucagguaagcauuugaccacugagcugaacuguuguccuccaucaacaauuuuaaagggcugaaacaucagaaauauuaagaaccaacgcccuaaaguagcccucaucaucuugcagaguacuguucagaugccuagaaauuuaccaauggcccacacauuaacuuccuuuccuaacacugcucaacagguacuucugaagagcugcauagggauacguauuggugcugcagacuggaauguacucaagagauguacuuaacacugaaagacaaaaucuggacgccagaaaauccucuaaugcaaauguggacagucacuuuccugguagacuauccguuucuaccaacucuuauaucuaguaaaaaauaggaauuuaacucucuugauugcugcagauuaccacuaggaacucaacugucauguuacacagcacaagaugugcuauggugacuacacuucucuuccaacgucagcuacugaaauguaagacagaaugccuuuaacugaggcuccuaugcgaguaauauuuacuagugcuggcuuucugccgaggguaagauacuggguacuaucacaaguuacugaccacuaaauucucaguucaugcuuagaacaaacacaagcagucaucugccauuucauguaaucucuaauuagucacaagggccauucuuugcuuucuaggcugugcuguguugugaugugaaauguuucucacagacuagaucagcaguaguaggcccugaaaccaugucuuugaaggcuauagaugaucccaguuucuuccuuucucguugcuuuuucucugccacggggugaaagccucuuccuccauguguucuugcuuacaauauucugcccuaucaggggccagaaucaauaggauuuggggaugacugcagguaauagacaggaguuaucaaagaggauauaaagcuauuuuucuaguuuuacuucuuucauaaauuuuuguuuuuuauggugguagaugaauauguaaaacuauauuugauagugaaaauguaaaaauauaaugugaagccccagagcaucagagcugcuguucuaacgaugccaacauucacugggauagacuacagucuuugagucucuguaauucuggugugugcuauuuuauuuguaacaauucaacuuuuaaacacucaaaaaucaauagaauuaaauguaaucuaguuuaacaaagcaccccaucuucaacuaauacacaaaaccgugguuaacuuuuuauugaaacuuuauccuuaucauaugucuacuacaggcacauccagaagagauuucaaaaugcauuuuaaccauucuaaacaugaaagaugaucuaauccuucacugaucuccauaagaccaaugugaucugcugcaacccugaauguuuaguaaaaaauacuucucagguuugugguuucagcagcacacugccacugcacagggagucacaggggacacggcacugccaugcaguacagucggcaauuaugacuguauguguguggaacccaaaguucuagaucauggcugcuuaaugccauucaggaauucugacucacaaaugggcacaguucugaggggaaaucccagguacacauucccaagaguuucuaccauuuugcucaauguuuaacaaaacuauaucugguaccucugacacauuuauaagucucaagggaaaacacaugguaugguuugaauaugaaauauucccucaaaagcucaugugugagggacuagguccccaggcagaacugaagucaguggaagguccuggaugcuugccugcaaaggcucuagucuguacuuagcccuaugcucucuccuagucagccugcucugcuguguucccugcacugagguucucucucucucucucuuaccacagacccaggaacaacgcuggcaagggggaacagaccgaaaccuccacauaagcuucccagccccagggguuuaucccggaaagcaggcgacagacacccuuaccuucagcauuuucuuauuugcuguguucuugccacauucucuccucagcugcucacucauggcuuguagcucucggccaaagugaaucauccucucuauggcagccugacuuccuccacacagcuggcgucuuaacugacugcagucaacuucuguaagcaaaacaacagcuaguucacuacuuagugcauagaaaacaguacaaagugagauuacacguuuuauuuuuaacauuguauacucuuuaguaacuacuauuuaguacuuuaucuaaauauagcuauauaugaacauuuugaagacaaggucuugucagugaccucccaagggcuggaguuacaggcauguaccacaugcauggcugcuaaacacagaaauucaaagauguuuuauguagaauguuguagagagucuagaauccaguguuccaugugcagccaugagacaaaagaaccuuccagugucgcaggcaguuaaguguaacgcucuacaugacacaguaugggggaugacacaaggucauucccucucaggcuuuaacagacaacagacagcaaacagaaauggaauaaaacgugcaaguuaagaccccaaaagaaaacacaugauauuuuaucuuacuaaugaaaaagaccaacuacacuauuaagggaaaucuuaccauuagaaauauuuuauauuauauauguuaacuaauacuuaguaacuggcacacuguauucauaaaaaucacuauuaguaacagcauucauauaacaauaaagaaaauggcuaacauuaacaaguacuugauauaauucgcuuuucagagaugaauucaccugcucuucagugacuaagauuuauuuuacccauuuuacagaugaaaaaacugaggcacagagcaguuaaguguucugucugaggucaagcagcuaguaaguagcaguugcaguuuucaaauccagguaagucuggcucuagaacucuugcccuacccaguauauauaaguaugucuagauacagaggucuuccaucaacagggaagaucagacugucccuuaaacaacuucaauguuuaccuuucagucucaaaauaugaagaaaccuaacacugcagcaaauuauaauaauguauaagucaaucauuuucauuguuugauaagaaaagggaggcauucgaaugcaucauuaagguguuguuuuaaaaaaagagaagucacauccacagauagcacuagacaugccauauauuugcauuuaaugaacuuaaagagaccagcuuaguugaaaguuacaacauaauuccuacccacuuagacucacugacuacacugaaaucaguguaaaagcgcuuucuaucuccagccuucacccugaggcagugaaguacaaaggacagcugagccaggaagacuggcuccagccucagagcccaaagguugcccuguccagcaacccaugcucacaaguguucugugaaauguuucaucuggaaaucuggcuuaugcuuagcugugaaucaguccaaguaaaaacauaaccuuguagccaccauuuuuuauuaaaauguaagaaauaucacugcagacccauuucggugucacaaucuuccauuucguggucauguuuagagcuaccauuuaggaaaccauuggaugaaguuucuccaacuccauuggaguagugaucuguuuccaugucuacaucauuacugaaaaugaagaaaacaaaccuaauuuuagaaauuaguuuaagauaaauuacuacaacacaacuuuguagccuguaagaaacuaauuuucauaagauaauagcaaucugcaaaugagguaaaugagguuaaaucucaaauguaccaaaccauacaggacugaucguuaacaaauuugcacuccuggagaugaaggagcagaggcccgugcaaaaguguaauuauucuugucacuuuacauaaguauggaaaagucauguuuuggcauaauacuuauuuuucaaacucacaucuguacuuuuuuguuaugccugaaucuuucugagacaacccccuccacugcuuccguaugcuucuagacuguuucauaucuacauuagugaaaccuuguuuuuguuaucaguccuugcuauuuaaaacuaugcuguuucaaaaauaacuaauaaauaaaacaaacaaaauccaagguacuccgucucaccugcuuccaccuucuuagaucuccacagcacuacgacuguccaggcugucuuuuggcuagugacucuaaaggaccauuaaaucuucacuuucauuuuuauuuuuacaugaucuauauugcccaggcuuugaauuuacaaucccccugccuccaccuccuaaauaguugaaaucacagcuaaguaccaccacucccagcucaaccacuuuuauuuuuaaacaguagucaauguuuuugaacagguuccaugcuugcucaugcugcauccuaacaaaacaaaagccaaauccuaguacagauaacccagucacugucagcugaacaaggcuguacacaugcacacgacaccuaacgccucccuaccucuacccaccccuuccugggcaacaaaucuguaagguaaagaaaggccaggcaggaggaggcaaaggacucaggacuacagaacagacugaccucgcuggaggggacaccuggcccugggucuuaagggcagaacagcagcgaauggguagagcgcuucagagaaugggggagagaagcacuaguuccuaagucagaaauccugguaagaacuuucagcucugcaacugacuaccuaauuagugaccuuaagaaacagcauuuacuuucugauauucagcuauacaucuguaaaaugguuuaaagagcuaaugccaucuuuaaucaacuucacaauacuggugcagaaaagucauuacucaaguacaaauacuucuuacugguuagcaguuuuaaaaguacuugcuaaguuuaaugucuugcuuucuuuacugcaaaggaggauguuguaucaucaacccuguggcuaagcaagaaugcagguaauaauugguuuacugagcaacuuccugccaagagggcagcaucuaagagaaaaugucacagaccagcagaaaacuuaccacaggacaaaggcagaacucugucaacaaucaaaauaccaacuauaaaguucuaauuaacaucugggcuucccacucagaauuuguuuccuuuuuauucuaagaaaucaaccgacuaugaaagaguacccacccucuacaacaguucuuucuccuacuguucuccaucuuuugugcccugccccaagauccuguaccuuuuccccuuaaaaguuucugucauaugugauagauaaccuaggaacuucagugucuuucuaaauucucaaauauaauuuuaaaaauuguauuuucaauuuaaaauacuauuuguucugagauuccaugcuaacaguugguucuccuucaauaaguaauucagaacacuguuugaaaaugcaguguuucugauucuaguuauagaaaaggcuacaucacugggcagacugaauacuuacaaauuuguucuuaaaugcguguuguccagagauuauacugcauggguuuuaaaaauccaggaauguuaaaucugagaguguaaaggcauaugauauguucauuaacauauauaucuucuguuuguuuguuuucugagacagagucucucuagguagccuuggcucuccuggaacuuacucuguagaccagagcucuauacacgaggaacuuaaaagccuaugggaaacagagucccuaucguuuuacuugaugggagcccagagcugcagagugcaguguggacuacagaaguucuucagauaauuaucaguaaagauggcaucaauguucuggccaucccuagggauacagaaauuagggaagucacucuauuaccugguaaaguuauuaacuugcugugaccuugauacauugagacuguuuagcuccgguacagucaagcuggauagcugguguuuacuauggcaauaugauuggugugcuuuauuugauauuacaccauugcuacaacuuucaaaaccugagaagaaaacagaaaaaaaaaaaguuacaaccuagaaaugaacagcaauuugauuagguuguaaauaauacuuuuauauuugauuuacauuuaacaauuuuagaauguaggaaagccaaugggguauuuaaauguuuuuuuuuuuuuuaaagcuggauaguguauuaaaaguucauugugaaauaugacuuccucugaguugaauucccgguaucaguuugugagaacaaccaguguuaugagggcacuucaguguuuacaccaaggacucuuauggaaacuggguuaauaauuucauugacaugcuaacauugucgauacucuuacaaaugccuagauggucaagcuuaucuaggcaaagugggauagccuaagccuccuaggcuauaaaccuggacagcauguuacuauacuauacaacaugcucuaagaaaucauaauaugggacuggagagauggcucagcaguuaagagcucucuagcugcucuugcagaggaccugggcucaauuuccaccacccacaugguacaucacgaccaucugauaaccccaguucuaggagauccaauacccucucuggccucucuugaccaugcacacaugugguacacaagcauacauacaugcaggcaaaguacccauauauuaaaaugaaaacacguauuuuuuucucuaaagaaaggagagugcaaugacauauauuuacauacuuugacauagaaaauauuacaauaaaaauaccaugugauuuugugauauuuuucuccuccaucaagaugcaugaggcuacuuuacauaguuugucacuaacagaaaugucauuauguggcauguuauaaucaucaccuuuuaucuaugaauauaccaacuguaugauagauacucaagagugaugucauccugucacugaggcaagucuuguccucaacauacaggacagugacucaaaaagccugagguaaagcagugcagccugacugcaggaaagaacagagauggcacugaugggagaaaaauaccugaucugcuuuacagaguuaaauacaggcuuggcaggaucaugagcugggaggauggcagauaaacaggaaaacaaagaaaauggaggagcagaaaguagacagaacaaaaagaaagauuuuuuguuucuccuaaacagugacaguguauguguaaggcucuggggaugagcagaguccuuacacugaaucaguggauauuacugacaaucuugucggaguucaucacugagaaucaccggcaagacaaugucaacuggaggagaaggacaaguccaaacugucggucuucuuaauuuaaaaggacccaagaaaacuuacuagagcuguagauuaaauggauaaagaauucaaaagggcuagaaaagcuuuuuggccaagaucuugauaccauuaaugauuucugaaauuaugguauuuucuguggaggccauaaauuaaacuguuuucuuuaguaguccugauaggcaugcaaugaaagaggucuucaguuuuagauuccuaacccaagcuuuuaacauccggcuuuaucuggccauauucagauugcuuccuggaguuucaugaggaaaccuaggauaaagugcugcaaagcaugcagucccacaugugaagucaagcagaguuuaugcuuuaguuggaucauuugugcacugcaagcugucugccggggguguauaugugaaauuuaaacguccuuuugacuuugauaaaguaguugagaccuguacucuaugcaucugaagguuuuagacaacagugggcugagagguuauuaaagagagugacuaauuucuuucuuaaggaaccaaguuuuaauaaaauuaucuaucuuaauagauccuuugcugucauauucuuuucaaagagcaguguccuguguuuuuguaaagaacuaaaaguuuuauguuaggacuucuguguugaggagccuuuugauuuaaaaccuucuugcauuuauaauauauuuguuaaguuuuaauuuccuugauaaaauuaaagccucugaaagaaaaugcuucaguaggaagaguaacagacaaggauuuggggcaguguuuuuccgacauaacugcaaguacuuucguuguggaaauauauaccuaaauaaaaccguccuuuuauggcuauucaaacuacucauguagacuguauauuuagguaacuacauuaaaugaguauuauauguagcuuauaauaagugaggauuaaaauugugcuuaagaggucaaacucuguaaaacuuguugguacuucuuaaugucucuaaaucaguaccugggaaaacacuacuugcuuaauccauuaauucaagaauaaagaaugagggagcuggagagauggcucaguguuuaagagcacuggcugcgcugccagagguccugaguucaauucccaccaaucacaugguggcucacaacuaucuguaaugggaucugaugcccucuucuggugugucugaagacagcuacaguguacucauauaaauaaaauaaauaaaucuuuaagaaugaaaaaucaaacaacaaaaauaaaguuaaauacauagagcuaagaguccaugcugggaaagacagagaugcaaagagaagacugaggauuagagaaaggucuguagcagugacagcacgagaggcagcaaaggaaacugucauuccgggaacaccgggggccagagugagcaguaacaagccgaacaggggacaggggaggacaugagcuuguaaagaacauuaggagcaagucaggagagacaggagcgcagcugagcuuggccaucagggggacagcacagccagaccccaguuagucccacgcuuuauuaaaucccucacuguguucucacuauugucagugguuagugacaacuuauuuugaaugaugacauguaguuggggacaucuaguaacagucucaguuucucaugaauucuuaguauuaguguccugcccauguucugucauaugaaacaggacacuguacacauacaacuggaaaaagguacaagaaugcuuagauuaaaaaaacuguuuaauucaaaauuacauaaaggagaguaaaaauuuaaaagacgucgucucaccagaaaaaugugcagugcugcuuuugccuggugcuaagcuguggauacucauuccaugacuggggcucaugcuuggacuacuaaagggucgaggacugacgggauaacugucuugagauuuuggacuucggccucccaaacaccgcacuucacugucuguaccauucaccauuucuauaaacugacguacucugaaagaaaaaaguaaguuuacuuaggcauaaucauuacgucauaugaaaacugaaaaucaguauuuacuugguaucauaucaagugaguuaaguaagcaagauuuggcacgcaugcaccuguacagccuucucucucccacacagcccuuccugacccagcccaggcugcacaucaagcucucagccacaauggaccucaguugacuuuguacugcuuacaagacugaaauccuaagcugaguuugacuuuguacugcuuacaagacugaaauccuaagcugaguagcaucccaacccccguuuuguuuuuuuauagagggucuuacuuugcagcccuggcuggccuuaaacuuguuauaugcagaccagaccggccuugaaauuucugagauucaccugccucuguguuaugaaugguggguugauuaaaggcauucuuuuuaaguaacaaagauuuuuuuuuuuaaaugucaaauuagaaaccuaaaaugcagaaaauacguguugaugaugacguggaaagauuggaacccuucuacucugcaggaaggaaaccagagugcagcaaagaaccaguacaugggguucucaaaaugcugagcacagcaaugaaccagcaauucuacuuuuagguaaauaaagaauugaaagccaggccucaagcagaugccuguaugccuuuuuccacaguagaauuauuuagucuucuaaagucaacugagguccauuuugguugagagcuugguauagcagagacagacagaagcaacuccaucaacagacagaagacuaaacaacaugcacugcuuacacacgaugggaucaucuucagccuucaaaauuaaggaaaauucugacacaugcuacaguacagaugaaacuuauaaggagcguacacucagugacuaagccagucacaaaaucaauagucucugaggacucugggcaagugaacaagggagaagcagcuaguguuuaaagggcagucuaagacagaaaagucccagcaauacacagaaacgcaagugcaccuaaauguguaauaauggguaaaagagcaaacuguguucauacuuuacuaucacuuuucaauauauccaaagagcuacucaagcuaucuuucaaagagcuggcauuacugcuuucuaaggagacauucacaguguaaagauggaaugauaaaagccaauccaaguaccaugugcacagagacccuaacacaaagcaccuucucuagucacacacgcuaagcaucugcucugcuacucgggacaugcuuagcuccacauguucuuuaaaaugucauuuaaaugugcuauauuaucuaauuauauguaaauaacugaagcaagggagaccaaaaaucaaaaccggaaguuaugaagauaauuuuaauuacuucagauguacagcauauaaaauaacauuuacuaaaacuuacuuuaaugugaaaaggagauugggauuucuuucaaguaaacuuggguauaacuguuguguuguuucaauggcuucucccauucguccugcuaacaccaacuucugaauuccuauucagaaauaaaagcaaaaauauuaaacucuacaaaagcagagacaaccuuaaaucgcuccagaaaauaaguaacagugaaaaccucuaaacaauuauugucaaacucucuuugucuacuagcuuuaaguuuagauuagaaaauccaagaaaaaaauuagaaaaguuacuucaguaacuacuuuaaaauaucauaaauaaaaauauguaaauauuauagggaaaacaugcauuguacaguauuauauuuucaaacaguaagauuuagaagacuacacuuaagagaagacauaaacucuuacuggcucuucagacucaggccuggagccgcagcccuugccuaggcuggagcuucaguagacuaaaacccugaguuagucaccuccccugcugaaggagggcacuagggcagggggagggagcagcaugcggggagcacagcaccagcgccuggcucacccuagccgccuggcucacccuagccgucgcaccuaggacaagauccguccgcccagccuacugauucuguuugccuguccgauuucccacccugcccaucaggugggaucuacacucacgggcugcaguacugacuuuggaaugucugacuuacaucggcugucagucugccuugcccugaugaaaacaguaccagccacaaggcccuaagcaguaacauacuuaugaucaacacugccuuaaauuuaggcagcaaauuagaagauauuuaaauuucuuucaaagaaaaaacuuauuucauauacuaucuccacuaccucaucaagacuaccaaaccaacaaaaggaaacuuugcaucucugaaagcuuaaggcggcuuuccugccccauccuccaccugcugggugcugacaccuccaucccaacccacaggaaagucgggugauuuuuuaauggaaacacaauaaagccauuuacuuuuaaaguucuaagcugcauuucuacauuuaaaacuccagugugaacuuuuaaaacaaaacuguccugaguguggcaugagggugagcagcucgaggucaagccugggcuacaaaacccugccacaaacaaaaacaaacaccucagagagucagugcagacagauuuggaggcauccacuuuaaaacaauauauuggggaaauuuuuaauaaaaauuaaguuuucuaaaagucaaagcaaccaaauguaugauuuaaaaacaaguauuugcuguguaccacaguauucuuacuuugucuauucuuaauggaagcuaauucuucuagaacagucuggucuguagaucuggcaaaggccucugcuguggcacaguacccaugguggacuaaauaagaugaaaccauucuuaaaacaaaaagaagaaacacaucuuuuagucaggagaauacaugcuucagacuacaauuuuuguuaacaaaguacaacuugguauuacaaaaaucaaucuauuuccuugaagccuggcucuucaaucuucaauuuuaaaauaacuugagaguaacauuuugcucuaguuaugaauaguccaaaacauaauuuaagauaagacgaaagacauuaaaaucgucuuuuuuacauuuaauccuuggguccuauuacccugguucuuuauccauguucccauuauucaauccuacuaaccaaaaugucugucucaccuuaauuacagacaucccaaaaagagguuaguucagaauaaaacaccuagcuuugagauaacugauuaguacuugguguuccgcaguuccaacagcauucuguguucauccugcagaugagaugagaucucacaagugugaggagagacucuaauguuagcccagagagagaacugcucagaacagaguccacaagaaacaauuaaacaauguggaaucagucuugcaucaauuugaucguuuuggacagaaaauucauugugcaagauuuaaagacagugauacauuucuaagacaacaaacuuccuuuuaaaauauaguuagcaaaacugguaauccaauauauuaauaaaaaacuuguuaccuccaaucacuaucuucccuaaacaauacacaaaaagguuuucuuaauauuuaaaucaucccccaagagcucccaggaacuaagccaucaacaaacauggugccagcugcauauguagcagaggauggccuugucaugcaacaaugggagguggggguggguggauggaggaacguccucauagaagcagggggagggaggaugggauagggaguuugggggggcagauaaggggauaacauuuguaauguaaauaaaauacccaacaaaaagaauaaaagaaaaaaauuuaaaucaaagaaccuuuaaagcaauuauaaauauacuuucacaaccauggcauacugaugauauauuugaagauguuggcuauuuuacuggccuagauuauacaaucagaaugguuuaauuuaaugguauuuaacuuuuguauauaugcagucuacaucagucuuuaacaacugucacuuaaugcuagugcuaucuaggcacugucucuagacuuuugacagacauauagucuagaaaagucgagugucacaggaauucaauuuuguugcugcuccuuacaaaauucuaugaaauaaagcauauaaagccacuacaaagcucuuccuccuaacagauuuuaacacuuacuuucuucucugcugcuggccauccuccauuauuauuaaugaauucaaaguauauaugcugcacuugggcuaacuccacagucauugcuccuuggucuucauuuccuuuaccuuauccuaagugucuaaugguaacuuauauaagaaauagcauuaaaaauaguuacuaaggcuuuuuuauuucuaagauuacaguuacuuacuuguuuauugugaguaugcauacacacacaauagcacacauguggaggucagaggaccuguaagggcuuguuucuccuucuaguaugugggucccaggaacagaacuugggaggaaaagcuuggcagcaagccaucuuucugccaucuugguggaauagcuucccuacccaaguuuuuaaauuuuaauuuaaauuuugaagucuuuugaguagagaccuauggguagauuccuggaaugaaaugcuaaauacaaaguaaagaagggguucgcuccaaucauuagagccacccugcuaacacucuuacagagacgagcaacccacacuccucagcgcuggaccaucccgugugcccacucuggcuguacccucauacuugucugcauugagaggaagcaucaaacaaccauucuuuuuccuccauauguaccugaacuacugcugacgaugaucacagaacccacaauaacauacgaucuaggucacccucuaaacuuaucucuuuuuugucaacauuuuuagaaguuugacugcauaaccuacagacuucacugagucaucuuaguaaggguaaaaaaacugaauuacgcuacuuuuauggucaagugucucuuuacuaccuccauccaguuaaaucagacagacacaauucugagggugcuuaaaccaaugcuauuuuacuccaauugguggauuaccuuuugagauuaaaauauaaucacuaguacacacaaaugauuaggauuuaaacuagacuucuggagauacaucuuugaagacaaaaagaauaguuugccuauaaacguucaguguuugaaucuguacauuuaaaauuccuugcucuuacuuuuggaucauggucugccauucuccuucucgauccccgauaggaaagcggucuaucugggccuguauuuugguucuccauucucgcauguagucuucuauaucaaacacaaaaggauguugcccaaaguuggcaucaaccacuucuccuggugucugaagccccacaguaggauacaaauuuggcuguaagacaacauauuuccuuaaguaucuaguuauuguacacuaaggacuucauugccuuugcauugcaaguauagaagcauaaauuauauaaugaguauuuuaaaaccucaaucuaaauaugagcagaggacaacuaaaacaaaauacauuauaugcuggaugaaaaaguguucuuuccuucacuguaaccaucaaaaaaauauaaacuaagauacccacaugggugacucuggggcccugccacacaacccauguggccuugcauuucuaaugcauggaaauuuaacccaugucuucagaauaucauauaacaguuauuaagcuuuaaaauuaacucagccuuuauauaaacuacauaucuaaaaaauguauauuauagcugguucacagaaaguaccauuuaaaaaucacuacaaucauuaccagacuauuuguaaggccugccuuuacaaagacaguuauaaaaacuugcuuuaagcaagacacaguguggcuauaaggauucaccaccaccccccgccccugaaagcauggaacacuucacaaauuugcagguccuccuugcacaggagccaugcuaaucuucucuguaucguuccaauuuuaguguuuaugugcugcuaaagugagcacacuuuggggacuuucaaugcaaaacuaaaaccucaaaaguauaauuucaaaggaagagacaaaucugaauauucaaacugaaaugcauucaaauauacccuaaguuauuaaagugaaaaaaaaaccucaucaaauauaaaaagaaguuaucuucaaauacacacagacaaaaugccagaucccuucuuuuugcuguuacugacuguugcauuuaaagagaucauguccuaguacucucuaaaugccaauuucacuccuuagaaucacugugaggugcuugcugccauuacacagaugcacaaacugagaaccagaaguuaaauaacuugcccaggguugcucuacuaccaacaagcaaacucagcacacaggcugccaacacuagagcaaguuucaucuucaucccgggacuccaacccucccacuuuagugucuggacgugagccuuguuucuuugcuuuuauuuguagguaucacaaguaucuucacuacaaacaagguaaauauauuuuguagcagacuacaaaauauuuaaaaguaacuucaacaagcaacauaaaucaaaaacaaaguaauaugucaaaacgaauacaaaauuguauuagaucauucagauaagauaugugguaagacaaaaguauugauucuuugugcuggggagauuauggcuauguauguccucuuuauugugacaagucucagguagccuugaacucagccucccaaguguuaagauuacaggggugauccaucaugccuagcuuuaacucuucauaaucagcagaauuaacacauuaaaaauuuaaacccaaagcagguaagacacucaggauagucuucucaugucaacacuuagaaaacaugagaccugagacaauccaaaagcacacagcuuguuaauggcaucguguaaaagaaaaaauuucuucuagcauaauaaacuuuucauccaaauccaucacagaauuaauuauuaaauacuuuaaaaacaaaaaauauaaggaaccaaaggcaucaacaaaggugcaagacaauucuguaauuucaggacaaaaacuauaagcuuaaggaggagugguuuaccaugcauuuauauacauuuagaauauagaucggaaauuccucuuuuaaaaauuuaucauccccaccaggccgugguggcaaacaauuuucauuccagcaggcagaucucugugaauuccaggccagccugcuccuacaggaacaguucuagaacagccaaggcuacacacagagaaaccucgucuuaaacauuuuauuccuacuaacguacacauucaaaugaauauuuaacaauuuaaguuuuauucuauuauaaauauuucuucugaaaacagcaaaacaacaauaacaacaaaaaacaaaagcaaauaaauggcaacuacguucaagucagcuuguugccuuggaaaguagcaaugcucuaaaugagcaggggcuagagagggugaugcagcuaaaagcccuugcugcuuuugcagagggcccagguucaguucccagcacccacauggcaauucacaacugucuauaacuccaguuccagggaauccuacugcagccucugcuagcaccaaacaugcauguacuauauagauauacaugcagguaaaacaugacuauaccuaaaauuuaaaaaucuuaaaggagaacagcuaaugacaauaaaaggaauauauauguacccaauuucaaacugaauugguguuuuaaaagauauuucucaaacaagggaaaauuauuuuuuaaaaauacaaggucuaguagaaagcuaucccaggaggcugggaaagggucaucauaggucccagccaagcugcaucucaaacaaacaacaaaacgauguaagguugucagaacuggguaaagaugcuaugaccgaagaauaguacaauacagucaaggacaagauuuuuugcaaauauacucccccaggauucaaugcuccaaacaacucaaaagaaagcauagauaagggacauauaaauauuuucuaagcaauuccuguaagggaaagacuagaguuuccuuuauucuugcaguagaaaagugaaauauagccugcggaagucccagaagacuuuagagcccuagagacccaggccaucaaaggaaaccuguaagaacuaccaccauguuuaccuuguucagugacacaaaguugccacugccucacucuacauggggcuaggggaggcuaccacacaucaccaaagagggacagacacacacacacagacaaaacucacacacugcugaaaaccagguaugccuucgcugaaugaucccugcuacgcuggccaaccacgaggaaagagaacuacuacagcacggccgccgucauguguuaacaugcucagggcaucaacagcaaaaugcccagcaacaaaacccuguaacaguuacaaguguuuuuaugaaagagcccccaauaguuaaggaugccaucaucuuaccugcagaauuuaccugcaggguaggugcaguggauaagaauuugcugugaaagcaggagaaacugaguuuaaguccccaggacccguguaaaagcugggcaugguuaugugugcauguaaucucaaugauggggcagagacaguggauucccaccagaaaacagcaagcuucagguucagugagggcaacagagagagauuccuaauguuuucuuacuuuggccucagggugugugugugugugugugcgcgcgugcaaaugcacacagacacuacccugucugucaccaccacaaaacuuuauuuccuuggccugcugccaagcuucucugccauaacaagacuccuaucccuuggaaccagaagccaaaacaaguucuuccguaagccauuuuugguaguuuuaucacuuaucuuuauccuagcaacuggaaaguaauacagcuucucccuggauuguaucuucagcuggcuuucagcagguauucuuucuuaccucacuaauuaauucucaauuucuuuuugauaguuucuuuuuguuuuguuuuguuuuuugguuuuuguguuuuuguuuuucgagacaggguuucucuguguagcccuggcuguccuggaacucacucuguagaccaggcuggccucgaauucagagauccgccugccucugccucccaagugcuaggauuaaaggcgugcaccaccacacccggcuuuuugauaguuucuuauuuucaccuaaacuuaucaugcccuagaaaucugucuacuucucuucugugucaacacacaccuacaguuguccacgugcacuuaaaacuugaacacuuagccuuaccauggaugagucucuuuaauuccaguuugcaaacccaacuguguaugugaccauauuugacucuucuacccaacuaagaaucacccugccccccaaaauguuccaacagauguuguggugucuaccaggaagguuauggcagaaggaugccugagcaauugcucaagcagaaguuuaggggcagauggggcaacauggacagcucccaccuuaagauuaaaagaccaagugcugggguguagcucagugcuaagcuuuugccaaccaugugcaagagucuggggucugauccucagacacaaagcaauaagcaaagaaagcugcucugcuuaucaccaagcagccccaccuccaccauggacucagguccucaggccuaccauccuaagucaagucugcuuucuuuuuuaaaaaagguuuauuuauguguaugaauacaagauuacagaggccagaaaaggaugucagaugcccugaagcuagaguuacagguaguuaugagcugccugacaugggcucugagaacugaacucugguucuuuggaagaacaauguauguucuuaauugauaagccaucucuuuagcccccaaaccuggucuuagacucugucugaccacuuuucucuccucuuaaauacucuuguccugcauauccacugaccuacucugucagagucucagcucaaguuccacuuugagcaaagcacacaacuucuacagcucuuucucuccaaaguacauaaacuucaaaauauaacaauucacuauuuuucaugugcucauucuguaaauuuccuuaccguagacacuaaucucaaaaccuaacuccagacaucuuuacuggcugcuaauggacacaaaagcacaggagcugaugauuccaacaacacaccuuaggugaaugcacaguuacaaguguacaauccuagcugaaaagcucaaacauaaccaggaaccacacuuuaaaugagcacauaguaucaaaagaguguuuuggggcuggggaauagcucaguguaaaggaaugcuuauugcacgggaagccacagguccaauccacaagcaaagcuuucuggguguuuuagguaaucccacgugagcugugcagcaggacgcaaugcguuuggagcauuuucugaagcucccgaggccuggggaagguccucugucugauggcagcucaugcacuuagaaugagggaggcugcuccacaugccuacuucuaguuucuugaacuucuuuuaguuaaaaauaaauaagaucuuucaaaaaauuaggucuuaccgguaagucggugaaagcaauaccuaaaaagaaaaaagaaagguauuaguuggcuuuuuuucgaaggaggguaauaucaaaaaccuaaauaucuaacuaaagcaaugggggacaacaggaaaggaagaagagguaaaagaaaagccuaacuuugugugacugcuguccuauagagaucgucaguccuacuggucacacacacuuuauuucugggauacaggcauuaacucgagaguuuuaaagugaucuuagauaagccuucagugcuauaugagaacacuggcugcaacagugucagauuugauaauuucacccaaaaguuguauuauccaccucaguacuaaaugcuggucuagauuuagcuuuuauaaaagcagugcaugcccgcaaucccagcacucaaaagacagaggcaagcucaaggcauccuuggcaacacagcaaauucaaucugagcuuggggagacucugucuccaaaaaucaaaaauaaauaaaaacuacuuuacguaaaaagaacagacauuuucuaguaaaaaaaaaaaaagugaacacaagaaagcauuguacuuauuucuaaaacaacaaaacaaaacaguuucuugacaggaugccuguuauccuagcacucaggaaacugaguuacaaggaccucuauaugaggccagucuaggcuacaugcugagacccugucucaaaacacaacccaacaaaucuauucuuucuugaaggauggcgagugcuccugaauaucucaacaggaauuucaacauaaccaugugccaaagaacuggaacaccaguaauggcauaaguauacuggcagucugaacuacaaagaauacaacaaaagagguuaagcauuucuauagcaucuuacucuacuguuuuuaaaaaguaacaucucaaguaagggcugaugaacccaucagccucugcacacauuggaagcauacaaacagcccuagcacaagcaccucucuuguucugacaagcaucaaaaguguaagagcaucuaguacuaugcugugccaagagaaaaccaaucucaccugaagcuaucugacucuacuuauuauaguaauaaaguaaaaaggcacgaugaauauaaauaucauaggcugaacaauucuaagcugaaaauccaaacucuaaaacuaacggugccauuagggccaaguucuaccacaacacacgugauaggucauguucaaaaugcaggcagacuaaaaacagggccuaaaaugacuguuagguuauaugugucaggcacauaggaaacuccagugauauuuuccgcucacacuuggguuccaucccguaggauauaucuccuacagauauauacacacaaauauccuacaauccaaaaucuuccauguuucugguccuaagcauuucagauaagagauauuuaacuugugauuuauuuuuguauguaaaaaugcuugugacugguaaagcuugcucugugcaucucucaaaggaaggcucagcucggcgcauugcuucugucacuccauacaaaacauccucacuacagcuucacucagugaauaggagccaaagauaaaaacuuacuccaaaaucaucaggaaauuaaacaauacaaaaaaagugagaggacaucuuaacaaaucaugauaucauuuuaaaaacauuuuaguguagccuaauuauuuuucucaaagauaugugcuuauauauaggucucuaaauuuacauuguuuuacuaaaaauucuuugucaguaguuacuaaaguuuuuucucuuuaucaagaaugcuaauaaaaauuccagauuagcuccagagaucggcacuuuuggccaugggcaaauaagugugcacaccuacauaguucagggccacaaacaggugccuagagaggaagcugggagaacuacagacauuucacuuuccaagcucguuccugaccugcugagaaagcuuucugaaauguuaucucuaaguaacaaaugaugucugauuuaaaaaaaaaaaaguuaaaaaaaaucuuguuacuuaagcucucuuauuuuuccaaauaaaaaccucuccauuuuucuuuauauaguaaguacauguucaauuuuaaaacccugguuucagccagaaacacagcucugccaaucuuauuguagaaauaucccucuacaaacgcccuugggaauaggaauggauagggacugaguaacauuuuaucuuccagauuccagaguccagacaguccuguaaguggucaacuagguaguacuuucuagguaguaauggugucucugucaccacuauucaacucugccacuggcccaggaaagcagccacagaaaaccuguaacugauguaaaggaaugaauggguggggcuguguucuacugcagcaucuuagggacgcucuguucacagggauaacuucuucuuuaaccaggucaccucuucagcccuggcacccagacagagguacccagcaucuguaacugcucagguaucacuucagcuuucucuaaugagcuuacuauggcagccgugacaggcauucuguuuuuauaaacugagaaauguucaguaagcugccuaagggcacauggcaaagaaaccucuugagucaaacccagucaagacugacugcagggcucugacuaacuauuauuauauuuccuaugugcucaauauuuaugaauuuaugaauaccaucaaacauuucaaauuuacagaaaacuagaacauaauuccaucauagguacccuuuucuuaagcaucuuaccuuuuaaaauggcuuucuuauucaaugaaaggguuugaguuaaauguuugugaaaaucuaauaggaaaaaaaucacaucaccugugaucuucccaucucccaaaauaaaauuucuucucugaaaaguuuaaaaaauuaguguuaaaaaggcuaaucgugguuuucuaaaaaugucuuguuuugcauuuuugagcugucaaacccaaaagcagauuucccuuaaguuuaugaucuuaaacaguuuaaaagcagcugguacaaaacuagugucaguuaacuacuuugcauauagucugcacggggucauuaaaugauacauggaugagaauacuuguuguuuuuuuuuuccagaccuguaauaauuuuuaagucacauaaaagagaagaguuucagaacuaaaaaaaaaaaaaaagagagagaagaaaggaaggcaggcaggcaggcaggcaagcaagcaagcaagcaagcaagcaaaaaucuuaaggcagacaggagcacaaagacuuuauacaugggcugugcugugguacuacagaagucugcugcgaugcaaaugaaacuuaagaaugaaucuucuuugauguaacggcacacagaggcuugccguuuaagauauugcauuauauacauaagcagacuacuugcaguucaacuuuuacaguguuguucagaaguaaagcagcuucuacccucuaagauuauuuacuuuuuauuucuauccauuagaaauaaucuacugugagcauauacuuuucccaaugguaaaaaugaaguuuuaaaaaacaguagucucauuaccuucuauauuucuugcaauuuaaaaagaacaguggguuagagagauggcucagcaguuaagaacucuuucugcucgucuagaagacccaaguucaguucucagcacccacacucaucaacucaaaucaccagaaguucaguagaccccacaccuccuccugcccuccuccaguacccacaaaugcauggcacacacucacacaaacauacccaaguguacacauaaauacaauaaaaacacauuuuuuaaaaaaggaaaauuacaguaacuacacacaaugcuacuaaugaacgaaugcacauuuggcuagagccuuucauuuuguauuauuccuacaacaugauucuuuguuucauugccauacuuuagcccacgugucuuuuuauuucuguuauuuacuuaauucuuuccugugccacaaacuugucucagacaccauccuucagcaacaccauuagcaggccuaagguguaagcauguccacucugcucuuuuacaguucacuuccguuaacugcucccccgauauucuuagaacugaauguuuuaaauuguacuagagaacugaauaacuaaugaaguuuuuguccaagccaagcuuggcauuucuaucacuaggacuggguggucacuucuaguauuacuucuguacauaaguuagccuuaacugaauacaaguuuuuaucacuuccuuaacauggacauggauagaauaauuaaacagaaucacauaauaaacaaaaccaucaugcuuaguaaaauaaucacaauauuuggcuauuuuguauuuaaaacaacaucucaguaccuaaacuauguccauucuucguguaaaagcagguauuguugauaagauuaacacaacagccaaugacaucaccaguuguaaaaguugguccauacgguuguccaguuccagaagaacaaaaugaauguccaucauccccaugguaaccauaugaauguuuaucccaaccuggagagacagguucaguauauuuacaaugauaaacaaggcucuucaucagucacuuaccacuaacguuguaagaugacucagaacggcacgacagauauuauacagauaaaagcuccaaguguccaucuacauucucaauaacuaaauuauauagugauuucagcauuaggaugcugucuacaacauuaaggaaaauaaacucaccacccagaacaguaaaaacaaguacugaggagaaagaauuucuaccaggaaugugaacauaaacagcagucaugccagguuauguuuuuccaugcauuaguucuuuagcuaauauagcauaggaguuuugcuuuuauuugaauaacacacacaugcuuuaauguaaaguauaacuuucaguuaccacaaacuucucaaggugauccagagguaaaagucauguaauuuguaaccauuuuauacacacaacuauacacauucuuaccuauuauaauuaagaccucacuuaaaccuucauaacuuuuggcagaagcaugcgaugaaaccccauccaguucuacaagaauccagugagguggcagcagcacuggcuugcugugugcccacucaaugcacuuacuguaguggucugcacaggucaguuagcuuuuuaaauacaaacuuucugcuacuauugauuuuuaacaucaggaaacagaaucaauuccuucugcuaacugguuuucacacagcauuccacaucagccacacacuccugagcucacuucugucaucugucccuacucucacacgggcacacaauuaacaugggcuaaaggucaggauaagacugguggcaaaagaaccagagacauuaaaauauuucaaguggcugauacaguauauaaaguuuaaaaggaugaaacauuaacagaaaaacaaagcauagguauuauguuauguaaauucuacagaggaacaugaaauuuaauucacuuccacuuagaauucauaauauaaagugaucaaaaucuaaaaagcuauuaccuuucaacuauuucaauuacuuaacaauuuaaugcagaaacgucaguccuaaaugucaggcucuaacaauacuauaauucacuuucaaguguaccugguagucuauucauguucacaccuugagcagaaagaccaauucccauguagcuguuggagaacaaaggaaaggaaaugcagguuauuacagucagguacggacauagcacuacauacucaaaacauaacuagaaacaagccaaaacugaggcuucuaagauagccacagaaauguuauuacaauguauuccauagcaacaaagagcacuauuaaccagcaauaagaccuagauucaguaaacuauaguaauccuucguauauacauuaaaaguauuaguaauggcugcagagcuggcucagugggugagauggcauucagaaccaagccugaugaacgaguuuaauccguagcagauaucuacgugguggaaggagaggacugccugucaccagcuuccucuccauacacacacaaugccaauacuacauucuacaugccaagaaggagaaaccugagagaccucuaaaguaucucacaauauaacaaaggaacaaaaaguauaaucagccauggaaaacaaaaaacaagaucaggcagaaauuaauaaaauagaaacuaauaauaauacacauuauuaacaauaucaaguuaguucuuugaaaagauuaagaacaacaaauccgcugggcagugguggcgcacaccuuuaaucccagcacuugggaggcagaggcagguggauuucugaguucaaggccagccuggucuacagagugaguuccaggacaguagggcuacucagagaaacccagucucaaaaaacaaaacaaguccuugaucaaacuaaccaaaagaaaaaaaagacucaauuuuagaaaauuagagaugaaaaggaagccuuuacgacguauaucauaauucagaaaauugcaaagauauaccuuaaaaauauacaguccaccaaguuggaaaauauaggagaaauaaugucuacauauguaugaccuagcaaaacuaaaccaaaaggagauaaauacuuccaacagauuuauauaacaaauagacagaaacaacuggguguggacgaggaggaaccacccauggccaaugauggcucaauaggugaaggugcuggaccacacaauagaacaaagagcuaacuccccacaaacuaaucucugaacaucacauacugccccugauaaauaaaugucacaagauuuuaguuuuaaaaaucaaucaaucaaucaaucaaucugccaagucaucaaaauccaaacccaaauagauugacugcugaauacuucaagaauuuuaaaagcaaacaccaaagggcccuaaacuaagggauagaacaguaccaaauuauuuuuauaaagcuaguauuaauccugauaccaguaccagauaaaaacauuuaaaaacaaaacuauagaccaaucuuucuaauggacacguaugaugauuuugagucuucccuauuuaguguauguuggcuacagauuuaucauacacaauguuuauuguguugagauauauucucagugucuucaagacgaaaggccuuauauagaugcauauauuugaauacuuagucaauggggaguggaacucuuggaaaggauuagaaggauuuggaaguuaaggucuugauggaggaaguguguggcuuugaaaugucaaaagcuuaugccagacccagucucccucugccuguaugcuugcagaucaggauggaaaggucucagcuacuucuccagccccaugugugccaccuacuccuugccauauugacaauggaccaagcucuaaaacuauaaagaaaagcuuucuuuuauaagagcugccuuggucaugguaucuauucauaauaagaacaguaccuaagacaacaaagauaaaaaagggggagggaccaccaaaacauuugccaacuaaauuuuauaaaacaccaaggagaucacugaccaugaucaacuuggcuuaauuccagagacauaggaauaguugguuauaauaaacacuacaaauuuuauauauaaauggacaaguacagaaaucacauggccauccccucaaaaugcagauaagagccuuugaaaguauuucauguuaaaagucuugaagacacuaggaauauaacacuauaauaaacacuauguaugauaaacuuauagucaacauuacacuaaauagggaagacucaaaagcacuccacuaaaaccaggaacaagacaaagcugcccucuguucaacucacucuuauucaauaugguacgaagucuuaccuaaagcaauaagacaaaaauuaaacaaaauggauacaaauagcaaagaagucaaucuaucuucauucgcagaagauuaugauuuuacguaagagucccuuaaagacucuacuggaaaucucuuagaagugauaaguuuugaaaagugucaauauacaaaauuaacaugcaaagcccagucaccuucauauauaccaaugcugagaaagcuaucagggaaauaagcccauucacaacugcgggaaacauacaacacacaacacacacacacacacacacacaccccugggaaaaaacuaaccaaagugagagaucucuacaagaaaaugauguuuuuauucaucuauuuuguauguaucucuguuugugcagguauuuguaacaugguguacauagauaccaaaagacaacauguaggaguugucugucuccuuccaacaugugaaucuucauguaaugaacucagguagucaggcuugccagcaaucucccuuacuuguugaacugucucaucaauccaggaacuuuaaaacacucaaaaaugaagauaugagaagauggaaaguuuccauacucauggauuugaaauaaucaauucuguaaaaugauuccccuaaccaaaaguaaucuagagauucaauguaaaccccaucaaauuucaaugccacucuuuauauagagauugaaaaaucuaucuuaauuuucauucguaaguuuaaauucacucaggcuauagaugacucaguaguuaaaauaguaccuggaggaucuagguucaauuccuagcacccauauggcagcucacauaugacugaugcccuuucucugccuccaggggcaccaggcaagcauguggcacagacacaaugauaacaaaacacauuagaaagaccucacucagguaguguggcacuuaguuauuuucaaccuucuggaaucaagaacugcuuguacaauaaagugcaccuguaagagauuaucuaaaugggcuuaauuguuauggaacaaucugccaacugugggggccucccgggcuguggcucuagacugaauaaaaauaaggaagagaacugaguauucauucauuuccuaacuuuggaggcaaugccaccgucaaccucaagcuccugcugccauaacuucuccaacaggaggggcgucgugaccuugaacugugaaccaaagcaaaccuccuuccuuguuuuugccagccauucuguccuagcaaaguguaaaguaacugagacagauauucaaagcauuuaugagcaaaaauaauguuguaugcuauggcuagagccauaauguuaaguuacauucccgagcuucaguaacacagcagcauggcacuaaccacaaccaacaacaacaacaacagcaacaacaacagcacacacaucaaugcaguaaauugaugggagagccagguacaaagacacauagcuaaucugguuuuuuugucugucuguuuuuacaaagaugccaaaaaauacucaggaaagaaaagacagcuucuuuaacaaaugggcucuaguaaacuggaagucuacauguagaagagugagaguagacguguacuuucaccaugaacaaaagcaacaccaaaugcauguaucaaaaaccuuaccauaagaccuaaaacucugaaaacacuugaggaaaaagugguaaaacguuucaagauacaggcucaggcaagggcuuucugaaaaggacucagucauuugggaaauaaaaccagcaaauagacaaaugggaccucaugaaauuaaaaaaaaaaaaaaaaaaaguuuccauacagcaaagaaaacaguuaacggagcacccuacaguaugaaucaucgccagcuauaccaucaacagguuaauaucuagaauacacaaagacaauaagauaaccaaucaaaaaaugugcuacauaacugaacagcauucuuaaaaggaaauacaaaaugccaauaaaugcucuuaaaaaguguucaaaauucuuagccaugggggaaaugcaaaucaaaacuacucuagagagucuauuguuucagucaguaugguagugaaggucucucccucuguauucugugacagggucucacugaacuugcuggguuagcgagagugguggacaagugaacccucaggaaccaccuuuaccagaacccuaccuaccacuggagugacagacaaaagccaccaugucuagguggguacuggagaucucaacucaggcuucaugcuugcagaacaauaacuuuauccaauaagcuauuaacaaccuggagacauuuucuucagugacacagcaagcacaccugcauuagcacugauggcugcugagggguaugggcaagcccaccauuaucccuaggcagcuggcccuaggcuauaagacagcuagauaaacuugaggugagugagugagccagcaagcaaggcuccuccaggcuuccuguccuuacuucccucaaugauacuguagucggaaguacaagccaaacaaacucuucucuccucaagguggucagaguauuuuaucauauaucaaacuagaacauggauauucuuuugugaugauuacuuuguucuaauuuuauaaaugaacagacuagagucccuuguuuagguagauugucaguuugcucaguuuuagaaaauagucauauagaaacuccaacauguauuuuguaguauaauauuauuaacaacuccaaauauuuuucaugaauuugacauuauauccaaauaagaagucauaucccauuuuggggguucugaagguucacuguguccucuuggaaacauauuuuguauuauuuaauauuucucacaugagauccucuauacuuguuuuugagaaacuguaauccuaaauggcuguuuuagcgacaaugaaagauuucgguagcauauauuaaugcuaugugacagcuucauuagaacauacucuuaugugcauaauuauuugaugguguuaucagccuuacucuuucucaucuugcuccacccugcugaucuuccucuccccacaagccccucuuuuacgcucuugucuuuugaguuuaaaagguucccacagaccugcaaacaggucaauccgauuugggcaauucuagccucagauggcuguaggcuuuaaucaagcugacaauaaaggcuuucuagaacaauauacacaaauuucaaaaccuuauaaauaccaauagaagcugagauuuuaaacagaaguaaauacaaaacaccuacaagugcaaaaacugaaaaagcaaauugaauacaauuuguuaaagucuauaauuugucuacaauuguaugauuuugugucauuugauaauguucagcuaccauuccucacaaagcauccaguaaagguaagaaaaggaaauuacuuagguaugauacuguuuccccuaacucuaauacaggccccaacaaaacaauacugugaaaaucagugaagccauuuccauuucaaacaauaacaaggaguugcuuguaucugcuaaacacuguuuuggagaucuuuaaaaaucuaauauaaaacaaaaaauaaccaguacaacauuagaaaacaagguauucauuuguaauugguauaauuauaugcauacaaaaaccacagaaacuauucaaagcauuaaaauuaacuaaguauuuuaaaagaggaacuggauauuaagaaaaucaauuucguauuccagcaaaagacagcugaaaauaggagcacugugugugacagucacagaaacccuaaaauaguaauaaaaguuuucuagcaaagcugaaaaacaauguaucaaaucuacaggcauaacacaacauguaucuagauaacaugacaauacaaauaacugucuuucuaaaacagugcuucucaaccuuccuaaugcugugacccuuuaauacaguuccucauguuguagugacccccaaccauaaaauuauuuccauugcuacucguaaguguaauuuugucacuguuaugaaucauaauguaaauauccguguuuucuaauggucuuaggugaccugugaaagggucguuggacccccaaaggaguugaaaaccacagguugagaacagcuguucuaaaagcuguagguacacugaguacauuucaagacacauuccaauccaauuucuuaaacuaggaaaaaaaaagauuuuaaaguuuauauacacaaauauagaguuccaagaaaagacaagacuuaaguaaauagcaggccauuccuugcuuaacuaaagguuaaugaaauucucaagauuacuaguuagagcccacugugaauguagguuggcugcagacuggcccaugcagccugugcuguuaaagcauagcaacagcagcccaagcucacugggagacacaggcugugacuguguacccacuccccagugccaaguuucuuuggagaaacaaaaccucacaaagcucuacaacagggguguccugguuuacuuucgauuuuacaacaaacccuaagaccaaaaccaacugaaggcagaaaggucuuucacauuccacuuuagggaacauuccaucacaaggaaaguuggagcagggacucaagucaaggccauggaagaaauguugcuuugccauggcuugcucucuuugcuuucuucuauaccccaggaccacccugaguggaagugggcuggguagguccaucuacaucaauuauuaauaacacuaauuaauaaaauguccaacagauuugccugcaagccagcucugauggaggcaauuccccaauuaagcuacuucuucccaaguagcuccagucaaaaacagcugaucaccaagcuuauuguuuaaugacaaagacuggaccaaaccuuucucauacuaaaagaaaacuaaggaaagcagaauaccaccuguuaccugaacuauggcaugguuagaaggcaagagggaaauugaacaaggaucuaaaccaguuauuaauggacuggucacuaaaucugcaacacucuucaaauuuuccugaggcaagaccuagaaacuccaaaaagaacucuagacaaagguucucaaccuacauguugugacccuuuugugggggacaugggcucaaugacuuuuucacuggggucuuaguagauagccugcuucucagauacuuaugauucauaacaguaacaaauuacagcuaugaaguagcagcaaaagaauuuuaugguugagggccccuauaacauaagaaacuauauuaagggguugcagcauuagggagguugagaaucacugcacuagacuggguuccaaggaguuggaauaaguauaaacuguacuaaaaaaaauuaaguuaaaaugcuaaucacacaaaaaauugaugaaaaagauaaaaaaaaaucguaaucaaaaugagguugcaaaauccuaaaauacaaaaucaacagcaccaagaauccauucuggaugaucaacucaauggacugcagcauugaguuccugaccauuagcaggcugugagaggacagacauguauaaaucaaagggaaucgucaugcaacuguccucuccuccuacuugaguguguucggggaauccagucuugcacaaauaccuuuuacccacugaccuaugaaccuggcagcaccuuuuuuguuaauaaguagguauuuuuauauaaaaagaauuauaaucacacacacacagaaaaaaccagugguacacuacucuauugaguucacuuaucuaguaauuuuuccacaguuaaagaguacacugcuagcugggccgugguggugcacgccuuuaaucccagcacuugggaggcagaggcaggcggauuucugaguucagggucagccuggucuacaaagugaguuccaggacagccagggauauacagagaaacccugucuccaaaaccaaaaccaaaaccaagcaagacgaaacaaaagguguacugcuaaauugaaauguauaacaugagaaggcuaaacacugacuuaucuuuaagguacauugagaaaaauuaaugaaaggaacaauguaaaaagauaccaaggaggagagucaccaacaaacaagugcuaucugucaccugacacccauucucaacagcucaugacaaagccuagugguaggcauaggucaagguacugaugguaauagcaggcagacuugaacuucaaugcccaaggaaagcaguaagaaugagaagaaaagaaagagcuauuaaggcauauaaaaaacuaaucauuuaugaaccacagacucuuaccaaagaauguuuuguggauuuauuucagcagaaacagaugaaagaaugcaugggccaaggcaaccauuaacacagaaaagaacaaaaaagucauuaaaaugauaguaaauguuauugaaauuuuuaaaucuauuauucaaggaguaaaauaugaucugauccaucuuccaucuaaagggggggagagaaagacagacagacaaagagaaaaagaauggagcagaaaaaaauaauucauaacgaucucccaaaguugaaaagacaaaaaaaauauagauucaaaauaaaauaaaccuuuagguaaguuaaauacaaagagaauccguaagguagggaaaaaaaaaaaaucacaguuguucucacuguaaauggucacaggcuguaacauguguuuucacuacuagucaucaagaaaaugcaaauuacaacugcaguaagcugccauuacacaacgccaaacaguuacuacuuaggacacacaaaagcagugucacaaaggcacugugcuaaaccuaccucaucaccuaaaauuccaccagaagaaacacagacacauauuuccauuugaccaugucacauguaucaagcugacaauuaaaacagugguucacaauuaauggugguacauagauccagcuaaagauauacuuaugacaguuauuaggggguuacacuuaccuugaaaaauaucaaaaagaaagaugaaacaaaggauggauacggaaaugagaugugagauaaagcaauugcugucacuucuauacuaucacaauauaggaaauuacacaacaaacaacaaagugcuggggcugaagaaacagcucagugcuuaagagcaguggaugcuuugccugaguucaaugcccagcacacacagcuuacagcuagucuuaacuccaguuacaggggaucaaacacuuucugcccuuuacagguauuuccauguccaugguacacaaacauagauauaggcaaaacacccaaaauauauaaaaacaaagaaaaacauguuaagaacuuauagaggagggaaaaaaugagaaauaauaugcaaauccuuugucauguuaaaaaauaacaaaaauugaacaugauuuagcauauguuaaaauuacaaaauaaaguagacacuugaaaacagccugauguuuaggugagaggucacaggauaugguguucugaaugaaaauggcccccauaggcucaaagaguggcacucuuagguguggccuuguugaaggaagugugucacugggaaugggauuugagauuucaaaaguucaaccuaggcccaguaucugucugucugucugucugucugucugucugucugucugucugucuccuccccucgcagacucccgccugcugauccagauguagaacgauuggcuccuucuccaaaccaugucucccggcauguagccauguagauaauacacuaaaccucugaacuggaagccugccccaauuaaauguuuaucuuuauaagaggggcuauggucaugaucucuuuauagcaauaaaaaccuugacuaagacacagggcuaaaguuauugugaagugacaagaagaaagguaucuggcagaagcaaguuugcaagugcaaggauggcucguaacacacagagaagugaacagcugguaaauguuugaggcacuguguaguagaaaaggcucaaacaaaacaaaauaguaggauuugcuuauauacgcaagcaaaaaaaauaauuguuguggcgcuauagguuuauaaaaaguaacaaucauaaagauuucuucagaucaauauuuugagacagaauauuaauucuucaguauuuucaauuaaguugugcccaacacuacacaucagaaacaaccaggauuaaagauauaagacccauuaucuucacaucuauucuauuuauucuugccuccauuuaucuuuuuuuuguuauuuuuauuuuuugacuacuacuaaacuauaagucuuauaaauuuaaaauauaucuuucagacauuacauucuuaaauuagcguauuuuucacauucugguaauuuaagauacaacuuuuaaaagccuguuuacuuucucacacuauuuuuuuuuuauucucaucaugucucaugccuucauguugccauguucacacaacucuguuauuauuguuuuaagcaauuaguguaauuuaaccuaacaagauuaacaguagacuuuaaccaaacuauggaagccagcucccagugggaaaauguccucaaacugcugaacagaaaagaaugcaaacucuguauaaagcuaaccuauacuuuuaaaacggagaaauuaagaaauucucaaacgaaucccacuuaggaggaagaaaaaaauauccaugggugcagaggcagggaggaccucgguaagugaggagauggcuagggaaauagaggggcaagaucaggucugaggagagacagggggaagucccagagggacaggagaaugaauggaaaugaugcagcugccagggguugggcauggagaagucccagaggcucccaggagucaaugcaugugaccuuagcagaaaugcccaaaguugggcuacagaaccugaagagaccaucuccaguagccagagaggaucccuaguggagggguggggacaucaacccaccuacaaaacuuuugaccaaaaauugguccuaucuaaaagaaaugcagugggggagacagagcagagacugaaggaauggcagaagugaccggucauuuugaaacggaucccgugggcaggcaucaaucacucacacuauuaaugaugcuauguugugcuuacagacgagcauagcagagcagcccuacccagcagcugacugagaaagaggcagauacccacagacaaacauuggacugagguaaggaacccccguagaaguguuaggggauugaaggcgcugaaggggauggcaaccccacaggaagaccaacagugucaauuaaccuggaccccugggagcuucuugaugcugagacaucaaccaaaaagcauacaugggcuggucugagacccugauaaacaguagcccuugucugggcucagugggaaaggaggugccuauacaccuaguggaggaauuggggguggccucucagaggugaaggaaagggggugggagaggaagucuucaagaagggaucgagagaggggcaacauuugagaugaagaaauaaauugucaaacaaaaacagaauuugccauuagcacucuacucuccaagaaacaguaacggggugggcaaaguacucagcaggaaaagcugcuuggucaccuaggcuaccacuugagcucacucucuagaacccacauggugaaggagagaaccaacucccacgugugguccucugaccuccacacaugugcucaguaccuguuucucccaccccaauuaaaaauguaaaaaauauuuuaaggagauacacagaaaacuauguaaauauauuuuuuauaauuuugucuucugauuuaaacagagcaauaacuauaaaacucuuaaaaccuauaaagauguaacugacauaauaacacuacaaagcagaggaagaauauagaauaaauguaacuaaagugauauaggauauaagcacuaacaucuacaauagaccaaugaaagaaacuaaucuaaauaaaugaccaccaugaucgagaauuagagauuuaacaugacgauggcaaauuaacauagagauucaaaccagcccuucccaaaaaauauaaccugcuuuuuuugauccuaaaauucauauggaaauacaagguguucccaagagcccaacacaaucucgaacaauacugaagaauucgcacuucucuguuuuaaaauauaccacagaauacaguagucaagaagaaauacuucuauacuugggccuaagaucauggcaauagaauccagaauuagacuagcaucuaaucuauguuaagaugauuuuuuuuuuccugcuugccuuugguuuuguugagacagggcuacaugauguaaugcaggcuagccucaaucuccuuauauggcugacccuccugcaucuacuuccuaaauaccgugauuguagguaugcaucaacaugcucagaaacaugguaaauucaucucugacagaaggaagaaguuaguucaacagggggaaaacaaucucuuagcacgcagauaaaaaauuucaaaaguaggaaaauaaacaaggaagcuaagacuauaaaaacaaacuaugaagucaguccucaggacuuggucuuaggcagugaccucuuagaucucauauccaaagcagaagcaagaaaagaaaaacaaacaaacaaacaaacaaacaaaaagcccauagacuuccuaagaauacauuuuuguguaugcuauuaaccuaacuccuaugagaccuuauauuaaagauauacuuaccuggguuucuuuuuuuguuuuuguuuguuuguuuguuguuuugggguuuuguuuuuguuuuuuugaaacaggguuucucuguguggcccuggcugugcuggaacucauucuguagaccaggcuggccucaaacucagaaauccaccugccucugccucccaagugcugggauuaaaggcaugcaccaccacugccuggcauaccuggguuucuaacacucagaaauuuauaccuguauuccaacaagaaaucacauaaaaggcaagagagcaaacagucugaaaagcaaagcuaugauagaaucugacaucucaaacuggggauucacaacaacuggucaaugugcuauggauuauaaggaggaacugaacucaacaugagacauuaaauauccccaaauagacaaaauugguagagagucgaaccaaagaaagaauuggugagcacaaagaucccaaacugaaaugccaugggaagacuuauuagaaaauaaaaauaagccagguggugaugguguacaccuuuaaucccaaaacuugggaggcagaggcaaaggcaggcggauuucugaguuccaggcuagccuggucuacaguaccaggacagccagggcuacacagagaaacccuaucucgaaaaaagaaaacaaaaaccaaaaaauaaauaaauaaauaaaaauaaaaguagacacaaauacaaaagcuaguguacaauguccaagcaguacagacaggggcugccacaggguaauccauucauugcaaccuccucagguauggcuaggaucuuaaauaauuucagagugagucaguaugaagccaaguuauuaggagaugaagagcaagagacaauguacuuuuagauuaaagcagggacuugagagaguugccuaacuaaauagagcuacuuacaggacuugguagcuuuucaaaaguuaacccugcuuaaaagcugugauuuccaacagguaauaaggacacaugcuccacuauguucacagcagccuuauuuauaauagccagaagcuggaaagaacucagaugucccuuaacagaggaaaggauacaaaacaaaaauguuguacauuuacacaauggaguaauacucaacuauaaaaaacaaugaauuuaugaaauucuuaggcaaauggguggaucuggaggauaucauccugagugagguaauccaaacacaaaacacacaugauaugcacucacugauaaguggauauuagcccagaagcucagaauauccaagauacaauucacuaaauaaacaaacaaacaaacaaacaaauaagcaagcugggauuugcaacuaaguucaaaguuuaaaaagaaugaacugguacuucuuucucgcugaaucaagcguccugagaaacauggccacaacaacacagcaaacacaucauuuguaaaaaaagcacacagguggagaaacauuuguuugugacaagaagaacagacacagauguaacagguguggggguuugaagagaucaucuccuugguccugggcauuugauuugguggcacugucuaagagaggcuuaggaggaaguaugccacuagaaagagccuuugagaguuuuuaaaacucacaucauuucuaguuuguucucucugcuuuaugcuuguggugcaagguguuaagcccucagcuucccgcuuuuaacugcggaagcauuucuccggccauuuuuugguuuuguuuguuuuuugagucagggucucccuaggcagccccacguaggccugggacuuacuacaauaggcaaggcugguggagauucucuugcagagugccaggaguuaaaggagugggccaccaccccuggcauauuagacagacagacagacagaagauggcaacauguucaugcgguuggaguacaaccugugggaguuggcucucccucuaccaaguagggcccagagauucaacucaggucaacaaacuuggcagcaagcuccuuuagccccugagccaucucaccaucucaucagcagcucaacucuuuaccaacucgggauucuuuacuaauguuuucuacccagccacaagcacuaauccucauuguacaacaugucuaccaaccaccaaaucauccauuaaaaguacaaaggucaaugacaaagguuacucucaccugaggccagcagaagcaaacagccaauacucaacauagaaauaagcauacugucuuugugaaaaagaaugaaagggggcugggagcgguggagggagggaagggagauagaaaaagaaaggaagggaaaagaaaagaaaguagguaggucaaucagucggucagucacuucauguaaugaauauaauaaaauguaagcuggguaucauaaugauuucauacaauguuaaaaaguuucucuuuugugauccaaauacaccuuaaaccccauuucucagugcuguuaaaaucaguuugaauaaaggaaaacaggauuaaaaaacaaaaacaaaacacaaaauggcagcacagauugaacugaacuguagggguuuucaaauguauuuaaguuggacacacaguaugaagucuuggguucaaucacauuauugcuacaguaacaaguauuuaugcuauuaucugucucacaaaauauugauuuccaucuuugaauuaagaauauugauaccugggaggagaggauauauggggcuuuggggauagcauuugaaauguacaugaagaaaauaucuaauaaaaaaugccuuaaaauauugauaccuuauaacuuuuaaaaaaaccaacaauuguuauauauaaaauuacugcuacaacaagaauugauugagaucccagguguacugaaacuaagcaacuuuagaacagugaaggaauacacugguuguguaucucgggucacuuuucacacaguaauuaagugccuuguuaaagaacuuaucuuuucucuuacaucuuccccucucucuccauguggucauggcuggacccacuucucuauucucucccuuucucugccucuacuacucucuuaacuccccuccccaugcccuaaauaaacucuauucuauacuaaaaaacaaaacaaaacaaaacaaaacaaaacaaaacaaacucaucugguucuccaacaaaaaugcagcuuccacccuccuuaaugcuuucaaaaugcaaguaagcaaaagcgaccuagagauucccaaccggaugucaaacaccaucugucacagaaauagacaaguucaccuuaaaacugauuuggaaacacaaaaggccucagacagccaaaacaauccucagaaaacaaaacaaaacaaaaaaaacaaugcuagaaguaucaauauccccgauuuccuguaguuauacuacagguacuguaacagaaacaguuuggcacuagcacaaaagcagccagguaaaucagugcgauguaaaccuauacagcuauuguccucugacuucuaacaggaugccaaaaguuucacuuuuuuaacucccaaaaauuuaaaggaaaaaaaacccagccucuucaacaaacagaaccaggaaaauuuaaugucuacacaaagaaagaugaaacuaugucuccccaugcacaaaaucaaguccaaauggaucaugaccuuagcuuaagacgugagacucuagaacuggcagaggcaagggcugcuggaacagaacucuacacacucacuacuguacaacgguaaaacacuguagaaugagaagaaaauuucauggcaaaggaacucguuaaucaaaugaagggagaagcuacagaaggaaugaaaaucuuuacuagcuacaaacuagcaggacagauaaauaccuggaauacacacagaacuuuuaaaaauuuaacaaaaacaaacaagacaacucaaucaaagcauggcuauagaacugauaaaauucuuaaaagaagaagagcucuaaccaucugggaagcucaacuacaaugaggcucgucucaccccaguccaaauggcuauuauccagagaacaaaugcuagcauggcgacugggaagggaacacuuauucacuacugaugacaguguaaacuggugcagucaccauggaaucacuguggagcacacucagaaaagcuagaaguacaacacagcauaagcccaaaggacgcccaacacaccagagacuccugcacauccaugcuugcugcuguucuguucacaauagccaggaaacagaaucagccuaaacgucccucaagagaacagauuuauguaaauauaugguaaaauacacaauagaacuuaaugaaaacaagaaaaauggacgcauguugucuuucauaugcagacucuaucuuuuaauuuuucuguaugugcauuuguguagaagccaggaaaccagaaaggggcccaugugagacauaaaaagaaacuucacaggagagcaggaagggugguagagcacagaagauacgaaaguaaaaaggaaacucccaggaacgggaggcugugggggcuggggcaggaagcuguaaaaaggggacaucaaucaaaaaccaaguagguaugaauaauggauaaggaaaccuaaucuuuugugagcuaauuaaauacaacucuuugaguuuugguuuuguggagucuuuugguuuuauuuuguuuuuguuuuguuuaacaggauuucacuauauaacccuggcuggccuaggacuggcuacauggaccaggauggccuugaacuaagucacgaggaucugccugccucugccuugcaagugcugggguaaguguacaccaccucaucuggcccuacauagaaaagcagagcuagugagauggcuccgaguagggguucucguuacauacauacauacauacauacauacauauaaauguaauuuuuuaaaagauaaagauaguucauggugaaaagggcucaaugaucaauuaaaaauguagacuggcaagauagcuaaguggguaaaucaccugcugaaacccugaccaucuacauucaaucucuaggucccaugugguacuagacugaagucccucaaguucuccucuggccuccauacacaggauauggcacaaaugcacacaugcacacucucacgcacacacagacuaaauugcagaaauucuauuauuuugaaauuuuucauauuugaucauacacauuccugucccccaacucaucccagaaccuuccccgcacccacccagaccauggaguuguuucuguguugugcaucuacuccugaggacacagccugccuuggagugcaacuugacagacuuaguguucccagcaaguaucaagugcacagcuucucggucaggaguggggugguguguccacaucuaccucuccauguuagaauccugucuggcacaaaccucugcaggucuugggcacacugucagucucugugagguuguauaugcaauaaaaauucuuuuucuuaacccaggcaagggagugcccacagcccacagcuuacaacucacucagucacagucuccggugcuuacaggucuagccguggacaaaagaaaagagugcccuguccagguugucucaggugauguguuugcccaguacacuuuguauuucugucuacugcagaugcaaaguacacacacacacacacacacacacacacacacacacgaauccucucaggaagcuuugcuucucucuucaguugucuuucacuguaauguauaacccuggcaucuuagcaaauccaccacaacccacacaggcugcuuuuuuuuuuuuuuuuugguuuuucgagucaggguuucucuguguagcccuggcuguccucgaacucggaaaucugccugccucugagagugcaccaccacgccaggcucaggcugcucuggcuggguaagaaaggaguagaucugugagaugauagacucagccaaacgagagauuuauacauuguuauuuucguaaggcugcucuucuuuuuuuuuuuuuuuuaaagauuuauuuauuuauuauauguaaguacacugugacacuccagaagagggagucagaucucguuaccgaugguugugagccaccauugugguugcugggauuugaacuccagaccuuuggaagagcagucgggugcucuuacccacugagccaucucaccagcccccaaggcugcucuucuuaaaccuuacgaaaaauaacaauguauaaaucucucguuuggcugagucuaucaucucacagaucuacuccuucuguacccagccagaacucaaacaauccauuugcacagaccaucaccauucaucuccacugagacuguccuuccgguuuaccuuaauuucguucuguauagagacccaauccagccuucuuaucaaccuaguacacacaagcaccgaguauauguaaacugcugacacaacaaaugaauggcuucauauuuacuuauucuuuuggaggcagggccucacucacuauguaguucuggcugaccaggaacucacuauggagaggagcucuagccuugaacucgauccuucagccuccgacgaucuucaaggcaaagguugucaccaccacacacaguccaaguuuaugagcaccuugcugagcaccagacagccgucaccaacagaagcaaacguccugagcugccaugaaccaggugcucuacugcaugcuuuaaaugcauuaguuauguuagacccaugaggccagaaguucuguuuccuuuucagcacucagacugaaacaguuuacugaaaaaguacaaaauccagggggugaagagauggcucagugguuaagagcccuaacugcccuucccaaaguccugaaaucagaccacaugauggcucacaaccaucuguaauaggaucugaugcccuuuucuggugugucugaagacaacuauaccauucuuauuaaauaaauaaaucauuuuucaaaagggaacaaaaucacagaaucagugaacagcagaggcaagacuuaccuguucacuaugcuuuucaagaaaagcaaugcagcucguaaaccaggggcuuaccuuaaaaaucggcgcacaccuuuaaucccagcacucgggaggcagaggcagguggauuucugaguucgaggcuagccuggucuacagagugaguuccaggacagccaggguuauacugagaaacccugucucaaaaaaccaaccccaccucaaaaaaaauucacaacacagcuaaagaaggauguccaggccacuugucaaucauggggugugaacauggcugaaagacagggaagccagagccucauguugaccuguuuccuguucugcaguguuaaauguuaccaagcuuguccugaucaccacugucuuccaacagcuggucaccaccucugcaugucagucuguucacauguauuacuacuauuuuauacuugauuacuuauuacaagccuauuucugcucuguccuauaaauaucuaaacaguagggacccuauuuucagcauaucuacaggcuugucuucaucuuuaucaagccuuguuaauuuuaacucuuacuccagguuuguggugcauaacagguaaucaacccgugaacccucuucuuugcuuuuagucuccaccacaaccacuccuaggccacacucucuagguaccuuggucaaugccauuaccaugguacucuuucccacucuccaacuggcuaugcugcauauggauauccauucucucacuuuccuauuaagaguaacaaaggcuugcuauuaccuacagaguuuagaauugcuaugaaggcucccucauaccuaaguccauucuuacuucugucagguuccauuacaauccccuaaagucucaguaacacugagcuaucauaaugccccugccaaagaccaaacaaauucauacucuuccuaaacuaccuuagccauuuaccaccuucagugguauuuuccuccaacugucucucaacuucuuacuaaucuuaaaggacuagcacauacuauuuccuugauguguguguuuucuugagucagaacuaccccucgguucccccauauaugaucucaaucuucauucaaaacacuuaauccagagguuuuugcauaaugacugcucucuacccuaccccacuguacuuuuuaaauauuaaccuggauguguuuccugaauuucuacugcauucagaaagcugacgaggaaguguaaguaagacaaccacgaaaaaguauugcugcucaggcuaugaauguaagccugcaauguaucacaaacacaguaagcugauagcaugcugcuuaccuacaugcccuucucucugcucacaccuuccucugugagcacaaccgacugaaacuaggaggaagaaacccuucaaacuuuguuucugaaaucagugucuauguauacauaugcauguggguuugugcacuugaaucagugccugagaaggccagaagagggugcagaaacccauggaacuggaguuacaaggccuuccugagcugcugucaugggugcugggacugaaguggggaccucuacaagggcaguaacuuaacugccuuaacuuaaucuucauagcuccagccccagaccaccacaaccacuaccaccacuucuuucucuuccucuucuuuccuuccuccuccuccucuuucuccuccucuuccuucuucuccuauuuaauuuuaucaaagcuagacaggaaccuuucuuuucuacucuucauaaaaaauagucuuuaaagccagguaguggcacaccuuuagucccagugcucagugcagaagcagacagaugucugugagucugaggcuagccuggucuacagagugaguuccaggacagcccaaggguugauagagaaaccuugucuugaaaaacaaaacauaaaaaacaaaaacaaaaagccuuaaguccauaauaagcucaaaaggaacacuuugaggguauaacaggcagaaaaauugaggaauagaacaaagacuaaaagauuugccaauucuucuagaaucacugucaaauagugguaucaauauuuuguucgaagaguuaaaaauaucauaugaaugaguuauaacaaaaaauuuucaaauguuauucucucucacacuuugaguuaacaguuucucuacugccucugugucuaucaguaugcauaauuuaaaacuugacugaaauuccugagcugaaauuacauucauaaaauaaaauuauuuuuagaaacuucucaccaaucauaaaaacauaaaguaaggauaaacccuuaaugucuccuaaacaauggccauguacauaacacaauauuagccuuuuuuaaugaaauguguucaaauucuauuuuuaaauuuaaaaauugacagguuaccgaucagauaaauuguccuuauaaauuauguuuauuuuuaugaauaaaaauuuaaauaaaaaacuaaaucagauaauuacauauauucuuucaugcaauaaaacaaauuuccuuuaagccuuauuuucuaggcaggaaaaaaaaagcccaucauauccaaguccucacuuuccucagcaggccagggacaaugagagggcagaauccgagcagugcccucacacacaccacacuccaccagauccucuauucuuugucaucuguccaaagaggaaacaacacuaaacuuguccuuucauuagaaaacuugucaaugacaguuuuccuagaaaacugagacccuggauucaaauuuuaccuguucuguucuuaaauaaacacagcucaaagaaaagucuacuuaaaguaacauaaacagaugaacauaaaucucuucaaggaaauugcagaguggcgagugaacuagucuauucaccggggugcugcagcaggauugcuucucaaaugcauuguuaggcugaagaugcuacaguuaagagguaccucuuaugugccauuuuagaaauggcagaacuagagacagaaaaccauucauuucuucacacguaucuagcuuugaaauauucccuacccuuaagucaguaguaugcaccauuauuggcaugaucaaaauguaacgacgacacauuauuuuguaagaggcagugacacacaaaaaagauaccuggaauuuagaacuuacaagccagacaucauuacaacaguuaaacaaacaaacaacaaaacccaguaagaaaaggaaguguaaggacaaaguaauaacgcuguguguguguguguguguguguguguguguguguguguguguguguguguguguaaaaaugucacaaugguuuguagacuuuaucaaaaugauuuuuagaaguggaaaaaaaacaaaacaaaaacccugacaauacacaaagacacagaucaagaggaauucucacacuguugguggaaagacgcauuagucagacuacuuugcaaaagcuaucucagauuucucauaaagcaaguuaccuacaauuuggcuaucuuguuccugaauauuuacccaagugaaaggaaaacuuccauuuacagaaaacuuugcacauauaaauguugauacugguuacauuuguaauuguggaagcuuacccuucaauuagggagugggcuagcauacugguuugaucaucuauacccucagcaauaaaaaggacuguucuccaaaacaugcaacaagaaugaaucuugaauucauuauucagagcaaaugcuggcagacuuagaaggcuacauauuaugauuucauuuauacaccacucuagaaacggcaaagguauaggcagaaaaccaucagugguugccaggcuagacagaaagggcucuauaccaaggaacagaacgacggacugcacauauuuguaaaaccucacagaucucuguaccaaaaggguuaaacauagaaggaaaaagaugagaaguccuggcuauaaacagaugagaaugaaaaaauguacaauugucacaucauaaaugacuggugaaaaguuucauauuuuagcccuaaagcuauguuccaaaugauuuuaaggaagagacagagccaagucaggacugucugagaaagacaguuacacacagggagcaccugggaggcaacugccaaccaccgugggaacuccagagauaaacuuuauuaagacccaacuaaggggggaugcagcggagacaacaagaaaaggauaaagauuagaaauccucagguuuauggcaacaggggaagcacuaagcuaacugcuucugagaaaagcuuucaaacaagcuaaauuuaaugacuauggaacacucaacugcaaacaucuugggaacuguaucuaacuguagcucaagggaauauaugagacauaaaauuagauuuaaggcucaagguauuuguagccaugaaaauuuaagguugaaauccuucauagaugggauacauagaaugaaagcucuagaggacucugacaaucauaagcaauaacagcacuauggagccaaauaaacaaguugaauauacaacuauagaguucagcuuucucuuggaaaucucugguuuuauguuugguuugacaacccuggcaaauaggcaauaggacaagcuuuucccuucugcuuuugguauugcuagcacugaguucagcaaagugaagaauaauguacuggacacuuacuuuuuguuaaucaaacacaggaaggucaacaaaaggauucaaaaacaaaccaaaacaagacccacaagucaacuuaccugaggaguccaauaucuugguaacuggacagaagacccuauagcuguuuaaaggacucucuaauaucucaguacaguaucagaaaauaauaugacuuuagagaauuaguucuuaacuagagauaugcaccaaaauucccugugguggaccuuucucaaaauaccuacaugauuaccaaagcucuauuucuaaaacuucugauuaaguacaggggaacgccagggccaaaaaaaugggaaugggagguggggggaggguaugggggacuuuugggauagcauuggaaauauaauugaggaaaauauguaauaaaaaauauuaaaaaaaagaauauuuuggugccaggugugguguugcacgccuuuaaucccagcacucaggaggcagaggcaggcgaauuucugaguuugaggccagccuggucuacagagugaguuccaggacagccagggcuauagagaaacccugucucgaaaaaccaaaaaaaaaaaaaaaaaaaaaaaagaagaagaagaauauuuugguuaaggcccaaacuguauauguaguagcccaauaagugacucuaauguacauuuaccauaagggcacugaaccaaagcugguuccacaaucaaccagagaguguucacucugaagcuuccacaccacgcacuaaccuccucuagaaagcucggaaucaagagcacagaagcauccacuuuccaaguaauaccucaaauccuacagcccaagcccuucaagacaccuaacaagccccuuacugacuugacuaaacaaauuguacaagaucuagcuucucggcagaauuuacagaaaagugagucacucuacugcuuaaaccucaacucgcaguuuuaauaaugacccugccagaaagacuguuaaaaucaugagcuaaagcuuuaguucaacuaguacuuaaccagaaccagaaccaauaccguaauauuuagagucuauuuuucuaaaaccaagauuuucaagauuacaacuucccaauuauagcauacacauguaugaaucacuucaaauguaaauauccaggaauagaaaugguuaugccaaccaaaauuuacacuuacccaucucuucccuuacugacaauuuuuacuucaaaauaauaaaucccacaggccgcugguauuggaugcguggcucgaacagaugcugcaucuuuggggguuuuaccaugaccugcccgugaaaaagaacaaaccacaaaugaaauuuucaaaugaaaaucuuaauucgagaaaauaaggcacuuggaugaaguuuaauucuguuaucaucauuucaaguaacugaaagacacagugaaacauuuaccauuacaacaaacccaauaugaaaaauagcugaagcugcccaaagaacucuucauacuaucacgggcuauauuaagaguucagaaucuguccaggccguggaguauacaccuuuaauccuagaaguugggaggcagaggcaggcagaucucugugaguuccaggccagccuggucuacagaguaaguucuagaacagccagagcuacacagagaaacccugucuugaaaaacaaaagagaaucugaacauacugauucugguagcggcccuuaacgaaaauuaaaguucuggguuugcuuuaaagauuuuuaaaaaauauuuacuuauugugugaguguuuacguguaugugugccaccugugugccugcugccaaaggccagaagcagguguugggucccuuggaacugcaguuauagguuacugugaaguugccauguggguacugggaaucaaacucaaguccucugcaaagacuacugagcuaucucucugguccccaaauuaaagaaauuuaagguuacguuuuaaguuauuccugauuggaagcacaugagauaaugaucuuaauuuuaucagaucuagaucugcauuuaauuuguagcauuucuauacauucuucugcaaaguggaccgcuuuuuaaacuggagauauuuguaugaucauauaauuuuaaauaaacuauauuaacagauacaacucauuaagaauuuauaauuccauuauuugauauauucuuagaauuucugaauagagacugacccacaauucuugagucaagauagucuacaggaaaguacagcuuuuuauuuuuuucugauuuuaagaaauaacauagccaggcagugguggcgcaugccuuuaaucccagcacuugggaggcagaggcagggggauuucugaguucgaggccagccugcucugcucuacagagaguuccaggacagccagggcuauacaaagaaacccugucuugaaaaaacaaaagaaaugaaacgaaaagaagagaaaagaaaaaaaaagaaaagaaaagaaaagaaaagaaaagaaaaggaaaggaaaggaaaggaaaggaaaggaaaggaaaggaaaggaaaggaaaggaaaggaaagaaaagaaaaggacacaaugcuguuaacauuacggaccaccuguugagcaauggcuuuuaaacuuucuuuaaaaaaaaaaaaaagauuuauuuuauguaugugaguacacuguagcuguacagaugguugugagccaccauguggcugcugggauuugaacucaggaccuucggaagagcaguuggugcucuuuauccucugaaccaucuugccagcccgcuuuuaaacuuucuaaacuugucauuccucaucucuaaucccaaugcuuuccaucauucacagucaccuuacuuuauuuacuaauuauucacuccuucuccaagauugaaaugauccugaaagcugaggugggcaagcaugagcauguuaaacuauguccagaagcgugcaaaggaagcagacagagaagggacugagcagugaugggcaaacaccugcucuugcagagacacaaggacucacagacagacacuuacacacaaacaugcccauauauaccuaauuaaaaaccaaaauacaaaauuaaaaagaaaaaaaaacuacaaaaaaauaggcaggacucagcaguagcucgucaaaaauacucagaaugugagugaaucagaucuccaucccccaggagugcuugagaaaacucucccccacuaugcaagugacguaaagagauaugugucacacaguacagcugucauuuaccauccuuuacggacaguagaguucuccaacucaccacaguugcucuaaaacuaaauacugcuuucaaguuaaaaauuauaucuuauaacauacaacacacacaaaugagguaugacucuuagcauucacuuuaccaaauuacuaauauaugccuuaucauuuaaagagccauguuuaccacugcaaugccaaguaaguacuacaugcucacuggcucaaaagaaacugaacugaguggauucagucaggcuacuccuuuuuuuaugaugcuggugguggugacaggaaucaaagcaggaccuaaauaugccuuuccauuccuuucuauuaacauuaaaaccaauuuucuuauuucuguaugcuugugugauguauauguagaaggggaauauguaugugccacaacacacauguggugaucagaggacaacauccaggacucaguucuccccuuccacugugaauccuaaaaacugaacucagcuuaucagacuuucugagccauuucaccagcccuccaugaaaauuuuugauaaaggcaaaaguaagacucagcccuaugagagucaaugaagucagcuaggaagaaaaaaaauaguauguacuuuaccaacugagcuauguaucuccccaaccguaauacacacaguaaguacugaauaaacagacauuuauugaauugcaguaacgaugaaauagcuuuucaguaaaaauaucuucaaauaauuagguuaccucgugcaguauucaugcaaacuaaaugcacauuuacaaauuagacagccauaguugggccuccucccuaugagcuauuggccagcaaggccucuauggccccuaaaacaauuauuugccauugcuuuuaguugccuaucaaaccuagaugguuaagacuaucaccacagacaagcuuuaguuauagcacagagacacaaagcuagagcugagcuggacacuucuucccuacuggucauagucccaaaaggugcugugcaggcugcugggggacagaguccuccucaccuguggacacuguaugauacucuaguacugaccugccaggcaccuugugccuaguggugaaauaaacaguaguggcaucaucaaccacacacacuuuuugauuggaggucuacucauaccugauucuauaaaccuggccgaaagcccauggcugagaaggacaccgguucuagugggaaaacuacuacuguuguuuugcuaacuggaccaugaugugucuguaaacuggcuucuaaguuuuuauguuuaugcccauagacuagugcugcugucagcuucggucaagaauuaagaguaaguaaucacugaauguucaaccggaauggaaaucuaugcuaccuucuccaaggcucaaggaacaucacagaagagauauggaaagaagguuaagagcuagaggaaggaguggacuacuaugaaauugcuguguucuaagcauggcacagcaaacaggauuaccuacacaagcuugggucugucaacauuguguuucauaggaaagagcuacaugcaguuaaugguuauuaggugagggagagacauuuuucuucagagguguagccauugagaagauguucuugcuccuguaaagaacccaucacccaagcuguguaaguaacccuaaugaaacucacugguuuaaacacacacacacacacacacacacacacacacacacacacacacacacacagaggcaggcgguaaagggcauuaguuggaagaaggaagaaagggagauagugggcguagaacaagggagaaaacccugacuacacauucuaaguggaauucuaaaucaauuauuuuauuauuggguuuuuauaauaaacaguaaauuuuggcagugaccaaaacuuauuuuaauauaccaaaaauuuuauucuaacaaaaauucuaguaauaccacaacuucuaggaauaaucucaagauauacuuaagaaauaacaguuaucuaguacuguaaaaaaaaaacaaaacaaaacacuguuuuaagaacauuguauuuaguaacuuguuuaauauucaaaacaauccaauggaaaaguauuacgcagccucacuucacaacacagaaaacaaagcgagagaaaccaugucuauuuuagaacccugaugauuugggguucugaagccaggauacgugcuacaguuuaaauucaagaagcccgauccagcaagagcucugacuccacaugaaagauuauggacaugaagaauucugggcaucacuucaccucuaugcccaucuaauucuucaaggcagaaggaauucuagaaggcauacaacuucucaaagugguagguacuuuuguauggaauuuucucauucaacacugguaacaaaggauuuaucuaucaucauuuuuuuaaaugaaacuuuuacagagaugaugauaugauuuguuccaaauugguagacuuauguuaaaucuaugcaauuaaaaucccaugucuucauuuugcaaaauaccuguaaguucuucacaauuuuaaaucuuuuaaaaagccuuuguuauguguuccuaaaacauuauagacuagaucuguaagugugaaaauuaaaaugacuugauucguuauuaaauuuaaaaguuacagguggccuaacauguacaauguucucuaggucaaugguucucaaccuuccucaugcuauucaucauauuguuguggccuucaaccauaaaauuauuuuguugccacucuauaacuguaauuaugcuacuguuacgaaucauaguguaaauaucuugauaugugaccccugugaacacaccccuagcaguuucaacccacagguugagaaccacugcucuaggucaauccccaguuccauuaaaaacaaauagaauaaauggauggaucuggaagauaucauccuaagggagguaacccaaucagaaaagaagacacaugguaugcacucacugauaaguggauauuagcccagaagcucagaauacccaagauacaaauugcaaaacacaugaaacucaagaugaaggaagaccaaaguauggauacuucaauccuucuuagaagugggaacaaaauacccauggaaggaguuauagagacaaagugugacacagagacggaaggaauguccaucuagaaacugccccaccuuaggauacaucccaucaacaaccaccaaacccagacacuauugcagauaccaacaagagccugcugacaggaggcugauauagcuugucuccugagaggcucugccagugccugacuaauacagaaguagaugcucacagagcacagaguccccaaugaaggagcuagagaaaguacccaaggagcugaagggguuugcagccccagcccccuaggaggaacaacaauaugaaccaaccaguaaccccuugaguucccugggacuaaaccaccaaacaaagaaaacauguggagggacccguggcucuagcugcuuauguagcagaggauggccuaguaugccccaguauagaggaaugccuggaccaggaagcgggaguggguggguucgggagcaggaggaggggggauaggauagggcauuuucagaggggaagcuaggaaaggggauagcauuugaaauguaaauaaagaaaauaucuaauuaaaaaaaaaaaaaauagagccgggcgugguggugcacgccuuuaaucccagcacuugggaggcagaggcaggcggauuucugaguuugaggccagccuggucuacaaagugaguuccaggacauccaggacuuuacagagaaacccugucucgaaaaaccaaaaaaaaaaaaaaagaauuugggaaguguugggagugugacucagcuuauagagcaaaugccuagcauguucaaagccccaggcucaauucccagcacaggaaauaaugauauaaauaagcaacaacaaaaauacaacuuugaaaaaaaaauagugcuaucucuuagacaaagcaaguaagaucagauacacugagccugucucuaauuuugcucaucagauacaaauuauuuuaaagucuguaguuuuuuuuaaaaaggagagaagagaggagucaugcccagaaguacagguuugucauuucacugaggcaggaagguggaaauucauugcuuagccuagaaacugaauccaaguucaaccugggcuaguuggugagauccuaucucaaaauaaaauguaaaaggaggcuagggauauagugguauccugacacaggcaagaaggcucuaaagucaaucccuacuggggggugacauccaaacagaaccauagauacccacacucugaguauggcuucaugaaucucacuuuaaaucuuuuuuuuuuuuuuuuuaauguugggaaacagggggaugugucauguaucagagaauaacuuuauagagucauucuuuccuuccacuucuguguagguucuagggaucuaacccuggucuucagguuucauagcauguguuuuuaccuacuucaugcugauucccaauuuuaaaucuuuuucagacaggaucucucuauguuaacuguggcuguccuggaucucaauauauauauauauauaaaccaggauaaccucacacuagagauccaccugccucugccucucaaguaccacuaaaccuugcuagacuuaaaucuuuguaacugcaaagcccucaaugcuaauuagauguuuauauaaaucuacaagaaaauuacuuuaagggggcuggagagauggcucagugguuaagagcgccgacugcucuucuaaaagucccgaguucaaaucccacaaccacaugguggcucacaaucaucuguaacgaaaccugaugcccucuucuggagugucugaagacagcuacaguguacucacauaauagauaaaucuuuaaaaaaaaaaaaaagaaaauuacuuuaaauuacauuacuuuaaaacucuaaagcuagcaagacuagcucuuguuagacuguauucaacaaucuguugauuccauuuaccugaaaggggaaaaguugaauaaaacccacuccuaucuacucuucaacagccagccagccagccagccaguuaauaccuuucugggaagaguuaagucugccuucucacacaaucccuuaagcaauaccacugaaacacucccuccgaagccuccccuagccuagaagacauagugcugcagcucuugcuggcccugucuucuggaugcucccuuuccuuuccuguuccagccacagugugugugcugcuccuguaacuggaaagcuguccuuccuuagggugcucagguccuccccacacuugacugcagaggaacuucaauccagcaacauggcugcucuggcaaggaaucacauccagagacccuguaggccuauaaaaucuggccacacacaucauagauuacaguaugaucuggcuggaauacagacacacccuuacaauacagacuucccuaacaaugaagguaagguuaguuugcagaaggaagcagccauguuuuaaggugaugccuaauugaaaggcagacaaagugacaaaucagagaaggauuugacagaaugagucagagacaggauauucucacaaaaacagcacaggaaagaggcuacuuaagagcagugcagggagaaaaaggagggggggggcaguuuuacacagacaguuuuacagagacagguugcagagagaacaagguagacacaggugaaaacauaaugccagagaauaauaagccagaagauuagaacauauugccaagcaaaauuaauaugagaccaagcagagcaauucagucagaagccaagagaaggcagauugaaucagucaucuuaaaagaucagacuguacagaggcuagaagcuucaaggccuaggccuaggaauaauuagaacagagaaagaaauguucuggccucggcccaaacuguguaugcauacaguuuggguaaggcucccaucucaaccuucauuugaggacauaaaagugacauuuacacuuuagaccuuggcucaagcuuaucugucuccaacauuggcuaacuucugacuuggucuuaccucauuuuuacacacucuuccagcagcaugugucucucuuauaugacacuagcaugcuaguucuuauuugugauuaucauaagcuuucuacuccaaauuaaagcacaccuucccaggccuacauucuagauucuggcaccuaccugcaacuauuccaccucagaaauacuaaauucuaaccaggccuguucugcuacgacaaaauauauuccuuaaauacaaauuaguucacuugcauuaaauaugggaauggugcuagcauaauaugccaccuacuauguaucaguuuucucaauaacugauacauuuuuaaaagcuuagcaauauacaacaaaggccuugaagagaaagagcugggauucuuacagaagaauaucccuguggugcacagcauuucaggaaccacuaagcaugccacuguguuaagacaucaccaucagggcaauacagcaacggucacagguuagaggugcuaguaagguuuccucuaugaguacagauucacccaccucacuuccaccacacauguacaacaguaugagaagcuaaaaguaugagaaaauuagcccacagucccucaagauagacuuuuaccaaguaaaguucaggauacaguuugaguuugcuuugcucuuaccuagacuccauuagugucuaaagauacugaggucacacuuuccccuccucccuaagguuauuucaaacauguguuauccaguuaagauuauuuuaucaagcuggguagagugcuuuaaaucuucaaucgcagcauucaggaggcagaggcaaagaauccugaguucaaaguuauuuucagcuucauagugaguucaaggccagccugggcuauaugagacccuaucacaguaguucucaaccuucccauuguugugacccuuuaauaugguuugcucaugugguggugaccccaaacccuaaaaucauuucauugcuucuuuauaacucuaauugugcuaguuauaaauuauaaggcaggagcugggcggugguguugcacaccuuuaaucccagcacuugagaggcagaggcagguggauuucugaguucgaggccaguuuggucuauagagugaguuccaggacagccagggcuauacagagaaacccugucucaaaaaaauaaauaaauaaaauuuauaaggcaggauaucuaacaugcaaucccugugaaaggguuguuucacacacacacacacacacacacaccugcaaagggguggcaacccacagguuaagaaccacugcccuuucagaaagaacaggagagaagugauugguggagaaggaaguuggggaaggagaaugaaaggggguggaaagaaccuagacuauuuuaucaaacugggccuggugguguuggccugucgcccuggcuacucaagguguugaagucauugcaaaaucaaugacuacuugggcaacuuauauagacccugucucaaaacaaaaauuaaaacaggcuagggauauagcacagugauaaaacauuuauccagaaugcacugaaacucuaaugcaaaguaaaucgcauucuucauucuacccuggaauuuuugucugucuccuaaaaugauuuguguucauuacgggucuuaguauugccuaagucacaguaaguaccacgucuccacaaccacaguaccgaacaagauauucucauuguccuaaaaauaccuuccaugcuuaaucuauuugauaccauuucuugaaugaccacuuuuuuucacugucuccacaguuuugcccuuuguacuaaguccuuuuagacagguugccuucacuuaggaauauguaguucaaauugauacaugucugcuugaccugaugacucauuucauuagucacugauaauaucccacaaaaucaaacuuaagucucuugaucucaucaccaauuauugagagguaucuuggucacuaccacuuuuuaaagaccauaaguaaaucuacugcagauacugaugcagggcagagguguagcucaguuauagucuugucuccaaagccccauuuggagggacaaaauuaguucagaugcaaguuucugugagguuuaaguaagagcauacuuggcgauacagcugcuggggaguaggguaaaaauauauuuggcuuugucagaaacugccaaaccauuuccaaaguggcuguaucauuuuguauccccacuaacaauaaugcaaguuccuguuguuagguguccucagcagcaacuggcacacugucaggcuaucauuacaguuuagccaaucuaaugcauguguaguuccuuuuuuuuuuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuuuuuuaaccaggucaagcacuuacaccuugaagcaggaagcagaaucuaaggcugcaaucagccacaugcaauacuggcaaaaauaccaguggagacugaaguaggcuuguagaccauuaggacugugauagcugcagugcucugcugcaguguuaaaacguuccacacucuuaaguaacuacccccagccccaggcuuccagaguucuguuauuuuuaacacacagcuguguggaaaacagaguuuucucagcaaugcauuuguggcacaggagcaggaauguaugccuguugucgucccccuuuaacuuuaacucucuaaaucuuuccuugggaguuuucccuucuucgaggacaagcuuacaugagaaucucuuacaaggccucaaaugcccuucaugugccuauccuucuaccacccauacaagcaaagccagggccagggccuuuccuuaggaucagucaccuucccugcuauggcccagaccucagccucuucugaaaagucuaacaauguagcaaaugaugacacugugaacuuagaacaucaccugcccuuucccagggcuaccuagauaucuuuagucaaccuguuucaauuacucuaaaaggcuugcccacauauuuauucuucauuggcagcaagcuuuuaaguucauuuugugaagaaaaauggaggccauuagauguggucauagucagcucuccacucugcuaccccaaaguggucuguguccacaccgaucuaugucuuccacuauuuuaagagggagagaaggaacucuccucucuaagaccaaucaccugugcuccaaaaacacucccacuggccuugaccccaucagcccucaagcuugcuuuaauuucaccucaagcuuuaugauguccccacaauaaacacauuguucucacaaagcugugccucuguuauaaaccauugcugcugucaguauuaucauuaagguugggaaugaauaacuugaacuaaaauuccagucucauacaguguuaacaucauuucaguuuuagccacaaacuaaguuaagcucaacuuagaaaugacauaacuguugucaccaugcuuucagauucuaagggaagucuugauuaugugggauuugcaucuaccuugaugacaucagaaucuagccuucaguuaaaaaugguaccaacuauccauuauuaaaaauagaaaacauuucuuuccauauccucucuacuugaaccccuccccccacuuauucuuuuaaucucugacacuugaguuuugcucccaucauggaauacaaacuccuuucccuaaggcuaccauggccucaguccaaccccaaggauaaacuuuccuggccuaaucaacuacacaccacugcaccaggagccucuuccuccucucucauucccuccgcucagcucccuugggcacuacucuucuuuccacucauccuccacaaaaucuugucuucuugggcccccaugugcucuucaugaugcaguaaguguucugccucugccacagcuuucucucuccacacaaacacucucaguucaacuaccaccccaaggugaguccuaaaacugugcuaacagacaccccucuucccaacccuuucccaggaggaagugccucacacugccccuaaugaagaaaguggggcucagacuauguuggucccacaguacugcauuuuauaucuacccucacuccgaacuaaaucaacacagguguuaugguuuugcuguaaacucgcccucacagguauauguguuugaaauuggucccuugcuguuagcucuauuugggaaggcuguggggccuuuaagagguagcauccauugagcuggaacccaugaguggcugggagugggucagaggccacagaagcucuccuuccagccuaacugcuuccugauccacagugacagacgcaaccagccucacucgacagcugccacccuggacaccucuaugccuuccccacuauggagggcuggggacccucucaagaguggacagaagaaaaccaauccuccuccacguugcuucuguccguuauuuuuugucacagugaugagaaaaguuacuagcaccccaccugaagcucaccaugcacacaguaacgacccaggaaaagcucuagccaauaaacugagaaguagcucaguagacaccauccuucccccagacuucaaaggagaggauaaacaagccauagggaaagacucaaaaucugcaacuguagccgagucucagcuacagaauaggcacagccuugugaguguccauguaaagaaccuugauuccaaaacaauuacuaugcuccuucuguaaggcucccccccuuccgcaucuccugguuuccaugaagaacgaagauuaaaauucacauuucugaggcuuggcaugggggcacaaaucuuuuaauuucagcauucagaaggccgagaggcaaguggaucucugaguucaaggccagccuggucuacauaacaaguuccaggccagcuaaggcuacacuucgacaaucuaucuuagaaacaaaagguucccauuuuuacuuauccucagggauauuaaaauacagugcuacagugcuaacaucuuccaaaaucuauuugacucaagacuuacuuuaagaacucaauagaucuaggaacccaauccuccuugauuucucucauuauuccucauaucucaguauuaccuucaaaaucucacagauauaucugcuuuucucuaccccuucccaucuaucuuucaaccaguuguguagucugacaaaaauaaaaaugaaaucucuggacgauucuccagcuccuauagaauaaggucucagcuuaauaaauguucauucacuaaggucccucccuucaugcuuccagacccaaccccuuggaacacugacugcccccccccaugcuuuugaucucccuuccuucacccaaucacacacuuuacucucgucguuuaagcuugaccacugaacuuaacuucuccaagaaacugcagauucucaaccuuuggggggccaaacuacccuuucacagggucaccuaagaccaugggaaaacagggauuuacauugcgaugcuaacaguagcaaaaugacacuuaugaaguagcaacugaaaucuuuguauggcuggagucaccacagcaugaggaacuggauuaaagguuaggacagugagaaguacugcaauccuuuccagggucagccugaguuagauacuaucuuccacuguacccuucuaacauuuuucuuaccauuccauuuuauguuccuugaguucugugaggucaaugacaguauuuuaaucaucuuuaaggccagaaaccaguaccaaguaaacaugucaaaaagggcugagugaaagaaugagcugaguaaacaaggcaugcauacaaacuuaccagaauuuucuacccuauacgcauuauuacuacuuacauuuuuuucugaguauaauuauuaaauauaaucaaagccaauuaucaaauuuuagcaaaaagaugcaagggaaaacucaguucacauuuaauuucuuucauuuucuuguuuugauacagaucauacucugaaggccaggcuggccuacaaaguccaccucuaccucccacauauccugagauuacagguauucaccaccaugcccaguauaaauucucugauuuuuaacauucucuuaaaucaccccuuuauagcuugagugugaguguaugagugugcauaggaaaugaggugucuuccucagucacucuucagucuuauuuuaugaucucucacugaauccggaacgggcuguaaucuggcugacaacuccccacaccuguguucauggggccagccucccucuggccucaaucacacacccacacacccuggaguuucgggcacagacugacacaaccugcuuuccugugugcgguggugaucggagcuccuauccucaugcuuguauaggaaccacuuuauccacuaagcaaucuucucagcacccgugcaaucuuuaacagaccuccuccuuguaagcaaaugauuguuaaauacucguucagccuucaggugugcuagaagaauggcucacugaauaggagugcugcuaaugacuccaauucccuaggaccaacaacaagaaagaaaaccaacuuuucaaguuguuccuugaccuccacaugugcaugccuauaacaugcaaccacacauaagccugcaugcacacacauacauaaaaaaagguaguaaggaaaaaaacuacaaaaauguucagugaugguauuuuuaguaaggguuaaaaaguaguaacugcugggacuuggggagauggcucagcaacugaagagagcuugacacucuuccaggaccagaguuugguucuuagcaccuauaccaagugggucacaacugccuguaacuccagcuccaggggaauccaauacccucuucuggacaccagggcacaugcacucagguguacauacgaccccugaccaagccaacuaaaaacaguaucuacuuauuaagauauuguuaaagaugcuucaguuaaaagguauaauucaccauuucaucacuuccuuggucuaccaagguucaauucuuugacaucuguccuaagcauuuuaaggcaggaguauaaagugcccaccuuuucugaagcauuacuaaaucucaguucaccuuuccccuaguuucagaaacacccuugaugucaagugucuuucagaaaugagauuaacguacacaaauggaaagauguaguaagaaugaaacaaagaucacaaaauuuggugacagcaaaaauuacauuucuuuaaaguuuuaaaaaauguacuuauuuuuuuguguguagaaguguucuccccacauucauguauguguuccuggugcccagagaggucagaagagggcaucagauucccuggaacuguaguuaaggauggcugugagccaccaugucagugcuaggaauuaaacccaaguccucuguaagcucaacaagugcucguaacagaugagcugacucuucagccccacaaaauuaauuuucaguccuagguaacuugugacuugaaaauucuaaccuucagguucgacacaccuucccaguuaacacacagacuuggguaggaucuguuagucucuguaaagcauccugauagaggggagggguuggggugggggggggggugagugaugaaauuggguauuaaaacauuaggcucaccaaauccaauaucauagucuuuaaauguuucuuuaauauucaucaaaaauaaaguuauuauuaagucuaaaccugucacuuuaaaaauuaauacugacaacuuuuuaaaauaagagggcuauccccaaguguaaggacacgugccaacaagccugaugaccuggauuagaucccuaggacccacauggaagaaagagaaaacccacucccacaagcuguccucugagcuccacaccuguaccaugccacacagacaggaacgaacacacacacacacacacacacacacaguguaaaaaggaaagaacucaacauacacuguucuauagauacugagacucuucuguaauucaaugcacuuuaucuagccaucuaucaauguuaacacagugccuucagaucacuaaagauaagcugcuucgauaaucagcauucccaauuuagaaaaacauuuuaaacacaggauguguucagaggaaaagaaauaaaugauaauucuuggaaacaaguaugaucaaccuuuuaaaauuuuauaacacagaaaaauacaaauaguaacuuuucauguuaaggaaacaagaacacaagaauacauuacauaaaacaucuccccuuaaauguguuuuauaaguuuuacuauucacuaccuacagcaccaccuuuugcugcugagacacacaggaaaaacagcaaugacagaaagcacagacuuuaaauaacaaggcuagaugaaggcuuggaaaagagacagucuuuguaauucuggaaagggagacaaagaggagagaaaaauggggagagggaugacaacagcgaaucuguccuccagaacccaugcucuauguuuaugaaacagcgagguuuccagaaagugaaucucaauguuacacaacacaguguaauaaaaaggccgacagaaagaguaacugcgacaacaguauccuaacauuggaaccccaagcacacaagcaugcauuuggcucuggcccagaugauucauuuuacauaaaagaaguaaacacgacuaagcaagguguaucacaaggcuaaguaagccauaaucacgaguuuuaagcgaaaauuccuuaccgaguacccagcuggacucccacaucacucagaagaggcugaggcccucucuugugacauaccuaguaucaccagugacugcuagaacucaggaaagcuaggauucuuuguucacuaaucuccccuacacacacagucucugccuuuacaagcuuuuuauuuacuauaaacuacaaauuuaaaauaauaaaguuuugucaaaucuaacaaaagcauucuggcugccaaaacagaaguaaacacuucauaacauagcacucacuguucacacaaauuuaaaaacaaaauuaaguaacaaucuacaaggaaagcaacaaaauguccuaacugaaaggaagaagaaaaaaaaaacuucaguauuuugaaauuuucagccacuuacaccaaggaacauaacguucaaaauaauaaguacuucuuuggaucuauggcaagaauaaaaaggaauguucaacaaggcccaucuuuguguagauucuuuacagccaaagcauucagcagauuucuguugccauaagcguuucuaauuaaauaguagccgauuugucaagagucuucgcaaacccuguucugaauucuuucagaaucuuacagcaagguuguuuauauccucacuaggagccaaagacccuuccuuuagagccaaucaaaaugagccugcuuagaauguaaaauccucugcuuuagauuuagggccuaaaacaccgacuguguucaaacugauaccacugcauuuuuuucuuugccccuuccacacagcuaaacuugacguaugccauuaaucugagcuacauuucaaaaaccccuuacuggcauuuauaaucuucuauacaaccaguuugcuuaaagcuuuguuuuaaccuaggaaaaaguggggaugggagaaagcagcagccuaaggugguuaacuuuguuaacugcaggugcaaaauauaagccaguuuugguuuuuuuuuuuuuguuuuuuguuuuugaaaaugcuaaucgguauguuuuaaaacccuuguuuucaacaaaacuucauguaacaccaacccggaaacacggggcauuuccaauccggagggggggggggucugcuccccgaagaaaacagggaauccugagguuccucucccaguugcuuucaguaaggugcaaugauggccaacuugggccccuuguccuuuugucccccuagacaaucucuggccuaauuugggacaaauccuccacugaucacgccucccucccccuccuguggaucucuguucucccuuaauuagaaacuguaccucggaaucgugccucucaccccugcugcguaagaggagauggccugacccuccaccuggagaacaauguaacccaacuccggcccauagauuuaucuccaggaaaucagaaggugcgaugugucuggucaucccggauucccucaaagcguccagcuccgggccuagggaucccagcuccuucccaccugggaccccacucucaccuucccucgcccagagccucgccccgcaccguccgaucucuccgccggaccccgcgccccguaccuuuguagugcacccgcagguuguucugcgagaggccgauguagcugaacuuguccuucgggcuccaggaccggggcagcggcgucuccugcucauccacagccggguagaggcgcuucagccgccucugcagcuccuucuccugcucguugagggccgagucgccgugcgggaaaggggcagcggcgcugcugcccgccgccaggcccgggaccgggacgccugcggccgggccggggcccaccgccaggccgggcggcgcgguggcgggggcggccgccgaggcggggggcggcggcgcggcgguggccgggggaggcggcggcggcggcggcggguggagcagcagggcggccgcugcggcccccaagccuccaccgggcgagccggccggggaggagccggcgcuggcggccgcggccgcgggcagggcgacuccggagcccggggccccggcggcgggcggcggcggcggcggcugcuguugcggcggcgguggcggcggcugcccggacaucccggccgcgacucagccugcggcaccuccacucgucccugcuuc

SEQ ID NO: 12212 - RNA, 2759 nt, Mus musculus
gucacgugaccgggcgucccgccucuuggcuuccagucccagaggugcuguuuggaguuagcuacgaggaccccagauucagucgguaaccccggcgcagcggagcuucgggcgcagcggcggucgcgcgggugagcaccgcagggcucugcggcgcgguggagggcgcuguccgcguccccgcgccgcggcucugcaaaggacggagcgccccgggccgaggcgccaggggccugcgaggugcgaggcccuugggguuggggucugaggcuugggcucugccugggccgcgcggacccugaagugggugaggcggcccagggagcaugagcgggcagcgcguggacguuaaggugguuaugcugggcaaggaauacgugggcaagacgagccugguggaacgauacgugcacgaccgcuucuugguggggcccuaucagaacgugagugcaccccugcggagcaggcaugggaggaagggguccggccaguauuccacacuuaucucuucccugguuguagaccaucggggcugcuuucguggccaaggugaugugcguuggagaccggacggugacucugggcauuuggguaagucccuugagaacagagucuugugcaaaccugucucccgaauuuaaugucuugccucuuaaaccagccaacuggagccucauagaggucguuuuuccuuccucacacccauuuacucgucuaaaaaaaggaggggggguugucuggaagauggggccuauuuuguagucuugugaaggagcuuauuaacuccuuucaccccucaggacacagcagguuccgagcgcuacgaagccaugagcagaaucuauuaccggggugcuaaagcugcaauugucuguuaugguaagggguugaauucuggcguguucaaguaguaaggguuagguuacaggccagcaucagagggaagccgcugaucuuuaugugucucuugccuuacccuuaccaagaccucacugacagcagcagcuuugagagagccaaguucuggguuaaggagcugcgcaguuuagaagagguagguggccagauaucacaagaguagggacagagacuguauuggucuguggagauaaucucagccuugucuucugcuacagggcugucaaaucuaccuguguggcacuaagagugaccugcuggaggaagacaggcggcgccgucguguagacuuccaugauguucaggacuaugccgauaguagcuguuuuuaagucucugaggaugggggcuugggggcggguacuaucugccugaguguauuucaaagaugggaaugacagucuugguugcuuucuggccuucuugaaccugugugguucaggagacugaacuguuagcuacauuuaggugugcuccccaagugugaagacagucacuucucuuugcagauaucaaagcccaacucuuugaaacauccagcaagacaggccaaagugugggugaguguugucuuggguccugucagcaggaacaggcaggacaguagagcagaaagguucagagggcugggccacugggauacccagggcugcuggucucaggcccucacugauucuuugcuugccagaugaacucuuccagaaaguggcugaggauuacgucaguguggcugcuuuccaggugaugacagguguguacuuccucaugguccccagccuucuuggugaccuacuugaugccccgacauaauaguagugcugagcagucaccucuccucucuuugacagaggacaaagguguggauuugagccagaaggcaaacccuuacuucuacagcuguugucaucacugagucaccacucaucuggcccaguggaauuagaugaauucccagaggggcuggaccugacucuugucugggcuggaauggucaagcgucugagcuauuccaggugccucucacagcagagguggcaccugccugugcuggcccauggaacggaggaaguauugggcugacugugggcaugaggaggaguaagggcugacuugaaucccaggcuucuguccagacuauuuaaguagcuucugaacuguaaauaaaauugaugcauuuccuugcugugugcacugggugucaaaacaccuaguuguuccuggggccacgugggccucacuuauaugaagacuuccaucuggaaccaaguaacaguuuccuaagacuaucacugaaaccauggauaaacaaugggcucuuuuucuuauggccuuuuuauuagugcuuacaugucugaguguagagcaaauaccagggcuucuaacauacuaggcaagaacuauaucacuuuuuuucuuuugugggggugaagauagguugaggcugggauggaaaaguacaaaguucaggagaagacgaaggaaagcaccucagcugugcccagagacaaaaggcuuggguacaucaaccucaagacgaguugguuaggccagcucuaccuguuguguuaugucugaaccugugcucaggggugugacucaguccuaagcuucccagugaaacccuauaauguacgcaacaagaggcaacuccaucuuucuauaacucaaaaaggucuuaugcauccaauuuaguugcuaacuuagaaaaaggccuugaagcuuccaaaccuuuacucacugcacucuagaggcagaggcagcagaucuccaaguuuaagaccagcauggucuacagacugauucccaguucagccaggacuacaccgugaaaacuauuguga

SEQ ID NO: 12213 - RNA, 6683 nt, Mus musculus
cugccagcgcccuuccgcugcagucaccggugagugcuguuggucugaagcaagccuagcgggaugaggcagccagggcucccgcaugccucccuucccacuaccuuggcuggcggaacugugggcaaggucaccacuccagcccuucgcgccccucuacagagagguuccaugguguugugcggauucagagcccgcagaggggagagacugcccggcuuggggagguuggucacugauggcuugccccgcaggacaccuggaguggcuucccuuggucuguaguaacucugccaccuucaagcugcuccgcuucuuguccugacuucuccuuccuuugcagaacugcugucuagagcccagcggcacuaccaugaaagucuggcuggcgagccuguuccucugcgccuugguggugaaaaacucugaagugaguggucucgcugcuuuagcaccaucaggaaggggcuugcaggaucccuuaagcagcaucaggggaaaaaugggggcugcacggggaacuuaggcaucaaaggcagguccaggcuuucccaggaaauaggacaauguaucagcggagggcuugugcacccaaagagguuugcacuaucuggcaagggaggaagaagccacggggagugccuuagcccaagggcaccugguuugugugaaguuugcuugagucaguccaugucugggugcuggcuaguaauaaacagaaaggggagagacagacagggguggggugggagaaagagagagagagagagagagagagagagagagagagagagagagagagaauauuaugagugaaugaauaucacuggaagggauuuugagguggggaccuguuuauccugaacaugaauucccuagagcaugucaccuucaucucuugcaggguggcaguguacuuggagcuccugaugaaugugaguaucugcuuccuugcacaauaguuggcugcacagagacccuugaaaaaccuuaggagacauacccucccugucccugcugaaaggcuggcuccccacuugauccuugcuuaccccuccuuugcauuugcuagcaaacuguggcugucagaacggagguguaugcguguccuacaaguacuucuccagaauucgccgaugcagcugcccaaggaaauuccagggggagcacugugagauagguauggggauuuggacuuggaaugugggagugggggaggaccagagaucuuagaacagggacagaugggugggaugcagaagcaggcagaagcuggccuuggaggugugggucuguuaccccagcacuuaggaggagacugaagccuggccuccauaguaaguccuugucucaaaaggcgggcgaggcgcagcuagagagacagcuuagugauuaagaacacuggcugcucuucuagacauccuauaguuugaguuucagcacccauagagguggguuacagccaucuguacccccagucccagagaaucugaugcccucuucugaccucuuccagcccaagugacauacaugguguacagauauacauggaggaaaaacacucauacacauaaaauaagcaaacaaacaaacaaaacaggcagcagaaguugggagucacacacacacacacacacacacacacacacacacacacacacucaugaaguaguggcuauacaagugugaaaaaaaagggugaaucucccucauaucaccugacaggucugaaaccgugucaccucugaaaugccuguccaaaccgccucccuuuucuaauacucugcacuccucaaaucauuucuagaugcaucaaaaaccugcuaucauggaaauggugacucuuaccgaggaaaggccaacacugauaccaaaggucggcccugccuggccuggaaugcgccugcuguccuucagaaacccuacaaugcccacagaccugaugcuauuagccuaggccuggggaaacacaauuacugcagguagguggugacugaguaccaagaauccuucccaagggggauagggagguggcucagcaguuaagagcacagacugccuuuccagagcaccuaguuugauucccagcaucuacagggcagcucgugacagucuuuaacaccuguucuagaggauccgauacccucuucuggccucacugggcaggcaugcacugucaugaauauaggaaaacacuuauacacauuaaaaacaacaacaucccuucccccaucguggccucuuagaaaccuuuguuaucaccaugguauaccugggaugggaauccuggcacaagaauccaggucucuggcugagccuuuguuggaagggagaauacagagaagacauucgggcuuggcaugacauucccuaucucuuuguguuaccaggaacccugacaaccagaagcgacccuggugcuaugugcagauuggccuaaggcaguuuguccaagaaugcauggugcaugacugcucucuuagugagugucgcugacugcuuaugacaacggggugggaagagacaaacucuauugucacugcaggagggaugagaagugaggugugccucagagacuucuucaucauugcugucucccccaaacaugugucucuuucuuuucuaggcaaaaagccuucuucgucuguagaccaacaaggcuuccaguguggccagaaggcucuaaggccccgcuuuaagauuguugggggagaauucacugagguggagaaccagcccugguucgcagccaucuaccagaagaacaagggaggaaguccucccuccuuuaaauguggugggagucucaucaguccuugcuggguggccagugccgcacacugcuucauguacguccaucccuuugucccuucucucugacucuuccacccaaccccaagacuguccuuccuccuucccuauggacgguuacaaugucauucuccugcuaacccucuaaccaugcagcuuguggucuuggguacaaguaauacuuugaggccucugggguggaguggagagagugaccggacuuugugagaccaggcugacauguuucauuucucacagucaacucccaaagaaggaaaacuacguugucuaccugggucagucgaaggagagcuccuauaauccuggagagaugaaguuugagguggagcagcucaucuugcacgaauacuacagggaagacagccuggccuaccauaaugauauuggugagcagaaagcuuaguuaccagaaaggcuaaaguaguggugggaaauguggggggacuugaagcccgggauuuauauaacgagauggaugaggaagagugcagaaugagauacaugagaagcugagggguguagggauccucuguggagaccuugaauuucccaaaaagauagauucuucuaaguagaaacaaucuuacaggcauacggcuuaggcugagaaugcccuguuuguacaaaguaggauggaugcuucuucucuguauaccagaauauagaauguauaaagcaaagccuuggcuggauuucagcucagcucccucagcaggaaacaaccuguucagcuguauaugguggauuuuguugccugaacaucugucaucugaugaaauaaagcauuuggagaauguggcaggggaggcuucaggguaacaagauaccagcagaccuuuuggaucucugugacucccaugccacgaguauagaucaaugcucagcauugguaggggagagaugaugaccaucugacacagugauaaccuuuccccuuugaccuuucccuuccccacccagccuugcugaagauacguaccagcacgggccaaugugcacagccauccagguccauacagaccaucugccugcccccaagguuuacugaugcuccguuugguucagacugugagaucacuggcuuuggaaaagagucugaaaguaagugacagaugaagcucacugagagagucugggggaguguuacgguccagaguaaagagcagacuaucaaaggaagacuguggaaacaggacuggaaacauuauggagggccagggauagaguagggggagaugggcaagcaagucaaacagggugugaacaauugugagugaaguaaaagacucagauuggagaaacaagaacaagagcuuuucauagcugggauauguuuuuuaucuucaccccugcagagagucucauuuauagacacaucuuaaugcaaacaucuguuucuuccaucuaggugacuaucucuauccaaagaaccugaaaauguccgucguaaagcuuguuucucaugaacaguguaugcagccccacuacuauggcucugaaauuaauuauaaaaugcugugugcugcggacccagaguggaaaacagauuccugcaagguaagacucucaagcaccccucuuuaucacccccaacuccccagagcucuuggauuugaucuaacaacccuggggagucucuuuccagccaacaaucuaagaaucaaggacuuaggucuuugggagcuugucccaauacuuauagguucaaacguugggcaugagucccugugcuauaugcguuuuagacuaaaagggaccaagacugcuaaaaaaaaauaacccagacaugguagagcauaccuauaaccuagcacucuuagcauuuugaaagcugagacaggaggaucaugaguuuaaggccagcccaaacuacagagugagaauucaaggccugugccacauagcaagauccuuucucaaauaaaacaaggaaagcacaaaccauaaaaaccaagacaauagcaacaaagggaugggugccuagcucagugguuuagugcuugcuuacuaugcucaaaguccugaguucaagucucaacucagggacuggagaucauaagaaaaacuaagagucuggggacguggcuuaguugguagaguacuuacccagcaugaaagaagcccuggauccaguccucggcacuguauguaaugacccaggccugcaguaucagcccuugagggagucagaaucaguuuauaaguucuucaguuacagagugaguucaaagccagccugaaagacaugggcuuaugagacucugucccaaucugaaagaacacaaccaaccaaccaaccaccaccaccaacagcaaaauauagauacuauucaaaucacuucugggccuuuggcuaagacaagugaaaucaacauaauucuauuguucaggaucgcagugaauuaccaaagaucagguaggaaaggaaggagaagucuuaaagagacuaugaacugguaaauaaagagacggaaggaaaaaggaagcaugugucaguuggaaaaaacaaaacuaagacugagcaugcugugugccaaggcgaggaauagcagggucugggaaagcacuggagagugggagaggaaagcuaagacuuuuuacucuugauucgguagaaaauggggaguugcgaaugucucugacucugggagccucuccccguucucucccguggcuggguaguggcccuucccucaguucuuccagggcuucaccucuuuaucuuuggcuucccagggcgauucuggaggaccgcuuaucuguaacaucgaaggccgcccaacucugagugggauugugagcuggggccgaggaugugcagagaaaaacaagcccggugucuacacgagggucucacacuuccuggacuggauucaaucccacauuggagaagagaaaggucuggccuucugauggcccucagguagcugagggaagaaacagaugggucacuuguucccaugcugaccguccucucugcaacagagucgucaaauggagggaagaagcugaaaagacagguuuugcauugauccucugcugugcugcccaccagggugagcgccaauagcauuacccucagacacaggccugggugcuggccauccagacccucccgaccaggauggaaaguugguccugacucaggaugcuauagaccaggaguugccuuuuuauggacuaaagccaucugcaguuuagaaaacaucuccugggcaaguguaggaggagagcuguuucccuuaaugggucauucaugagaucugcuguugggaaauaaaugauuucccaauuaggaagugcaacagcugagguauugugagggugcuuguccaauaugagaacgguagcuugaggaguagagacacuaacggcuugagggaacagcucuagcaucccaugaauggaucaggaaauguuauauuuguguguauguuuguucacucugcacaggcugugaguauaagccugagcaaaagcugguguauuucuguaucuaacugcaagucuagguauuucccuaacuccagacugugaugcggggccauuuggucuuccaugugaugcuccacgugaauguaucauucccgggcgugacccgugacuagcacuaaaugucgguuucacuuuuuauauagauguccacuucuuggccaguuaucuuuuuuuuuuuuuuuuuuuuuuuuuuuuuuuuuuuuuuacuaauuagccuaguucauccaauccucacugggugggguaaggaccacuucuacauacuuaauauuuaauaauuauguucugcuauuuuuauuuauaucuauuuuuauaauucugaguaaaggugaucaauaaaugugauuuuucugaag

SEQ ID NO: 12214 - RNA, 19473 nt, Mus musculus
cgugguagggaggccauccuaucgcgagaacucugucuucaggguccggauccuuccacggcuaagugucugggucggucuaagguccgcucggaucaccggaaggagcgcugccagccgguaaggacgagaguggccggcgggcgcgcuuccucuucugcccugugcccuucuucgcuccggccuguggccuguccugcccuccccuccauucuucccgacccucggguccgggaccaccaucccaccugccugcacgcggggcccaauggcccuucccuuccccaggucacgucugcugugaucgccucuccaguccccgcgucgcgccaggccagagcuccucucccuccccucgucccgacgcuaccacuuuuccuucaugcccaagcgcuggaucugucuucucuccucuguccugucgacauguuucguuccugggccacgauugcagccugaaugcuucucuuccaucccuuucccuacauugcccugacuguccucuggguuuauagcggugacagcccuguuucucuggucccaggcgggccugguuuccauuacugacccagugcacauuugccccuauuccuagugguuuggcaagguggaaugacuucuggaggcccacuauccguuuccuucucccagcagucccuuuaaaucguuugauucgucccuucagcugaugagaagagagagcuugcagaaucauuaauucauagcucgggcguucauuugcuauaugcuuaggguacugaggauauaguaauguaaagaaguggacgugcucccggcccugaugugacuuagcccuugcggugggaacaguauggguuuaagugcuacaggcuggaacuugggaggauggcucaagaaugacaagucagaggggcuggaguuaucugacccuccugcacacagcucuccugcuaguguuguuuaguagguaagggccugccacccuggcguccuuuuggaaggacuugacuuuccacccacuugguaauuuggaguauggucauagaccuuuugaguuacuucccuggguguguaugggacagguaaggcuguugguucuccguuagcaucccacugugauguuucugaacuuuuaaaguacauuagaacauuggaaagaauuucauccugugugacaaacaggagacuaauuuguacugcucagcaggucgcuugauuugcucuguggauuuuuuuguuuguuuaagaagagugucagauccccuuacaagccauugugagucaccugaugugggcccuaagaacugaacucuggcccuuugauaaccacugggccaucucuccagccugguuuguuuaguuugcuugagacuggcugcagggauccuguuggcucugcuggguuuacagacguacgugccaccacacccaggugauuugcucuuugcaagauuuacucgcccgaagaauuguucugcuaagugagauaauggguagcugcuggcacuaacagucccugcauuuagaucucuuuuuucuuuuuuuuuuaccuccucccuugggucuuugagccuuucggaaaauaaccuagacauuuaaaguuuucagauugaaguuugaugaugacgaacgugucugucucuacaguuacguuauucuuuugaggaaaauuaccgaacuacagaugaacuaagaugcuucuuaaagcaucuuguaucuaguuuuagaaguuaacuugacucccauggccaguuuaugaaagcagugcagguugcuugugucccagggaucuguauguaggucuuauagaacucugggugucccggcacacaccccuucugcacuugagagucucucagcuagcuuucugggccuuugcccacacaguguuaacacaccggucaguacuuauagcaacucacugagccuguuagccaccuuuuuuuaccugugcuucuuauuucagaaaucuauuguugucugugaaucaguggcacaaacguucugcuagauggcagauucaccaucgucuccacaggaacaacaccacugugccuuucuguucaagaccuuaaauacuugaaugacuacauaaaccuuaaacggccccuucaaaauaccuggugcagaugagggguuuagacucauacuagaucauagccaaaaggcuaagaggcaaccagacucagacuuuuggguguagaagccugugacuacagguauccuauuuaacccuguuaagccuauaagaguugcuaaguugagcucuucugcucuaggugugucaccagugguacucuuguuucuaugcuugucucuuagaggggcugucaguuguccucagcuugccuucugugacuguuaaaucuaacacuucagacaucauuuguaagcuuaucgucuguauaccugaauuagauagauucacaggcaagugagcuaaauaauuacuguguagguauucuguuuuuagcuagcaugaaccacucaucaggugcucaugacugucuuccuccagguuggcuuugcuuggcuugauugcgcgguagaaucaacauguuuuucugggggaccaggauugcacuuggggcuuuugagcuuguaguuccucccauuuggcauugccuugauugcccuacagaccgagcaguuuugguuuaguguugagugaguagguuaaaugggcuuagcuugugucaguaaguauagcauagucuuuuaauacguggacaauuacagcuuccaaaauaauucagguauguuuugaguuuuacuuuagcuauauugcuagucccucaggcaauuucugugguacuuacugcaaaaucugaggggggaaauguugaguuggcuguaaauacagugcacauuuuaaccaacaagcccauuguuauuuugaguuuguggaacuaagauuuuugggucuggcaguuuuaaaaacugccuuucucagcacucaugcuaggauugugauuucuguggagacaacccucaucaguucuguauuguuugaaaacaagaaauuaaguuuuucugggugcuguugcaaggguucuggaaguccagaaggucuaccaagaggcagaauacugaguucaagaccggcuugaacuacaggaaacugucagaaacuaagggcuagggcguggcuuaguuaaaguguugucuagcauauacaaagcucagcguuguaccuccaauauuggggggaaaauguguuggaaacauuguccucuucuaaauuacuuuccuaaauuaauacuacagguuuuaaggggacagcaucaaguugauuauguuuauaacacaaagauuuauuuugcagcugcucugaauuugaccauuaacacauuauuuauucauccauuaauaaaagauguauuaaagcacagguugguucaagaccaagcauugguacaagugcugcggguccuuuucuuauuuaggccaacucuguugcacauacagcacgcggggaagguuguuagugccaagguacagaugaucccaagcuguguguauagugcuguguguucuagcugggagagccuucaggguaagaaagcaggccugacaagagaggcauguauucaagcauugcuucucaaccugugggucuugacccuucgaggcgucaaugacccuuuuguaagggucacuuuagagcaucagaaaacagauauuuauguuaugauucauaacaguagcgaaauuaguuacgaaauagcaauaaauaauuuuaugguaggagguugagaaccacuguguuagcggguucuuacuggaaaccuguauagauaguaggcacaagagggcagcaugacaguucuauugccugguaauauugaagaaucguguauuugaccaggaaaggcuuucuauugcuuauaacuugaaaagcagacggcuagaagggacuaacguggcaugcuggcagaaagaacuuggagaaccaagcuggacaagacaggguggaaagagggacuucuuaguuuacuaaaauggagaugucaagacucagacuagcuguauuucccuuccccugguauuuuuggacagggucuugguguauauagguggcuuugaacucacuagcccaguaugggaagggugguuuuccugcuguagccugcuggcauuaccuugcuuaaauguaccacugacaugaaguacagagagcuguacauuuuucauucauuuaaucuuuguaucuucaccaaaugugcuauccaaacaggauaucuggaacuagcuguuucugucuuccuuuuguaaugaguguaugacuugggaucucaaacugcguuucaggguaaaggaggugaugcugaucugggauguuugagucuucucucaugguuuugcuuuacucuuaauguccacaaagucacuuuauauguauaggaaauagaaaauaagugucugauggggcucauaccuguaauccuaaguaccuccagagugcugagucagcucacaggcccuucccuccacucuguaaggcuggagggauucugaccacaccucaggaaagaaugcucuaauuagucugagugaagccaaguuaaugaguuuauuaaguagagauaagagauguccacccuucuguucuggcaguagacaucaaaggcauaggugaaggcgucuucagaguucugcacguacuugucuuuaccaugauuuaugcgguauugcucaaaaguugugauuaugacaaagcuuaaagauuaaguaagcaaaguuuaaaaguugaguaaaguucaaacauuacguaaaaaaaaaaaaaaaaagcugguuuaaagaacucguguuuguaaauggcuguggugguucugugaggcauguuguuggggccaggggugagaagaguuaagauggucaggaccucaaauaagcagagggcuuuuguuaauuuguagucuuugaaguguaccaggacugaccuggaguucuguggcagggcuuuaacucuggauccucuuuccuccugacuguugagauuacggguuugaguaccgcagcugaugcaauugguuguuucugauacccuuuucugaaaugccuuuaggaaaacaaccucuggggcuggagagauggcucagugguuaagagcacuaacugcucuucuggagguccugaguucaauucccagcaaccacaugguggcucacaaccaucuguaauaggauaugaugcucucuucuggugugccugaagacagcuccaguguccucauauacauaaaauaaauaaaacuuuaaaaaaaggaaaacaagcucuaucucuguaggcaguuucuguuuuaucauguauguuguauguugaaguuucuuuacuuucagacaggaauuguaaaguagaucccaaggugaggggcacguuucucuuucuguaucugccaguuucagcacucuggaaucuuaggcauuugcuagaggccagccuuaacuacgcagcaagaguuuuucuguuucuucccucccaaccccccaucccagguauuugcuguguaguuccagcaguccugaacucgccgcgcucuagaccagucuggucuuuaaaacagccugucucugccauccagccaguaacagcuuuucuaagcguaaaaaggaagaagucuccuaacuaaccaagucaaaauagcucuggggagaaccccagucggcugcuggaccguuaucgcggucgcugcgggccccgcuuguucucuguaguuagugacuugcugcugagaccucuugaccgccgcugggcccggggaggggcugccgaaggccccagccucgcgcccacggaggcccuguggugggcggaguagcagguguguuugcggagggggagggagacgugacgcgcgcaaggcggggcgugaccuggccgguaggguauaaaccuggccgucgagcguguucucgcagcaguuuucgucgcggggccagacuaccugguaagugugccaccugggccaggagacugcgcaugcgugcggggagcccugggggaccaauuucauuagccgcuccuagaaagggcaacgggaagccuagaaagcuguuugagucacugcuacucuagcuuaauuuuuuuuaccguucgguuuuuaguuuuugaaacagaaaaaccuuacuuuaguuuugccauuagguggcagaauuuugcagccuuugccuuuuuuuuuuuacaccccccccccccccccccaguuacugcuuauagaguuuaugugcuggguuuaguagcuacuugugaaagcaagcuagagggcuguggaggcuaaagaauuugaacuggacuuaacucaagaucuguauacucuuugagauaaugugcugugauuaaaaaaccccuuuucacuggaagaagaaacagcaagugaaggcaagaaauggcucaagguaaaauugcaaaauaaccacguacuguuacuaaauugauagcuuuuucacuccaaguuuguacaaacggucuccuguaggcugucucuucaaacauaauacaguugacaguauuuuaagauaaauauguguguguccuauaggucuccuauggccucuugacucaacugccaggaaaaucaguaaaacguggaggacaguuuuuuagagguagagagauuaucuauuccagccaggggagguggcacccgcuuuuaaucccaguacucuggaagcagaggcaggcuuggucuacuuggugaauccuugcauuaaauuaaaaaaaaaaagauaaucuauuuuaaaaccuugauuuagucaacaaccaaagccuggagugguuaugauuacccgcaugcuggaacugaagggucucuuccuccauccuuucagcuggacacugggacuugguaguauuuggauuauucugaggcuaucgugacagugcugccuguuuuuguaguugcaauccaagguagaugguucuggaacacugcuuguaauuuaucaaggacuauaaaauguauugagacucuguggaaauuaauaauaaacccauagaaacauuaaucugaaacucuaauuuuggcaaauacaauucauggguugagaacccuuguucuaaauccaagucucacccuugugcuuguggccuuuaaagggccauuuaggggcuggagaguugguuuauuuagcgugugagagcacuugcuugucuugcagagcacucauguggcucaaccaccuguaacuucaguuccagggaucuguugccuuuuggccucuuaaaguagaaggugcacuuguagugcacauagucuuugcaaacaaagccugugcugagcuccaggcucauucaguuuuuacacacacacacacacacacacacacacacacacacacacacacaauguauguauguauguauguaucauuuauacuauguaguccuuuggcuucaugcaugaaaugugggucuaguauuaaaauagcaagguuuuauuuaacuauauuauugguguugagcguugaacucaggaccuugagcaugcuaaacacuuuacuguggccccaguaagcuuuuccuucuuucaguuugugguuagugugaaucaugagaauuacagcuuuuggaaaucuuaugguuaaagcaugugauauaaguuaucuuuaguuugugguuuguugcuaauacuggcucaaaggucuuuggacuuaacuagaucuguaugcugcauauagauaccguccccucagcuugguggaguuugaggggugcaggggguggugaugcuugagaauagggugugcugcuuuuacguuucccaguguucuaaaacuuaguacagaguguggcauaugccuguaauccaaguggcuggguggcggaaaucggcuugugaaguuuaaacaagaugauuuauuuuuugaagggauuuuuuauuuuguugagacagucucacauuguagcccaggacgccuuagaauucaguauguaacucgggcugggcuugaacucuaugcaguuuugccuuagccuccugagugcuaagaugugccaugagccaccauuuguuuugucuguguccacuccugggaacauguuuguaguuggauuucaaggacuacuguuaaggaucuaguaguacagucuaaucuacuuauagucaaguguuucuggcuuaucuagaauuguggaggguuucacauugugaagcagaauucuaauuaaaaauuucauggugucaggcauuuuaguauucuacacaagugaggacuugagaagguugacacagguaaagacaguugggaaaauaguuacauaggccaugcauggcuaacuucagugcaguguggaaaugggggacacucagcguuucaaaccuuccaauacuacugugauggcaguuacccuacagugugugcccaauacacuugaagcccacuuauaauaugagauggaaacaaauuaauauagcugcuguuuccaggauuaggaacaauuccacaggggcuucugacaaaugcaauugaggaagcccuuucuucuguaggucauuguggguaaacauacugagguagcagaauuagcaagugggaaguuagaaaauuuccugaacuuugaguauuggguaggaacucagaaguuccucgaucugagcccuuugcugcaggggaagaaagcugcagagcuuuaucuuucugcuagcugcuucuuucuuuguuuacaaauuaucucguguguauggguggguguuuugucugcauuuaugucucuguaccucgcuuacauuacuggugucugaggacccucugagacuguaccuacagauaguugugagccaccauguggaugcuagaaaaugguccucuggaagagcaggcaguacauuuaaccuaccuagccaccucuccaggccccuagcuuauuucugagggugagaacucaguauugcuucuguccagcuuucagccugagaggaaaccuggucuuggucaugcugucaaggccaguccacaauucugccucuccucaaaugggcagccagccauugcuacucuauucauugagcugcaugcugccuuagagaccaaagcaggcuucuuugaagucauugucuucaggauuuuaggaaguuuguuaagacaauccccuccuuggagcuauucugaagucugacucuacuagacaggucuccaaauguuggagagguguaaucauggccucccagaguugcuuaucuaggccaaacagcuuuccuguuuggagauguucccccuccgcccuccaugguuuugagcccuccuucccuuuuucuaaaugccuccauagcaugucacuaacggccuaaugaucauaggaccaagaagccuugugacaaauguauccaaauaacacaugaauuaaaauuuccgaauauccaguacaguaguaccaagucagaauuugccuucaacaucuccaucuuuuauuuauuucuuuuuauuaauucuuuucuaacuguccuuacccuucaaugcaaacaaguucuuuuugcuuuauuagguuuaaagcuacauagaaauaguuuuggagucuguuucugucacagaucuauguuguuucuaacauuugccuuuuauguuuucaaucccaguaauuagagaaaacagguauucauuaaacaaacaagcuaacaaacaaaacaaaccgcuguacacaggccugguggccucuuuggggcugugacugucgcuggcuuuacuuacuguguagcugaagauggauaaucauuuuaccuuuaauucuuagucuuccucccucugauuuaggaguccagaaguuccaggcauaccuucaugcagguuucuguagugcugaggauuaaaugaaggcuucaugcaugcuaggcauucuguguuuauaccuuaauucuaaaucugucccagacaaccgcgguuguccucgcagugaacguugucuaguccgcuauguggcuuucugacacuuuuuguuauucaccugguucugucaugugcuccuccccaccugugcuuuucuccagcuucugcuagugaacuccggguacuuucccacacuaaauucuuuuuuagaaagcuuuuauaucuaaguuacauagaaucguuuuguuagauauagcuuacuaaguauaauauugucuguuaaaaaaguauuuuugugugucugucuguccuguuguuauguggguacccaaggaagccagaaaaggaaguuagcucuccuggaguuguuguuacaggugguuguaagccuccuagcagaggugggugcugagaacugaacccagggacucacacguggugagagaguuacuucuacacugagccacauauguaguucagaaacuuauuagugauuggugguuuuguuuuaguuuuguuguuuuuuggagacaaggucucaaaaccaaugcuuuguaguccugcuugcugucaucuccccacuuccagcacuacguaggggaggagaucacagcaagcuugauguucuucuaacauucucacucgcauguguugugcuauuuuaggaccacuaguguuuuuuuuuucucagauacauauguucacauguagauugcccuuacauaaaauagacagaauuuucucccucccucccguuaccccucgcuccuuucuuuugcuuucuuuugagacaggguuucuggagccuuggcuguccuggaacucucucuguagaccaggcuggccucaaagucagugagacccaucugccuuugccuccagugcccccucuccaccuaaacgcuuucuagcagaaauagguuggugaggaagggagaauacauguguuggaaucaccaaaguuguuaguagugagagccuuuugggccaugauugauugaaagaugguuuggggauguaauuauggugcuauuuagauuucuuucuuuuacaggaacagugagcagaaugaacacaucccuggaacagaguggcugcuacaguaauagagaaacucuucugaggugcagugaugcaaggagggagcuggagcuugcuauugguggaguacuucgggcugaacagcaaauuaaagauaauuuacgagaggugugcugggugcuuuucucuuccuuggucuggcuuuagcacaagggugguuagaguacagcaaaggacuccucagugucacccagaaagcuugaucccauauccugaguggucuuaacccuaauccucugccugguguguuggagcuuuugaucucauagggaaauaaguccugcuggaagaaucugggaaucugacuguagaaugcucuucagcacaugguuuucauugcacuuuuguaugguucuuguacacagucaugcaagguaacagaguaggcaguagucugccuagcugcaguuuuaauuuauugagacagggucucucucuauaguucugacuggaacucucagauuugccugacucugccucccugggugcuagaauuaauuaaaggcgugugccacagugcucaggguagcugcaccuuuuugauacauaaaauaugucacuucauuauguccccacuuaauuuguugguaacaugauuuuaaguaguguagucucuaaacuacugucacuuugcauaucagaaugaauuuuuuuaguuccaauaguauucugcuggugagugcuucaaguuguauaugauuuagaaaaccuuucccuacccccaaaggggaacuuugugauauacuuaugugggugcccaugugauuuauaggugucuugaauuuucccucagaauuuuuauauauauagacaaaaugugaauugcuauauacguucuuaggaacauuaguuaguuuauaauuagucuaaacuguuaauccuaauggucuccuugcuuucuggaauacucuaaaggacuguuuauuccaugcaagugggaaaagcacacagacuaacuagcagcauaucuuuucuuuugcccccccccccccccccaacaggguuucucuucccguagcccuggguguucuggaacuuguucuguagaucccucuaauauacagauaucagccuuccugucucucuaaugcugggauuaaaggugugcaccaccaaguuuaucaaugauaaauuuguaagacuauauuuuaaaguucauggaaagcugaggggaauuaguauccuggcauaacuuuuucuuuugauugcugauaccccagauaagucuaguucucucaggaggaggagugagugaaggaguuuagaaguuagguauggcuuuuuuuuuuuuuuuggcuuggauucuuuaacuaggauucauaggacuucaugggaucacugaaauuguaggcacauuuuugaguauagacugaaaagggaagacccuucacaguggccaguaaauauaaaggauuucugacccucagaaguuuaagagcaugaacauuuuaugggaauugucauucuuuggcuuauagcacuaguuuauguuaucaugcauuuccuagguaaaagcucagauucacagcugcauaagucgccaccuggaaugccuucggagccgagagguguggcucaaugaacaggucgaucucaucuaucagcuuaaagaggagacacugcagcagcaggcucagcagcucuauuggguaaggugacuguguuugagcugccuucuccauuccagugaauguuuucucugccuucuauuacuaugucagauaaaagucagucuaaaaugguuuuuauuaguuugaauauuucugguacuuuuaauaucuuuguggcuagauguuugcauuuuucuuguagcuaaugggccaauucaauugucuuauucaucaacuggaguauacucagaacaaagaucuugccaaucaagucucugugugcuuggagagguaaagacuuuuuacuuguuuugacucuggucuauacuaguaggcauuaaagcaagucauuuguaacucauugucuguguuggauuuaacucaacuuuguguucuuguguaaaaccacccuaccuuuauauuuaauguuacuugcugauacugauauuccuugaaaaauaccuacauuuuaucauuuugguagacugggcaguuuggcccugaagccugaagauucaacuguccuacucuuugaagcagauacaucugcucugcgccagaccaucaccacauuuggaucccuuaagaccauuguaaguaauguuaauuucagcuauuucuuaggucacuuuucgggucucugaccucauggaugguggcuugcuagaggcagugaccuuuagaaaugugacaguaagcuggcaguuuggagauuguugcugauucacugagaauacuuagagcucauuuugacacauuuaaacauaaauguuaggaauuuggacaggcaaccgaguauagucucaugagucuuguuuaaaucgagguacugcuagguauagggaagacaucuuaugacacagauaaugcaaagcuuguaagccauuggauuuauaguggauaguacuuuagugaaaagagaauuaggauuaugcuaucagguuuuuuuugauaggagaucacaguguaaauaacacaguucucuucuuuucauagcaaaucccugagcaucugauggcucacgcgagcuccucaaguauugggccuuuccuagagaaaagaggcuauauccaggugccagagcagguaagccgcagcucugugucugguaauucucuugugucuugauauccauuuuuuuuuuuuaaauuugugaagagcauccacuugauugccucucuugaagcacugaaugucaaauagaaauuuaguuuuauaaaucuuuaaguuuuauagauuaaggagaaaaauaaucacuuuauuggaaauuccuaacauugcuacugacuuguucuugcuugaggauucucuaauucagagauguguuuguaaaagcaagugaauaaaggguugaagacaucugaguugagaggaacucuagcacucagacugucucccucagucugauuuaguaguuauauaucccacacuggcuucagugugcaaaccuccugccuuggccucccagagcgcuagguuguaggcaugcaccaccacuccuggucuuguuuuguaacugugaaaauugggacugguaggauggcucagggguaaaagcuuaacccuguagguuaccugaguucaauccguggaaucugucuaaagggaaggagagauccaaauccacaaaguuguccuuugaccucuauacacaugccguaccaugugugccuucucacgcagugcauuuaggaugcacacaccacagugccuguguggaggucagaggacuguguaggaucaguggauuaaacucaggucaaucaugcuugguggcaggagcccucacugcuaauccaucucaucagcccaguaagaaaaacauuuuaaauugagguuggggaaggcaugagacuuccuuaagguuagugguaacccuagguuagagugcuuggguuccuguuucugcuaaguuuucucuugcauuuguuaaugccuuguuacacaacuaaguguuucuuuuuuccuuucuucauggcuucaagaagucagcauccaguggcacagcuguaucucugagugaguggcuucuuguaagcaaaccugccauuggucuucaggcuccuuauguacccaguaccaacccacaggacuggcuuaucccaaaacagacuucagagaauagucagguguguagcugccuuuauuguuucugagguagauuggguuaacaguaauuuguguuucugagcauuauuuaaaaguacauguuuuuaagucuuuaauuacaauagugaaauuacuucacuauagguaggaaguuuagaaaaaaaaucuugcaacauacaaguccauaauccuaagugaaaugacaucaucaagauauuuuuguugggauccaaugcccuuuucugaugugucugaagacagugacaaugaacuuucauacauaauauaaauauaaauaaauaugaaucuuaaaagagucacucaagcuguguauacauggcuuaaaaaaucauuaaaauuuuuuuuuacagcauuuuucuguauaugcauguaauuaaaaauaauuugugccaggugaugguggcauauaccuuuaaucccaagcacuugggaggcaggugugaguucauggccuaccuggucuacagagcaaguuuuaggacagccagggcuacacagagagacucuaucucaaaacaaaaccaucauucuguauuucauuuuggcaaguguauaauguuugaucacauacaauucgauuggcugaaacuuaagauucuguucccuaaacauuuaugagcucuuaguucuuaggaguaaacuccuauaaauugaauuccuagguuacuauucugccuauauacccuuuugacuuuugauacauugugccaguuugucuuucuaggaaguuaaugguugauaauaaguggaguauucaccacugucuuacuuuuuuucuauauucugugaagagaaaccagguccaaaacaacuuacaaaagaaaacuuuuaauuggguacuuguuaaaauuuaagagggugggugaguucaugacucaucauggcagggagugugacaguaggcgggcauaguguggggcaguagcugagaguucacauuuuaucugcaaguuggagguggagguagggagagacagacaagacacuggaccugggcuuuugaaaccucaaagcccacacccagugauacaucuccuccaacaccacauggccuaguucugaacagccuaccuccuggaaaccaagcguuuaaauagaugagccuguguggccauccucauucaaacugccagccaccaaaccucuccaauagugguaguaguuuucaaguuuguuucuuugauuuucacagaguaucaauuuugcuuuugaagcaguugaauguuuuuguuuguuagacuuugaaugucuguccuaucacacaggcauuauaccaagaauacauuucauuuucuaaaaccuaguacaguacuuugaaaagauuacaaaaaugggauuuucauuuaaauguuuuaguauuuuuuguucaggaaaauuaagcauuaauuuuggguacuuuuauagacuucugccagagccugcaguuucuucagcgaugccuggggcaaucugaagggcuuagaaaauuggcuccuuaacagucaucaacaagaaauugcuggaaaaccaaguuccucaaaauguaacagccauuguagcaccaguucuuucucuccugaagcugaaaaggcugaagauguagagcuccuugaucaagacgagcuggaccugucugauugguuggugacuccucaggaacccugugagcuggagaagccuguggauggcagcugggaaaccagcgagaaguuuaaacucuuguuccagguguucagagagcccuacaaugugagugauuggcuugucaagccugacuccuguaccaacugucagggcaaccagccuagagguguggagauugagaaccugggcaaucugaaaugccuaaaugaccacuuggaggccaaaaaaucagugucgguccccggcgcaacaaucagcgacggcuggcuugcccagaaccaucaggacacauggaaaguagaggaaguguguaaagccaacgagcccugcaccaguuuugcagagugugugugugaugacaacugugagaaggaagccauguauaaauggcuucugaagaagggaggaaaggacaagaauggaaugccuauggaaccuaaaucugagccugagaaacacagagagucccugacacuguggcucugcccuuccagaaaugagcuaacagaacaagcuaaggcacccaaggcuauggcuccugcuagaauugcugauuccuuccacgucauaaagaauaguuccuugucagaguggcuuauggggccuacgugcaaaggaggcccuaaggacgugccuaauacagaggagagagcuggcaaagagaugcuucaaagcuccauggccacuuccuggugucccuuuaacacugccgacuggguuuuaccaggaaagaaagugggaagccucagccaguuccccucuggagaagauaaguggcuacuucgaaagaaggcacaggugaguagagaccaaauuuuucccauuucagucauuuaauuccugcuaaguuuggaugagguaguaauuuuccuaagucauaagagaauaacuuauaacuugcauuuuuuaugaguuucucagguccuuagcauucaagcugcaguaaagaugaaaguccaaccuauuuuguuucaaguugcaaccuuuguucuugaaaaacauaauuguucuuaaccauuugauggggaguuuagucccaugcuuaccaguagucaucuuuuuuaucuucaugcaggaagcauuucuuaauucaccccuacaagaagaacguaacuuucgccccgacuguuacggccucccagcaguuugugaucucuuugccuguaugcagcuuaagguugauaaagaaaaauggcuguacagaacuccucuacagguagguaccuaccugcauuaguguuauuguaguggcucauaaauguuuucuucuuaugaacuuauggguuccccccaguaaaccauauuccuguuaauuugugcgugaauagaagucuuuuaaauuuaauguaacugugugcuaucaaaguaaaaugccugacaaucugaguucaguccuuagaacccauuaaaacuagaacugauuccacaaaauuauccuuuguccuccauacccacaccauaaagcacacgcgcccccacgugcaucauacaaauaauaaaacuaaaaauaaccuugaacuuuaucuuacuuuucaauuuguuaacugcccauaauuuucuuauucccucauggauuguggguagcuuaagauuugagucuauuucauggugggaagaauuuugcugucggugugaacugaaauuucuauuggcuuuucuuuacagaugugaaggaacagacuaccagaaucgagcagcuuuccugcagauuauugcacauccuugagcugagugacugcgauuugccaaaccauugugcauuccaagccugacuagucagcuuaguuccucuccugcuuaguuuugaacuaguaaacagaagucauaaacuaugaguuaagucugugaaagaggcuucaaguggaggugauucauucuuuugaaagccguaacgugcguaacuugaucaacucccguacuagaaaccacaucccgguacacaggccuuuaccagcuuuucuacagccaacacuaguuuuaaaagugaaauauuccuauaucaaguguguuaauguguucaagguaauaaguucucuaacauuugucuuuuagcuguuucucauuacaggcuucuagagauuugaaaauuuuuuuuguucaguugauauauagaauauuucacacaaauaguuaaccuugccaauacaguauauuuuucccuacuaaaugucuauuaguuauauugcaaauuuugauacucaucagauauuuagccuacauaccauuucuaacauuucucauuuggaagaaauuaagcuauuauaguuguugccuuuauuucuuuccaguauccagugagcucuuugaaagggacuuuguuuuaagaccacucuuagggcagucagagcucuuaaaguccuacaaaccucggcuuuaacuaaagugaacccuaaagcagaaagguaaaaaguguuaggaaugcaguacccgaaccacuggucauccuaaggauuucuuggugcauccuguguaaauggaagcugagcuugacaccuggugcucuuaacuagggauaaagucaauguccuguuacuucaagcacagcauccugaaccuccuaaaguacagugcagugacaucuugauuaccaggcugugcucaacacugugccuuggagugucucaccgagacuucacagaacugauauccuugaguucuguauucuagaaagcuucucuaaggauuuaucuuuuacaguucccaaggauaaauuaguugcuuucuauucuuugaacuauuaauauuaagccucugaaaugccuaugcuauuggaaguacuuuugggaaaauuuuauggucccauagugacauuaccauacagcuuuacugaagcuccaaaucauagcugaaaagaaccucauauuuucuuaugucccucaagaugccacugaguauuauaaaguugguagguaaagacaauuuaaggagccuuuccaacauuuuagguugcagggaacuuuguaguuucuuuuuugaggucuaacacuguauucacauuauuaaaacauaauuuaaguuaaucacuugcuaaugauauauaaaacuuucuuuugcauuaaguuuuaaaucuccauuaaaagcauaauggacacaucaguuguguuuguguuaucuguaaagcucagaauguaacgauuaagggguacaauaaauaaucuuaucucuagcccuaaacuacacauauauuaaaaauacacauaucccag

SEQ ID NO: 12215 - RNA, 14450 nt, Mus musculus
agagggaggucgcacacucugaguuucggugacccggaagggagccccgugguagaggugaccggagcugagguacugccucgcgaggccugagaauuccaguccuugugacgggcgucggcacagcgggaucugggcuggcugcuacgggcggggcgggaaggccgggcucguccucgcucuucaucucccugggcagagggaugcugagucagccgcucggggacccgcgcgggggcccuagcugucggcgaucgggugccguggggguggugcguggacgcggaggcagcgggcuagcggugagaggggaggaccgggcgcauccgaacacucaagcucaaggaagcguuaggaagggucgccacuaguucguagagacccagcccaggagccgguuucagacguccagaaucugcacuuaaauauauggcagauaacccucuuggcuguuccacgacauaaggccacgcagacuagguaggcucuguucgggucaguaagcugaagccauagguugagaugauguaauggcaugaaaguaccaaaagggcuccggguuuuuuccgcaaggucagaugccuagagcugugugcacuucguaguuccggaaauucuuaacuuuggaggugcuaguuaaaacuucuuuacauuccuauaguuuuaggguaauucaugggcgauuucaaagucccauuuuggccaaguuuucuuguauuuaaauauuuuacaaauggggagaaagcggaaauacaaaucacuugccuaaaauucaucacaacucauugaccagaaaugugccuuuagcaucgcagaaaggcguguacuuaacuauuuaucgauauagucuaacuggaacugagacaauucaauuuuagaauguugggggcagggguuacccuauuaagaauaccagaagguguuuuaacagggaaaccuagcagggcaauuuuguuuauuuugauugaauguuauguaguggaauaauuuaauuugaauguaucugucguaucuuaaagggaaguaacaucugaccuacuugguagacauuugcaugccuggcuuuuguucaugguuuuuagucucgagugguuuaguuaucuuuucucuggaugauguuuuucuugugcugaaaugucacacagauucuuuuacuuuuacucauugaaugauggaguaaauaucaggccaagcuauguuuguaaaaucugugauugugucaacauaauaacauugauucuguauuacauauaucuggucaaacuuggauuuauaucauuggcugcccauucuaaacuagauuuguugagucagaaggaacaagggaaggauacagcauuaaaaauuaaugaggccacuguucugauuuuuuucuucuauuuaaauuaaguuucuucugauuuuggcuacuauguuuccuucuuaauuaacuaaauuuuuccccccucuaccuuucuaacuagcauuucagaucugcuuaguaaaccgguguaucgcccaccauguuggcugcaaggcuugugugucuccggacacuaccuuccaggguuuuccagcccacuuucaucaccaaggccucuccacuugugaagaauuccaucacaaagaaccaauggcucguaacacccagcaggguaaagcaugcuuuuccaguauggauuuccgccccauucagauuuucuguuuuagaauuuggugguaauggugguugauuagugggcuguucugugaguuucacugcuugggaguagcuuacucuuuaguuaguuacuguaacagugauuuuucuaaagugacaguaaaguuuccagugagcuuuguccuugccacuucacaucauuccagucccuccuuaucacaaaugcuuuaagagggguccugcaccuuucccauaucuaauauauuagauaacuuuuauguccauacuacauuaguuuaaaaagauccuauguuuuauuguagcucugggugauaugucuuuuuuugucuaugucaggaauaugcuaccaagacaagaauuaggacucaccgugggaaaacuggacaagaacugaaagaggcagccuuggaaccaucaauggaaaaaaucuuuaaaaguagguggaaguuaaguauuuaaugugaagccugugcauguguuuaguccacaaacagccuccugaaaauacauucaaacauguauauauguauuuucugcaagaaaagucguacuucuguuuuuggggauccaauaacccaaaagagauuggugcuuugcauuggguuucaugguuccugguuauauuaagauuuacugguuuuagaaaaaccaaauuuauuaucauccuauuaucuaaaaugguagagccuguuuagggaguuuauuucaaguuauuuagaaucuucauucaagcacauguuugugaaugucaauuucuauuuagucauguguaugucugugugacugugccaggugugugcugaggccaacagaggcuagaagaagguaucuaaucaccugggacuaggguuauaggugauuguaugccaucugaaguaaaugcugggaacggaacugaaagaguugcaaagggcucuuaacuacagagccauaucugcagccccuuggaggguauuaccuuaaugaagccauuuugauucauaguuuggauuuuaacuuugaagauucugaaaccagacugccagguugcuaaucuugccuacacuauuuaaacagaagcacuguacuuaauaguuuucgaagugucacuguauuauauacugaggagaacccuaucaguaucaugaaaagcauugcuuuuugauaaaagucuugaccacagagaagaaaucaagauuuuccaguaacauuuuuaaugaacaaauuuaaguugaagagaguaagguguggucuuuaugagcaccugccucaguagaguugauacauuuucauuuuuauuuuuauuuauuuauugauugauuuauauuccgagaccaggguuucucuguguagcgcuggcuguccuggaacucacucuguagaccaggcuggccucgaacucagaaauccuccugccucugccucccaugugcugggauuaaaggcgugcgccaccacugcccagcucauuuucaauauuuuaaagcaagacuaucugccccuuuguugguacauaaacaguaguguuuuuguuuguugguucucuagagucacauaaagcuucaccuggguuaauaccuuaggcacaauauggaaugacugaugccauuucucucgcauuuuuccuuuucuuuacuguuuguugaguauuuauucauccgagauauguucuugcuguguaaauccaguugccaggcugaaacucaugaucuuuugcugagucucccaagugcuuuaacaguuguguggaccucuuuaucaaacugcuccuuuguucuuuguagugacuguuguacauuuguuucggaaguguccuucuggucugcucagguugagaacuaucuguauccccaaggugacuaccaugaagaaauaguuauaauuuguuccccuccugacuauuuugacucauuaccccagcacuuuaauuuacuugaauugugcugauucuagccuguguuucuugcugugcuugcagucgaucaaaugggaaggugguuuguugcuggaggagcagcuguuggucuuggagcgcucugcuacuauggcuugggaaugucuaaugagauuggagcuaucgaaaaggcuguguaaguaaaguguucccaaacaaccaaaaccuuuccuucaaauaaacgcuccuguuuccuucccauuccgucucuagucacuuuuggaaugcauugucugguuuucauuuguaaauaugcaagaauguauacagucucuuguucauuagucauagauuuauuuaagccuaaauaagaaucuuuuaccaagguuauauauucagacaagaagaaaauguauugguuuuuauguguuuugguuuuuaugugguuuuuuuuuuuuuuuuaauuuuuauuuuaugaguacucuaucucauauacacccaugugccagaagagggcauugaucccauuacagaugguuauuagccgccaugugguugcugggaauugaacucaggaccucugaaagagcagccagggcucuuaacugcagagccaucucucuagccccuaguuuuauguguuuuuauauguaauguaugguuuaugucauuuaaucuucaacagcucuaagaaguccauacuuauuuccgucauagacgagcaugguaaugcaugccuuuaaucccagcacuugggcgguagaguccaggcaggacuacauagagaugcccaucaucaccaucaccacuaccaccaccauuaauuacuauugccaucguaaauaagguugaaaccauuaaagugauuuaucccagagccuuuuguaucuaaugaaugauuuaaucagaaauuauacccauacuucugugaacuaaccuugucacauuucuugcagaauuuggccucaguauguaaaggauagaauucauucuacuuacauguacuuagcaggaaguauugguuuaacagcuuugucugccuuggcaguagccagaacaccugcucucaugaacuucaugaugacaggcucuugggugguaaguuagcuacuugcugucuuuguggggaaggugauccuggauguuugguugcuuuaguugcuuuuuuguaugaagaucaaaagauuucuuaaauagggucauuaguauauuucagcagcacuauauuaauuucuuguaacagugcagaaagcuugggcuuuggggacaggaauugcacacugaucugcaaggugauuuugcauuuacuuuauuuuucagcaaguggguacaaaauagaaguuguuuucuaucugcugcuaauuaggaagagucccucuaaguucaguuuccaacucauaauccuauugaaacauguacuuaaaaaugaugcaguguucuuccauuuaauggccucuuccuuucuuauaauauauuuagcaauauauuuuucuucccucuaucaagaacugaaccuauguagcucagugcauucuaggccagcucuuuuaucauuauuauuauauuauuuucuuuauuuacauuucaaaugcugucccaaaaguccccuauacccucccccugcccugcuccccuacccaccuacucccacuucuuggcccugcuguucccccauacugaggcauauaaaguuugcaagaccaaugggccucucuuuccaaggauagccgacuaggccaucuucugcuacauaugcagcuagagacacgagcucuggggguacuggcuaguucauauuguuguuccaccuauaggauugcagaccccuucagcuccuugggugcuuucucuagcuucuccauugggggcccuguguuccauccaauagaugacugacugugagcauucuaggccagcucuuuaccacuaacuagcauuguaugauuucagaugcggguugugcugcucugguggagauccagagugcacuguguaguaugugcaguaagaaauagacauuugaaaaugaaguagaaagucagcuugaaaaacugccuuggagcaucagggcaguucuguggaggagacuugguucuucaggguuggugcuggcuaacauguuugauugcaaaagaggacagagucaguccaggcugaccaagcagcugagcaaaggagaagagcuaggcagaccgaaugggaaaagugcuuuauaguccauuugagggaaaugccaaggcuugugaggucuaaagggugagagguugugguuagaaaggguaucuuucauuuccaagcugaggcaaaguacauaaacagagagcacuuguagagagugggguggcuggggaaaaugugguucuguugaguguuaagaacgaaugugagagagagacucauaagcaggugcaccagcugugccaugccucugcgcgucaaaaugacugaucagaacagucagucuaaugugugcugcagugauugugagcaaggcacgagauggaaaucaaacacuuguuuccuguaguugggaacccagaacuaugaguuuggaaucauauuuccugugccuugaacucuuaagacaagaaucauggggugcuggggagauagcucaggagguaagagcacugacugcucuucugaagguccugaguucuauucccagcaaccacaugguggcucacaaccauuaguaaugagauccuaaacacucuacugguaugugucucaagacagcuauaguguacucauauaaauaaaaauaaauaaauaauauuuuuuuaaaagagaauucguuguggggcacacuuuuaauucuaggaguuggaagacaaaggcagauggaucucuaaauucaaggucuuugugaucuacauacuauguucuaggauauccaggaacuugacucaagaaaacuacugccagccuugcuacaaacugaguucuuugacagugaggguugauagaagaccuuguucucaaaaaccaaccaacuaaauaaacauaaaacaaacaaaagaaaaauaaaucaaaccaacaaacaaaaaacauccuggcagagcagugagauaggucagcagauaaauuucuaacugagcuccaaaugcaaaccugaggucuuguguucaucucagaauccacaacaggaagaagagaaccaguuuucauaaagcugugcucucaccuccacaugcaagccauuacuguauauacauaucauaaaugcgcagagacacauucauacccuuccuuucuaccugaccgaaugacuuauugcaggagcuuuucggguaggcucuuugcgcaauagugacagaucugucccauccuaauggcacuucaagauguuaggucucaaaccuggaacaaauggcugaggugucuauuuaacauaucaaaauagaccagaccaccagguucucccuacaucucucaguucccaccuggcacugagcccuccuggcugacguacucucucaguacucucucaguacucuuaagcacugagccaucucucuagccccacagugacuucuuagaagcacaguggauacaguuaaggaagugugagguuugggaguauuuuucuaauccuacccauucaguaucacuaauguagaauguagaaagauaaaaagcaaaauacuaggaucuugaaagaaaaauauacaauugagauauacaacuaggaauuucuaugaacaaacggugugggaagcaguuuuuagucauuguuucuccauuagaaaacagugagguagaauccuuuauguuuuucagcaucaguuuguuuugguuuuugucuuccauaaaacccagcuguuuuauuuuccugucagguuggaaaugaugugucuguggcaguagagggcgcucuugcuaauguagucaaugcugaaaggaucuagaaacagaagccaaacugugcuggauaaacucacgggauucaguuuaguauucuucaaagugauuagcuguacuugaaugugugguccucucauuuaaggaucuguuucucuuaugugugucuuccagacaauuggugcgaccuuugcagccaugauuggagcuggaaugcuuguacacucaauaucauaugagcagagcccaggcccaaagcaucuggcuuggaugcugcauucugguauguucuguuaaauucuuauuaaauugucuuguauauuauucacuuuccuguuauuugucugacuuauuuuccuuuucaguuuuugagguaugccagacugcccugcaucuuccuaccuuccuguguuagucucuugacacagcagacuuuuaaauaguggccuuuuugaguggcucuucaguuuuaaaugacuuacuaaaccucauuuuuggaaaacacaauuucauacagucacugcugguacauuauugccaggccuucacuuuaaaaguauugguauugaagguugguaugaagauagcucugagguuaugcugugagauaaacuauguauaagaaaagagcugagaugccagcaagguagcucagcagauaaaggcauuugcugugcaagccuggcgaccuguguucaaccccuggugggguccccacauaaagauagaagagaaguagcccuacagcgcuguccucugaccuccacagcauuacauguauuucuccauacacucuaugcacaaaugcuuuuacagcaguaacuuaaaacaagagccaggucugguaguauaggccucuaguuauagcuacuuacaaggaugagucagggaaauuaaagacagccuaguaacacuggacccucucccaaaagacaggugcaggguauguagcucagugcuauuaggcuugcugcacacacuuaucgccugauuccuggcaucaugaaaacuaaaggaacaacuuuacauuauuccucuguugaaauaauuuuguaauguaggaucguccaguuggggagauuuuguugauguuugguaauuggaaauaauaugccacuguaauauuuugcuguuuuguuuuuucaagacagggucucacuauguagcucuggcuguccuggagcucacuauguagaacaggcuggccuccaacucaaagagauccgccugcuucugcuuuccuagugcugugauuaaagacagguaccacuaugccugccuacccuguaauccguaaggaagauuuuuguaaauccugacaacugagcuuucuucuuaaagguugaaaagagcuguguuccuuauuaggugaggcaaauucagugucugccugucuacauuucaguuccaccacacacuucccuuucaguucuucccuuugagcagcaggucugaccuucagcugucugcuuugugugaguucugucuuaauaauugugaaauccaguaguggucuaagaucaaaauaguggccuuuaguaacuuuuacaaacuuacuaaaaaugcaggcuacuguuggaauugugacccaguauugaugugguagagaguuuguauagucauauauauuaauuguauaauuuagaugguaauauagaacuaccuaaauguaaaauuuguuguguuuacauugcuuagcauaaggaucaccuucacagugagaucuucuccuugaugaucauuuaguagauauucaauaagacuuuguugucuccccaggugugaugggugcaguuguggcuccucugacgaucuuaggggggccucuucuccugagagccgcaugguacaccgcugguauugugggaggccucucuacuguggccaugugugcgccuagugagaaguuucugaacaugggagcaccccugggagugggccugggucuugucuuugcgucuucucuggguaagcugcuaugccuuaaaggguucagguacucugaagaauuaagauuuaguuuuuaaagcuauuuaaaagauuugauugggguuugauuauuucaaugcaucauaaaaucuuggcuuauaguuaacuauucuuuuuauuaaauuacuuggaaaugaucaagcugacuuggaaauugcucuaauguucacaaguaacccauuggagaaaugacuacccauaaaauguauaaguaccuacucaaaugucaagaaauacaaagguagccuuaaauaauggaaacuauaaauccaguuguaggagaauuuuuuuuuaagauuauuuauuuuauguagaauagcacacuguaacugucuucaggcacaccagaagaagacaucggcucccauuacaaauuguugugagccaccauaugguugcugggaauugaacucagaacgucuggaagaauagucagugcuuuuaaccgcugagccaucucucuagcccaggagauuccuuuuuauaaaauauauauauguguguguguauguauauauauauauauauguaauuuuuuucuuguuucagggucuauguuucuucccccuaccucuguggcuggugccacucuguacucaguggcaauguaugguggauuaguucuuuucagcauguuccuucuguaugauacucagaaaguaaucaaacgugcagaaauaacacccauguauggagcucaaaaguaugaucccaucaauucguaaguaauccuuauuguuacuacuguguuccaugguguuuuguauuguguguauuaguuucacaggguaccaccauaacacaguagcauaagacagguggcuuagaauuuauucucuucaguuucugaggcuagaguauuaggcaggauggggagcucugaaggcucugagagagaaucuguccucugucucucagcugcuuaugagugcuggugauccuuggcuaguagauagccaccucgaccuucaucugccauucuuccuugccaggguccagccccagcaugugguguuucuucuuucuugucaguucuucuugaggcugcagagggggaagaggguaggcggaggguaagacuuugucuuacgaguuucugggguaagacuuugucuuacaagaaauuuaagguugcuauauaauaaaaaguuuacuuaucuaagucuaaguuacuaugcuguuguagcugaccugccuucuguguuucucugaggccagaaacugcagucucaggcacuuaguaccccauccuaaaacagcaagagauuaaguaaaggauuaauugcuagagccuuuucccuauugcccagaugccucuugcuugucaggcuagagggaaguuuggagcaauaaacuucuauugaaccaggagaagagaauaacacucgcagaaggaaaaacuuuuacauaaacaaauaugcauaaugucacauaaauucauauucagcuucauucaugcucauuuauucauuuucauucaaacccaguugggcccagcuugcaugcauucucacaauuacacacaaacacacacguauucauucucacaauuacauacugccacagacacauggagcaaaagaccaagcacuggugcagaaagaacucacucauuuuggaugaaaaaugcgcuccaaucuuuauuacauagagaaagaaaaggcuucuaccuuuuuaaugcuaaaugaaucaaacccaugcuuguaagaaaacaagcuuuguuucuuuuuaguaagacuaaaccugccuuaugguuaaggagaagccugccugcuucucucugcaacaucaucuuuuuucucuuucucucugcauucugcacauugcucucuuaguauuuuauguuaccuauaauuucuaaguuacuccacucugcauucuccuucuaaucuaaaaaguguucugucuaaaaacuccucagcucaguugcucucucagcucaguucuucucaccuccguuccucucaccccagccccucagcucugacucuucucuuuguccucagcucuuaaacaucauucagaauacaugaucacguguuaaaauguucaucaaaauucacacagaaaaucaaaucauaaauugaaauagaaguuuacagcagagaauauuuacaugcguauccauuaggagugauucaucacuugucucagcuccacagauucaccaaagguuuaaaacuauaacuaaguuaagagaaguuuggcauagauaaacccagucaauauuuuaucuucuguccuagcaucuauaauaaaccauuauuucccuuuguaugaccuuugguuaauuguuuuacaaccucuuggaaugugcucugaguaugagaaagucugguuaccaucuaagagcagcuaacuggugacacuugagagacuggcagaguucucauugcagcuuugacuaucagaaaaggaccuaauagaagucccauuauaaaaaagcuuaauaaucacagauagaauuuuaggaauucuuauaggaucaucauuaagauuuaagucaucuauuugucucuauagcaucacuacaagacagcacaucucuguggaucugcagagaccugcuccaaagggaugugcuacuaagugacaguuauauguguguaauaauaacaggaaaagcauauugauagcaggaaucuuuccugaaaugagucccucacagccuugcuuaaugagagcucaccaguugcagguuauauaauccaaggcaggccacuucaggaugaucaccugcuaguuauuagcuugucccauuauggcuccugacacucccuauguuguauaucugucuuuuaauaaggccaccagacauauucuaguauaaugucauuccaaauuacauuguaauuauaucuuugaauaccauacuuccaaauaagcaaauaggacuaguacugggugucccuccagcaggucaaaucuugcuacuucuguuggaguagacaguagaaaacugaguacaaugcagcugacuagagcauuuaggggucaguuacguguccgaccuguuggaaugcacauaauuaacuggaauguguaaggaaggaaaacagcccugaagacacuucuccuugugcguguuuuagacggacucaacucguguugacauucaauaauauaaaauaguguucuuucuuuuuucuuggauucugccuagaguuucagagugucucucacauuuuuaguaacguuuuccuuuaccuaaaaauaauguaaucgcuuuuuuaaauguuaauauaacacuuguaguuuuguagcagcuuucuuaaaggggguaaaguggguauauuuauccuacuugaaaaugccagacuguguuugcaaguuuuuuaaagguguguuucuuugaacuuuuuugguuauuccauugucugacacccagguuugauagucacagcaggaugucagagaacagauaguccuuuaaaaauuguguccauaucuaaaaggugauugguucuacaagaaggaagucugaauguuaucuaguuuaggacuuuaacuaaccuuaaacauuguauuuuuaauuuccauuuaauaacuaacaauaggaauaacgaguguuuuuccuuuauauugaacuauauaacuauauaacuauauugucauuauuauuagaaucauaucuaucuguaauauuuuuucuaggauguugacaaucuacauggauacauuaaauauauuuaugcgaguugcaacuaugcuagcaacuggaagcaacagaaagaaaugaaguaaccgcuugugaugucuccgcucacugaugucuugcuuguuuaauaggagcagauagucauuacaguuugcaucagcagaauuccuugagguuuagaagauagccugucaccauguuuaaaaugugcaguaaugcgacccuucaggcaugccuuuucuuuuagaaaauaaaugcaauagaugucuuccaaauauauuuucaucucuuaugcuuucauacuuuaaaacugcuuugaugaaugugugaacaaauauauuuuagaagauuucaaguauuguuuuauguauuggauaaguaaaauuuagcaaauuugcgugucuucauauuguggaagccugcagaauauuucaguggcaucaugagugacaaguuuuuguauagaggucagagagauaaaaggcaccugcagucaguuugaaugcccaggacaacacugauuguggugagccagugaaagacaucagagauguggaacaagggaccaccaaaugugggguuaacaaagacacggauguuucuucugugcucuuaauguccuugagguugacugcucauugucaggacaguccagaguguuaaccauacagagaaucucugcuggaauuaugucuguguuuuacuaugaagucuuuagaacaagcagguuggugguggcgcacaccuuuagucccaucaucugggaggcagaggcaagcagaucucuaaauucaaggccagccaggucuacaaagugaguuccaagccagacaaggaccugucucuaauacaagcaaacaaacaacaacaaacacuacccgcuaugcucgguaugauguacuacuccaaagcucaagacuccuuugcugucagaugugugguguauaugcaguuggacaggauuuagguuuugguuuuugguuuuguuuuauuuugauauuuuucucagugucuaauugaaagcaugcuugcuuucucaucacagcuuugacagcugucagaaaagccucuuuguggcuuaugcuaagauuaggauugguuuuucuucuaaaacuguuggcuuccuccguucccucucagcuuaagcaugaacaaagcaaacuuaguugaccuugggaaguauuugaaugaaaacuggaauggggaggugcucagcuuccuugugacauaagauuuuaauacagaucacuuguuuguggugagggguucuucauugaagucuguauguauuuacaaaauaacuauuuuugagaaguauuuauuacaguaauccauaaguaauucuuuuaaucacuuuaaaguacacugaaugcuaauuucugaaauaaaaguuucagcuaaguggc

SEQ ID NO: 12216 - RNA, 4690 nt, Mus musculus
cagguuuaucuggucucacuccauccccucuaguuuuggagcugcuggggggugggggggacggcgggggugggggacgcaucugcaacuccuuuaaaagccugugcccagcgucucccggguucuuuuuaguuagugcuggaacguggaggaagcugcucccuccgaagcaguaaaccagcauuucuguuuguuuguuugcuuugcccuuaguuccgucacuccaaaucuacccaccaaggacccugacccuguccacuccaggcgaaucgagaccguccggcuggguccccccaauuugggccgacuuugcgccuccaaacaaccuuagcaugaugucuuaucuaaagcaaccgccuuacgcagucaaugggcugagucugaccacuucggguauggacuugcugcaucccuccgugggcuaccccgguaagugaguccgcggccuucuagacgcccuuccacacgcccgccccucuggagcuccgagguuggagggcgcgcuguccucacucaagcucaaggcgggguucccgauguauuuuccuugcuaccaaacugccgagugccacagagcauuuacugacccaagagggaacaagaggcugggaagaggcgaaucuggggucugcagaaguaacagagaaucacaccgcuccauucuuaacucgaguggcuuggcgacauucauugggcuaggucguggaagguuguugaccuugucacuugagcacgcucuugcguacguuuccacguccaauuccuagcuauuacuucccugggagcaaccgaauucucuccccuacugucccuuccaguuuucccuggccaggggcuuccagggguuuccgguacgucgaugcccugucccuuuaauccuuagagguguggcuucccuccaggugccagacaauuuucuuuucuagucagauuccucccuccccccaaccaaaaacucauaaaaguaugaacuaugucccauuuuaaagauaaaagaacaaacgucccugugguguuaaaauaccgugggaacuggcucggcguucgcugcgucauucugaaccuuugguccucauagagccuuuaacuuuacuagucagccuuuucuggugaugugugugaucuagagguuguuauuugcuuguucguuuccagaacugggcguggggaugggaauuguggcuccuuguuuuauuuuguuaguuccucaaguaauuuguagcuggcgucggggggggggggguuggaggggaccgcauuacacugggaggucguguguccugugaggcucuggaagggguggggauacuggguaacgcggugagaggagggaggucggggagucugaggaccgaggcaaaaguccugugacugagaaacugcucccccacccuaaagggcccugggcuucuuguccugcagccaccccccggaaacagcgaagggagaggacgacauuuacuagggcacagcucgacguucuggaagcucuguuugccaagacccgguacccagacaucuucaugagggaagagguggcacugaaaaucaacuugccagaauccagggugcagguagggcagauguagacacuuuucaaucuugguuuauacugaugacccaaugaggccuugucccagaccaaagaagggcuugaaauucuaaacccucaggagccaggggacuuuuuacuucccuuucucuuccuguuccuccuuaaucauaugaaccagggucuuuuagccugguuuccaaggcuggaagcagcacuucagcugcaaugagaaagucuuagaaccuguaggucgcaagagucccuacaguuggagaugcaacacagggcagauuucaaagguagucaugugguccuuguguggcaauccuuuuuguggacuuuuauguugagggagcaggggcguggagcuuaguuccuggacaguccaaauuuuaaacacacacacacacacacacacacacaaacacacacgaagaaacaaagcagaugacuuuaucaaggccauaccuaauuuggugacagaaucagaaaaggugcucuuagcaaauaaguugacaaaaaaaaaaaaaguggugugucuguuuguggaggugacuucuggaggacagaacucaguuuucuagcucugccacuuagcagacuacucacaguaucugugcagauacucucguuccuuauucuaauuauccccauaguugauucugaaagggagaaagucuaccucucgacuggagagcaagcccuauauggaacucuuuggugcuuggccccucauuccucccauuuccuccccugacacgcccacacaugacacccuuccuuuggguaugauaugguuuugaaggugccagacaucagugugaacuacaaagcagaaaacuggauuuuucaaaguggcuuggaaaaaaacuuuaguacuuguaagucuugacccaaagccuucacgagaaauaaacuggcuccagauauuuacugcuacugagaccagcccuggugggagggggaaacugcuuuugccauacuuguaagacccaaacuggaaaacuccuucaacagaguaaucaaggaccuguagccaauggccgagugugguggguuuucaccuuagcacuagggaggcagaggcagguggauauuggaguucuaggcuagccuuaucuacaaaguuccaggacagccagagcuaugaagaggcagaaccuguagcuaggucagaucucaguuccuagcauaagcuccuacauggcagaggaugcauaaggcugcugcuaaagagaguuuucagauuggcaggcugaguuuuaaucagugaauugauguagagaacagaguacguugugcgugaaucugaaggcaccaacuugaaucuugaagacagauauugaggucugucuuugagcucaaagcagaaggcauacgagucaguucauucacuacaaaggggcuuucagcagacacuggcucagaucuccucuccacaggagcaugucuucuuggagauuucuuuuaugagucuaggagagacaaaauguuaggucguggaaccagccuccauauuagcuauugcuuccuggacagugcaauguaaacuguuugaacuuagucugcucugggugacaugcaacaacagaauacuuccuucuauaagacauagacauagucaucccaaaauacagugaguucucuucucucuucucucucucucucccucucccucucccuuccccgcccccgcccccccccucucuguguguguguguguguguguguguguguguguguguguguagaggaaacgaaauagaaagcaaaguggagaauuucuagcuuacaauuaagaguaauuaccuuacauuuucuuguuaugaacuccgcauaagguggacuuucccacaacaggagaaauagaggugagaggguuuuaugaguagucucuaagcagcaaaggaaauugucugauuauuuagccaugugaucugggaugacucuggaguuguguccauguuaaagaaguuucuuucccuuucaagguaugguuuaagaaucgaagagcuaagugccgccaacagcagcagcagcagcagaauggaggucagaacaaagugaggccugccaagaagaagagcucuccagcucgggaagugaguucagagaguggaacaaguggccaguucaguccccccucuaguaccucagucccaaccauugccagcagcagugcuccagugucuaucuggagcccagcguccaucuccccacugucugaccccuuguccacuuccuccuccugcaugcagagguccuaucccaugaccuauacucaggcuucagguuauagucaaggcuaugcuggcucaacuuccuacuuugggggcauggacuguggaucuuauuugaccccuaugcaucaccagcuuccuggaccaggggccacacucagucccauggguaccaaugcuguuaccagccaucucaaucaguccccagcuucucuuuccacccagggauauggagcuucaagcuuggguuuuaacucaaccacugauugcuuggauuauaaggaccaaacugccucuuggaagcuuaacuucaaugcugacugcuuggauuauaaagaucagacguccucauggaaauuccagguuuugugaagaccuguagaagcuauuuuugugggugauuuuuaaauaugcugggcugaacauuccaguuuuagccaggcauugguuaaaaaaguuagauggaacgaugcucucagacuccugaucaaaguuaccgagaggcauagaaggaaaaaggaaggggccuuagaaggguccaucaaccagcaaccugaaauggacaaaccaaucuacuuaagauucuguuauaguucuagaucauugguuuccugauuugcaaaugauugaucaaauauauucuagcgacaugcaaccaaauaccacucaaaacaaaaauccagcaaaacugaguugugagggaagggagggaaggucauggccuucaaagcagaggugauccgguguuuuagccaaucuuugguugaaucuuaggaauggacaaugucccaggcucauucacguuucaugaccaacagguaguuggcacugaaaaacuuuucagggcuguguggauugugcgacugauuguccuagaugcacuacuuuauuuaaa

SEQ ID NO: 12217 - RNA, 28733 nt, Mus musculus
ugcgggcccgcgguucgggcggcuccggcucgaggucgagcucuguugcugcucucgcccucggggcugcaucguccucccgcuuggcccgcucacagggccgcgcacgacucguucagcugcagccccgcugccggcgcccggggcgcugccgcggccgugagccgacgaguccguaagggcggcggggccgcggggucggggcgcggcgcgcgggcgcaggucuaugucgcgggcggcggcggcggcggcggccgcgcagggacgaugcgcgaguacaaagugguggugcugggcucgggcgggguaggcaaauccgcccugaccgugcaguucgugaccggcaccuucauugagaaauacgaccccaccaucgaggacuucuaccgcaaggagaucgagguggacuccucgccuucggugcuggagauccuggacaccgcgggcaccgagcaguucgcguccaugcgggaccuguacaucaagaacggccagggcuucauccuggucuacagcuuggucaaccagcagagcuuccaagacaucaagcccaugcgggaccagaucauccgcgugaagcggugagcagagcggggcacacggggcucgguggcugcggcgaucccgguccuuggcuugcccgggcuacaccaccuccuccaggggcucagauuugugggcuuuguuucacaagugaaauugggcauccuguuaacccucagcccagcccuuugucucuaggacguugguagcgcuucuucgggacccuagaaagaacaaaguuucaaacuugcaaggaaagaagggaugaguaggugggcgcuagggaaaggggagcugucuuaguguaggcacgccugugaagagugagcgcgcgcuuaaaugcacccguaagagguuugacagccgaaauuuguacauacauaucuugugacagugucaauacuaaguuaggggggaccuuucucguugcggaaaagauuaaauguugccaggagguuggcagaaauggauuagugcaaaacuuuaaagacacauuggcaaauaauuugaagaccacacaacauucaguuggcuuggcauauagaagcacacuugugacauuuacgcggagagcgugcagauucaguucucuuucucucuuaaaagcuagccuccucaucccccccccgcaccccccccccgaaaaaaaaaagaacagggaaggaggcuauucuuggaaaacaaacagaaguuuagucugaguucuggcuuguguaucagcuaauuuaaaguuaaugcaaaaaaaaaaaaaaaaagaagaagaagaagaagaagaagaagaagcaaacaagcuuuuuccugauauaaaguguucaaaggauguauuuuugcauguggcuggugaccugaaugcuuuuaguguuuguucucucuuaaguugaugcuaugcauuuuccccuuaaccuuuuaaauacugaaagucuaacauguuacuacagaguucuggcaucauuuucuaguucuucuuuacugauaacgcuccucucugguccuuauuaacuaauacuacugacagucuuccaggauuauuuuaccuguagcuacauuugaagucaccauugaagguuuagguagaaacaaucacacuuauccaucauuugggguuuauacacuucagagcucagagcaaguuauuuguauucagggaguacuuaaaaauuccuuccaagugguguuuuuuuuuuuuuuuuuuuuuuuuuuuagugguggguuuuuaacccuguacagaggucaaaggaaaugcccucuccucagugccugcuccagccagacuagaaauuucuguauucccgcauuaaauuccaaaucacaaagcaguggcuaugauuaugaucuuuucccaaaguuggugacacugguagccuuaacuucucuaguguuauuuuuuagaaauguguuuccuugugugguacacacguguggguguguuaauacguuugucucgaaguuguuuacagaucaugauguaagugcugcaguugucccaccuucacacccagugcaugcccacacgucugugcuaagauccccaauggcaugggccacaucaugucggaguuucuguuggcuucguguagcucacguuucucaguuauaaugaugggccaguuuauuuacuagagcaguccguuggcaucucaacccaggacaacagacugagauugggauucuauucacccagggucacuaguugcagcucuugauguaagaagagcagugaugagcugaguugaguugagcaacuuccugugggguaaauguugugucauuagagccucucuggacccacuuucuuuuuuucuucuuuucuuuucuuuucuuuuuuuucuuuuuuuuuuuuuuuuuuuuuuuuuuuugagacagguucucuauguuggccuggcuguccuggaacucaccauucauaccaggcugaccucaaauccauagagauucuccugccucugccauggggcacugagauuaaaagguccguguccagcuugggccccuacuucuauguccugguuuuuguaccucacccuaaguucaucauuugccuuccagguccgggugagcuguagguuauucccauuguacagcaguguauaaggcaauacucaaaccugcugugggggcacgcaacuccucucaagagaaagcauggguuuacauuagugcauuuucuacucuuugggggaccaguuccuuaacuacucaguugcuauaggaaguauucaguaauuccaucuucugcccauugugugccagcugucugcuuuacauaugacauacaagagcuuuggggcgguuaguuacagugccauagugcaguuggcauaacugaaaggcuauggcuugauaacucaccaauuacugauaaagagaauuuuuaagaugucugaguccauauagccucuucuacacaggugugucuuucagcugcuaauacauuucuucaaccagcuaacuauaaaguauuaucacuuuaauaugccacacaguauuaaacuuauucagcuccuguacuuuccuaugcuguaucuuccaagucuguuaggacuaaacaugcaaguguuugguugccauauguaccguaguagaguucauagcuuuuagauguuugugguuuagggaaauacuugcuuauuuuauaggccugaguuuccuuuucugugaaagggaagauagcauccccucccagugucaugagggugacaugcugccggguguacaugggugcccauguggucguugaugcgcagaaaagggcgaaaguccuuuuugucacucuucagguuugucccucugaccuccauugguuuuauccgugacauaucauugcagccuuagaggaaauaauucauauuuguaauugugguuuaaaauuccuugccuguuacaaagagugcuauggaagagcaauguaaauuagucuuaggaaaauauuuuguugguuuuguggaguagcuucccuuauggggagaucuuauggggggaaaggcagggaaaugaacauguaacacagcuccacaaauggagcuucucacuguauugauauggucuagaauaucucauuuuaaaaauauuaaaaugggcccuuaucucuuuuugaguuagguguguguacgcacaugcauacuugugugugcauucaugcagaggccaaagguuggcaugucucauucauuugcucugaaccucauuuuguuuuuaaacauuuucauuauuauguuuguguguggaggccauggcacauguauggugauacacauuugaaggucagagggcaacuugacuguccccccuguuuuggguuccgguaggcagacuuauguggcaggcaccucugcccacugauccauugccuuagucacuagucuauuguugugaagagacaucaugacagaggcaacuauaaaagaaagcauuuaacuggggacuugcucacugcuucagacacuuauccauuaucaucauaguggagagaauggugacaggcagggcacuggagaaauaguugacagcuacagccgcaaacaucacaggcagagagaggcagccccgggaccuggcaugggcuuugaaaaacucaaagcccagugacacacuuccuccaacaaggccacaccuccuaauccuucugauccuuucaaacagugccacucccuggugacuaagcauucaaauacaugagccuguuggggcauucuauucaaaccaccacagcucccucuuuuaaaaaaagauguaugaauguuugccuacaaauauagauguguaccacacauauauaccauggaggugagaagaggguaagaggccuccagggaacuguaguuacaguacgaugccguguuggugcugggacugaaacccaguuguucuguaagugcucuuaaccucugaccccuuucaagccugcuuccuuaguuucuaagacagagugucucacugagccuggaccuugaugauuugguggacagcaagcucgggguccucccauuucugccuucucggguacugguuuauagccgugugcugcugaguauuuuauuaggcuugagggcucugaguucagauccugaugcauagauggcaaguauuucuccauuccuguucccccugccucccuuuucccucccucccucccucccucccucccucccucccucccccuuccucccucccccacucccuccacucuucaucucucccuuucuuucacacacacacacacacacacacacacacacacacacacacacacacaauauacauacacuugcauggcacacacacaaacagaagacuucaaagucaagugacaaaucuaaaaaugucuuuuguguaaaucauaugccacuucuuuuccuccuccucucccucccccucuccuuccucccccuccccuccuccucuuccucuucuuccuucuccucuuccuccucuuccuuuucuuccuccuccccuuuuuuuucuucuuuuugcuugacuuuagaucacacagaaaaagaauaauaagcacuuagauuuuaacagaacaagaauucguacugauugcauuauuuuaccuucuuaccugucucaggauuaguggugguccugacuugaaguaucuuggaaccuaccacuguucuaggucuguaucuuaggauaaggcucauagacucugagcaugaccuuuaagugcacaugcucaggucccccacuggccgugcagaugcaccuccccaccagcauccccgcuuucuuuuaguuaaaaaccucucucucugacuucuccugccuugguaccuguugucuuuuuguagaauuaguuuuuacccauuucuucacccuggcuugaaauauuucuucuugaaugaauuccucuaacuaaccucacaccuggccccccucaaccacacaacagccuggaggcuggcacccuguuccucucguccuguuguaguguaguugcacauguuuugcugggaugguuugcaagcauucucacugacucaaugcccagguggcuggccugagaccaacagcgcacaggaaacaacaacaauacagcaagagaggaaucuucagagaggaaagcacuuggacucaguuuccccaggcauuuuaguguuucgaguugauuuugcagauggaggagaugcuuucugcaagagugcuuccagucaggccagcaaggaagaggucagaggucaggcgaacaguaaagucagagaggauguccucuggcuggaggaaauggcauggggagugcacaggguagauucuggguguuaaagaaaccaggacaacuaaacuagagacuuacauagaccugggggagggggcugagggcagguaacugauuuuaaaacuuaaagacagaagguuaguuagaccaauuauagaaauaacaacagagaugagaugguagaugguguaauggugaugggagacucagcagucuugagcagugcgacuuagugucuguaugauaucuaaagccugggcuagcaugcugacuagagaaagacagggguaagguuguccagaauucagucaucaagcagugggagagggaaaggucaaaggugcucuucacaucugaagaugggugagugagauuagagcagagucacagaaaaugccauuucagcccagaugacaaucguuggaauagcccugucugauaauuagaauauuugaaaaggccuugaaggucagguuccauaugaauguccgaacucggcaucaccugcagagcccagauugagacuagccgacaccugcuguguagagcacaagugaguagauguggcugggaauaggaauuagaaucaaaugcuuauagucaaggacagagcuggagucacagggcaaacaaugaaggccgcacacagugugcucagcuacaagccacuaagacuggggcaggcuucaagucuucuuagaaaccaacacugaaucccaagcaaggcuccccagguaaagagccuaaugguugugagucacuuuuuaaaaugaaugacugugucgugaaaaguuggugacuaaauccugucaaucaaacauugaagaguuaaacguaggaaaagauuaaugggaaauguugaucugcuuaaacagaaaacucaagaucaagaacuguaaggagugugguuaaggaucugguggcacaggcggguaggauuugcugaaggaggcagagacaggaggaucuggaguucgaggccagccugggauacacauuuuuccagggcuauacagagaaacccugucucgaaaaaaaaacaaaaacaaaacaaaacaaaaaagccgggugugguagcgcacgccuuuaaucccagcacucgggaggcagaggcaugggaauuuuugaguucgaggccagccuggucuacagagugaguuccaggacaaccagggcuauacagagaaacccugucucggagaaaaaaaaaaagggggacauuagcauuaaacaccucagcaauaugaaagaacucagcugcuacauacagaaaugaggagagggcauugaguuccauagccuucacuggaggaacucggaguuacaaauguaacacacuuuaaaacacuucucagacagcuugcucuuugaaagcucauugauuuuuuuugucuggcguuccccacacacugguagaccaucaucacagucaucacauugcccggcccaagcuguccaucucccccuucauucucuugagucauuaguuucugcgugcucggaauacuuaaggugugucuucuugguaggucuuuaagugccugacacuugcuguauucccucugcaggacucagaacauugcauagcaaacguuaguuuaagauggguuuugcucucuguguuccagaggugguuucuugguugguugcuuuucucuuucuucucgaggaggaaacuuguguuuuuuguucuuuuuucugaauuguaaaauuauaacauaauaucacuauuaugaugcaauaguuuucuuggcucuccuaggauuggacucuucaaacuuaauuaacauuaaggaagaucagaggaacugguaaaaaauauuugaaaauaacccaaccagcaggagaacuggcaguguggcagacuuacuugcuaacauuuguuaguggugauaacacguggaugacuuaauggccaugggagccucuaggagguuacauaaggcacauuaaagcgaaggauaguucacauuuaugcauauuucuaagcaaggacuguuggacaaaccaaaugcacauuauacuugaucuuugagaugguggugguggugguggugaugaugcacagcuuuucuguagucagcauagaucucguacccuagggaggaaagugugaguccacucuaggcuucaccgugcuguugugacuccuguaacugugguucucuagccuuaccuacuucuuucucguguguuuauuguuuuccaggcuaauggcguaaaguuaucaauaauuuuuaaucgguuaggaaaacuaauagaguuugacuguaagaacaccagacuuuacaacaagacuuaaaacuuacagauagggaggaaguccaggcugauacuugcuguacaggccacaguccgucccagcauccccuggaaaagccgggugcacacgcuuacccaccuuccucucccucccaagugcugagauuaaaggugugugccaccaugcccuaccuuuuaauggaauuuauuguaguccacaggaacguauaauauuguacguacauaaaaugcaaacauauguaaaauuuaaagaaaucggaaauaucugagaacagucacuauaaucuuauaaugguacauggugaguccuaaauugcuuagcuuuguucuuuuaaaagauggacaucucuuuggaaauggaaggccuaauacgccaacggugucacuuuuauuccaguaacagccugaauguuuaaaguuaauuuuaucaaucaccuauaugcuccuccccuaacccuugccagguguaaccccauucuuacacauucaacuuuguguccuuuaaaaaaacaaacaaucuuuugaaagcacucugugcugcccgaauguucugggaugugugcuuguccacuggagcaugguuaacuuagagggaucugucucucuuccuggcagcuaacagucaccaggagcuccauggccagggugggacugagucaaccuccuugccuguaugugggauuugcucugccuuagguuugcacagguucugugcacguugucccaacuuuugugaguucacaggugcagccacucuacaguguccagaggauaagcacuguuuuguuauagucugccaucaccucugguccuuacacucuuccgccuccccuuucugcagugaucccugagccuugauggggguugggggaugugguggugguggacuauuuauucccuuuaaggcugacaguucugcagucuuauccguagcaccuuggccagccgugggccucugcgcaccaucuucugagaagcccagcuucucagaugagcacuggcaggugcauugaucugugggcacaacacugagccauuaggaguagguuuaaucccauauccguguagcagccagcauagcaucagguucuccugcagggucaaugaccuaccugucucucuguagaaucuuggcucaguaauggugccaggcauggaugggcucuagcuuguggaguggggcuucagugcagucagaaacaucucagcgucugaaauagcauugcagauguggguguggcuugugggcagucacugcugcaacucacaugguucgguucguagcaucaugaaagcuagccaaaaggaaugaagcuuccaggccaugccagcuugaucuuaccauguuguagcucaaggaugugguaucucagcguugggggucuuacagcccaggucuagauuguaaacaagaacaguggcaacaucuuguaauguuuccuggucuacaagacuccacuagcccauaucuaaaugauggagcucacgucuggcccugggccuuuagguugccagccucugguguccagugggcacuguugccccuauaaacaagucuaguuuuuaaugaucuuccauuuaaauaguaggcuauuagugaaagaggauguuuugaaguauaugagugaguuugagugcgguuauggguagguuuuauuaagggcaugguuugggaaauccugucacuuuagcacuggaaauuugaugcggcuaaaauguuggaguuguacccuaacucacagguugcugaagaguguuucugaguucaugguuuaaaguagacugcagcuguuuagcaagcauacuuaaguuguacauucuuguucauaauguugaaauuuucacugaauugcauagguaggcuguggguuuugguuuguauauacgauuuauuauuuuuuuuaggauacauuuaugauuuaaagacauaccaaaugauauuuugaggagaaauacaaugacuuaauaacuuuuauaugccuaagacccugggggguaaugaaaacaccaucuguuugcuucucuuaguccagucaccaauugccuucacgucuucuuacccaaggccauauccacuguccccucugcgcaagacagauacacaggccugaaaccaguugaguauuuaaaccccucugagcaggacagacacccagggcugaaccagugugcauuuccucucgcuguguggcuugcacuccuuuucaguucauuuaucaccacagcgcucucaucacacaugauuuggagacugcugucuuagguaacuuuacuccaggaacacuagcuggaacugucuaaugcuuccagacaguucuucucuccuggguuuccuaguuuccugccaugauaccuuauugaagaaugugagagagugggcagcacaguuagaaggagaguugguguauagucgugcaaucuuguucauccauugaggaaagcugcccccugccuguuccaaaccuaaagcagagugagggauaccgugcaggaugagcaucuguaccugaaaugucaccugaagccagaaguacuccccucucugcagccuucugaacccugauggcucagugcagaaaucccacaccugccuucaugugaccaccugcgcucaaaaaccacagcugcacuacaagugcuguaugcgucggugugggcaauaugccuaaguguacaugaaacuaaggaauuucaugucuagacauggguuccauccacaagauacggcgacccuccccaagucuacaaucugaagugugucugguccgcaugucucagauaagagguauucagccuguggugaugguggaacuuuguccacaccuacaucucauggcugggacaugggagggucagcugugcugguucaggaaacccgugaagacagguaaaaaggccgcaguugcugauaauaucaaaucacuuaguaaaaccacccagggggagcacucuaagccucugcuuggcacacugacuuuaacgaguugcuuccuauacuuacugucaccucagaaguuaauaauucagaguggaaauucugugucuuauuaauuauucauuacacauuaauauuuucuucuuuaccugaagucuuuauggcucacuaagugaaauauuaguguuuuccucuguaauuggucauauguuuuauuauagaucuagauaugcucaucuuccaguuuucagugaaugccucaaauauccuauacaauucucaaaugugacauuuuugauugugcagagugaucagaccuucucaucuaugcgacugacagugaguguugcugcgguugaagcugaacuucagcucuuacuggcaauuuaguuuccacaucugcaacaugguuaugauaaauaacuaaagaaguagugaacauaaaaugauucuuuacauaaccaccccaaaaugccaauaaaacaguuucaagggaaaucacagaaagcaggcugagacccaggccucuguuucuggggaaccgucuagguucccguggagcugugcugggccuguuccucugccucagcccucacaagcugugcacugagacuuacauuguaggccuuccgugcucugaguucugggucuuugccugccccuugcaaacuuaacucugcugacaaggacuuuuuagcugggaagaaauuguaguggucuuuacuauauguguuuuaauuuuaaaaaauuauauauaaaaacaaucagcguagaauauuaguguuugcuaaguaacauuuuucuucuugagaaguuggagaugauaguagaucuuuucaugaaugccaaaagcuuuaacacucuguggcugguuauauauaguaaaguguugacagauuuuucuuaauaaaccaauuccagaaaaaguuuuaucugacuuuguauaaaaaccaucacugucaacaucaaauaauauggcuuaagccacccgauuugcauagcauugcccugggcauuaugcagaauaaauacaguguacuaucuuuagcuaaugugccaaaaugugcugucagugaauauauaucugacagcucuaacuuauaccgaaguacagccuuaaaacacuugacuuuuaaguuucgaaauaucguccaccagaaacauugcuuuuaucaggaccaccuuucuuggugaagguuuugcucaucuaacucauuaaagguaaaaaaaauuguccuaagaacaauaauuauauauuuacauugggaaaugccuuaguccguugaagcugcuauaacaaaauaccccagccugggugacuugugagcaauagaaauauauugcccacaguucuggcggcuagaaaaaaaucuaaaaucaaggugccagaauauucaguuucuggugagggccuguucauagauggcuccucuucacacaaaugcaugaaacuggaagagaaaacuuggaugucucucaggccuuuucuaaugcugcuaacauagcaucuccuggggacagccacucaccugguaaagcccucauaucuucauucucacuguggagaugacguuaggcucaacguucugaacacagugcguagucacuauaguuuuaucuccuuaaccaagauaaaaauuccuucuccuccuggugaccccuguucucucuucuccuccuaguaaccucuguuuucucucaccauucacuuuuccggcuuugggaaccaacagucuaagccaacuuaagccaucaguuaauaagccugguuagaaaacguaagggcuggauguccguuguuaaggccuguaguuacauauaugcauaccugaaggcuagcuagagucacaugcauacacacaugagaacccuuaccugacaaagggcguauaugcaugaaagccagcuagaaaaugacccagacuucaaguugguaguuuuguuuuaaggagcaagggcugagagaguucucagugacuuugauucagccuuugugugcuaacguggauauggaaggcacgguucugguagucugccacugaccagaguuggaggucuguuuguggccuuaccccagaaguauuugugaggagccccugcagugcugagcugcugcuagaggggcugugcuaggggagccuccagcuggauuccugggcugagcaagguguggugcggccccauccacuagcagcaucacgccaacagcagccagcgugguggugucuccgucccugacaggucaguaccucaguagcgacaggcagacuguuuauuuccgaggcuccccaagcacacacaccgucuggugaaaggaaugacugaggaaggagaguucuuccacugcucucagcagcacauccuuucuucacagucuguggcuuccagcagacccuuugaauaagugcugcugcguggcucuggcccuuuccccacaggcgaccacaucucauucccuggauccuugaggcuuaugucuaugcgcugcacauuccucuccgucucagaagcaucccacaguccaaugucugggauccaacucacgaucuucugggcuccuccaagggcuugggucacuucuccagccaugcccuuuguagcacacacauugucuucuaggcuccagaugccuguacuccacugcugcugcugcucuugguagucaucucaugguacuggcuucuccaaaaugcugcugccuuccacuguaacuuggauuuaacaauagccucucauaggcucucuucauggugcuaagccucaaauccuuugcaugaccccuucaguccuaggccaucacuugcaacugaggcugcaccuucaccaaugaccuuccauggccucacacagugccgagcccaggcugcucugcaugaccccuucaugccuucaaaaccaguaccaccugggugacucuuacacaguaccaagucccacuguagcaggagauacaaccuugguuaucucuggaacacagccucugugcucucaaaaaaaaacuucccagaagaugucaccucaaugaugcuggucucuucuuaaucaccacuaauuucuuagcuccagcuaaccagcaucaauagucccaguaaugcaaaguuuuugcuuuaguaguucugguaucuuguuaaucacagcugauucuucagccaaguuaaccagaaccauagaaucuucacaauccaaaauagcgauggcucugaaagagucuuuaauuuucccucugaaauuucacaagccaggccuccaucuucugcacuguucucaacauuaucuuccaagcuccuacacaauaaauaucccacagagcucucaaugccgaauggauccuccagcccgaaguuccaaaguccuuccacaguccuccccaaaacauggucagcucacaggaauaccccacuauucugguaccaauuugucuuagucaggguuucuauuccugaacaaacaucaugaccaagaagcaguuggggaggaaaggguuuauucagcuuacacuuccauacugcuguuuaucaccaaaggaagucaggacuggaacucaagcaggucaggaagcaggagcugaugcagaggccauggagggauguucuuuacuggcuugccuccccuggcuugcucagacugcucucuuauagaaccaagacuaccagcccagagauggcaccacccacaaggggaccucucccuuugaucacuaauugagaaaaugucuuacagcuggaucucauggaggcauuuccccaacugaagcuccuuucucugggauaacuccagcugugucaaguugacccaaaacuagccgguacacacaccuagaaagacuguaugcuuacauugucccagugacaugucugucacuugaggcagcaugaaccucuugaggaaacuucuaaugugauacccaucaccucacuguuacucucucgguacgcguaagcauccgggagcauugcaacagcgggcgggcggucaaagcuauggcccagacagugccgcuggccguggcuguuguuggacaacgcccacugguguuugguagguuaagacuuuaguggcugcuaauauugugcagagcuggugaguuucuucucuccuuuccugucccgauugucuuaccacggcaucagagacgugcuucguacccugugacagcaguguguggugagaaagagaugcauugauaaggaaaaauacuuguuuguagaagaagcuagauugucagcuuacauggauuagagggaauauugucuccuauuuuuuaacuccuuuccauggcaauuaaugacauuuagacuaaauaauuagauuuggucacacuugggccaaacaauguaauccagagacaggagggaagauacuuagcaacagaguggauauguuuuuauaguucuaucacuccaguuaagauucuagagcucucuugcuagcaaaugguuugaaggaaccuaaagaugaauagcuagcaucccuguagaauuuuacagcagccauacuugacggggugauccgugugcauugcugagcgcagagucuggcguaagccaagcccucugcagaugcugguuguuaguaaugcucuuacucucaucaccauugacauuauacauuaauauuucugucucacaggccgagagcccugguuccagaaggacaggcagcauauccaagggaacaaacagccuuugcgguccuguaaauccaagcccaugucucugccuugugcccucuguccugguuucagccuguggccacccuugacuauagccuuuauuccaggcucuguggagccaccagacauugcuauaggacagucgggauggggaguggaccauaaaagcaguguuuuaauuaccauggaauuggcauagagugggugagaaguaggugaggcccgguagagacuggagcucaggagugagcuguauuagaaauggagggguuugagcauaugaaaauagcagggugcauuuucucccagccaguaaccugcucagccuguccccauaaccacugcuccucccagacagcuguuacagacccucauaugggucucugauggaggucagagaccucccacccgccgugcccugaguggucucuuguaacucucugagucugguuuucacguguguguuggcucgucgcugucauguauugggcacucguccuucucugcuugcuaccauaagggccccacccuggcaguguggugcagugaucagacccaccucccccuucacuugcgauuuucuucuuuucccauuguucacccguuacuuuugcuacuucagaucuaaaguucuguuuucauaaccugagcagucagugucaugagaguggcucuggacugccuagugugguuuguaugacuguuuccauuucugucagagccuuuguuuuauagaaaucuuuguuuuauugaaaucuggcauuuaugcuuguuugauuucuggguguuuugagguaagaucuuggcuagcccaggcugaccuugaacucaugguaguccucuuaccucagccuccccagggcuaagguuaaaggcaugagcugccauaucuuguggcuguuuuagcuuuaaguuuuucuuggugguggugggggaggguaucuauugauuaauuauuuagaggaaagaaagaaauauauuuaagucuuuucaugagaauugauguguucucucaggcaagcacuccuuugcucauaauuccuaaugccuuagcucuucauaguuucaagcaucuuuaagcccaccucauuuagggguaacuuuaacaaaauuauuuauuucugacacggggugcugagaagguaugcacucugguauaacggagacacgauugcucacgcagcucccguucauacagcugucagucuggucauccaagaguuggccugccuuuaaccguagaucucaaauccaacauucacuuaaaggugaaauguguguguuauguuucagcaccgugucugacucuggccaacugcuguggccuaccucauugugggucucugugugugucuguguaugucuguguccaugucugaguggugugucuguauaugugugugugaaauguccgugugucugugucugaguguauauguguguaugguguguguguguguguguguguguguguguguguugcuuuuagcagacucaaccaguuugauucccacucaguucugaugacaaggcuucaggcuuguacuugaaaauaccuccucacagauccacauuccuggcaugaauugucguuacuucuaaugauaaagagccaguugaaugcaaucauagcuacauuuuauaauuuuuuuuucuuuuuuugggugagacaggguuucucuguguagcccugggugcccuagaacucacuuuguagccccggcuggccucgaacucugccugccuuugccuccugagugcugggauuaaauguaaaccacccaguuuacauuucccccuuuaauguggguuuggaaaugcugcagcaucuugggucuccuaaagauuuguggugcacuuuggaguugugauccugaaggaaacuuccagaacuauugucauuuucauguccagggucaugcuguucucuaauguuggccuucccuagucgaggauagagauucaguggcacagcagugauuggcaggauucagcuaaguaacagaccuacugaccaaccuaacugugcaugcuauauuauuggaacaugauuccccacguccguguguccucaguauauaguauaaccuccugaagguuucucugcuauccugauugaaugagaacuuguuuaacuauguuaccagucuccucccuucagucuauuuuuuacugagguagacuuugaugcaguagaguagacacuccuuaacccuuagauccauagcuggaugcugugccgaggacucacagccccucccaccugcacuucucuucccugcacucagcgucucuggguuccugugaacuugcauggcauacauaccacagagacuccuuccacacccugcagaccacagagccuguucuggccagaaguagaguuucucucagaguuuuagcucugcacaggguucucacagaacgacuagauaaaaagagacgggaagaacuggaaaccucccacucccuuuggccccuuuccugauucuguuaguuagaaaaacaguggaguauuuguuuccuguaucuuguugcacuuuuucugggcguuuguuaccuuggucuugcacauggugcugggguggcuuuuuaaugcauggaaaaugccugugaguuucuuucuaucgucacuugggccacccuaauagaauuggaggguucgaugucaacccucauaauuucugugagaaagcugacauuuacauaaguugcauggagccccugacagcucuaaacacacucuuggugucaucuuguuuagcuuacguuacgcuuuucacuggacaaguucaguguccacucagacccuggagggagucaaagcaaaggugugacagagagaagccguuagaaugaugggaaugacgaaagcaucugagaacuaacaaguuuagaggaagugugcacccuugcuuagcccugcccuucuucccagcucaguacuggacaggggauggcgccaggccuggagguggcuauauucuuagcauucagcacugugagugcuguauaaauuccugcuguccacuggagauucugugugcagccacacagcaguuugaugaacucaucaauggguuuugcuaauucaaaggcuuuaaaaggaaaaaaaagaacaugcauagggguuuaaaaaauauacauuuuauauaccuuuuggugcagaaaucacacuuacaaggacauucaucagauugcugguuauguuugccaaaaaauggcacuaaugauaauaagaguaaauuaggauaugguuuuaggagauacauacauacauauauguuauauauguggauauaugcauauuauaucuauguaucagucuuaaaauguuauacuguuuggccaucaugauaugcuguauuuauugaaauuaagaacuccauaauauuaagcaaaaacaaacuacuaaaugguuugaucucuucguauaaaaauguauucuucuguuaauaugcaugaguaggagaagucugaaaguuuauauacuaaaauaguuauggugcucauucucacaagggagauuaagagucucagucucucucccucucccucccccucuccccccucucccccucucccucucucccucuauucuucccccuccucuuucucuccuucuccucuccacuccuucucucccuuucccccucccucuccuccucccucccucccucccucccucccuuccucccucccucccuccuauuuaaauauuggugggaauuaaaacagaaguuagggccugugaaggggaaggaugcagacgucccaggucugaacacagcaaacuuuuaaacucuugaauucuuaacacuaacauuuaacgaacagacagaaggacauagccagcugcccauagcaugaauucugugucaugggagguguucagaacacugcagagacaucuggcaaggguggccacagaguggcugacacauuugaguauugcucuuugccucaggccuuuuuaagagaggagauuuuaacacuggggagaaaauugaaaaagggaacuaagaaaaaccuuucuaguucucuuccaaacucaaagagaauucuauuccaaccagcuuaugagcaagaagagccugaugaaaaccccugugagacacgcccuccucuuaagugcuaaguaugauagccucaaaggaggccagugggacugacugcauagaucuugcuaguuuacccugaugagcuagugaagacaagagccuugauuuuagacuugcugcaugugaggucauagaugguaggcguagggugccauuugggaucagcgucaccgaugagucugcuggugccugacaucucggaagcucagagucccucugcagacuucauguaugugaucucacagaaucagacucaguagcucuggaacaggacccaggaaucaguaccuagacucuuacguuguuuuaauaaccagccaagcuuagacagucccagaauaaaguguacauaaacacguguauugggacaguuaugaagcaacaccagucuauugauaagccauugauauuuagagaacagccgcauugagaagcccaucagcguuguauagcuaagcaauguuuugugcaauccauuaagcacagcugcuuaaaagagcuaguuuuauuuauucauacauuauauaaucacacccacgaauauaacaaaagcauguaaauucauguuaauaagacaaauguuucccacagucuacaaacaaacuaaugggccaccuucugaucccgucuauggcguccccuucaacaacgaaaguuaauggugguucauaaauagaguaauuuuggaauuuggcacucucaacuucuucccgaaugauauccauugaaaaaggagaaaugaagaaaaucacggggcugcuaugagaaucaaacaugagaguauuugcugucacauauucgcagaguaugcaucccucuaaauaauaauaucagcuuccguacguccugugucugaugaagucacuuccagcaccccgcccguccccaguucuguuucucggguaaccuguauugggaggcugagcaggcaugggagggguugcacagguggauccccaaagccauuugcuguuccuugaacugacaggugcauaccuacaagcucuugacaccuacgucauaucucacucgggaguuacccccccccccauacuuccguggcagauuccuuacuccuucgcuuaacguuguaugacaccuccccagugaagccugugauguccugugcuccuaacaugcucucuggccugccucuucugucucuaauaaacccuaaguacuuaccuuuauugcuaauacccauuuccucggcugagcuauagucagcaugagggccgaugucuuuguuguuuccuguguauccuaggugggcauagcaguauguacgauguaguaggcucuuagaaaauaaauauggugguggaugacagagucuaugauccaaaguccuauugccgcucucccacuguucugcuaccgcuacacagugggccuuugcucagugcagcccaugguucccacagaguuagagcuucccgcacacugugugcagaaguauugcuccucagcucuuggugcauccuuccuacuacugugagucaaaugcacugacaguaacugcuccauacucuggucccacaggauuggcuccacccagcccucagugugcacuuugauaucucgucuaaagaccagcccgccguauguucucaccacggugccagacacucagccaauaaguguugauuguggguugggccaccaugucugaugugauuuuuaacuuucagguguaagagagcuuuagauguaguccaacaaacaggcacuugaaagacuguaacauaucaaguucacaugacuagcuaaguggauucugaggcuaaagucuuggucugguuugggaguugugugcugugcuucgucagcauagggcuuucccucuuuccaugucuucuccuccgagucccaggagauccagguuccuccagguguuaccuuccugugucggacucuuccugucauccccgccccucccgcuaguguuagcaucuucuguaaggcccgguguucugagauuacaucucugcuuguccugucaggcagugcggggcugauucaugcuaugcuuuggcccccucucucuuucuaguuccaccucacagcccugaucccuuggcccagcucguuucuccuccgcagaucucuccaucucuugcugauuucugauuuccuaacacucugucuuuuggcaagccguguucuuauguaaguggugauggcaggaggggguggguccuguucugugcugucugaucugaauuccuguauugucuccucuggcuuugaaagcaucuuugcugcguuaagugggagcggguaccccagcucuauuuuaccaacugagaucagacacagacaucaggaaaugcugugcucagcccugcagcuucuccuggcaagggugaaagccaagccuccauccacagccuaguguaugauauucccacugucccaaacucgaguguuaacagagagacaaagucugucaugacccaucugauguuuggaaauggauagcaguuguuguugaugauuuguuuuguuuuguuuuguucuuaagauuucgaucuguuugucagguuucuugaucagguuguuaaucugcauuucucuagcauccuuaauauccugguggccaaaaagaccgcuguccguucagucaguagggguagacagguucucggauacugacgacguuuuccccccaucacugcaugugacuaauagcuauuggaccuguguuuguaaugcugaacagugccaagaacucugcugacaaccuggucaaggagaccuauugauuguagguuggccaccaucucuuggaacuuuaaccuccagacugaagagcacauauaucagcuaagugcugguaacuugauacuuuugcagauuuugaaaaguccuccuguuucaauagaaccugucuauuucaacuaaaaguaugucucucuuaauauaaaauauugauacaguauuguauuuaagcuuaagauuauucuuuaagauacuuuucuuuuaccuaauaguagaaaaugauuuguuuauuuguuuguuuguuugagaucaagcucagacuggccaccaauacacucuguagcugagggugaccuugaacuccuggucuuccugccuccaucuccuaagugcuuagauuauaggugugggccaccaggcccagcauuagaaagcaaugucucagcacuuaccauucucaaugaguauaguuaacggacugaaguuagaucuuaacuccaacucaauaaauguuauuugucaccauuuguaaauugcuucauuaacaagcaagacaugucaucuugugcucuguuggcaugugugcccccagaccagaaggggaaaaccaccacauccuugaguguaggacagaucagaagcugaugcugauauggguggcagugacagcucacugccaggcugcucauuuccccaggugcaagcuggcaaugggucuguguccugcagcuccaucacccauacccucugugcccccagaggccagcgaguacacaaaaguguguucaagagaguccugaaugaaaggaugcgaaggccucacaucauguguggcagccacagggacacccaggugccucuggagcagaucagagcugccugcgguccccagaagaagcagaaugaugcgguccgcauucuaaaccugcccugauacagucccacuccucuauccuuauacacacguugguguguucuugccugggccugcauuuguggauuccggaggacaagcuugcacauccuccugaggaccgccauccgcuucugaagcagggucucucauuggccuguuguccgugaguuaagauagauuggcuggccagugagccacagaaagccucccccuagugcugccccagagcugagaugaaaagcgcgugcaacugugccuggcucuuugcuguggggucuggcgauuagaucuggggucuuaagccuacagcaggcacuguaccaacugagcugccuccagcccucuggcuuugagaguuaggucuguucccagacucagucauaccccagccugacuccuuucugcuagaacuacugaugcgagcaccacacuggguguucccacuuaccuuccaguccucuguuuugcugccuggaauagacagacccccauggugguaucaguuuguucucuugccaaaggaaagccuaaguguccauucgggauauacuuggcuuuaggguaaguagggagagccaucuugacaggacaaugaaauugcacagcucuuaugugggggagccuacccacuaucccauuuccuaaaugugcuguaguuuaauccuuaaacuguaaaaaaaucaagcacuuuuccuuucagcuggcugauuccauguggaacagggugggcuuugguuugaugcuuuuccucuucaugaauuccacuacaguuucagcuuucuuuuuuguugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugcuuuguguucaggagcuauuuagaacaugauuuguuuuguauucuuauagaauauaguaaaauugucacugguaacaauucuguuaccaguaaagcuaacgauugcaugacuggcugagauuuugaguucgcaucucauggaacagacgacauuuaaacuaagagaagucagucugagaugcugagagaaauuccccaaguauaucugaaaaggguacauaauugguuuuaaaggauccauaauugauuaauugaaaacaucacuugaaaagccaauuuauggucccuucugagagcaauuucagaaugcccuagguaaacaccaagccaacuggugcaaguagcuuuucauguggcuaaagagguuaauuuauaccacauuagagaaagaaagagaaacucuguucucccugcuaacuaacugcugcaaucccugugugucuuuucagguaugagaagguuccagucauccuggucgggaacaaaguggaccuggagagugagagagaaguguccuccaacgaaggccgcgccuuggccgaggaguggggcugccccuuuauggagacuucugcuaagagcaaaacaaugguggaugagcucuuugcagaaauugugcggcagaugaacuaugcagcucagccugacaaagaugacccaugcuguucugccuguaacauacaauagcauccgaacauggcugccccggacaggauucgucuaggcucguaggcaacaguaaccuugucuacugcacugcaguuuguaggauggguggugugugaguccacggugcacugcaaccuucaggccggauggccagcugaugccucugaguaccuguggguuccgugacuacagccuccacuucuguccucaguccuuguacaucugcaaccugaaggccccaccgccaagcuacagggugaccucauuugacgugaugauggcauugcuguugaggugacagaagccacuguuguguaaacuaaaaauaaucaugagagagaaaccagaauuccuaugaucacuaacaauuaaaauauuuuguugucuuaaaaaaaaauaaaaggagaaauauuuuccuacaagaguacugaagucaggaacggauggagcuucuagccaguguauuccguccaguaaaacagcauugcagggagacucugcucagcugacacguuucuaguuuucaaauugaugccuaaucguagauguuauccuaauucgugacaugaaacucacucacauaucaguccucaauagaguaaaagucagaacaaggcugugugaagauccagucuggcuuuagaaucuguuguaucaccugcucugccacagaaaauagucucucauagggguuuaugaaaauugagucgcacacccacccucuguuaauggagagaggauggucuuuauuuacugaacaagacagaagcaacugagauggagagccagucuuacuaacgagccuuguagccgauuaaccaucgcagaaggaaaaugaagccauguuacacccacacgcucccguuugcagacaccccacaggacaguacagacaucuggcuuuguuugugcgugcgugcgugcguguguguguguguguguguguguguguguguguguguguucgugaaagcugccuuuaagggccacgguugcaaugggacccuuggcucaccugcuuuggaaauccagucugcuguaucacagcuuuauuauaggcacuuaaaacaaaaacaaaaaacagauugaacaaccuaugaaaaauuugggcuuaaaaguagaguauaaauuauuuuagcgagggaaggaagggacacaaaaccucuuaucuucccuuuccuggagaaucacggaagcuuuucaugugugcauuccgcccugauggccggaguggcuggcacacacugccugagugagucuucuguuucgaaagggugcuuaagcucuggcauuuuuggccaugaaguguuuuaucauuugcaugaguaauggcacaggaaaaaaaauuucaguucaggaguuucaggaguguggaaggguucuucucaccucccuuagcggcguaagugcuggcgagcgucuugauccugcccucugaagagcaguguggccuucagaaccgcagugucagugagccuggaggcacuuagggccuacgcguucucaggcuccacagucucgugcaaguaaccacguagucucacguguaccagaaagaagaguguguuugugugugcauguguguuuaucguuccuaagaauuuggcacaauucaggcuaucgccucgacugagaaucuauacugcagaacauaauguauaagcaagcaguuuuuaaauuauuagucucuuacaagccauuggaaucucccccaccccaaguauuuaguagcuggcuuuaaguuuacaagauagggggacaaggucaaugguguuugucauaugugagaaaaaaaugauaauguggguaaaaccagguuguggguguuagagagucuuagaaaauucaugaucuucagcgccauuuucuccacuuaggaaggacaaaaauguccauuuuauaggacaaaaaguccuaacaguuuucuugaaacaaagucuauuauguaaaaguugauuuuugacucagacauauugaaaaauugaacuaaagaaguauguuucaucugcugaaguagaaauagugugagaccucugagaccucuaacuugucugacucauucuaauuuuuagaaucucauaaugaacagcaauugaugauacugcguauuagaaggggcugcacagaucccacagccucacgucacggauggcccaugcaaacauggaaagggugugaagccugagaaagccgggcaaggugugaagugggagcuuuugccaggcaucugggcaggcucuuccuaaggcccaguguuuacaccagcccuucauagugccugggcaucacuuccccaggccaaacuguaccacgcccucucccuguuccucuggugcaagucugacugacaguugugcaugauggugcugagauggggauaaaaacccaaggacaggaaaaggacacuugucagcacaagaaauggcagggcgcaaaggagagcuggcccagugauauuucuuuaaaagcccaauccaccuagcaaccagauaaaugaaaguuuguucuaacaugccuuaaaaauaugguuugaccccaaagacccacaauuucuuuagcuauuacuuaguuuucuuugcuuuguuuuuuuacuuuucacacagagccagguuuuuguuuuguuuuagguuuauuucuuuuaugguguaacuugcggguucuuuuaagcuguggcagcggcgguaaccaacgccuuucugcuccucagcuuccacaggacaagccagcaugugcugggaagccuucuagguguuucuguacaccgugagaggugcuuugaacucccacccuuugcuuuguagaauuagggcuugcccgugcacuccaguugccacucucugggguagaacuacugaugcuugcuugcuuuuugugucgcccguggacggcuguggugcgccguccagugugagugcugcugcugguggcugugaagguguguuguccuccacugcuguuggguugcuuagucgcuuaguuucuccaucaguagccccccucccccguuagcacuggcucagcuuuaacuguauccucagccaaucagauguugaagaccauggggguccucuuguuuaauuuguccucguguaucuauuaaaccgugaucaggguuucuagaacggcugcaguagauuuugaaaacagacuuacuguuauugauugggguuccccagagauccaguucacaguuaauuguuggacucuaauacaacugaccauugaaaaaugaacaacggcuuauuguuuuguaacagugucgggugagcccugacauuucaauugaaacaugaauugucauuagaacucaaugcaaauucaacaguuguauuuggaguuaaauuauuuuaacaaauaaauuuauuuaaugaa

SEQ ID NO: 12218 - RNA, 29773 nt, Mus musculus
ccugggcuguguggggggccacagccgcgggcugaaggcucccuuguguaccccaucgacgcccggcccgccggcuucgcccagcuccggcuccucaugaccgccuucggccccgcagcccacggacaucgccccagcuccaagaauuaacacggaagcucccggggccggggccgugagggagagccggccggucccgcgucccugucgguccggcgcggcucuugugcgggagccaugaccucgcugacccagcggagcucgggccuggugcagcggcgcaccgaggccucccggaacgcugccgacaaggagcgggcggcgggaggcggcggcggcagcggcgaggacgaggcgcagagccgccgcgacgagcaggacgacgacgacaagggcgacuccaaggaaacgcggcugacccugauggaggaggugcuccugcugggccucaaggaccgagaggugcgggcgccgcggccccggccgggguggcagccgggguggcagcgggacccggguggcuccagguggggcccgggugggcgcuggccgaggccucaccugucccugcuuccggagccccgcgccccugagcgcccucucgucccaaggagugugggagucagcccucuccggcugcgcuccgagugcucccgauccucccgguaccaagugcucgcuuggguuuucccguccucugcucacaagcacucuuaguuccgaagucuuggcgaucuuugcguuucuucuucuucgccgucugccgcaaauaauggcaacuccaacccaagacuguugagaucuaaagacucggggcuaccgcggcucccaaguauugaguuuuugcagguuuuaagacccgggagagguucgcggaucuacuugcugucggcccucuuucuuauguaaaacuugaguugcggcgcgcgguuaagaaauuagcaaaguuguuuuuacuggguauuguuuuaaaaagucaauacuaaguugauauaaaaccuaggaaguuacuuuuuggaugaacuugguuugagcgagcgaugaguuaguuuugcgguuagaucugcugucguccuuuccguuuugccauuuuaagggagggcuugugaagagcugggaggaauaccaaguuugcgcuuugaugaaagacugcaaagauuuagguaggcuuaaguuguguucugacguuuggaaaggucaccccagauauuuaggaauuucacacauauaaguugaaaaagugcaaguguccgucuuuuaaaugucuggauucuguaguuaauguuugauugauuuuauuaauacccauccaucucuaaagaugauuauuuuuaagggcagacuugcaggauuggauguuucauaaaucauguaugaugagguggcccggaaguuuguuucguuucaguguggaaacucuagacaacacauuuugagagucagacagaaagguauuggaucuuguuuuuaaauacguuuucagaauucaggaaggaggacaagaaacaaaccagaacaaaacucaguucauccuauaaaacaguuuuuuaguuccucagacuuagcagcgguagagagcugaguuuuuccagggacuguuugugguucccggauauuagauacuacccagggaagugcuucuugaugccuuaauaccauucagcuugaagacacuuaauggcccucaggcugugaaaggggcacaguaccuguuuaauuacaguuauuaugaggaaugcggugguguguguuucauuuuuaguuguggagugaaaagcuagauguuaguguguggcaaugcgauuuuagagagcauucacuuaggaaguaauuagauuuugaaagcaggcuucuuguaauacacauuuaucuuuccuucccuccuucccuacuuuggaacaaaacagauuaugagacauuucuaggaaguacaagaaaaacaaaaugaagguuacauuccugggucagcauuuugguucuguaugcuagaacucgguaaagcuacaacggaacaaaaaaaauuauuuuugguauugucacauugagaaacaaugguggaaaaauaccuuuuacuuuagaagccuuacucugaauuuuuaauauaaagcuguuaccaguuauuuuucugugauugguucccgugaagauaaucugaagaauuuuuugaauuuaaugcuacuacaacauucaacuaguuuuguuuuguuuuguuuuuuaaacaauggaaguucuuugauggcagguaacugagaccaucuguugugguuguuuuguauaaguauacuucauaagucauggccaagguucagccaggcacuaauuuguagcaugugggggugggcacuuguuuuuaaaaaaauguagguacauauuuuuucuuucaucaaguguguacacaguagugacuaguccuauaaaccuaucacccagucuauuugggggaugguccccuugucuuuuuuuuuuuuuuuuuuuuuuaaaagacaaagucuugguuuccuggcucuguuuccguagccacuuaagcuuuguucaauuuguuauuaacuuagguucuagggauugggaauauacagcucgguugauagagugcuuuggaugaaguucugaauuugauuccuuccucugcacagacugggcuuggaagcccaucaugccuauacuuccacuugggaggcaagccuaucagaaguucagggucaccuucaccuacauagaaagucagaggccagccugggcuacaugagaagccauuggcuucagauuauuuacauggaguuuuguuuaaagucuuuguuaggucucaaacucaggaaguauagcugcuagccaaggugccuaucagagcagacacuggcuaccugucucagcaucgccuauaccuguuaagaguccugacucuucuuagcacuuucauccagcccuccuacccucaaccucugcagccccugagcuucacucccuucccucagcugcucugcucucuauaacccugccuuuuggcuauguggucucuuggccucuugcucucuuugucuccuggcuuacuccagccucuuggcucuuguuucuucucuccagccuccuaucccccucacaugccagguucagaguggaccuuuccagaugccuguuuauccccucuacacuaaaccuuccuacuucaaaccuaggaacagucauguccucauucaguccugacuauaguuuuguuuuauuuuauuuauuuuuuuagguucgagguagcuuuucagguuuuuucuuuucuuaaaacauccaagggcuggagagauggcucaggaguucagagcacugacugcucuuccagaggguucaauuccuagcaaccacaugguggcucacaaccgucuguaaugggauccgauguccucuucugguguaucuggaguguauuuauuuguauacauaaguaaaucguaacaaacaaacaaacaaacaaaacacacacacacacacacacacacacacacacacacaacaacagcaaccgaaaaacaaaaaagcccaagccuaggcucauucauagguucuggguacuuaaucugggugaagugucagugagugauauuuagaggccacugcuagaaugucagauagguucacucaugaauuccaauuaaguaauuggcaagauuucuguggaugguugggggcagagcaggacaaauaguaaauauuuucucuucauuauuuauuuguguuuuuuuccauugaagccuugaguaguuucaggauacuugagaaugaccauaaauaaccaaaaaguuauauuaaaauauuuuuuuaagaagacuaaacugaagggucucacacauauuguaccacuaacuguaacaaugacccccuuaaauaacuugaauuauuuuauuggugguaggucuaaauacuuaaggugagaucugaucaucucauuuacuugccuauuuaaagguuuauuuauuuuuauuuucuguguaugaaugcuuugcccccauauuuguauguauguacaucuaguuuguguauccaaggaggccagaagagggcauuaggucccugaaacuagaguuauaggugguuggaagcuuccauguggguacuuaaaauugaaccugggucuucuggaagaacagccagugcucuuaaccacugagcugucucuccagccucaguuugacuacuuuaaaugaccaauuuaaucuaguguuugguggcuggguaagauuguuaaagugcuuaccacacaaacacgaggccuugcuucccagcucucucuggaaaagcugggagugaugucacagguugaugcagagugaagcuccuggaccagccauccuagccauucagcaagcuccagaccagugugagacucgccugaaagccaagaugguuggcaucugagggcaacacugaaguugacugccgaccucuacacgaucacauauguacagacaccuacagaaacagggagaaagaaaauggccuguugaguagaagugaggcuuugucguccuucucuuuacauacuaugcaagaguuucagaauucucacaaauguggaaaauggucacuucacgugcuuggggggguguacuuuuguggcacuuauugcuaacacuuuacuguacuuucccccuuugucuuugcgaagcccuagaauuuuagcuuuuuauuauuuacuuauuuauccauucauuuacuuauuuauuuuugagucucaggguuuaucuacguaguccuggcuguucuggaacucuguugaugaggcuggccuugaacucacagagguccuucucccucugccuacagagugcugggacuaaagggggugugccaccauugccugauaggauugcuuguuuguuucuuguguuuuagauagggucugaugaaggccaggcugguuuccuugaccucucucuggguccucuugucucugucucccuaauguuaggcuuacugacagcuuuggaauggcuucuugagguauccuccuauuguuuuguguuauaguuaagucuuguccagucaguugcccuccacugaggcuuuggaagaaaaagaggcugaaaggaaaccuuuucagaacagccuucuuguguguacuguacuccugaauguuguuguuuuguuugguuguguuuuaguuuucucccugucuuuuucuagugugguuuuuuuuuuuuuuuuuuuugucaucugauuuuucuaagguuuaauagcuuuuaguaacaucuucuuuaaagauacauuucuaaaguccuaagagcucuacugcaguaacacuugaauaguauguagugauuagguggguuuguuuagagaaaagaugguauuuggcaugccucaaauuuccuggcaguucuugaaucugaagucuucuugaacuggugauccucuccucucugccuccccaagacugagauggcaggcuguguggcaagacuuaggaaguuuaaaagaugaaacugacuuuguuguuuucacacugucccccaaaauuuguucauuuugaaauaauguuuagaacacaguauuuaucaagauguauaacuguuuuguaaacauuuuaccucuaugaaguuaauguaaaauagugcuauucuuaaaccuauaagccagauaguuauugagcucaguuuuagaauuucaagguguguuaaaaguuuguaguaauuaaaaaaaaaacacacauaaaagcuucaagaguuuugaauuuuguaauuucuuuucuaauacuaacuauauucuuuugauauuuuugaaggguuugaauuuucaucucuuuaagccaaauauaaaauuuagagccuauaugaaaaauaagcuguaaagauugcaaccuguuggcguacuacaguauugcaauguaaccuuguguauacacuauaguguuauaauguggcaugcacuaacacacacacagacuuaaaaagaaaacagaauauuuuucuucuuguuucauaaacauuagauugacaggggagaugucccaggggugcugguagaggaucucaguuuggguagccagaacucucauaaacugggucucaucaaggcccuucuguaauuccagggcucuugaaucaguaugggugcuggagacagcagaauuccuggaagcuuccaggcuaacuagccuggugugugcaacagugaacaacaaagacccugucucaaggaguccaguugaagauggcuuggcugaacugacuccugcaaguugugcucugaccuacaaugaaguaguguguguguguguguguguguguguguguguguguguguguaugugucuccuguaugaugaacaaacauacaaauaaauguagcaaaaucugggugguagaaagcaagggcugaacuuugagguugguucuguaauugcacaaauugguacagccacauucacacaugcauacacaugcacacaggcauucauacaugagauagagcaauagagaaugguagaaucuuacuagcauguuauuguccuucauuuuaguguuuugauggugcuggggauuuaacccaggccuugcacccgcuaaccaaguagcacucuaagccaaauuacauguccguuguaaaguuaauuuagccuuagugaguuguguuugguuuacaugcuuuacuagagaaacuguccacuuggugucaacaggugcaguuuaaaacuuuugcuucuacaguugacuaucucaccuugacucaguaaauagucuaaguacaucauacacucacugaagguaacauuauucccaagagaaugaacacugauuuuuggggguggucuuggaaaaaacgucuuccuuucguguauagagaggugagacauccagaauguccaucuuacauucaugaaggaagagauggggggggggugaaaacugguggagagaccgaggcuucuuacauguguuugcauuuagaucaccuuagaaaccauuucugguuucugugguggaaaucauauuacacuuugguguauuuggcaaugaggauggcacccggggccuuggcacccuaccuacauggucugaacuacaucccuucccuagaaauuauuuucuaugaaaggggggcaguggaacaugccucugacaacuugggaggcugaggcagggggacugcugaucucagcccuuggaggaggccagucuggacaacauagcuccuuucucaaagaacagcucuguugauagaaauuucauuuauaacagaauuugacugagacuaguaugaauucuagaaaguuacuaguuaacauuuuaguaguaauuuuuagagagcauggaagauaaccuguaucuguccaucccuggcuuuuugagaaagacuucagauuggagggcuuacagucagcuuuuggugauuacugcccccuugggauuuuuuuccuggucaggacugaacuugggaccuugugcuggcuguggauucucuuuaaguguucuaccucuaaacgaccauccuugcccuacccuaguuccccucccucccucccuuccagauuuauuuuaugugcaagaguguuuugccugaauguaugcauauagcaugagcaugccuggggcccuuggagaucaaggcaucccaggcuucagagccucuaaaaccagaguuuuguggaugguuaaugagccagcauguugguucuaggaacuaaacuugggucuucugcaaaauccggugcucuuagcuacuaaucccccaaccccccaguuucaguuucuuauacaauuguuaaauaauuuuauaccauuuaaaacaaaaaacagaaauuacauguauuuaaauuuaguuauugaguaggauuugccaguuuuugagauuaaacaaguuuaacugguaauucguauuuucaguuaaucaaaauaugucauucauguaucaguuccuuugcuaagugcugagguuucuaagauuuuuagcuuuuuuuuuuuuaaagauuuauuuauuuauuuauuuauuacauguaaguacacuguagcugucuucagacccuccagaagagggagucagaucucauuacggaugguugugagccaccaugugguugcugggauuugaacuucggaccuucagaagagcagucgggugcucuuacccacugagccaucucaccagccuagauuuuuagcuuuuaagggacaaucaguauacauaggagacagcacuccagaugauuuggguaugauuggauaccaacuucagagaaaaacagaagguguagacuagggacuagagaagaacccucagaucaggagccaugggacuauuguccuaguuauauuucuguugcugugauuuaaacaaauaaacaucacuaaagguaauuuggacaggaaaggauuuauuucagcuuauaguuguagucugucauaaaggaaagucaagauagaaaauguaaccaggcaccgaagcagagcccacagggaugcuggcuuguuccuggcuugcucaguuacuuucuuauauaugcaagaccaccugcuggagacggcaucacccauagugggauggguccuuccacaucaaucaucuaucaagaaaguacccuacaggcuugcauauaggauaaucuuauggggaccuuuucucaauuuagguucucucuuguggcuguaguuugugucaaauugacaaaguaaccaacacaaacuacccaugguuuugacuuguagcuuugucuuuuuugacuccuccuugggagaacuagacuaaauguuuuugaauuuuuagaccucauuguuuccugggcaaaacagaccucuauuuguggucugucucauaaccuguuauaggaccuaagggcuaaaaaggauuuagagccgggcgugguggcgcacaccuuuaaucccagcacucuggaggcagaggcaggcggauuucugaguucgaggucuacaaagugaguuccuggacagccagggcuauacagggaaacccugucucgaaaaaccaaaaaaccaaaauaaauaaauaaauaaauaaauaaauaaaaauuaaaaaggacuuaggcugaaacaaaugcuguuggcuggcuccugauacucccucuucuucacucucuuucagugcugagggucaaacucugaccuugagcauacuaggcaagugcucugccacagagcccagcuuccacuauugccguaaguuccugaccauccuggacaugauaauuuagugaauauuugacucauucagcuacuuaccuaugccuuuucacugaaucaaucugucucugugccucucucucucucucucucucucucucucucucucucucucucucucucucugugucugugucugugucugugucugugucugugucugugucugugucugugucuguguguguaaaaaaguaucccccuccccucuguuuuuuuguaaucccagaccaucugggcuaggaaaucuggaaaccucaaguauuuugguuucuuuucccuagauguaagcccagagucugugguuguuuccauuauuucucuucucuggaauacuguucacucucuggagguaucagaagccccaaacuucaaaaucagugacuucuauggcagcuguguuguauaaagugaugggugugguuggcaggcaguaagucuuauuuccuuaugccuucuguuuccagaagagaaagcuugugaggagccuggccucuucuggcccuuguuguaaucaguucuucccacauuuugaucaucuuauuuccucuuuguuugguguuuuauuuuuuagggaaagaaaauaaucuuuauuacuuuccaaggccagaaucuucacagaagguggcuagggcagguuucuacaaccuuuaaaaauuauuuaagaaaauaucuucuguauuuauuuguauguggaugugggggguggggugcugucuggaggucagaggacaacuugugagagcuggcucuccuuccaccaugugguuucuggaguuacuauauauugggguagcaaguacuuugacacacuguuuauuauugggacagggucuccagcacccuuggcuggccuccagcucuguggcugagcguguccaggaacuuaucaugauccuucugcuucuacuccuagagugcagugccagguugggauugcaggcacuuccaccauccuugguuuauguuuguacaucugggauaggcaaacuucccaguugagcuaaaucucuagcacugguccacagaccuauaaaaguauuuugucauuaaaaaaauaaauauauguauguauuuaugcauaguguaaauaacagcaguuaaugaaaaaaaaggccauguguuugaaacagagcaaggggaguguaugggauggcuuggagggagggaaaggaaagggggaaagauguaauuguauuguaaauucuaaaauaauuuaaagaauuaacguaauuuuauuuguguguguuguggggagggucauaugccuggugaccaagcucccaggauccacugugcugggguuauaggcacacauggccgucccuagccuuuaugcagguccuagaugauugcacuccagucccggugcuucacagcaagcagugcuacgcacugagccauuccccaguccccacauucuaucccacccccacccccaacccaccccuauuuccaguuuuaaagacaucuuuacaaugccggggauugaacccagggcguuaauaugcuaggcaagucccugucauggaacugcauccuuagcuccucuucuaugucuuauuuuguagcccaggcuggucccgaacuucuugguucaagugauccuucuguuucaggcucucaaguguuuuuacuuucaggcucugugcuccuguacuuggagauauuugagcacagugaaguacaggcugugacuuaacagacgagaaacgacguuuuagacaggacacaacagcuacgauggagauuaugucugggauaaggaacaugaacauuuauuggcacaagaaguuaaaagcuggguugauauuggaagcaguuguagguuuuaaagacaauauucuacagagaauuuuuagaagaugugaguguagaaaguaguggacaaacuagagagagcaaagucacuggucuugggauuacuaaaaauguuuauaguuuauuucucuguguguacaugccuagaggucacauggcaacuucugaaaaugggucucagggcaucagguuuguaaacaccuguaucacucacuggccugaaauuauuagaacuugcaaaaugaguugccaguccuggaugaagauuaagcgauacuuauuuuuugaccugcauuuaagucuguacuauaugcaugugaugcuucaaaagguaaauuuagggcuggagagauggcucagcgguuaagagcucugacugcucuuccaaagauccugaguucaaaucccagcaaccacaugguggcccacaacuauucauagugagaucugacgcccucuucuggagugucugaagacagcuacaguguacuuacauguaauaaaucaaucaaucaaucaaucaaucuuuuaaaaaaagauaaauuuaaaaaauacguaauuacuaagauuuuacugucccuauaauuaugggagaaaugggguagacuuuaaggcaugagaauaguagaaauaugccuuuuaaaccacaaggagccuguauauuuaggaaaguauaggcuaccaaaaaauagggacuggaaacauggcucagcagucaaggguguuugcugcuuuuccagaggacuggaguuaaguuuccagcucaacauugcuuguaacuccagucccagggcauaugacacccucuucuagccuucucagguacccgugugcacacacauacaccccuacaccacuuaggucuuaagugacuggcaagaguggcuccaugauaaagacucuuggugugugagauacuacuuauuucuuagugcuggaagaaaguaaaaccaauuuaacaaaaauggaagauuuaaaguccauaauugaccuuuaguuacucaaaauucuacuugugcaauuguuuuaugcuaagcauugugcuaaggaagacagauacauaaauaaacaaagauguguguacauguauauaaguacagauugugauaacuaugcugaaguaugcugaagacaguauuagaggacucugugugagaaugacuggggacugugcacaguggaguccuuucuaagaaaugcuguuuggugggaccugaggauugggaagagccaggcuuggucauggaugauagcguauauucaaagguuuguguuggauuugagaaacagaaaggugguucuuagguauaucauuugcaaauguuuuaguguuucuagugucuuuaucauguuacugauagcaucuuaauuauuaccuuauaaguuugaauaacuagucuuuuucuuguuuucuuguuccauuuuucucucacaucuauacagaaaagucuaaugugaagauagccagucagucguuauuacugcuaauacuuuccuaaccuacuuuaaaaaguguuauaugugaaaacauacauauaugcauacuuauauaaagaugaauugguuuucccuguaguccuggcuauccuagaacugucgaccagacuggccuugaacucagagaucuuuccaccugacucugccucccuagugcuggcauuaaggcuaugugccaucacugccuggcugauuuccccauuuucuaaucaucuuugcacugggaugguuaaaagauguuuuuauuuauacccccuuccuuacuaauacagcauuuauugucuucucucuguggaacuuugagccagcuacuucaccacacuuuggggggaggggguuguguacaaaagaaaagaacaugcaggguagguaaggcacagaagagccaugggagguggaagcgagacagcugcuucucuugguuaggaggaaggccaaggcugacacuaggcaaaaggaccuacugugucugagaaaugaaguccagauaugaggaguccccaaccagcuccagagcuagcuaccugaucccagugaacuuggcugcuguguugauggccuuugaaauggugcugacugguuuggaagcuguggcuagggaugagucaaguuagaggacaugaggcugucaagcuguugaagcucuuaagugucuggucagucaguuccgugucacugcagacaccaaggagacuguggggugagcccagaguaggcuugcguuuuaggguugagagaccacggcaggaaagcuguuccuagggcagggaagaaggacuucuugcuuuuugagucucacuuuguaacucuggcugacuuggaacuuguuauauaggccaggcuggcucagagucguggagagccaccuuacucugaugucauaaugcuguuauuaaagaaauaugcccagcaccuggcccuuaguuuugaaugugugugugugugucucuguguguuguauacauugagugcagguaccuuugcgaggcuacaggaguuggcuacuuuuggaacuggaguuauaggcaguugugagugggaucaagcucaaguccucuuaaaaccugguuccuagaaacuauauucaguaaguuguuauaugcguacagagugauucaaugucaaaaaguucggcaaacgcugaauuuauuuuuauuuauuuuuagguugguucuggguguuugguuuguuuuacugugacaagaucagugucuuuguccauacauuuuucuaugcauaguauucuguaauguaacuuaaagucuauagaacugugucagagaacuugaauuucuuuuucuuuuuguccccaccucaccuuguuuacaauugagaggcucucacuguguuacuguguagcccuggcuggccuauaauuuucuguguagaccagguuggccuugagcucuuggcuugccucugccucccaagugcugggauuaggaaaugcacauugaaaaauagaaaccuuagugcuggagagaugguuagcacuugcugcuuuuucagaggaccgagguuagguucccagcauaggcucccacccaaggcucccacccagucauucacaaccaucuauagcgccaguuccaggacauucaguguccucuucuggccucaucaggcacgaggcacacauggugcagacauacauguaccugcaggugaauacucucauauacauauaaaaauuaaauauuuacaauacaagccuguauguauuuuuucauauuauuuugaauucaggucuuacuuauuauauuuuuauauuauguaaauuauggaucaaggacauuuuuccauuuuguaugucuuuguauaauacaugaaaugucuuugaacaucugguuguuguauccuuugacuaaguagacuagaccuucagaauguauuuacacuguauuucauugugaguggccaacucaaguuccuucauuuuaaguaagagaucuggacuacauaguguggcucuucacccucauggugaauccuucuuguuguuggcacuuuugagggcuucuuuucccauucaagucaagccacuugauaagaggaaagaaagcaggcaguuggagauccauacaagugauggucauugcugagaaaaaccgggguggagguuuuccuagaugcagucuugucuccuaauguuguccuugaaacugcccauggugauggugauuguguccccuugcuucaucuguuacuuacuguacaguucuuucugcuguacucuuugacugaaugggaaagacaguuuauuucccuugaguuuuuuuuuuccauuuuuauuagguauuuagcucauuuacauuuccaaugcuauaccaaaagucccccauacccacccacccccacuccccuacccacccacucccccuucccuugaguuuuaugcaacauuaugaggucugcccugaagauugacuguuuuugccaggacccacaguagcagaggauugaucugcaucggaugcugcagucucauuaaccuagcagcuggugaucuguuagaacgguugcugccuaucagggaacuaguagucuuuacaggcgacuggagagugcccugagcuguguaugcuggcacugcagugcauccccugaccaggacagcagauuagggucucuggcucucuggcucuguuguugcuuugggcgauuguggacccaugccaugucuggauucuuguuuguuggggauaguacuuaaccugcuugauucuggaaugucugcacuucccgauaaaacuuuuuagaacauagggacuuuuuuuuucuuguuaaauaacacuuuugaaauaaugccucagauuguuuguucugugguggucuucugcucuaacuaagguugggguugucucauacgcugugagugaggugagggacacuaucuuagagccacugguucuucuggcuuguuuugcuucccuggauguaucauugauucuuuauucucucagagcuguguaugcaaacacaacuaguuaguucuaccucuugaacuaaaacuguagcugcuugguaccaccaguuuuuuauuagucuuucccauagacuuuagcuaccuuauuaaaaguggcugacuggcuuuguuagauaggaaagauuuguugggacacacuuaaacaucccgugaguauguacuccuccaguaggcucuuggaauuguucuugagaaacaaggccaacguuuucucuaccuccugacugagcacuucucugcuaacuugucuaugccauauugugucauggauucacuggagaaccaggcugacuaagguugauuauaguccuuugguacaguccugguccauuuggccucaauuccauauggcauugguuuuuuuguuuuuguuuuuaaagauuuguuuauuauauguaagaacacuguagcuguuuucagacacaccagaagagggcaucuaaucucauuacagaugguugugagccacugugugguugcugggauuugaacucaggaccucugguagagcagucagugcucuuaaccgcugagccaucucuccagcccccaauguggcauuguuaucuggucaguuauaucacccccucucccuuguucuuuuggaucaguuuuacucaaccuaaaaacaaaacagcaaugacgacaacagcaacaacuucugauaauuccugaucaugcuuuuguacauucaugauaggaguuuuacuaggagguuaucaaaacacugggcuacucuguugcuugcuguuucucuuggcuucauccaucuugucuuuucugauaagucccagaaaccuuggcacagaauuguuucuuuuuuuucuuucuuucuuuuuuuccucaucuauuuuccacaugaguuaucagguuuucauuaaacguaacucugaacucuguaguaaagaccuuguuuugcugacaaaucucuggucgagucauaacaugagaauaguuggaacaguauuuagcccucuucuguacgucaucagagguaaacugcuaaaaucugcccagcuagacagaguuucagacuuguaugcuaaccauacccauuuuacuuuaugaaguguauauucugucuacauuuugguguuucaaauaggaaacccauuuguguguucaggccccugagaaacacacagcuguaacaugauuucauguggaaucaauucuggaauuaauucccuugcuuccuaagucuuuaauugcuccagaucuugauuuuccucuauuguuuuuuuuguuuguuuguuuuuguuuuuuuguuuguuuguuuuuaaaaaaagauuuuauuuauuuuauguauaugaguacacuguagcugucuuuagacacacuagaagagggcauccaaacucauugcagaugguugugagccaccaugugguugcugggaauugaacucaggaccucaggaccccaggaagaagagucagugcucugauugaccacugagccaucucuccagcccucuacuauuacugguuuuaauaaauguuguuuaguccgacaaucuuuucauuuuagcaaaucucaaaacuaaucugcuuccuugauuucacauugaaauuggccuuuuugauaaauaugaaaccuuuuaaaaacuuuuuagacuuguuuuuaggucucucuguuauguaccucugguuauccuggaucucacuguguaaaccaugcauauagaucacagagaucuacuugccucugccucuugagugcuggaauuaauaaccaggccugacaaaacuguaguuuuguuuauccccuuuaguuuucuuuaucuaaaugcucucccaacaaaagugguauuuugaacuagagaaggacccagauuugauuuccagcaccaacauggaagcucacaacuguccguacuaccuacacacacacacacacacacacacacacacucucucucucucucucucucacuauguaggcaaaacaccaaugcacauaaaauaaaaauaaauuauuuuaaaaacuguuaucacuuuaaaguucuuacaucauuagugaaguuccaugaccucugauggucagccauccucuuaaauaugggcuuaucccauugacuuggguaaguaccaggaagccuucccugaguaguccaggcuggcuugaaugcuggagguaugagccaccauuuuuuauuuauuuaaaauuguuaguuuauuuuguauauagggguguuuuguuucuauguauuccuuaacuauauguaugccuggugcccaaggagcccagaagagggcauuggauccugggaucugcaguuacaguuuucagcuaccauaugggugcuaggcacuuugguuuaauguaagggcaguaaguacucuuagucucugagccaucucuccagcccuguccuugaacucuugagccauuagaauguccccauauucccauugcuagaauuucagguauguacuacugucccagcuugaccucugaaguuuguuuuauccauauguaagauaccugguaaaaggacgacccuuccccagauccuacauuaacaacauacuaauugugcauuuuaguguuuuguuguaagaagacauauguggcuuuagcuaaagauauuucuacuuuugacucaagguaaauuagcuguuuuguuuucuuuguucuuuuuaaauaggguuacacaucauuuuggaaugacuguauaucaucuggauuacguggcuguauguuaauugaauuagcuuugagaggaagguuacaguuagaggcuuguggaaugagaagaaaaagucuuuuaaccagaaagguaagaggacuucuaaauaauccccucuuuacaaggauuacuuucuguuucagugaugacuauuucuaauagcuuuauaauauuuaaaucguuuuaaauuguccuuauuggauugcauucuugguuuuucuggguuuugcauaugcagcaugaugcuccucacuguuaggguugaugaccgcuguaccuuagggcgaugcccagcuuuaauuguuucugaaaaagucguaagccugaagaccuugauaggacuuuaaaaaauccgagaguuuuguagaaagaacugaauuacucggggcauuaaucuuucuguaaaagugugauugaucuuuaugucucuugccaugguggagguggcacuucuguggcagaucagaaugcauaugcugguguguggguuuuuaacuucagacucaguucuucacucuucuggucuguuuuuuaugcuuuggacaugguauuucaaaaccauuuuuucuuuuguaguuauauuuguaaaucuaaaagauaggccagaaccuuguuguuauuuauuuuuuaguuuaguuguugguuuuauguuuuuguuuuaagacauucuuugcuuuuuaaccaacgcugaccuggaacucacuagcacauguuggucuugaacuagaguuccucccacccgcaccuccagagcucuaagaugacaagccuaugccuucauuucuuacucugaacacuggacuguaaaaccagagugaucauuuuauaagaaggaaagccauuacuguguuaaugaaaagaaauaauguaggcaguaauagaacuucuaaauaauagaaguggcugguuguuagucagagaaaauuuguuuccuagccauaugggcuuauuaaugucccucuaguucugagugacguagguaauguuggaagaauauucuaugugauuuaauaaguuaaguuuuaaaaguauuguugguucaguuaagauaauccauauaguuagaagaccaaauguagcuguuuuccuuguucuuuagcucucuucauggaagccaacuauugcaguguuuggguuuuuuuggagauagauucuuucuauguaguuucauaugaccuggagcuugauaaguaaacugcacuggccucaaacucagagauccuccugccuuugccuccugagugcugugauaaaggcgcacaccaccacuucgggcugucuucaguucauuuuaaagccaucuuaacaaaugaccccagccuuagugguuuucccuuuggaggccaguuaggagguguacuaggguuauguuuucuugauggcuugaagggagagucugucugcagccucucaccuuuuaguuauuuuauucuugcuccuuagcuucuguccacauguccuuacagccugccucgugccacauaacugaccuugggccucucauaaaagauugccguuuccauagcacuucuuuuaugaaucuaauguuuucuguuaaaccccugaggccuuuuugaaauucuuuuuaucuauauaaugcaguuccucagaggucuuguuuuaucuucuuuucaucccuucuguguuggagauagcaagaauuuauugaagcauagcauauguauuuggaagccacacauuuuugaaauuguuaaaggaauuagcacuugcuugaaucuuguacuaguuuugagcaggaacaauggagagcucagugugcagccagggcugaaaggggccagagggcugcacucaggcacuuagagacucacagcgccucugcauacuggagaagugaggccaggcagcaccccgguaugggguacagaggccucaugaggcuccaucccuagcugaggggcaacugauggcugcugggggagguuggguacguguggccacugguuggcugccugcacucugauggauggccucacaugggcagcacgaguaagaggcagugguuguuaagugugugggggcauggaggugagaggagaacuguuaggaagaagggaauguggagaauuugaguuggauauaaacaaguuacauuauaucuaggcuaugaaauuaucaaagaauuaaugaaaguauucuuaagacauuaaaaaaguucaaggccucuagacaggagaccaauuauuacaagagaaagauggucagacugguagacuaaaaucauggcaaggauaauggaggaauugccaagugagaaaggcuuagagcagaacuuaggugcagucaaggugugugagggagguggagggugaggcagauacuggucacguggagagagggaaggggugggagggagaggcaggucccauggccacaccacagacacaagauucauuuuccugaagaucuuuuucuccccauaaacccuggucuaacuagucaccauggagcaaauguucugaaugguguuucugaaucuguacugcccaguacaguaaccauaccacuuuuauaaauaagcugugcugcaaaacacccuggguuuuuaaaaacaguauugauaaaaccugagaagggcgaccaugagcuacugagugcaugcugggaacaaaccugacuccugggagagcagccagcaugcuuaacuccugagcuuucucucaguauagguuuuaauuacagauuuagagucuguccuugccuccccagccccaucccuguaucucuguuccucuuggugcuggagguugaguaauuuuacauaaucaaaccuguugaugguuucauuaaggcuucugcuagcgguggcaguuuaaaaagucguuguuguuccuaaaacuauauucgccuucauaucuuuuauugagcauaagcucaagggagccaguuggaaacaggguuucucuguguaagccuggcugcccugguacucacucuguagaccaggcuguagaucugccugccucugccuccugagagcuaggacuaaagguaugcacuaccaugccugacucggggggagcuaucucuuaucuaucuaucuaucuaucuaucuaucuaucuaucuauaucuauuuuggcaaaguuuucuuaauaacauuuauugagaaaauugguguuguuuuuuuuuuuuaaacuauaugaaaugccuuuaguauguugaauucuuccauauuguugggccuuucuuuguccaagacuuuaaaaauguaugaauuucuauauuaaguaccucacgguuaagcaucaaaugacauuauaguaagugcaguuucuaagcaugagauguuugcauugauuuguaugcagugguaccaguggaucauuucugaccaauguguuucaggugaucuguaaaucggaugcuccaacaggggauguucuucuugaugaagcucuaaagcauguuaaggagacucagccuccagagacaguccagaacuggauugaguuacuuagugguaagcugauguauuaacaagcaaacauugaguuguguuuagagaaguuuguauaguuaccuauacaaacguggugaugguagggaugauacguuuuuaacaauuuuaucucuguuuacaggagagaacagauacugaauaaaauggauauucuuucuucaagcucuuauguauguuuguuuguuuguuuugagucacuacguagcccugacugaacuccaacucagaucuaccugccuuuuccgccuaagugcuggaauuaaagaccugcaucaccgugccugucuucagucauaccuuaucuaaauuaauugguaccguuuacucuguuuagagugggccaugcugugaggaugucuucauaaacuauaaacucucuugacguuauguuuuguacaccagugggucauuugccuuauccagucugguggucagugucuugaucaccugauuuccucauauaccccaaaaggccucaguaagggguucgguugauaaguuaacuaguuaacuaguuaacauugcauagcugcugacugacuaaaucuuacuagugugaguauugacugaacuugguuucaacuugaguugcuguuguauucuucuucuucuucuuuuaaaauuuauuauuuauuuauuuaauguauaugagaacacuguagcagucuucagacacaccagaagagggcaucgaaucccauuacagaugguugugagccaccaagugguugcugggaauugaacucaggaccucuggaagagcagucaguucuuaaccacugagccaucucuccagcccuguuguguucuucuuauuggagugaacauugaagagauaugacugacauuuauguuuucucccaaaguauugaaguacaguaacuuauccauuggauuaggccagaauucauuaggcaaguauuuagaaauauccuaaaugauuggcuacaaaugccagaaauauuuuuuuuuagcacauacaauuguuaggucuauguuagugaguuaucauggugucaugaaagaaggggauccagcuuaggaggagaaaacagagcgcaugcuaugcuagugugggaauucuguuggaacuuagugaaggaagcgguguuugggaccauacagaaggcccggcauugauucccaguccugggaaggagaaaagggagacagugacccguucacuauugagcagacauugccaguuaauaacugagauuucuaucagggagucaugguuguggcgggcgggggcuguggugaucgugaccgggcaugggaagaggaccaucaauaugcaagagucaguucucuccuuccaccaugggagcccaucugucaggcugcuuucccaucccuuaggagauuuuaaguauauaggacgguggccaacuuggagcuuaaagcaucuuuuucucuuuuuucuuuucucuuaaauuuuaguuguuuuaaaacugucuucaguagugauauaguccuuaaggaucuagaguguacaaagcucuggauuggacuccuguccugcacuguagcuagaucgucagcagaaaguaugugguggacugucugagugcuagugcuacaugguauugacacaggugcuaugaacuuaaauagagauacuugcagcuugaaggggucucaaaccuaagugugcuaacaaucuaauauuuaugguucugaaguuuugguaguucagaaaaaacugaggacacauuuagaaauugaaggaggaaguagaccucggauuaaacuuuuaacaggcaacagugcacacacacagaaggaaaugucagaaggguuaggaagggccagugagaaggcucagcagaccaggcacuugcugccagcuugguuaccugagcucaguagauggccaagauguugucuagagugugagccccguccuggcugacggauuguugggacacaguuguguuguacuguaguucugugaaaauguagguguagucagacaguaauaccuaaugaguuaguguugcuaggggauaguacauuaauaacuuacagauuaguauaugcauaguuaauuguagaauuauaggguagauuuuagaauaaguaguuauauaaauguggcuauccuccgaagauguauuaguuugaauucgccguagucagcuaauguaucucaucugauucuagcucgggguuguuugccuuccugacaguggcguugggaagcaguaaacgcagaccccacacugucaggauugaguaggcacugugggagacaguggaugggacaguugaaaguuggaagucaucaugcuaugcgcuugcgcuguuucuccuguucuggaugugacuugugaucccguccccuauaguguccuuauacagagcucuuaauaguaaaucauuucuaaugccucauuuuguucuuagggccacauuccaauuuuauucuagccaguaaauuauauuaugaaggcuucucucacuuaauuguaaguucuacaggauaaguaauaaaucuuaagauguuucuauucuugguccuaugguuucuaagaacauaguaccuuauuaaguaacuugcuuuuguguccuuguauaugcgcacuugcucacauacuuacacaugcuuaccaccacugauauuuuguuuaaaugcuuccucaaauacuuaaauggccuuaauuaugaguaauucauaguaccagccuuuuaucauuuaauuucuuuuccaaaguaaacuguaaaguuuuaaugguugcuccacaggccagugaaacacuucauaggguaaaggcacuugcuaacaggcaugcaggccucuaguugaguuugaguccacaugauggaaaaaagaacugacuucugcaaguugcccucugaccugcacacuuguagcaugagucacauacauguacacacacauacauacaaaauauuggaaugaaaaacugccucaguuaauuuauccuuuauaaauaacagcucccucuuguuucuucguuuugugcacauguccuuuaaguucuguaugugucacacuagcucucuucaaauccuugucgcuggcuuucucaccuuugcuauccuuguucauggcugcuuugguuggcuguuuccauuccccauuaguuugggggcacauuuucuucuuugcaaaucuaauguguuuuguugcuauuauugucuuaauugaauacucagcauugugaauauuauauuaagugcugaaccuugaagucuuugucuaaagaguguugaaauuuuagugugccugcccagcauauggagguccugagcucaacuuuaguauugucugccuuccuccuugugggaaaaaguauuggcuuuugcuucgguagguagacacuuaaguuauuuguggaucagcaugcuuuaaagcuuggauagaguaguuuucacuugugacuaguucagccuuguuuuuaaaaugugcucuuucuggauccccucaugucccaggugcucaggaagccccaagccaguuggguuccuugccucucuaaaaacucuuggcauuguccaguuuuuuaguuggauguuuucuuuauuuacauuucaaauguuauccccuuucccuguuuccccuccgcaaacccccauccccuccccucuuccccugcuucuaugagggugcuccuccacccacccacucccaccucacugcccugguauuccccuacacuggggcauucagccuucacaggaccaagggccucucuucccauugaugccagauaaagccauccucugcuacauauguggcuggagccaugggucccuccaugaguacuacucuuugguuggugguuuagucccugggagcucaggggugccugguugauugauauuauuguucuuacaggguugcauacccccugagcuccuucaauccuuucccuaacuccuccacugggguucccacgcucaguccagugguugacugcgagcguucucaucuguauuugucaggcucuggucaaggcucucaggagacagcuauaccaggcuccugucagcaagcacuucuuggcauccucaauagugucuguguaugggauggauccccaggugaggcagucucuggauggccuuuccuucagucuuugcuccacucuuuguccccauauuucuuuuggacaggagcaauucugaguuaauuuggagauuagugguugagguucucccucacuuuguugggcauuucagcuauuuucauccccauuggguccuaggagccucuuccuuuccuggcaucugggacuuuccccaagcauuguccaguuuuuuugauauuugucuuuuugcuuagcuuugcaguuucucaguucaccuuguguguuuaguauucugagauuuaagaauaccgugcaggcuccaguuuucugccuugcaccuuucagcuacuucaguucuugaucucugaucucagacuugggcagggugacugagccaagggugacugcugugcugugcuugggauugucucugcucccuaggauaugccuccauccugggggucauuagauuuugccugagcaucauaguuuuagaauucuuaugacaaguaucuaaaaacagucacuuucaauucuuuuuuuuucucauauuucuaacaacagugaggauucuugcagucuacgauagucuuuguuuuuauuuuaugucuuugaggcuccugagugaauguaugugcaccuugugccugcaaaggccagugggcauugcuuccccuuggaaauuggaguuguagguggcuaggaggcaccugauguggguacugggaauugaacucugguccucugcaugagcaucauguacucucaacgcacugagcuccugucaaggauauucuuuacuguugaugaugcaaguaaaauuguuucuguggccgucugaacaguaacauauuccagggugccacagaccacuagcucuuccuggauaauagcaguguucugugcuaucuagugagaaauuaauacuuaaaauaauacuuaaaauguagcuuguaaaacugaggagcugaaaauuuuaguacauuuuuaaauuuauauugcuccauguuacuggauucaguaauucugcuuaagguugauucucuuaaguguuccaaaacgucagccuuaagagucuuuacacugacuaaaggugcuugugguuaauuuucaacaugcucuaguuuagaaaaguacuuugguuuuuuuuuuuuuuccccuaaauugcaaauagaguugucauuggugauuauuuggaaauacaauuaaacuuguuacauauaaucugaaagauacuaaaguuauugauacuacuaucugauacuaauuuuuuaaaggaaaauaaaugauuuuaauggaaaaugcuuaguuuaauuaaauuuuugucucaaaaagaaguguuuauagaugccaaacuuaagaacugugaaaauaaugcuggacagugguguacaaccuuuacuccucugccccugggaggcaggcagagucuggguucuaggccagccugguagcugaugauuuccuggacagaaagggcuacguagagaaacccugucuucaaaacagaacaaaaaaaugugaaaauguuuuauuaauccacacaaauuuugcuauauacucugucuuuguggcaguuucaggauuagcuuauaaucagagccauguuuuccuucugucuguugaagauugguauuuguagggacuugacuuuucugcuuuuauaguguaaagggguuuuauuuuuuauuuuuuauuuauuuuauuuuauuuuauuuuauuuuauuuuuuaguauugacuauuggaccuggagccuugugauguuuuuauacuguagaacaacagucuuuuaccauguaggccgugugcuuccacacuugagcgccuccugccucucuaccuggugcacguuugccccuccacauucugcuuuacugagugcuucuugacagcagccagagcuucauuucccuuguagaucaagggugacuguggcuugaagauuacuuucaguuuagacuuuugagugacugcugugucugagaaugugugggcugccuagauguuccccaaaugucuggacuccaugaucuaguguggaaggggcaagaauaaaaguucuguugcuuaucuaagacuguguguguacaauuuguugcuguuguaauuuagcaaauaauacccaccauuccuaacuuuuggaauguuuuuauuuaggugagacguggaauccauuaaaauugcauuaucaauuaagaaacguacgggaacgauuagcuaaaaaccugguagaaaaggguguacugacgacagagaaacagaacuuccuccuguuugacaugacgacacauccucucaccaauaacaacauuaagcagcgucucaucaagaagguacaagaagcuguucuugacaaauggguaaaugacccucaccgaauggacaagcgcuugcuggcccucauuuaccuagcccaugccucggauguuuuggaaaaugcguuugcuccucuucuggacgagcaguaugaucuagccaccaagagaguacggcagcuccuugacuuagacccagaaguggagugucugaaggccaacaccaacgaaguucucugggcugugguagcugcguuuaccaaguaacugucagaauucaauguuuccuuuuucucaugugaaccaguaguuuuucuucuauugacucugguuuucugcaguuuguacuuucccacacuaauaauuggcuuuuguucuacaaaaugguggguggauauuucuuuuuguauguacgcaggauucugcugguacgagaggccuuccucuuucuguuuguaaccaaccuucucgccauauuggcacccuacccccuguugccacucucacuguuccuguuuuggguuucugguguacugugaccuucagaguaccuccagcccccaccucaugcacagcguucuauuaccucagcuugagucucccacaugugcuuauucaccuggccuucugccugcaguucagacaagucacagccaggccuucaacucaccaaaggcaaacaucuguaucuauuaggacguuuuauacacaaaccucaguugagauguauacuuagcaaaauuauuuuucaauugaaacagcacaguaaauacauaauauaaaaugccccuugaauuuuugcuuccuuuguaaaucuguugugugauuacaguuguuauaauuuuagcuguucaaucauaaugguccaauuguuucacaaagccaguuugggaugggcugcauuccacuaaugcuguauauaguuugaauuauauaugaaucgccccuucuucuggccaccucugccucauuuuaguauugaauugugcaucuggugccccucacuugcuucauucauuguuaucugauggcaaaauagagcucucauuauugaaggagagagaugugugacccuuucagggcucuuuaugagcuaugccccucaugauagucuaccugugcaucccuuuugggacuuuuuuuuccucaacuuuuccuguuuuuuaugauuuguguaggaaagaggcuugugaccaguacuaaucuugaguacaguuuuuuuguuuuguuuuuccacuuuucuguccuuaaguaaauuaaugucugcucugauauaucguucaucuacucaucuucucuugagaaaagaaaaucagauaucaguccuagcagauguugcauguaaauugguagcaaguaacgacuacaacucaagacgauuaagaauuuuguaacagaaagcucugcuauguuuuaauuuuuauauacaauuaugauauuagcauaccauaagacuacaaacaucugcuuuuuaauguugauuuuauucauuaucauuguuuauuuacuauucguuucauaauguaaauacuauacauugaacaaauuaaaugucaaauuuuuauuauuauaguucauguuaauaguggggcuuucaggugucuagaaacuuuugguuaacauuugaugcaaaaauacuagaugcguauaacuuuagaguugaauuuuaagggacucccuaauauguauacuaucuuuuuaucuggaguaauaaauaaacuaugaucuugaaagugccugaa

SEQ ID NO: 12219 - RNA, 29773 nt, Mus musculus
uucaggcacuuucaagaucauaguuuauuuauuacuccagauaaaaagauaguauacauauuagggagucccuuaaaauucaacucuaaaguuauacgcaucuaguauuuuugcaucaaauguuaaccaaaaguuucuagacaccugaaagccccacuauuaacaugaacuauaauaauaaaaauuugacauuuaauuuguucaauguauaguauuuacauuaugaaacgaauaguaaauaaacaaugauaaugaauaaaaucaacauuaaaaagcagauguuuguagucuuaugguaugcuaauaucauaauuguauauaaaaauuaaaacauagcagagcuuucuguuacaaaauucuuaaucgucuugaguuguagucguuacuugcuaccaauuuacaugcaacaucugcuaggacugauaucugauuuucuuuucucaagagaagaugaguagaugaacgauauaucagagcagacauuaauuuacuuaaggacagaaaaguggaaaaacaaaacaaaaaaacuguacucaagauuaguacuggucacaagccucuuuccuacacaaaucauaaaaaacaggaaaaguugaggaaaaaaaagucccaaaagggaugcacagguagacuaucaugaggggcauagcucauaaagagcccugaaagggucacacaucucucuccuucaauaaugagagcucuauuuugccaucagauaacaaugaaugaagcaagugaggggcaccagaugcacaauucaauacuaaaaugaggcagagguggccagaagaaggggcgauucauauauaauucaaacuauauacagcauuaguggaaugcagcccaucccaaacuggcuuugugaaacaauuggaccauuaugauugaacagcuaaaauuauaacaacuguaaucacacaacagauuuacaaaggaagcaaaaauucaaggggcauuuuauauuauguauuuacugugcuguuucaauugaaaaauaauuuugcuaaguauacaucucaacugagguuuguguauaaaacguccuaauagauacagauguuugccuuuggugaguugaaggccuggcugugacuugucugaacugcaggcagaaggccaggugaauaagcacaugugggagacucaagcugagguaauagaacgcugugcaugaggugggggcuggagguacucugaaggucacaguacaccagaaacccaaaacaggaacagugagaguggcaacaggggguagggugccaauauggcgagaagguugguuacaaacagaaagaggaaggccucucguaccagcagaauccugcguacauacaaaaagaaauauccacccaccauuuuguagaacaaaagccaauuauuagugugggaaaguacaaacugcagaaaaccagagucaauagaagaaaaacuacugguucacaugagaaaaaggaaacauugaauucugacaguuacuugguaaacgcagcuaccacagcccagagaacuucguugguguuggccuucagacacuccacuucugggucuaagucaaggagcugccguacucucuugguggcuagaucauacugcucguccagaagaggagcaaacgcauuuuccaaaacauccgaggcaugggcuagguaaaugagggccagcaagcgcuuguccauucggugagggucauuuacccauuugucaagaacagcuucuuguaccuucuugaugagacgcugcuuaauguuguuauuggugagaggaugugucgucaugucaaacaggaggaaguucuguuucucugucgucaguacacccuuuucuaccagguuuuuagcuaaucguucccguacguuucuuaauugauaaugcaauuuuaauggauuccacgucucaccuaaauaaaaacauuccaaaaguuaggaaugguggguauuauuugcuaaauuacaacagcaacaaauuguacacacacagucuuagauaagcaacagaacuuuuauucuugccccuuccacacuagaucauggaguccagacauuuggggaacaucuaggcagcccacacauucucagacacagcagucacucaaaagucuaaacugaaaguaaucuucaagccacagucacccuugaucuacaagggaaaugaagcucuggcugcugucaagaagcacucaguaaagcagaauguggaggggcaaacgugcaccagguagagaggcaggaggcgcucaaguguggaagcacacggccuacaugguaaaagacuguuguucuacaguauaaaaacaucacaaggcuccagguccaauagucaauacuaaaaaauaaaauaaaauaaaauaaaauaaaauaaauaaaaaauaaaaaauaaaaccccuuuacacuauaaaagcagaaaagucaagucccuacaaauaccaaucuucaacagacagaaggaaaacauggcucugauuauaagcuaauccugaaacugccacaaagacagaguauauagcaaaauuuguguggauuaauaaaacauuuucacauuuuuuuguucuguuuugaagacaggguuucucuacguagcccuuucuguccaggaaaucaucagcuaccaggcuggccuagaacccagacucugccugccucccaggggcagaggaguaaagguuguacaccacuguccagcauuauuuucacaguucuuaaguuuggcaucuauaaacacuucuuuuugagacaaaaauuuaauuaaacuaagcauuuuccauuaaaaucauuuauuuuccuuuaaaaaauuaguaucagauaguaguaucaauaacuuuaguaucuuucagauuauauguaacaaguuuaauuguauuuccaaauaaucaccaaugacaacucuauuugcaauuuaggggaaaaaaaaaaaaaaccaaaguacuuuucuaaacuagagcauguugaaaauuaaccacaagcaccuuuagucaguguaaagacucuuaaggcugacguuuuggaacacuuaagagaaucaaccuuaagcagaauuacugaauccaguaacauggagcaauauaaauuuaaaaauguacuaaaauuuucagcuccucaguuuuacaagcuacauuuuaaguauuauuuuaaguauuaauuucucacuagauagcacagaacacugcuauuauccaggaagagcuaguggucuguggcacccuggaauauguuacuguucagacggccacagaaacaauuuuacuugcaucaucaacaguaaagaauauccuugacaggagcucagugcguugagaguacaugaugcucaugcagaggaccagaguucaauucccaguacccacaucaggugccuccuagccaccuacaacuccaauuuccaaggggaagcaaugcccacuggccuuugcaggcacaaggugcacauacauucacucaggagccucaaagacauaaaauaaaaacaaagacuaucguagacugcaagaauccucacuguuguuagaaauaugagaaaaaaaaagaauugaaagugacuguuuuuagauacuugucauaagaauucuaaaacuaugaugcucaggcaaaaucuaaugacccccaggauggaggcauauccuagggagcagagacaaucccaagcacagcacagcagucacccuuggcucagucacccugcccaagucugagaucagagaucaagaacugaaguagcugaaaggugcaaggcagaaaacuggagccugcacgguauucuuaaaucucagaauacuaaacacacaaggugaacugagaaacugcaaagcuaagcaaaaagacaaauaucaaaaaaacuggacaaugcuuggggaaagucccagaugccaggaaaggaagaggcuccuaggacccaauggggaugaaaauagcugaaaugcccaacaaagugagggagaaccucaaccacuaaucuccaaauuaacucagaauugcuccuguccaaaagaaauauggggacaaagaguggagcaaagacugaaggaaaggccauccagagacugccucaccuggggauccaucccauacacagacacuauugaggaugccaagaagugcuugcugacaggagccugguauagcugucuccugagagccuugaccagagccugacaaauacagaugagaacgcucgcagucaaccacuggacugagcgugggaaccccaguggaggaguuagggaaaggauugaaggagcucaggggguaugcaacccuguaagaacaauaauaucaaucaaccaggcaccccugagcucccagggacuaaaccaccaaccaaagaguaguacucauggagggacccauggcuccagccacauauguagcagaggauggcuuuaucuggcaucaaugggaagagaggcccuugguccugugaaggcugaaugccccaguguaggggaauaccagggcagugaggugggaguggguggguggaggagcacccucauagaagcaggggaagaggggaggggauggggguuugcggaggggaaacagggaaaggggauaacauuugaaauguaaauaaagaaaacauccaacuaaaaaacuggacaaugccaagaguuuuuagagaggcaaggaacccaacuggcuuggggcuuccugagcaccugggacaugaggggauccagaaagagcacauuuuaaaaacaaggcugaacuagucacaagugaaaacuacucuauccaagcuuuaaagcaugcugauccacaaauaacuuaagugucuaccuaccgaagcaaaagccaauacuuuuucccacaaggaggaaggcagacaauacuaaaguugagcucaggaccuccauaugcugggcaggcacacuaaaauuucaacacucuuuagacaaagacuucaagguucagcacuuaauauaauauucacaaugcugaguauucaauuaagacaauaauagcaacaaaacacauuagauuugcaaagaagaaaaugugcccccaaacuaauggggaauggaaacagccaaccaaagcagccaugaacaaggauagcaaaggugagaaagccagcgacaaggauuugaagagagcuagugugacacauacagaacuuaaaggacaugugcacaaaacgaagaaacaagagggagcuguuauuuauaaaggauaaauuaacugaggcaguuuuucauuccaauauuuuguauguauguguguguacauguaugugacucaugcuacaagugugcaggucagagggcaacuugcagaagucaguucuuuuuuccaucauguggacucaaacucaacuagaggccugcaugccuguuagcaagugccuuuacccuaugaaguguuucacuggccuguggagcaaccauuaaaacuuuacaguuuacuuuggaaaagaaauuaaaugauaaaaggcugguacuaugaauuacucauaauuaaggccauuuaaguauuugaggaagcauuuaaacaaaauaucaguggugguaagcauguguaaguaugugagcaagugcgcauauacaaggacacaaaagcaaguuacuuaauaagguacuauguucuuagaaaccauaggaccaagaauagaaacaucuuaagauuuauuacuuauccuguagaacuuacaauuaagugagagaagccuucauaauauaauuuacuggcuagaauaaaauuggaauguggcccuaagaacaaaaugaggcauuagaaaugauuuacuauuaagagcucuguauaaggacacuauaggggacgggaucacaagucacauccagaacaggagaaacagcgcaagcgcauagcaugaugacuuccaacuuucaacugucccauccacugucucccacagugccuacucaauccugacaguguggggucugcguuuacugcuucccaacgccacugucaggaaggcaaacaaccccgagcuagaaucagaugagauacauuagcugacuacggcgaauucaaacuaauacaucuucggaggauagccacauuuauauaacuacuuauucuaaaaucuacccuauaauucuacaauuaacuaugcauauacuaaucuguaaguuauuaauguacuauccccuagcaacacuaacucauuagguauuacugucugacuacaccuacauuuucacagaacuacaguacaacacaacugugucccaacaauccgucagccaggacggggcucacacucuagacaacaucuuggccaucuacugagcucagguaaccaagcuggcagcaagugccuggucugcugagccuucucacuggcccuuccuaacccuucugacauuuccuucugugugugugcacuguugccuguuaaaaguuuaauccgaggucuacuuccuccuucaauuucuaaauguguccucaguuuuuucugaacuaccaaaacuucagaaccauaaauauuagauuguuagcacacuuagguuugagaccccuucaagcugcaaguaucucuauuuaaguucauagcaccugugucaauaccauguagcacuagcacucagacaguccaccacauacuuucugcugacgaucuagcuacagugcaggacaggaguccaauccagagcuuuguacacucuagauccuuaaggacuauaucacuacugaagacaguuuuaaaacaacuaaaauuuaagagaaaagaaaaaagagaaaaagaugcuuuaagcuccaaguuggccaccguccuauauacuuaaaaucuccuaagggaugggaaagcagccugacagaugggcucccaugguggaaggagagaacugacucuugcauauugaugguccucuucccaugcccggucacgaucaccacagcccccgcccgccacaaccaugacucccugauagaaaucucaguuauuaacuggcaaugucugcucaauagugaacgggucacugucucccuuuucuccuucccaggacugggaaucaaugccgggccuucuguauggucccaaacaccgcuuccuucacuaaguuccaacagaauucccacacuagcauagcaugcgcucuguuuucuccuccuaagcuggauccccuucuuucaugacaccaugauaacucacuaacauagaccuaacaauuguaugugcuaaaaaaaaauauuucuggcauuuguagccaaucauuuaggauauuucuaaauacuugccuaaugaauucuggccuaauccaauggauaaguuacuguacuucaauacuuugggagaaaacauaaaugucagucauaucucuucaauguucacuccaauaagaagaacacaacagggcuggagagauggcucagugguuaagaacugacugcucuuccagagguccugaguucaauucccagcaaccacuugguggcucacaaccaucuguaaugggauucgaugcccucuucuggugugucugaagacugcuacaguguucucauauacauuaaauaaauaaauaauaaauuuuaaaagaagaagaagaagaauacaacagcaacucaaguugaaaccaaguucagucaauacucacacuaguaagauuuagucagucagcagcuaugcaauguuaacuaguuaacuaguuaacuuaucaaccgaaccccuuacugaggccuuuugggguauaugaggaaaucaggugaucaagacacugaccaccagacuggauaaggcaaaugacccacugguguacaaaacauaacgucaagagaguuuauaguuuaugaagacauccucacagcauggcccacucuaaacagaguaaacgguaccaauuaauuuagauaagguaugacugaagacaggcacggugaugcaggucuuuaauuccagcacuuaggcggaaaaggcagguagaucugaguuggaguucagucagggcuacguagugacucaaaacaaacaaacaaacauacauaagagcuugaagaaagaauauccauuuuauucaguaucuguucucuccuguaaacagagauaaaauuguuaaaaacguaucaucccuaccaucaccacguuuguauagguaacuauacaaacuucucuaaacacaacucaauguuugcuuguuaauacaucagcuuaccacuaaguaacucaauccaguucuggacugucucuggaggcugagucuccuuaacaugcuuuagagcuucaucaagaagaacauccccuguuggagcauccgauuuacagaucaccugaaacacauuggucagaaaugauccacugguaccacugcauacaaaucaaugcaaacaucucaugcuuagaaacugcacuuacuauaaugucauuugaugcuuaaccgugagguacuuaauauagaaauucauacauuuuuaaagucuuggacaaagaaaggcccaacaauauggaagaauucaacauacuaaaggcauuucauauaguuuaaaaaaaaaaaacaacaccaauuuucucaauaaauguuauuaagaaaacuuugccaaaauagauauagauagauagauagauagauagauagauagauagauaagagauagcuccccccgagucaggcaugguagugcauaccuuuaguccuagcucucaggaggcagaggcaggcagaucuacagccuggucuacagagugaguaccagggcagccaggcuuacacagagaaacccuguuuccaacuggcucccuugagcuuaugcucaauaaaagauaugaaggcgaauauaguuuuaggaacaacaacgacuuuuuaaacugccaccgcuagcagaagccuuaaugaaaccaucaacagguuugauuauguaaaauuacucaaccuccagcaccaagaggaacagagauacagggauggggcuggggaggcaaggacagacucuaaaucuguaauuaaaaccuauacugagagaaagcucaggaguuaagcaugcuggcugcucucccaggagucagguuuguucccagcaugcacucaguagcucauggucgcccuucucagguuuuaucaauacuguuuuuaaaaacccaggguguuuugcagcacagcuuauuuauaaaagugguaugguuacuguacugggcaguacagauucagaaacaccauucagaacauuugcuccauggugacuaguuagaccaggguuuauggggagaaaaagaucuucaggaaaaugaaucuugugucugugguguggccaugggaccugccucucccucccaccccuucccucucuccacgugaccaguaucugccucacccuccaccucccucacacaccuugacugcaccuaaguucugcucuaagccuuucucacuuggcaauuccuccauuauccuugccaugauuuuagucuaccagucugaccaucuuucucuuguaauaauuggucuccugucuagaggccuugaacuuuuuuaaugucuuaagaauacuuucauuaauucuuugauaauuucauagccuagauauaauguaacuuguuuauauccaacucaaauucuccacauucccuucuuccuaacaguucuccucucaccuccaugcccccacacacuuaacaaccacugccucuuacucgugcugcccaugugaggccauccaucagagugcaggcagccaaccaguggccacacguacccaaccucccccagcagccaucaguugccccucagcuagggauggagccucaugaggccucuguaccccauaccggggugcugccuggccucacuucuccaguaugcagaggcgcugugagucucuaagugccugagugcagcccucuggccccuuucagcccuggcugcacacugagcucuccauuguuccugcucaaaacuaguacaagauucaagcaagugcuaauuccuuuaacaauuucaaaaauguguggcuuccaaauacauaugcuaugcuucaauaaauucuugcuaucuccaacacagaagggaugaaaagaagauaaaacaagaccucugaggaacugcauuauauagauaaaaagaauuucaaaaaggccucagggguuuaacagaaaacauuagauucauaaaagaagugcuauggaaacggcaaucuuuuaugagaggcccaaggucaguuauguggcacgaggcaggcuguaaggacauguggacagaagcuaaggagcaagaauaaaauaacuaaaaggugagaggcugcagacagacucucccuucaagccaucaagaaaacauaacccuaguacaccuccuaacuggccuccaaagggaaaaccacuaaggcuggggucauuuguuaagauggcuuuaaaaugaacugaagacagcccgaagugguggugugcgccuuuaucacagcacucaggaggcaaaggcaggaggaucucugaguuugaggccagugcaguuuacuuaucaagcuccaggucauaugaaacuacauagaaagaaucuaucuccaaaaaaacccaaacacugcaauaguuggcuuccaugaagagagcuaaagaacaaggaaaacagcuacauuuggucuucuaacuauauggauuaucuuaacugaaccaacaauacuuuuaaaacuuaacuuauuaaaucacauagaauauucuuccaacauuaccuacgucacucagaacuagagggacauuaauaagcccauauggcuaggaaacaaauuuucucugacuaacaaccagccacuucuauuauuuagaaguucuauuacugccuacauuauuucuuuucauuaacacaguaauggcuuuccuucuuauaaaaugaucacucugguuuuacaguccaguguucagaguaagaaaugaaggcauaggcuugucaucuuagagcucuggaggugcgggugggaggaacucuaguucaagaccaacaugugcuagugaguuccaggucagcguugguuaaaaagcaaagaaugucuuaaaacaaaaacauaaaaccaacaacuaaacuaaaaaauaaauaacaacaagguucuggccuaucuuuuagauuuacaaauauaacuacaaaagaaaaaaugguuuugaaauaccauguccaaagcauaaaaaacagaccagaagagugaagaacugagucugaaguuaaaaacccacacaccagcauaugcauucugaucugccacagaagugccaccuccaccauggcaagagacauaaagaucaaucacacuuuuacagaaagauuaaugccccgaguaauucaguucuuucuacaaaacucucggauuuuuuaaaguccuaucaaggucuucaggcuuacgacuuuuucagaaacaauuaaagcugggcaucgcccuaagguacagcggucaucaacccuaacagugaggagcaucaugcugcauaugcaaaacccagaaaaaccaagaaugcaauccaauaaggacaauuuaaaacgauuuaaauauuauaaagcuauuagaaauagucaucacugaaacagaaaguaauccuuguaaagaggggauuauuuagaaguccucuuaccuuucugguuaaaagacuuuuucuucucauuccacaagccucuaacuguaaccuuccucucaaagcuaauucaauuaacauacagccacguaauccagaugauauacagucauuccaaaaugauguguaacccuauuuaaaaagaacaaagaaaacaaaacagcuaauuuaccuugagucaaaaguagaaauaucuuuagcuaaagccacauaugucuucuuacaacaaaacacuaaaaugcacaauuaguauguuguuaauguaggaucuggggaagggucguccuuuuaccagguaucuuacauauggauaaaacaaacuucagaggucaagcugggacaguaguacauaccugaaauucuagcaaugggaauauggggacauucuaauggcucaagaguucaaggacagggcuggagagauggcucagagacuaagaguacuuacugcccuuacauuaaaccaaagugccuagcacccauaugguagcugaaaacuguaacugcagaucccaggauccaaugcccucuucugggcuccuugggcaccaggcauacauauaguuaaggaauacauagaaacaaaacaccccuauauacaaaauaaacuaacaauuuuaaauaaauaaaaaaugguggcucauaccuccagcauucaagccagccuggacuacucagggaaggcuuccugguacuuacccaagucaaugggauaagcccauauuuaagaggauggcugaccaucagaggucauggaacuucacuaaugauguaagaacuuuaaagugauaacaguuuuuaaaauaauuuauuuuuauuuuaugugcauugguguuuugccuacauagugagagagagagagagagagaguguguguguguguguguguguguguguguagguaguacggacaguugugagcuuccauguuggugcuggaaaucaaaucuggguccuucucuaguucaaaauaccacuuuuguugggagagcauuuagauaaagaaaacuaaaggggauaaacaaaacuacaguuuugucaggccugguuauuaauuccagcacucaagaggcagaggcaaguagaucucugugaucuauaugcaugguuuacacagugagauccaggauaaccagagguacauaacagagagaccuaaaaacaagucuaaaaaguuuuuaaaagguuucauauuuaucaaaaaggccaauuucaaugugaaaucaaggaagcagauuaguuuugagauuugcuaaaaugaaaagauugucggacuaaacaacauuuauuaaaaccaguaauaguagagggcuggagagauggcucaguggucaaucagagcacugacucuucuuccugggguccugagguccugaguucaauucccagcaaccacaugguggcucacaaccaucugcaaugaguuuggaugcccucuucuagugugucuaaagacagcuacaguguacucauauacauaaaauaaauaaaaucuuuuuuuaaaaacaaacaaacaaaaaaacaaaaacaaacaaacaaaaaaaacaauagaggaaaaucaagaucuggagcaauuaaagacuuaggaagcaagggaauuaauuccagaauugauuccacaugaaaucauguuacagcuguguguuucucaggggccugaacacacaaauggguuuccuauuugaaacaccaaaauguagacagaauauacacuucauaaaguaaaauggguaugguuagcauacaagucugaaacucugucuagcugggcagauuuuagcaguuuaccucugaugacguacagaagagggcuaaauacuguuccaacuauucucauguuaugacucgaccagagauuugucagcaaaacaaggucuuuacuacagaguucagaguuacguuuaaugaaaaccugauaacucauguggaaaauagaugaggaaaaaaagaaagaaagaaaaaaaagaaacaauucugugccaagguuucugggacuuaucagaaaagacaagauggaugaagccaagagaaacagcaagcaacagaguagcccaguguuuugauaaccuccuaguaaaacuccuaucaugaauguacaaaagcaugaucaggaauuaucagaaguuguugcuguugucgucauugcuguuuuguuuuuagguugaguaaaacugauccaaaagaacaagggagagggggugauauaacugaccagauaacaaugccacauugggggcuggagagauggcucagcgguuaagagcacugacugcucuaccagagguccugaguucaaaucccagcaaccacacaguggcucacaaccaucuguaaugagauuagaugcccucuucuggugugucugaaaacagcuacaguguucuuacauauaauaaacaaaucuuuaaaaacaaaaacaaaaaaaccaaugccauauggaauugaggccaaauggaccaggacuguaccaaaggacuauaaucaaccuuagucagccugguucuccagugaauccaugacacaauauggcauagacaaguuagcagagaagugcucagucaggagguagagaaaacguuggccuuguuucucaagaacaauuccaagagccuacuggaggaguacauacucacgggauguuuaagugugucccaacaaaucuuuccuaucuaacaaagccagucagccacuuuuaauaagguagcuaaagucuaugggaaagacuaauaaaaaacuggugguaccaagcagcuacaguuuuaguucaagagguagaacuaacuaguuguguuugcauacacagcucugagagaauaaagaaucaaugauacauccagggaagcaaaacaagccagaagaaccaguggcucuaagauagugucccucaccucacucacagcguaugagacaaccccaaccuuaguuagagcagaagaccaccacagaacaaacaaucugaggcauuauuucaaaaguguuauuuaacaagaaaaaaaaagucccuauguucuaaaaaguuuuaucgggaagugcagacauuccagaaucaagcagguuaaguacuauccccaacaaacaagaauccagacauggcauggguccacaaucgcccaaagcaacaacagagccagagagccagagacccuaaucugcuguccuggucaggggaugcacugcagugccagcauacacagcucagggcacucuccagucgccuguaaagacuacuaguucccugauaggcagcaaccguucuaacagaucaccagcugcuagguuaaugagacugcagcauccgaugcagaucaauccucugcuacuguggguccuggcaaaaacagucaaucuucagggcagaccucauaauguugcauaaaacucaagggaagggggaguggguggguaggggaguggggguggguggguaugggggacuuuugguauagcauuggaaauguaaaugagcuaaauaccuaauaaaaauggaaaaaaaaaacucaagggaaauaaacugucuuucccauucagucaaagaguacagcagaaagaacuguacaguaaguaacagaugaagcaaggggacacaaucaccaucaccaugggcaguuucaaggacaacauuaggagacaagacugcaucuaggaaaaccuccaccccgguuuuucucagcaaugaccaucacuuguauggaucuccaacugccugcuuucuuuccucuuaucaaguggcuugacuugaaugggaaaagaagcccucaaaagugccaacaacaagaaggauucaccaugagggugaagagccacacuauguaguccagaucucuuacuuaaaaugaaggaacuugaguuggccacucacaaugaaauacaguguaaauacauucugaaggucuagucuacuuagucaaaggauacaacaaccagauguucaaagacauuucauguauuauacaaagacauacaaaauggaaaaauguccuugauccauaauuuacauaauauaaaaauauaauaaguaagaccugaauucaaaauaauaugaaaaaauacauacaggcuuguauuguaaauauuuaauuuuuauauguauaugagaguauucaccugcagguacauguaugucugcaccaugugugccucgugccugaugaggccagaagaggacacugaauguccuggaacuggcgcuauagaugguugugaaugacugggugggagccuugggugggagccuaugcugggaaccuaaccucgguccucugaaaaagcagcaagugcuaaccaucucuccagcacuaagguuucuauuuuucaaugugcauuuccuaaucccagcacuugggaggcagaggcaagccaagagcucaaggccaaccuggucuacacagaaaauuauaggccagccagggcuacacaguaacacagugagagccucucaauuguaaacaaggugagguggggacaaaaagaaaaagaaauucaaguucucugacacaguucuauagacuuuaaguuacauuacagaauacuaugcauagaaaaauguauggacaaagacacugaucuugucacaguaaaacaaaccaaacacccagaaccaaccuaaaaauaaauaaaaauaaauucagcguuugccgaacuuuuugacauugaaucacucuguacgcauauaacaacuuacugaauauaguuucuaggaaccagguuuuaagaggacuugagcuugaucccacucacaacugccuauaacuccaguuccaaaaguagccaacuccuguagccucgcaaagguaccugcacucaauguauacaacacacagagacacacacacacacauucaaaacuaagggccaggugcugggcauauuucuuuaauaacagcauuaugacaucagaguaagguggcucuccacgacucugagccagccuggccuauauaacaaguuccaagucagccagaguuacaaagugagacucaaaaagcaagaaguccuucuucccugcccuaggaacagcuuuccugccguggucucucaacccuaaaacgcaagccuacucugggcucaccccacagucuccuuggugucugcagugacacggaacugacugaccagacacuuaagagcuucaacagcuugacagccucauguccucuaacuugacucaucccuagccacagcuuccaaaccagucagcaccauuucaaaggccaucaacacagcagccaaguucacugggaucagguagcuagcucuggagcugguuggggacuccucauaucuggacuucauuucucagacacaguagguccuuuugccuagugucagccuuggccuuccuccuaaccaagagaagcagcugucucgcuuccaccucccauggcucuucugugccuuaccuacccugcauguucuuuucuuuuguacacaacccccuccccccaaaguguggugaaguagcuggcucaaaguuccacagagagaagacaauaaaugcuguauuaguaaggaaggggguauaaauaaaaacaucuuuuaaccaucccagugcaaagaugauuagaaaauggggaaaucagccaggcagugauggcacauagccuuaaugccagcacuagggaggcagagucagguggaaagaucucugaguucaaggccagucuggucgacaguucuaggauagccaggacuacagggaaaaccaauucaucuuuauauaaguaugcauauauguauguuuucacauauaacacuuuuuaaaguagguuaggaaaguauuagcaguaauaacgacugacuggcuaucuucacauuagacuuuucuguauagaugugagagaaaaauggaacaagaaaacaagaaaaagacuaguuauucaaacuuauaagguaauaauuaagaugcuaucaguaacaugauaaagacacuagaaacacuaaaacauuugcaaaugauauaccuaagaaccaccuuucuguuucucaaauccaacacaaaccuuugaauauacgcuaucauccaugaccaagccuggcucuucccaauccucaggucccaccaaacagcauuucuuagaaaggacuccacugugcacaguccccagucauucucacacagaguccucuaauacugucuucagcauacuucagcauaguuaucacaaucuguacuuauauacauguacacacaucuuuguuuauuuauguaucugucuuccuuagcacaaugcuuagcauaaaacaauugcacaaguagaauuuugaguaacuaaaggucaauuauggacuuuaaaucuuccauuuuuguuaaauugguuuuacuuucuuccagcacuaagaaauaaguaguaucucacacaccaagagucuuuaucauggagccacucuugccagucacuuaagaccuaagugguguagggguguaugugugugcacacggguaccugagaaggcuagaagagggugucauaugcccugggacuggaguuacaagcaauguugagcuggaaacuuaacuccaguccucuggaaaagcagcaaacacccuugacugcugagccauguuuccagucccuauuuuuugguagccuauacuuuccuaaauauacaggcuccuugugguuuaaaaggcauauuucuacuauucucaugccuuaaagucuaccccauuucucccauaauuauagggacaguaaaaucuuaguaauuacguauuuuuuaaauuuaucuuuuuuuaaaagauugauugauugauugauugauuuauuacauguaaguacacuguagcugucuucagacacuccagaagagggcgucagaucucacuaugaauaguugugggccaccaugugguugcugggauuugaacucaggaucuuuggaagagcagucagagcucuuaaccgcugagccaucucuccagcccuaaauuuaccuuuugaagcaucacaugcauauaguacagacuuaaaugcaggucaaaaaauaaguaucgcuuaaucuucauccaggacuggcaacucauuuugcaaguucuaauaauuucaggccagugagugauacagguguuuacaaaccugaugcccugagacccauuuucagaaguugccaugugaccucuaggcauguacacacagagaaauaaacuauaaacauuuuuaguaaucccaagaccagugacuuugcucucucuaguuuguccacuacuuucuacacucacaucuucuaaaaauucucuguagaauauugucuuuaaaaccuacaacugcuuccaauaucaacccagcuuuuaacuucuugugccaauaaauguucauguuccuuaucccagacauaaucuccaucguagcuguuguguccugucuaaaacgucguuucucgucuguuaagucacagccuguacuucacugugcucaaauaucuccaaguacaggagcacagagccugaaaguaaaaacacuugagagccugaaacagaaggaucacuugaaccaagaaguucgggaccagccugggcuacaaaauaagacauagaagaggagcuaaggaugcaguuccaugacagggacuugccuagcauauuaacgcccuggguucaauccccggcauuguaaagaugucuuuaaaacuggaaauagggguggguugggggugggggugggauagaauguggggacuggggaauggcucagugcguagcacugcuugcugugaagcaccgggacuggagugcaaucaucuaggaccugcauaaaggcuagggacggccaugugugccuauaaccccagcacaguggauccugggagcuuggucaccaggcauaugacccuccccacaacacacacaaauaaaauuacguuaauucuuuaaauuauuuuagaauuuacaauacaauuacaucuuucccccuuuccuuucccucccuccaagccaucccauacacuccccuugcucuguuucaaacacauggccuuuuuuuucauuaacugcuguuauuuacacuaugcauaaauacauacauauauuuauuuuuuuaaugacaaaauacuuuuauaggucuguggaccagugcuagagauuuagcucaacugggaaguuugccuaucccagauguacaaacauaaaccaaggaugguggaagugccugcaaucccaaccuggcacugcacucuaggaguagaagcagaaggaucaugauaaguuccuggacacgcucagccacagagcuggaggccagccaagggugcuggagacccugucccaauaauaaacagugugucaaaguacuugcuaccccaauauauaguaacuccagaaaccacaugguggaaggagagccagcucucacaaguuguccucugaccuccagacagcaccccaccccccacauccacauacaaauaaauacagaagauauuuucuuaaauaauuuuuaaagguuguagaaaccugcccuagccaccuucugugaagauucuggccuuggaaaguaauaaagauuauuuucuuucccuaaaaaauaaaacaccaaacaaagaggaaauaagaugaucaaaaugugggaagaacugauuacaacaagggccagaagaggccaggcuccucacaagcuuucucuucuggaaacagaaggcauaaggaaauaagacuuacugccugccaaccacacccaucacuuuauacaacacagcugccauagaagucacugauuuugaaguuuggggcuucugauaccuccagagagugaacaguauuccagagaagagaaauaauggaaacaaccacagacucugggcuuacaucuagggaaaagaaaccaaaauacuugagguuuccagauuuccuagcccagauggucugggauuacaaaaaaacagaggggagggggauacuuuuuuacacacacagacacagacacagacacagacacagacacagacacagacacagacacagacacagagagagagagagagagagagagagagagagagagagagagagagagagaggcacagagacagauugauucagugaaaaggcauagguaaguagcugaaugagucaaauauucacuaaauuaucauguccaggauggucaggaacuuacggcaauaguggaagcugggcucuguggcagagcacuugccuaguaugcucaaggucagaguuugacccucagcacugaaagagagugaagaagagggaguaucaggagccagccaacagcauuuguuucagccuaaguccuuuuuaauuuuuauuuauuuauuuauuuauuuauuuauuuugguuuuuugguuuuucgagacaggguuucccuguauagcccuggcuguccaggaacucacuuuguagaccucgaacucagaaauccgccugccucugccuccagagugcugggauuaaaggugugcgccaccacgcccggcucuaaauccuuuuuagcccuuagguccuauaacagguuaugagacagaccacaaauagaggucuguuuugcccaggaaacaaugaggucuaaaaauucaaaaacauuuagucuaguucucccaaggaggagucaaaaaagacaaagcuacaagucaaaaccauggguaguuuguguugguuacuuugucaauuugacacaaacuacagccacaagagagaaccuaaauugagaaaagguccccauaagauuauccuauaugcaagccuguaggguacuuucuugauagaugauugauguggaaggacccaucccacuaugggugaugccgucuccagcagguggucuugcauauauaagaaaguaacugagcaagccaggaacaagccagcaucccugugggcucugcuucggugccugguuacauuuucuaucuugacuuuccuuuaugacagacuacaacuauaagcugaaauaaauccuuuccuguccaaauuaccuuuagugauguuuauuuguuuaaaucacagcaacagaaauauaacuaggacaauagucccauggcuccugaucugaggguucuucucuagucccuagucuacaccuucuguuuuucucugaaguugguauccaaucauacccaaaucaucuggagugcugucuccuauguauacugauugucccuuaaaagcuaaaaaucuaggcuggugagauggcucaguggguaagagcacccgacugcucuucugaagguccgaaguucaaaucccagcaaccacaugguggcucacaaccauccguaaugagaucugacucccucuucuggagggucugaagacagcuacaguguacuuacauguaauaaauaaauaaauaaauaaaucuuuaaaaaaaaaaaagcuaaaaaucuuagaaaccucagcacuuagcaaaggaacugauacaugaaugacauauuuugauuaacugaaaauacgaauuaccaguuaaacuuguuuaaucucaaaaacuggcaaauccuacucaauaacuaaauuuaaauacauguaauuucuguuuuuuguuuuaaaugguauaaaauuauuuaacaauuguauaagaaacugaaacugggggguugggggauuaguagcuaagagcaccggauuuugcagaagacccaaguuuaguuccuagaaccaacaugcuggcucauuaaccauccacaaaacucugguuuuagaggcucugaagccugggaugccuugaucuccaagggccccaggcaugcucaugcuauaugcauacauucaggcaaaacacucuugcacauaaaauaaaucuggaagggagggagggaggggaacuaggguagggcaaggauggucguuuagagguagaacacuuaaagagaauccacagccagcacaaggucccaaguucaguccugaccaggaaaaaaaucccaagggggcaguaaucaccaaaagcugacuguaagcccuccaaucugaagucuuucucaaaaagccagggauggacagauacagguuaucuuccaugcucucuaaaaauuacuacuaaaauguuaacuaguaacuuucuagaauucauacuagucucagucaaauucuguuauaaaugaaauuucuaucaacagagcuguucuuugagaaaggagcuauguuguccagacuggccuccuccaagggcugagaucagcagucccccugccucagccucccaaguugucagaggcauguuccacugccccccuuucauagaaaauaauuucuagggaagggauguaguucagaccauguagguagggugccaaggccccgggugccauccucauugccaaauacaccaaaguguaauaugauuuccaccacagaaaccagaaaugguuucuaaggugaucuaaaugcaaacacauguaagaagccucggucucuccaccaguuuucaccccccccccaucucuuccuucaugaauguaagauggacauucuggaugucucaccucucuauacacgaaaggaagacguuuuuuccaagaccacccccaaaaaucaguguucauucucuugggaauaauguuaccuucagugaguguaugauguacuuagacuauuuacugagucaaggugagauagucaacuguagaagcaaaaguuuuaaacugcaccuguugacaccaaguggacaguuucucuaguaaagcauguaaaccaaacacaacucacuaaggcuaaauuaacuuuacaacggacauguaauuuggcuuagagugcuacuugguuagcgggugcaaggccuggguuaaauccccagcaccaucaaaacacuaaaaugaaggacaauaacaugcuaguaagauucuaccauucucuauugcucuaucucauguaugaaugccugugugcauguguaugcaugugugaauguggcuguaccaauuugugcaauuacagaaccaaccucaaaguucagcccuugcuuucuaccacccagauuuugcuacauuuauuuguauguuuguucaucauacaggagacacauacacacacacacacacacacacacacacacacacacacacacuacuucauuguaggucagagcacaacuugcaggagucaguucagccaagccaucuucaacuggacuccuugagacagggucuuuguuguucacuguugcacacaccaggcuaguuagccuggaagcuuccaggaauucugcugucuccagcacccauacugauucaagagcccuggaauuacagaagggccuugaugagacccaguuuaugagaguucuggcuacccaaacugagauccucuaccagcaccccugggacaucuccccugucaaucuaauguuuaugaaacaagaagaaaaauauucuguuuucuuuuuaagucuguguguguguuagugcaugccacauuauaacacuauaguguauacacaagguuacauugcaauacuguaguacgccaacagguugcaaucuuuacagcuuauuuuucauauaggcucuaaauuuuauauuuggcuuaaagagaugaaaauucaaacccuucaaaaauaucaaaagaauauaguuaguauuagaaaagaaauuacaaaauucaaaacucuugaagcuuuuauguguguuuuuuuuuuaauuacuacaaacuuuuaacacaccuugaaauucuaaaacugagcucaauaacuaucuggcuuauagguuuaagaauagcacuauuuuacauuaacuucauagagguaaaauguuuacaaaacaguuauacaucuugauaaauacuguguucuaaacauuauuucaaaaugaacaaauuuugggggacagugugaaaacaacaaagucaguuucaucuuuuaaacuuccuaagucuugccacacagccugccaucucagucuuggggaggcagagaggagaggaucaccaguucaagaagacuucagauucaagaacugccaggaaauuugaggcaugccaaauaccaucuuuucucuaaacaaacccaccuaaucacuacauacuauucaaguguuacugcaguagagcucuuaggacuuuagaaauguaucuuuaaagaagauguuacuaaaagcuauuaaaccuuagaaaaaucagaugacaaaaaaaaaaaaaaaaaaaaccacacuagaaaaagacagggagaaaacuaaaacacaaccaaacaaaacaacaacauucaggaguacaguacacacaagaaggcuguucugaaaagguuuccuuucagccucuuuuucuuccaaagccucaguggagggcaacugacuggacaagacuuaacuauaacacaaaacaauaggaggauaccucaagaagccauuccaaagcugucaguaagccuaacauuagggagacagagacaagaggacccagagagaggucaaggaaaccagccuggccuucaucagacccuaucuaaaacacaagaaacaaacaagcaauccuaucaggcaaugguggcacacccccuuuagucccagcacucuguaggcagagggagaaggaccucugugaguucaaggccagccucaucaacagaguuccagaacagccaggacuacguagauaaacccugagacucaaaaauaaauaaguaaaugaauggauaaauaaguaaauaauaaaaagcuaaaauucuagggcuucgcaaagacaaagggggaaaguacaguaaaguguuagcaauaagugccacaaaaguacacccccccaagcacgugaagugaccauuuuccacauuugugagaauucugaaacucuugcauaguauguaaagagaaggacgacaaagccucacuucuacucaacaggccauuuucuuucucccuguuucuguaggugucuguacauaugugaucguguagaggucggcagucaacuucaguguugcccucagaugccaaccaucuuggcuuucaggcgagucucacacuggucuggagcuugcugaauggcuaggauggcugguccaggagcuucacucugcaucaaccugugacaucacucccagcuuuuccagagagagcugggaagcaaggccucguguuugugugguaagcacuuuaacaaucuuacccagccaccaaacacuagauuaaauuggucauuuaaaguagucaaacugaggcuggagagacagcucagugguuaagagcacuggcuguucuuccagaagacccagguucaauuuuaaguacccacauggaagcuuccaaccaccuauaacucuaguuucagggaccuaaugcccucuucuggccuccuuggauacacaaacuagauguacauacauacaaauaugggggcaaagcauucauacacagaaaauaaaaauaaauaaaccuuuaaauaggcaaguaaaugagaugaucagaucucaccuuaaguauuuagaccuaccaccaauaaaauaauucaaguuauuuaagggggucauuguuacaguuagugguacaauaugugugagacccuucaguuuagucuucuuaaaaaaauauuuuaauauaacuuuuugguuauuuauggucauucucaaguauccugaaacuacucaaggcuucaauggaaaaaaacacaaauaaauaaugaagagaaaauauuuacuauuuguccugcucugcccccaaccauccacagaaaucuugccaauuacuuaauuggaauucaugagugaaccuaucugacauucuagcaguggccucuaaauaucacucacugacacuucacccagauuaaguacccagaaccuaugaaugagccuaggcuugggcuuuuuuguuuuucgguugcuguuguuguguguguguguguguguguguguguguguguguguuuuguuuguuuguuuguuuguuacgauuuacuuauguauacaaauaaauacacuccagauacaccagaagaggacaucggaucccauuacagacgguugugagccaccaugugguugcuaggaauugaacccucuggaagagcagucagugcucugaacuccugagccaucucuccagcccuuggauguuuuaagaaaagaaaaaaccugaaaagcuaccucgaaccuaaaaaaauaaauaaaauaaaacaaaacuauagucaggacugaaugaggacaugacuguuccuagguuugaaguaggaagguuuaguguagaggggauaaacaggcaucuggaaagguccacucugaaccuggcaugugagggggauaggaggcuggagagaagaaacaagagccaagaggcuggaguaagccaggagacaaagagagcaagaggccaagagaccacauagccaaaaggcaggguuauagagagcagagcagcugagggaagggagugaagcucaggggcugcagagguugaggguaggagggcuggaugaaagugcuaagaagagucaggacucuuaacagguauaggcgaugcugagacagguagccagugucugcucugauaggcaccuuggcuagcagcuauacuuccugaguuugagaccuaacaaagacuuuaaacaaaacuccauguaaauaaucugaagccaauggcuucucauguagcccaggcuggccucugacuuucuauguaggugaaggugacccugaacuucugauaggcuugccucccaaguggaaguauaggcaugaugggcuuccaagcccagucugugcagaggaaggaaucaaauucagaacuucauccaaagcacucuaucaaccgagcuguauauucccaaucccuagaaccuaaguuaauaacaaauugaacaaagcuuaaguggcuacggaaacagagccaggaaaccaagacuuugucuuuuaaaaaaaaaaaaaaaaaaaaaagacaaggggaccaucccccaaauagacugggugauagguuuauaggacuagucacuacuguguacacacuugaugaaagaaaaaauauguaccuacauuuuuuuaaaaacaagugcccacccccacaugcuacaaauuagugccuggcugaaccuuggccaugacuuaugaaguauacuuauacaaaacaaccacaacagauggucucaguuaccugccaucaaagaacuuccauuguuuaaaaaacaaaacaaaacaaaacuaguugaauguuguaguagcauuaaauucaaaaaauucuucagauuaucuucacgggaaccaaucacagaaaaauaacugguaacagcuuuauauuaaaaauucagaguaaggcuucuaaaguaaaagguauuuuuccaccauuguuucucaaugugacaauaccaaaaauaauuuuuuuuguuccguuguagcuuuaccgaguucuagcauacagaaccaaaaugcugacccaggaauguaaccuucauuuuguuuuucuuguacuuccuagaaaugucucauaaucuguuuuguuccaaaguagggaaggagggaaggaaagauaaauguguauuacaagaagccugcuuucaaaaucuaauuacuuccuaagugaaugcucucuaaaaucgcauugccacacacuaacaucuagcuuuucacuccacaacuaaaaaugaaacacacaccaccgcauuccucauaauaacuguaauuaaacagguacugugccccuuucacagccugagggccauuaagugucuucaagcugaaugguauuaaggcaucaagaagcacuucccuggguaguaucuaauauccgggaaccacaaacagucccuggaaaaacucagcucucuaccgcugcuaagucugaggaacuaaaaaacuguuuuauaggaugaacugaguuuuguucugguuuguuucuuguccuccuuccugaauucugaaaacguauuuaaaaacaagauccaauaccuuucugucugacucucaaaauguguugucuagaguuuccacacugaaacgaaacaaacuuccgggccaccucaucauacaugauuuaugaaacauccaauccugcaagucugcccuuaaaaauaaucaucuuuagagauggauggguauuaauaaaaucaaucaaacauuaacuacagaauccagacauuuaaaagacggacacuugcacuuuuucaacuuauaugugugaaauuccuaaauaucuggggugaccuuuccaaacgucagaacacaacuuaagccuaccuaaaucuuugcagucuuucaucaaagcgcaaacuugguauuccucccagcucuucacaagcccucccuuaaaauggcaaaacggaaaggacgacagcagaucuaaccgcaaaacuaacucaucgcucgcucaaaccaaguucauccaaaaaguaacuuccuagguuuuauaucaacuuaguauugacuuuuuaaaacaauacccaguaaaaacaacuuugcuaauuucuuaaccgcgcgccgcaacucaaguuuuacauaagaaagagggccgacagcaaguagauccgcgaaccucucccgggucuuaaaaccugcaaaaacucaauacuugggagccgcgguagccccgagucuuuagaucucaacagucuuggguuggaguugccauuauuugcggcagacggcgaagaagaagaaacgcaaagaucgccaagacuucggaacuaagagugcuugugagcagaggacgggaaaacccaagcgagcacuugguaccgggaggaucgggagcacucggagcgcagccggagagggcugacucccacacuccuugggacgagagggcgcucaggggcgcggggcuccggaagcagggacaggugaggccucggccagcgcccacccgggccccaccuggagccacccgggucccgcugccaccccggcugccaccccggccggggccgcggcgcccgcaccucucgguccuugaggcccagcaggagcaccuccuccaucagggucagccgcguuuccuuggagucgcccuugucgucgucguccugcucgucgcggcggcucugcgccucguccucgccgcugccgccgccgccucccgccgcccgcuccuugucggcagcguuccgggaggccucggugcgccgcugcaccaggcccgagcuccgcugggucagcgaggucauggcucccgcacaagagccgcgccggaccgacagggacgcgggaccggccggcucucccucacggccccggccccgggagcuuccguguuaauucuuggagcuggggcgauguccgugggcugcggggccgaaggcggucaugaggagccggagcugggcgaagccggcgggccgggcgucgaugggguacacaagggagccuucagcccgcggcuguggccccccacacagcccagg

SEQ ID NO: 12220 - RNA, 5022 nt, Mus musculus
guauuuuuuccaauuauuuuauuuuuuucuaaaaacaauagaaaaaaaucaacuuuaaaaaugaaaaugucuuuaaauaaaaaaaauuaugguacaugucuuaaaaucuuuuguaacuguuauaaacguuuuauuaaaguuauuuacauuucaaggcccuauuuacaugggaaaauuggauagauuuuaagauuuuuuuaaaaaaacaauuaaauacaaaucuguuaaaaggaaaaagaaaaaagaugggaagcauaaaaaaaaguucuuuuauacuauuuaaguuugaggcaguuaaaauuauggcugaagcuuacagucccaaagccccagccaagguugugagguuaggcuuugagcaugcauuuuaauuccagcgcaucaguucugucagaaggaaccguucuccuuacucucacgagagauuccagcuccuccucgaguuaggucaguuuaugcaccagaguuucgaagcuguucgaguuuguguuucaacuguucucgucguuuccucaauaaguccuuuucagaggugagcuugugcucgucugcuugaauggacaggauguaggcgguggcuuuuuugaggaucacuaccuugggggccuuuucguuguuuuccaauucagggaucuggucacgcagggcaaaaaagcugcgcuucagcucguuccuccucugacguuccaagacguuguguguccgccucuugucguuuuccuccgugucugaggaccuggggcuggagcacuugcgguuguugcugaucugcuucaggacccugccacuguccaacuuggcccucuuggcagcuggauaguccuuccuuguggaggggggugcggcguaguugugcuggugaguggagacguggcaccucuugaggaccagugggcugugcggagguuugcuguggccucgggauggagaugagcccgacuccgaccucuuggcagggguuugccucuucuccacagacaccacaucaauuucuuccucaucuucuugcucuucuucuguaagggaggaaguggaagaucacaguuagccacgccuccugaaucccggacgcuauacauaggauuugaccgaugcuauccaaauaccaaguuggaaagggaagaaaguaagaaucagauccagacaccaucuucccuucucccagaaaggcagaacaggguuagggcacaggugagaaaauuaccauguaccaggauaugguauccuugccaauucuuaccuaagauuuaaugaggcuucagacacacccaaagcaaagcacauuucccaagcaccuccuauuuuuaagggacuuuaccgagaaccuuucaggucccgugagggauagcugcaaaucucuugcuaugacuuuagcaacucccuauuuuacuggaagcacaauuaaaaaaaaaaaaaaaaaaaaaaagucuugcagcuuugccaaacguccugguguugggggaguguugggacggggggagaaguccaaauugaacagaauuugcuuugaaguguucaaaagaggacgaaaaaacaaagcaaaacaaaacacccaaaagagcccagcucuucaauucuuuaggaacuuucacuagugccuggcucuaaggcuauaaaggcugucccagcuucugucauugcuucucuugggucuuagacaaacguauccauuaaauucaaauauucuucuggcagucaagaaaagaagcagguaauucaccccccuccagaucaguuccuuuauccucauucacacccuucccaggguaauuaaaaugcuuaggagggguaaagggaguggauggagcugaaagauaagccagaagauuuaaaaacccaaaugaaauuccugaggggugggaaggguggggggugggggugacaaccagggcggucugggggggggggggggaggggagggagggauagcugaagcacgggaauccagggaugaagagcucuuagacagaagggaaagaaagggggagccccggaggccaauugaauuaaugccaaugagugguggagaaggagguccauccaaccucucgcuuccuacccugcugugaaugggguagcuuaccagagucgcugcugguggugggcggugucuccucaugcagcacuaggggcucagggcuggcccguggggaggacucggaggacagcagcgaguccgaggaaggagagaaggccguggaaucggacgagguacaggauuugggcgagcugcugucguugagcggguagggaaagaccacugaggggucaaugcacucggacgcggcggcggugagguccugcagguacaggcuggagguggagcagacgcugugcccgcgggcggggcucaggcuggugcugucuuugcgcgcagccugguaggaggccagcuucuccgagaccagcuuggcagcggcugagaaaccgcuccacauacaguccuggaugaugauguucuugaugaaggucucgucgucaggaucgcagaugaagcucugguucaccaugucuccuccaaguaacucggucaucaucuccagcugaucggcgguggagaaguugccaccgccgccgucaucgucuucccuuggggagaaggacguagcgaccgcaacauaggauggagagcagagcccggagcggcggcucggggacaggggcggggugggaagcagcucgaauuucuuccagauauccucacugggcgcgggcggcugcagcucgcucugcuguugcuggugauagaaauucucuuccucgucgcagaugaaauagggcuguacggagucguagucgaggucauaguuccuguuggugaaguucacguugaggggcaucgucguggcugucugcuggagggggcacagcaagggaagcaagucuagaguuauccagcucugguuggugcggaaaccuggcgcagcgcguaccccaauccugaaccacuccccuuucagcgugcuguacuuccaagugugugugugugugugugugugugugugugugugugugugugugugguugggggggaggcaugcacucuuuuacucccuacuaucagugacgcucgucggacuagcagcugcuccgaguccccgccuccuucgagcagggacuuagcccugcagacgcccaggaaucgccaucggccuuggcuucagaggcugagggaggcgacuguagggaauacagucugcuaagagccgaggcgcaaaguuuugcgccaccugaaggagaaaggcgagaggcgccgcgucgcucggcccccucccgugugccggcucucugcgccgccgaccggguccgagucccuauucgcgccgucgccgcgcuccuacccagccggcgccgccgccccucuccgcccuccucuuucuccacccccagcgcgcccccuuccuuccuuugccggcuuuucuuuccgauugcugacuuggaggagagagcucagucuccggcuaucacaagccucucgaaauaaaaggggagggggugucaaauaauaagagacaccucccuucuacacucuaaaccgcgacgccacugcaccagagacccugcagcgauucagcacugggugcagggcgucuucccucuccccgccgaggguagcagcuguuacggaaccgcucagaucacgacucaccgcagucuuccuagcaauucaggggcgcgagggauacccgcggaucccaaguaggaaugugaggauucccucugguuucccccaagucaacgaaucggucacaucccugucccaauuuugcuucuccucacugcgcuagcccaacaucaaguccuagugccgcgggggucaggcuuaaauuuuacuacgaucacuauuuuuaaagccaaaauagcaacuucuuaaaaggcucagggacggguugcgaucgccgccggggauuggcgggcgggacgcaccuccgugucggucccaggcugucagaaaugcaccaagcugaaauuuaaaugcccucucagagacugguaagucagaagcuacggagccuucucgcucccaaacgcaaaagguaaucccuucuccaaagaccucaggauuccaagggcuuucuuuggccaccacgaagcgaccucccgguuugaccccucaaaggacacauaucaauuaauguagcaaagcaagaauguccaaccggccgggucagcgucagcccauaguaaccucgggaaccccgcuucaaaaugcaucccgguuuuucccuuccccuuuccucugucaucuugacaagucgcucuaccccgacucagaucuaccccagccuaccccaacuacucuugagaaaagugucaaaagcacaggaauggaagaaagacuguccuaaccggccgcuacauucaagacgcagaaagaacacagggaaagaccaccagaucugugcuuaccgggguuuccaacgcccaaaggaaauccagccuucaaacagcucgaggagcucuuuucaggagagcugaucgcgggcagaggcagagaacacuguccccaaauagacaaaaauucccuccccggagccuggggaguccuguccuggcucgcagauuguaaguuccagugagaagugucugcccgcugcaaugggcaaaguuucccagcggcggcgaggguugcggccgcugauguugggucagucgcaggguuggggagagugggcggcaggcucggaggcaaagccccucucacuccagagcugccuucuuaggucgccccggagcgcggcucugcacacacggcucuuccaaccguccgcucacucccucugucucucgcuggaauuacuacagcgagucagaaaaaaacgcccgaaaagcuucuuuuauacugcgacucaggaucccuccccucccuucuuuuucccgccaagcgucggcgaagcccugcccuucaggaggcaggaggggagcugagugaggcgagucggacccggcagcugagagcagcgcagcccagggguccucggccgcgcagacccccggaauauaaagggcgggugggcgggg

SEQ ID NO: 12221 - RNA, 14647 nt, Mus musculus
gaaggcggguugaugaugguugccaggagccuguuuggcgcgacucuugggaccagaggacuagugguugugucucaacucuucuuugggccgggucuaaggcuggacuuggaacggguucugcuccgccccaccggaaccuuugcaggcugccuggggccugaagcccuccguccacccaacccuagcacccgggccaucauccaucccuccaucacggccucaggcccuggugucagcuguccccgaauccuaacccccuuucagcgucccccacccccacgucuccgcuaguaccugguuacuauggugaagcuagcugccaaaugcauccuggcaggugagugcuauauguguuugaacgcgugguccccagagcccuagccguccuaacucgggcgguuuugguucaccaucgcguccacucucugucucccuuaggaauggcuguagugaccaacagcagauucuagaaggcgcgcggggcgggggaaugggcuccacaggacacuccccccaccccuagggcacauuuguagaugcagcugugucccggucucccucccauauuuugagacuaccuucaccagauagacuuaacaaacuugagcgaaguacaagcauggacuugucaggggucagcguugcuggucccacucacucugaugucaggaagaugggguggcgcaucugagagcauuaacuuagagauuccccggaaguaagauguuuauuauuguugacugucagggaaauagccugcacagugcccagaguguggaugaguauuauauagauauauacagagugaucugguggugcucacacucgugggcuugccuugagccagucugaacauucggaagccuauaugcuuagcuuguagucugguugacagcugagcacaugugucuaccgaggcgacacugcagccagugucauguggggguauuucauuuaacccuuuugccacagcgcccccagguagcuucugugaugugaccugaugugaccgaagcccugagugguguugccaugggugaacccccaguggaagucguacaccccauucccagauucgccugacuucugccugugggucaggaguguuggcuacuucuuauugugacaacuuacuggaccggaaguugggaguuuauugugcucacggguccagaggacugcccaucauggugaggaaggcaugguggcaagacugggaggcaggcuggccacguuaagucaacagucaggaaauggagcaugagccuuggcucucagcucucuuucucccuuuuauucagucaggggcuccagccuguagaguggugccacucaccuuugggggcgggccuucccgccuuaaucuaaacuagaacacuucuuacaggcauguccagaggcuugucucuuccgugauucuucuuuguaauccaaagauuagcaggggugucuuuugaucuuuauucuaccgaguaagaagggggggcagggaauggaggggaacgguacccgugaugacuuuucuaauuugaaaaugaaagcgucaugcauagacaugagugacagguugucacucagacccuagugcagcagaaggaagccaggcucugcagagaaucuguaguucucagggugccaggggaggcagugugguguaacaaaagcagccaguccuugcccagcucuguugcuuuggacaguguucagcuucugcauggguaaguuggggacauuuauuauuuuuuuuuaaaguuaaauuucguuuuaagugggcgguccugccugcuguucucuuccuuagcugguuagcucucgaggagcuccuguggugagccccucugcuuagacuugcuguaugcuggcccuugucacucccucacagucuucuggccaaaugcucaaagcuaccagccaguucucauguaagaugaggcaagcaaggcccagagcaaugaagacccugauccacaggcuacagcuucuggcuaacuaaaaaaccaccuccaggcucuuuucccuuaggaguauccagggaccaccagaccccaauggaaccacauucagauuccuaaucuccacaccucccuuaagugcacaugcgcacgcgcgcgagggcacacacacacacacccuuccucuuccccuggcuuuuucuuuucacuccuuguaggcucacauaaucaccgguccacacauauagucacucagcagauguuuauugagcaucuaauacauugagucaccaugcaagcugcagucgccccacgcccccaccaggaagagcccagaagugcaagugugugacucaugggcccuuuguguacuguaugagccuuugcugagugccucagacacagcugcggcuucuuuggcuugagaggcagagagagggagcaccauugacaggcaacuguguuucauuuauugaaccaacagccaggugcaccaacacggcacacacugguucauuaacucuggcaacauucuguaguggguccuucacaaaagcuguuggccuaacuuacagauguagcaaaguggccacagagcacugaggccuuaaguggcacagagagaaaggacaggauuuggagcuggauuagaaagaggauugcguguguguguguguguguguguguguguguguguguguguguguguguguguguguguguguguguugcggggggcugggggagguccaaggaagaaagagcaagcacgccuguccagacuuucuuuuucuuucuuuuuuucuuucuuucuuucuuuuuuuuugggggggggggguucgagacaggguuucaaaccaguauagcccuggcuguccuggaacucacuuuguagaccaggcuggccucgaacucagaaauccaccugccucugccucccgagugcugggauuaucuauaagggacagcuggggaccguuggaguggucaccuaggaguugauggaagagcuacggaugcaugcugugggagaaugagaggacucaccgccggucuguucuaugacugccucucuggugaggcugagcugggcgugggagucacagaaaguuaaagacagaaucaguuugugaccgugagagacuggagucagcccgaaggagcagagacaugcagcgguggugcagacccggaaggaagucacugagcuaggcacaggccucuggggaggggcgaugccuggcggggacagaacucagcucagucacacuagggcaauguuaccacgugccacacugccgccgccagaaccuguuucuucugguagaggacucagcacagccccagagccaagugcaagccaguccauuucuguguucaggacagacgugagucccgacaacuacgcucuacaucagugacugucacauagaggcacugggguuagucagguagagggaucaccaccuccagggccggacagagagaagcccaaagagggggcucccagcucuacagaugauguuugagcuccuggggcaaccuuggauuguggggcaagugcccaaaguguaggcuugagagagagcccagaaccagaaggacgggagaggagacagcaggauggggaggagguagugaccacauccccagcauccucggacagcgaggauaucggguccacggcggcaugaugagcagaaggagauagagaaaucacucaggucuguggugagacauggugguggcuguggccagucaaacuacagaaaagaguagaagcccccacaagggcugaaaacacagccagcugggaaggacccggccuagggcagcaaggaucaaggaaugagagaagccagggcuguggauguagcaggagcagagcccucuccucacaugcaugagccccaaacuaagaugagggggagggucugaggcagaagagccaagaucagagcauggaggacagaccccagcaguauacaccauuggaaaacugaagaggaugaacacguggggaggggggggcacagaggagcaggcaauggcgacagaauagagccuugcaggguccccacaacuacacgacggggguggguugggguguggacggcaguuggggauugcugcaggcuaccaccccaucuagagaguucacuaaugagagcccaggaguggccaccggacauggcaguuaauuacgaggucaugaguagccucccauggugccuucccaaggcagucuggucccccagccccugcugcagccccggggaaaccccccugcacccagcaaccacgugggcucagaggcucucgagguuuccccggcucccucagaugcccugcuucucagcugugcuguuuggcuuuccgcuugucauccuguugcuccuagaguguguuuaucaguuccuccgccucuccaugcucagaucccuccucgcagcccacacaggagucccgcugccagccuuggugacuggcagucagcagaaagauucacgaaauuaaccaaagccaaucuguggggaaucucccagggggagaaaaagccaauucccucccggguuuaggaacagaaugggugucaggaugguggugacuugacucccauucuggagugaggggguuacggaggcaagcguggagaaggagaugcugggccauaugccccggggcaagugagaccugcagacccugagaggucauagugaaaagagcccgaaggugguauuugggguagucagccagaccagccuggugaaacaagacaguauuaaaaucucagauaaguucccuagcuucugugagccuggcuggcuucaccugugaccucagugguggucacagcacaggagggacagacugagagugaagggcuugugaggagagcguggcccacugcuguucccuucuaagaagcaccagcaggaaaccaagccccucguggcucacugggcccucaaagagauaaggagacaccauaauugucucauaugggaagauugcagugggaaaagacugcagagugccagucuggagaggucaggcagagggaaccgcugggaagcaaacagaagacagcguuguuccaaacgcugggaaucaagaaacacagaaugggugguggcagcaacaguggugaugguggugguggucauuguggccauggucacgccccugagggucaggaacucgagaaagaaagccgguguccugaaacaccugggcgauggagugagaaucggcauacugcucucaaggccagaaagaugcccgaauauguaaagcaaccagguaagcagaggucaggugggacagaggagagagcaaggcacccugagcuguccccaugaccacccggaugaacucuguaugaaaccacucccuccuauuguggaaaagacccaaaucugaucugggccugaaaacugacaggaaacuuuguuucgggggguggggggugggggucguccuccuggaacuguuuauugaacaaagagagggaagggcccagggaggcaaagaggccauuggagaugacugaagaugugugugugugugugugugugcgugugugugugugugugugcgcgcgcgcgccuaagucuggcagcucccuguucaccuggcaggucaagauggaguccaucacuugaaaaugaaauuucucacagugugugcaaccucuugacuuccucacugccugugcagaugagagaucaggcaguggcucagccagguggggucacagguuguugcucaccccuuuugcaggccagacucuagagugaauuggaguuuaaaagugacagguuuccccacaggaugugcuuuuguggaagaguguaacuucuguugccagggcuccgaagcccuccuucaccccuguuaccgcuaccuucuaggucauucuucuaguugacagggcuaugggguuuauagaaacauacucaggccuggauaagcuuuaaagacggaucucccggaccaguugcccuacuggcgaccccucugcuucccacgagagcugcagacauuugcucugaaaacucagcgaaguuucugauuucgaggcaagcacucuagagcaggaggaggguucucaugccucgugggauccaagcaaugacuuuuccucugcucuggccccaggggacccagccguaggcaagacggcccuggugcagauguuccgcagcgacgggacccauuuccagaagaacuacacccuggugaguuggaguccccaccuggccacuacugucaugaaacguggcaguuaaccaugagagugugacuuggcaagaucccuagacuaugcccuaaggggccugagaagagauggggaaacggccacauggagauccagucuccauuggccacuaguaagggaccaaccaggauagcacaggguugccaggaacaguggagggcagggacuuguaaccgcaauuggcuacuuuauuggauucuuuucccuaccgcccuucuccacccuuagcccccaacauuaaacaggagagaagaagguugggagagaaagggugagucccuaucauuagaaacuacuuccuggugauuaggggcaucaaguuccuuggagaaagaccuuucucaggacauuagagagcaggaacagagggagcagcagccuccucucucagacuaugguauuuuucuacccucugaauaguccccagaauuccaaagguaaacuaucuucagcuggcaaagucgcgcccccaccagagcacgaggcaaaucacagucagcugcugaggacagacugaagcagucccacaucucccaccugggauuaaaacaacaacaaaaauaugaacguaacauaucucuuuucuuaaaccaaaacucucacuaaagagauugggaaguccugacggccucugacuucugcuuggcugggaacaccuccuucaaggaaguggggacuuggcucauucugauugccccaguguggggcccccuaaggccugugaucuugguguccccugcagacaacuggaguggauuugguggugaagacagugccaguucuugacacaaaugacaguguggugagugcuacccuggcccugaagucacuuggggcugcuccugugagcugggguucccucacuccaaggguaauagaaucguggaacaaggacacggggaaccuucgagggagggccuaggguaccggggaggggauugggaugccaggccucaccaaaaggaacuuguuaucuuuuaucugaguucuuaaccgggucccuccaaagacucucaccgcucuugggggagacuggugcagcaucgugucauguuuguuuggccucucccaggcugcauucaucggauguguaaggagacaucugagcaaaaagaaaggcacagaaguccccccccacaggaaaggcugagacaggaaccacacuguacagggccaguccguggagcaggcagugcugcccuucagggucuagagccaggcaggagguugggcaccaggauggggcucagggaccucugaggggguuucaagcaagcagcagcaucugggagggucuccacccgggcugggaaggcucggaacucuguguacagagcccguguucacugccucagagcagugacaggcuguccuacuuuaagcgccuuccccaggccuccucagcgaccuccuuuaccaagaauuguuagacgcucugagaguccauuugguuaacaaaguacagaguggccuuuuggacaccaggacccuugccagccugcuuagcauucugucuugccaggugggcagucagccuccucccccucccccccaccccccgcgcgcgauuuuugugcuugggguuggacaaggugagccaccugccacccaggucacaccagguggacagaagccuauaccucugccucucggacacuccggucuguucucgccaucucucuggggcaucggagacgguagcgcacgugugaaggcagccacgcgcaugggcaugcucacucgcucuccacgcaaaccuuguguaugggaagcugagugggacagcucggcccaacucucccugcacucucuucugacacgagcuuuucuggucccaggaacucuucauuuuugacucagccggcaaggagcuguucucugaaaugcuggauaaguuggcaaguagugugcugauuuuuuuuucuuuuccuucacuacccacuuccgcccaaccccuugucccuguggggcuccuggugggaugccccaggagcaucagaagugaccaggcaggaucuucuaaggggcaucccugcuacugggucuuugagccacauggcaaauauagauguuccuccuuacccauccaucauggucagccccagcuccagaaugugccaggagcuacgaagcuggucaguccuuguagcugcccaaugccccccccccagccugcuguuuuuaauagcccuuccugagcguuuuucaacccuccccagucagcauccucucugagcuguuugcuucggcuacaaagugagacucucccagacaaccuuacugacuggggcaucucagugauugacaggcagcuccugaugagcggugccugccucugccagccacugccaucuucugaguagggauucccccaacccagguucaaguuccucuuucccuugcuugucccucaugagugccacugcaccuggcaucccuucaucuguggugaccuguggccaucugugggugggacaguuucucagcucacaccccucucuuacccaccuccccccgaagcccauuuuucucccccuccccaccccuguccccauccaagagucccugucacaucccuaaagcaggcuucuccugucucucgcuuagugggagaaucccaacguccugugccuugucuaugaugugaccaaugaacaguccuucaucagcugcaccaagugguuggagaagguccggucucagacuucaggcaucucccucccagguaucaaacuguagaugggccuuucuccaacucugacuccguccuucaacucaagggucucaucaggucacugugcaagccaugguggaaauagaacaggagccugaaucccugacucucugaccucagcguccuugcucagccucuaaauguucucgaaaaccuaccgagcauggggguggggagacaaugccacccaccaggcagagcugggcgggcugagauaaaaagaagggaaggcgcuguguuccgaauggauguuuccagaaagcuaacuccagggaagaaucccucaucucccccucuacacuggguacaaguuacauuccaucccgguugucacuccugcacgcuuuaaaucagguucuuucucaucccugugugagaucaacaaauucuccucauuagaggccagggaaagcggccuccagagacggacugagaaauuagcacagccaaggcagcugggaacggagcucaauuaccugagucccugagucugagcccaggcccgagauuagcauuaaugaccacguccgauguuggcuccaugagcugagaauuagcacaaaugcucuucuaaaccugauccaggccugccuggugcuuccagcccuaaggaggugaggaauauagauauauuuuugaagccacgugugacggcgcugagcugagcugccugugcacagcaaaaccagucugucuucuguggccuugggggaccuucccugcuggcacauauucccucaagugggcagcuucugucacuugaugugucacacgccccucucucugccgccacccugccaccucaaaaccuaauauugugguuauuucuuuugagcagguguuuuagugggaacuaagacagaccuggcuggccgacaaacaguggauucagcucaggcccagguaugggcacugagucaaggccuggaauucuuugagacaucuguggugaguucccccaacccucugagccacugggaugggggccccagugcuagagguuugaucgugaccugggacgcaucaagugguucugccaccagaugcaaaaucuaaauuagaaccgaugcucacauucugcccagggacucugcucagugugugucaggagagucuucuguauggcacacugugaagcagggcagacagccuacccugggcagagccgugugcaucucucuuggaaagacuuugaaguauggggagagggaggggguugcaagggccauuccauuuuccugacccuuggacuccgagagcugcagaaggccaugcaugucugugagacaggaauuggccccccaguuccaaauucagcauuaaaguuaaaaaaaaaaugaguagccccaggcccacaugacagggugcacccagccccgggauccccgcccccaccuucucucauaccagaggagcaucuagugucauuuuuugauagagucgucuugcagugggagacuccagaugaugggcagcugccaucagaguuguguagcacagugaaaugccuucugacaucuggaaccuucaaaguuguggcuuccggccacaugauucugaucacaccagucagaucccugcccugugucguccgucccgucccccgucccccccgccccaccacaggcaugaggguggccuagacaccacuagucucauaagcagccacagaccucacgcaggaaguugccagagaguccuguuaggccugcaguggcuaugucguauggggucucacuuuagggucucuagacccaacuacauggcuuuccaaaaaucgucagcaagagaagcgcauacccugggugucaccuccuccaacuguaggcucugucaugccuacgaagcagccugagccagcacucuguugcuguguggaugugggcaucuauagugucucucacuggcacacuuccccagacaaggcaucagcuuccagggcaaguguucugccuuccgagggcaagaagcugaacugccucugggacccugggcuugggaugugugcuguggggccucaggcucuucaccuguagauacagggcuaggaagcugcccuuagggcucaucacgcacaggaaugaaaaacgccuagcacaaagucuagugccccauaaacacucaccaugcuaguguuuuagacaacgaucccuuucuacaggguuuuuaacuguuacuccuuacuaaaccccagggccagcggcugguacagagguggacgucaccccugucucgaguccgauuaucacaaugcuggauuaguucaacugagauagcuccuacuacccagggcacccuguugagccaagccacacaccuuugagcaagcagcaagccuacagcucuagcaguagcuccccguccccucccuccucugccuucuucugucacauccccccuccuccgacgccccauauuuccuagaaauuaaaacccaccccaacccaucaucagucagccacccaaagcuaccggucagcuuccggcucaggugucgggaaggaugcgcauaaauucugcuugaagaggcugugguugagugcuccguauuaacugugcgaguuaacuagucccccuugaguugcugcuaacaggggcaccacuggcggcucgguuaagaaagccguaauuaaaaagggaacauaacccaacgugguuugagaugcugccaagccugcccauccccuccucccuucuuccagugugcagcugccucggagagacaccuccgugguccuuccaguguacagcugccucggagagagaccuccgugguccuuugguucucagacaccuccaggccccaccccacccccacaacagucaaaaaggauuccuuugaacaaaguuuaaaggguuuucaaaacccaaaucaaaauccacgauuucccccacugagaugggaugucauauaaaguacaagagcagggccaagcccuccucuuggugaggaggcgcgcccuccccaggcagccgagggccuaccgcuugauugguguugcaaagauuaaguuuccaaccucauagcaacccgacaaggcagcuguuccugucucuguuguucaauuagcagacggacucagagaggccacacgucucucucuaguugcacagcuaaggagaaguaaaaccaagaccagagugcagcccuguccaccuggaaagucaggucuuccaagaguucgaacccuugaccccugagcggaccugcucgggagcucucggcgacagaauucuaggucaaaucaagagcuagucugagccuccuccagacaucaucucccaaacagccugcuccaucaguguccaaacugugcacaagaugauaauuagucaucggauaaaagggcuucugucgcuggcgggcccccuuaaugcguuuggaaaaugguucaauuuccaucuauuuccaggcucuccacggugucugucggggcuccugggcauugaauuccuuacguuuuuaugauggguucucccaguuauugcuuuggagagcuuucaacuccugucuaaaaacccucccacagggucucaccaccucccuucccuccacuuggugcucgaggagggagggaagcuguucagugacacugacuggccuggacaugaugccacacaagcagaagagagagacucgagugcccguguggaaccucacacaggcagucacugggcacugcacccugcucagugacucccugaccugcacuuccuucuuccuggcugugggguccagacagcuuucucccccaggcaggccuggugcacuucuguccuuuuuacggccacaucauuaaacaguccccugcccgggaucaggguccaguguccagcugggccacuccacccucuugguuucauccacuccuccauaaaaguguggccacacugacuucugggauauuccucccguuccaucagggacacuucaaugccucuuauccgggcugcgccuuugccagccgcugaaaagcuuucagccaggcccuuguaggcucuuagcugcagcuccugugugguaguagguucugccugccacuuuguucauuaaaacgccaggccuuaugaugguguguaccuguaauccuaccacuugggaggccgaggugggaagguuaagaauucgaggcgagucuggacugcauagcaagaaccuaucuuagaaugaugguggugguggugguggugauaaugauggugaugacuaugucaugaugaagugugguggugguggugaugaugauggcaguuagggacgugccucaggugguaaaaugcuuggguaacaugcagaguacucuugcguguggucaccagcacugugguacauaccuguaaucccagaauuccagagguagaggcaggaggauuagaaauccagucagccuugacuauagugaguuccaagccagccugaguuacacgaguccuuaucucaugaaacaaaugaaaaagcagucugggagaugggcuccuguguugggucacguggcauugcaacauuaggcuugauuuuugaaaaacuuggggaaugggaacacagagaaaacagacacccacauuucaggugagcaguggccacagugucagggggaagcugugugugcgcaggcccccucucuccccacagccccauaugaccucaaccuggaggccacaccauugacuccucuuagaugcagccuaaggcaagcuccugaauuuucccgaucaucuggccaguaaaaguguccucugggcaccuuuggccacuccagcuccgucagugucaccccaggggucagggaugaggaaaccuaucaggccaccagcagacagccagcucugcaccuucuaaggugccuucaccacuccccgcucccgugggaggagccacgcauucuugcugggauccggcaccaucccggaagucucaguuuauuccuuugaaauaagccucuuuacacucggcccuaccggggccagccaccccaccggccuuccuggucucuggaaugaguagaaggacacuccugcagccuggcaucauugaguaggggcugggugugcugcaccucuccuggcugggcuggggccagacuuucuccuauaacacaucugucugcuguucugcaucggccuuugguccucugucggggcuaaguaaggggacucaucuucacguccuccacacagaacccuaguggccacaaggaugguucuacagguagacuucagcccuggcuccacccaucacacaucauauagcuggcagccuguccuaucuaucucucaguuucccuauaaaagcuacaccgugacagcagcugcccaaacugcgugaagaugcuccgacaccaagugucaggggcccgaagggagggaagccucuagcaugugcccacuuccccggacuaaacucucacgcccccucucacgucuuacagaaggagauggauaauuacgaggccccguuccacugucuggccaagcaguucuaccagcuguaccgggaaaaaguggacauauuccauacccuggugugaggguacaguggacuguccugaagggcugcccacucugccgcugcugcugugagcccagcagaccauugucuuuucaggagacagaagacgggaucaccugggauuucucaguauccaccaugguuuucaauaaaaugagaagagcaac

SEQ ID NO: 12222 - RNA, 11400 nt, Mus musculus
gggcucgagagcggccaaggaccgccaccgcgacagccgcgacaagcacgcacugagcgccgggccuggcggagagcgguaaggacgcgucagggacggggaccgagcuccagaagugugagcuccggguccugccugggcggcgcgugguccuccugccccuucggcgcccccuuaacaucagcucccggaggggccuccgaggggcuggcugggaggcggugcgcgggccccggaggaagccggggcgggggcgggggcggggcgugcacguacgugacucggugagaacagucccuggagccgcgcccagcaccuugugugcgcgguuuguuuacgucucccgguggcgugcgugcggcuguguucuuuggggagcguccugaguucugcgggcugcgugcacacgguguacuucgggguguguguuuguguguguggccgcacgcgcuccuuggagacugacacuagcccaguguaucuugaagugggugcgcaccaguguccacuggagcaaaugcggaauaaggacccgagcgaaggaaguggcccgaucgguggucacaccaggucuggaauuuuucucccgccccuuccacccuccgucauccucccccuuuccaccagccgggacugcccggucccuguugucucuggaguuuccccuggcuggagccaugugacaucaguguuuguuccucgcccagcgcgggugccugcagcuuagaauagagcagagguuagcgagccagucuucuccuggccaccugguggaucugggaaccuaguacaugggaguccuuccuuagccccaaguuuuccggcucaguauggacuguccaccccuggauugucccauucuuccagucucaggagaaacaggcaaggccagaaaguuugugacagauuggagaacacaaggcucccggacuauucuguuggcgacugugguuggucugggugucugaggcugcaccugcuggguccaggaggauggcaugaggcccacugucacacuccucagguuggacuccuuagacuggaccucuguguagaccgaucgguggucacaccaggucuggaauuuuucucccgccccuuccacccuccgucauccucccccuuuccacccuggaccccagggcuacuuaaauacugggccagcuggcacaccuggagucuacccaugcccagcaagaucagcagccagugcuaaccccugaucuuccugagggaaggguuaaugugggagaggagcgcugccugagaacaccuguucugggaacccccgugaucccacucaagacuuucccucuuacccccucccccacccgagggugcuggaguccgaggagguggcaacugaacuaguuaggggguggaaucagugauauuuuaacuuugagcccagugaguucugcuaccacugugaggauuccaggguccccaucugcaguaugauggcaggagagcucugcaagacgcucuggaagcugagaugcacagccuguuuuccaggggaaacagggaaagcagaggccaucccaaggaccggggcuggauagaauuggggguuagggguuugcagccaggcccacaggaaucauguggguccauccucaaaccucaucaggaaacaucucccaguaaagcugggggaucagaggugaggggacguggcuaacuggcucacugacagauggaaacuuagcauugaaagaugguuuucccuugagucuccaggggacacuuuuuuuguuuaacaagcauuuugucugcauguauauguuugcacuggguguguaccuggugccagcagaggucagaagaggguuuugggucccuuggaauuguaguuaccagucaugugguugcugggaaccaaaucugggucuucucuguaggaguguucuuaaccacugagccgucucuucaccuuauuuauuuuggaaaggaggacaaauuuauuugagcucauggugugaggggguauaugcucaccguggcaggaagcgugguggucagaccaguuugucuguggcuguggugguacggggcugcuggcccccaucucagugccccuggaagcugcugggccagauguuggggugaggcugauaggcagaugcagagauugccuucuaggaaacaaaguaaaagaaccaaagaaguagauacaguguagcagcugagauaggcgggaugaugcagaaagccaaguuugcuuaaguagcaacagggcuucuacuuagcuggccucaaucauggaagguuucgccgggggauguggcuagcaacuuggugacugauggugacucuggaacccggaggacaagggcuguauuuccucuuuggaccuucaaggcgcagcacaggaccuggcagacaguaggugcucccugcaucuguggcuaguugaagaaaugagcaaugggucuagguccuugaggucugugacacagguagaaagaggaccucggguccagggaagcagaaagcaagacugugggcuauugggggcuugaaccccgcccccaaugagcagguccuguagaguacaggggaguuccuucuucacacacacagagcccuuuugaccaauagucaauagaaaauccugucugcucauuuguugguuauuaggggaaaagaugcuaugagaauggagggaacauguuagcagccagaggcgccucugugcucuggggcagcugguagcuugagcucugugguuuugauuuuguuuguuuuuguuuuuucuucccccaaagguucuuuaaaacucauuuucugccgggcaugguggcgcacgccuuuaaucccagcacuugggaggcagaggcagaggcagguggauuucugaguucaaggccagccagggcuauacagagaaacccugucucgaaaaaccaacaacaacaaaaaaacccucacuuucuacguagauguuugcgccuuagugaauguaugcguaccaugagugcaggugccuguggaggccagagggugucaggucccugaaacuguagccgcaggcaggcaugauccccuugaaaugguaccgaggacagaauguagcucaucugcacaggcagcaaguguccuuugaccacuaagcgaucgauuuagcccgaucuuuguuuuuauuuuuuauuuauuuauuuugauauaaggucuuauguagccgagcuggcuuugaacuucugguguucauaccucugccuccuaagggccuugaucauggcauacgucgagaccacacucaaguugcccaaggucucaaaacaugccaaagucaaguuuguagguuugugucucuagugacuccuuugacgcuauuggagguaguggcggaggagggggaagcaauggugaggccacuguggucuuggucuggcugguaagaggaaguggcccuuagcugugcagguggaggagaaaggaggucagggcucauagacuggcugcuugugcucucaugcuucugccuccaggaggcccucccugguuuccuuuccuuuccucccaugccuccaaccugcuagcagcauuggauggagcucuaugcugggccagacucuaacacuguaaacucagacauugccauugcugggugguaccuuaggcucaggggagguugggcauguugggaaauccaggcccagagaaccaggagcugacaaccugaaagucacacgcugaguguguggguagcugaauggggcuggaacccaaggccgcugcuucccugcgugcugcuccucucucagccuugccccuucccgcagggaggaggcgccccggccgcacuggcugccaagacccaggcaaacacauuuuuuccccucuguccucagccagagaggagcccaugccagugggugggccgucugcaggaugucucggguguacagcaaggggccagagacagagacaggaaggccauggcccucggcggcggggcagccgucaucucccugagaaugagcucacaacugggucuccaaagaacacuaggaaccucagaccuggaguuggcccugcuggcuuccccaggaagaagaggagccuugagggcggggccccccgggucaggcagacugguggcagcgggcuguccuugccuuguguccuggaaaacuggggccugcugcuggaagccaaaagccaaaggugaugggaaaaucccccuucucauguugggacguucccucugagacugacugacugcugagcuaggacauuccugggcaaaugcgggccuccauggcuggcuaggaugcuacugaggagccugacacuagaacagggguggggggugggggugggggguggugggacagaggagggugggcagguccccagccuuccuagggccaagcacucauugucucuaaagagcauggcugugguuccaucucuuggaggccgggagcugaggaggaggacaggggacuggcuguguagagagggaguucaaggccuugagaagaaaacagggagguuuugaaagacuggggcuguuucaacucacuggaaacaggugacugguuagaacugucuggcccagccacccaagcccgacucugacuugaccuaagacuuuuuauacacuaaggcauuuuacacacugacuucauucuacaagcgggggugggggugggguggggaaccaggcucaggaaggacaggugacuggugaggagccaggcuaggcugccaagguucuggaacaggcacuguacuccaguacuccgcacccaguagguccuuaguuaaccucugcgggagagacccccuucuuccaccaagugucuugacgaagcaguuauccauacccccacccccacccagcuccacccaacccgcaaggaggccuggacgugcguuguccuuugcauguccugucccuaaccagccuaacccaggucaggcagcacaggcaaaguggcuuccucuacauagaggugaggagacagggugcagagaaggggcuguacagaaggguguacugugaggagcugucuggcucaguggaguuucaguccugggcucugcccuguguggcuguguccccucggucacccucucugggcacauuacuuggcaguguuaucagaaagacuaugaagaugaugguaggucaagaguuaguccugaagccagacagugguagccgcaugccuuuaauuccagcacuugggaggcagagguaguuggaucucugaguucaaggccagccuggucuacagaguucuaagacagccagggcuacacauugucuugagaagggacacacccaaccaguccugagauuuuuccugguguuaggauucuaccccauugcagauagguggcuauguggcuucuagcaaguaaugucccucucugggucacuaccuagggccuuuccuacaugcaguucugcaggugacccuugcuggcuaugcugguucccagagcuggcugcagcccugacagcuggucaggcuuagcaguuuuacuaaguucccagcuguuucuugucccuuuauuuauaugacaaguucucacuaaaacuguagaagaaacugucccauucuacagaugggauaguagagacccaucuacuaucuacuagagagagaagcucuccccagauugcacagccuggagaauacacagacaggacucugggcuugccuuccaaccugugccccuuucccuguuuccuacacccugauccgggccaaaggucacauggguggggucccggugcuugcuccaguucuccuggcacaugugacaucugcaggggcagaugguaaggaggaugaggaagcugccuagcaaguuagacucacaccuugcuucccuaagcuggucuuggaacucagcugagacacugacaagcugggugaccaugacagagacuccaaccaacccccaccgccccaucccuguucaccugcucccugucacuguugggcccuggcugggcaaccucaaacacccaaggcugacucaauugugugguguagggacagcagggaaauggauggugacaccacugagggagaaaggcugaagcaagaagggcuaggggacaguggucaccuagcaaacuuccuacccuggggacagagggugagcaggaaccugguggaccaacuggggaaaagcggagagguaucagaggauggcaguggucuggaggggagaaggcaagagugagagaugaagcgaaagagauucccagaggcagcaggcagaauggagggaggcaggcuaguggggccaguaggguagggcugggcacagggccugccuggagcccgggauggaugccuggacucugucuucuggcuaguagggauccauggggcccgcaggaagugucuaugugggcauugucaugucagauuuucuugguggacaggcaccacccucacccagcuccccaguguguggcucaggcaggggacuguuuaaagagaggccacugcaggcacagugacccacaccuguauccucagaugacugaggcaggaugaucagaaguucuaggcacuccuguaaagucaaguggacuccuucacccagaaucagcaccggaacccacaccugcccaagucccaaguucuucaagcuacauccaucaugagagacacaauggcuuuuuguucuguagagauggagucuugcuguauagcccagucuggccuugaacuugguauguagccaagggugaacuaaaaugcuucagccuccccaacccugggauuacaggguaugugggaggucaugcuggccugguggcucuuguuuagucuuugacuuguuuugauuguuugagauguaaagauggucucauggagcccaggcuggcuuugaauucacgaucucuaugaugauuggaaccuuugacccuucugaguguugggaucacugcuuugagccucaacucuccagcgggccccaaaaaacccugcuagcccuggggccacaguagccguuucggucaaaacugucuugaauggccaacuucccuuuccugcccagcuccuuccugcugacugagcugcuagaccccugaccugguaggaguucuuccucagaagccccagacgguccccaccuuggccugagucacacugagagucccacaguugucacaugagcaucuucucuagacagacacucuucucagcccuggggaaaccauagaggacucagcaagguuccugcaguugaagaggggacauccucacagggcagacagacacauggugcugcaugcaugugguaaagacucagugugugucagcacacagggugcaaguguguauggaggccagagguuggcucuugcaguccaugacugcuuguggucuuauauggguuagcuuggucuggggaaucuauuuuuuuaauuaauuaauuuauuuuuuauauauaugacgaguacccuguagcugucuucagauaccagaagaaggcgucagaucccauuacagaugguuuugagccaccaugugguugcugggaauugaacucaggaucucuggaagagcagucagugcucuuaaccgcugagcuaucuccccagcccgggaaucuauuuuuuaccccugucuggaauuacaaguggacaccacacauacccuguauuuauauagguuuugggggauccaaacucaggguuucccacuugcucuuuuaaauguacuuauuuauguauaggaguacacuguacuguaaagaugguugugagccaucaugugguugacccccgcucgcucuggccccacucgcucuagcccaaagauuuauuuauuauuauauguaaguacgcuguagcuaucuucagacacaccagaagagggcaucagaucauauuacagaugguugugagcuaccaugugguugcugggauuugaacucaggaccuucggaacagcagucagugcucuuaaccucugagccaucucuccagcccuuugaauauuuauuuguaugaguauuuugucugcauacaugucugugcauuguguguucuaucucuagugcagaaaaaaaaggaaaaugauuggagagauaacccaggcuggccucgaaguugcuaugaggccaacaguagccuuuaaguccuucuuggcccucuaccuccagggugcgggauacaggugugcaccacaccagcuucccuccaugaguuucuauccacuugucuccccagucccuguccauggcaaacuacagcuauucagaaaauggccacuaaaggaaugugaggcuccgaggcucauggggaaggcucuaggaccaaugggcuggcuuuaggcuaggggauagcugcuguucccucuagagcagguguucuuagccuaugggucuuguccccuuuggcgguuggaugacccuuucacaggggucaccuaucagguauccugcauaucaaauauuuauacuacaauucauuaacaguaacaaaauuacaguuaggaaguagcaaugaaaauaauuguaugguugggagucaccacacuaugaggaacuguuaacagguggcagcuuuagaaagguugcaagccacgcucuaggaccaugcugagcagugaugggcagacccagggagucugggacucccagaggcaggaggauagugaguuuaaguucagccuggauuacaugguaagaccaugucuuuaagacaaagaaggcaggugagauggcucuguggguaaaaggggcuugcagccaagcccaagggucugagauggauuccuuagaacccacagguggaaacugacuccugcauauuauccucugagcgccacacaacugucacagcgcuggugugccugacuaacgcacacauaaauguaaaaagaaguugaaacaaacccaaaaguugcaugcauacccuggccccaugugggaaaggagaguggaaggagaguucacauuuguugaguaccuaguguauacaggcacugacugaccuugguguggagaggcugcagugaaacgggaacuucgguggagaaggggauggggagggacagaccauccauuaggacaccucugaaaagguggcacugggcaaagaccuagauaaugagccauuauggggaacuggggcaauacagggagagcaagagcgaaggcuggaucguuggggucagcggagguugcuaucaauucugagauagaagccuugaaugccagguccggagauuggauuuuacucauguaaguaaaacaugaacacaccaaccaaggugacccugaacuucuuucucucccaggucuccagcccagaggucaucuucugcgaaaauggcuguggaucccuuaucuagcaaagcccugaaggugaggcugcuagcuccuuguagucucucucugcugcugcuccugguagagcaccgacaucccaauuccccuuuccuuccuggaagccccaaaggcgacucagcagcagaggcagguuacuuccuguugagcgcgcuucccccauugcaaggggcuuuccaggcuggguuucucagcuggguccaggacuugacgcgugguuaguuugagccuugggugaccuccuguaggcugaugcugguccugcuaacuuucaaggucuuggcucaaguccaguaaccgccgaaacggggagagugggggcgcaaugagaaggggggcgccaugggaaguggggcggcauccucaagcacgggccccgugccucuguuuccccauggcccucaggucaagcgcgaguugagcgagaacacgccgcaccugucggaugaagcgcugauggggcugucggugcgcgagcugaaccgcaaccugcgcgggcugucggcggaggaggugacgcggcugaagcagcggcgccgcacacucaagaaccgcggcuacgcggccagcugccgcgugaagcgcgugugccagaaggaggagcugcagaagcagaaguccgagcuggagcgcgagguggacaagcuggcgcgcgagaacgccgccaugcgccuggagcucgacgcgcugcgcggcaagugugaagcgcugcagggcuucgcgcgcuccguggccgccgcccgcgggcccgccgcacugguggcgcccgccagcgucaucaccaucgucaagucggcgccgggcccagccccugcugcugaccccgcccccugcuccuaguacccgcccccaccccaccacaccccucggaggccacucccuucuucaagugccugaguuccuucugcuucccauuccuuuccucugccacucguuguagugacuucacauuccuuuccugggcucugacucuugcaggcccccaaacugggaccugauggcccuggggaggggcaacuuugcuaaguuggggguggggggaggcguuaggguucuaaguuucccugggcugaaaguccggcucaaauugaaaaugaggucguguggccagaaggagagcugguggaagaggcuuuggauugugccagcaugcccuuccgacccucccaggacccaggacuagguguggccuugugagacuguccugcugggaagcagaccucccaacugugcuugagacuugggaaugccaggcuuucccaagcuaagagucuuuggaacggaucaauggagcucaguugacacauggggaagcugucaggcaaaacgaccuaaggccacugagcacggaauuguugagcugcaaacccaaguggggccuucuuacagcugccuuaaugaacauuccaagcguggcuuucacagggggaacaguaccccgggacugaauaacaugguaggagagccucccgggccugggagacagcugugugguggggaaagaagcugaaggagagagaaggugacacaaaggguugaggugaggagcuggccagccagagaaagauggauggagacgaccacugguagagagaggcaaacacuacaguccugaugcaggagaaugggguggguguggggugaccuggaguuacggcuuccacuuugguccagaguaucugugguggucugagggugcugaucacugucccccugggaaguccagcccuagcaccuucccaacacuguauacagcugacucuuccacacucuuauuuauugcacgaaucuaaguuauucucaccagccagaguccagcuccucuucccugggaaauacgugggcccugagcuggacuuauauuuuauaucuacaaauaaaucacauuuaaucuuauauuuagggagagcuggguggcaacaauagguuuuuuuuuuaaaaaaaaaaaaaaauuugcgcagcucccagaguuuauuuauuuucugacuucaagugagccaguuaucugccuugaguauuuuguagacuuucugaauaaagucaaguucucuuuuuccacaa

SEQ ID NO: 12223 - RNA, 3534 nt, Mus musculus
cgcagggcgggugagagcgccgugaaagccgcggaacgccgugcaccuccgcgacucuacuacggcaagcuaguccggacgggucgucguccccgcgcgccaccagcccuuggugaaacgacagggagcguccggcuuccccagcaccgcccugcgagacucaaaacagccacaccgcaaagcgagccucgggcggaaggaggcggagcuucaggcggccccgccuccgcggaaggauacacaucuccgugguccaaaaccccggggcgaggcggccggggcgugugagcugcucggccagcugccgucuacgcgcuuucgcgcggccaccgggcaacugcgccgcgcggcugccccgcugagcgcucggccucggggccgugggauccgccgcgcugucugcggucaggaagaccgcccucccgcguccuugccggacgggucagaggcggcaccgcacgcgaggccacccgcgaugcugcuguccaaguucggcucccuggcgcaccucugcgggccuggcggcguggaccaccucccagugaagauccuacagccagguauguguggggaccagggagggggccugggcgggggccgggggguggcuuugggucaucaucaacccgauuguuugucccacagccaaggcugacaaggagagcuucgagaagguguaccaggugggcgccgugcugggcagcggcggcuucggcacggucuacgcgggcagccgcaucgccgacggacucccggugagucguggcuccgggcgcacccgcguggacgaucgccacgcucggccgcccgucugaccgcucgcgugucgcccccucuuuuccccgcagguggcugugaagcacguggugaaggagcgggugaccgaguggggcagucucguaaguaugcgggugcggggcgugcgggugcggggcaugcggguguggguugccuuggcuuuguccgaugaccgccuugucccccagggcggaguggccgugccccuggagguggugcugcugcgcaaggugggcgcggcgggcggcgcgcgcggcgucauccgcuugcuggacugguucgagcggcccgacggcuucuuguuggugcuggagcgacccgagccggcacaggaccucuucgacuucaucacugaacgaggcgcccuggacgagccgcuggcgcgucgcuucuucgcgcaggugcuugccgcugugcggcacugccacaauuguggggucgugcaccgcgacaucaaggacgagaaccugcugguggaccugcgcucgggagagcugaagcucaucgacuucggcucgggcgcggugcucaaggacacggucuacacugacuuugauggugagcagguggugcggcguuccggcgacuguuaggcggccacgcgccacgccuggcuuacgggaggggugggggggacuggggacaccgggguagcccucugcggugugagggcgcagggucuggggacgguggguggcagccagggagacccgcgauacgcgcgugacgcagggcccccgccagccgccucggcgccguggccccucccugugccggggagggcgcucgcgggccucccuugcgugcgugcgugcgugcggagcgcgggggcgccgcaguagaaauccccgcauugcggagcgcggggaagccggggcucccccacuccucuccucccuccucccaucucucccgccccuccucuuucuaagcuccucuccuccccuuuccgagccuugcagagcugagcaaggcgagccggggcgggaggagcuagaacaccaggccugguucccaguggcuuacguuguaucuguuuguugugaaacuggagccggagcucaugugacgcgcuccugccuuggggccuguuaggggugggccuucaccuccccuucacuccuguuccuccccugcccuccaugucccuccuuuccugagucccgccugcagcuguguugggguuuuuccagggugaugacaagcaagauucucagaggccccauggaggcuggcugagagcuaaugaaggcccguuguucaguguguucaccccccaguguguauauauccugauguguaccuaaucccgauucuucccucaggcacccguguguacagccccccagaguggauccgauaucaccgauaucacgggcggucugccacuguguggucucuggguguacugcucuacgacaugguguguggggacauucccuuugagcaggaugaggagaucuugcgcggcaggcucuuuuuccggaggagggucuccccagguguguuguagaagcuggcuggggccguguugggggcagggcaguguugcagcaggacucugacccccuguucucucugcagagugccagcagcuuauugaguggugucucucccugaggcccucagagaggcccucccuggaccaaauugcugcccaccccuggaugcuggggacagaggggagcguuccagagaacugugaccuucggcuuugugcccuggauacugacgacggagccaguaccacuuccagcagugagagcuugugaggaggagaaggggccugggcucggccuagccagcgcucucccagaauugaacacuuucugccugggaugucugcugcaaaagcagugaccucugaccccuggugaccuuugcucucggcaccgggccuguuuccuuugcuuugagugccuuuuugaacgcugcuccacagggccuggguuuucuugagcucuucuguccaaagauggcugcgggcuaagcaagguccugcccuggguggauacuugaaccagagaucccgacccugcugcuccaucucaggaggcagccuuccugaccaaguguguuugacauggagcgcccuguggugcccaccuccaacccuccagucuccugguguucaucugggcaugucugcacaagcaaugcaacgcugggccacugcugcccgucugccuccccggcacggcacggcuccgcacgcaaccuaagcgugccaccacggucucuuauuuauggugugaucacccuggagggcgcccccgcccugcuggggcuauuuauuguuuaauuuauuugcugagguuccuccaagcaaccaccuucuccaggccccugggguguugaaagucaaauguggcuguugaguccacagacccccauccuaauuccugcaccuggaggaguuccccaacccccguguuugcgggaggaagcauuuguacaguggcuaauuuaaggggagugggagacccugucacccugagcacucugcgcuggggagggguuuaaauuauugaccuuguacagucugcuugcuggcucugaaagcugggguugggggacagagucucaagcccuuaauuuauuuuagcagcuguguuucugugacccuggugugacuaagcaucaggggugggguuguauaaguucaaaagugugaaaugucugaagaucauauuuuuuauacagguauuucaauuaaauguuuugguauauaaugga

SEQ ID NO: 12224 - RNA, 3534 nt, Mus musculus
uccauuauauaccaaaacauuuaauugaaauaccuguauaaaaaauaugaucuucagacauuucacacuuuugaacuuauacaaccccaccccugaugcuuagucacaccagggucacagaaacacagcugcuaaaauaaauuaagggcuugagacucugucccccaaccccagcuuucagagccagcaagcagacuguacaaggucaauaauuuaaaccccuccccagcgcagagugcucagggugacagggucucccacuccccuuaaauuagccacuguacaaaugcuuccucccgcaaacacggggguuggggaacuccuccaggugcaggaauuaggaugggggucuguggacucaacagccacauuugacuuucaacaccccaggggccuggagaaggugguugcuuggaggaaccucagcaaauaaauuaaacaauaaauagccccagcagggcgggggcgcccuccagggugaucacaccauaaauaagagaccgugguggcacgcuuagguugcgugcggagccgugccgugccggggaggcagacgggcagcaguggcccagcguugcauugcuugugcagacaugcccagaugaacaccaggagacuggaggguuggaggugggcaccacagggcgcuccaugucaaacacacuuggucaggaaggcugccuccugagauggagcagcagggucgggaucucugguucaaguauccacccagggcaggaccuugcuuagcccgcagccaucuuuggacagaagagcucaagaaaacccaggcccuguggagcagcguucaaaaaggcacucaaagcaaaggaaacaggcccggugccgagagcaaaggucaccaggggucagaggucacugcuuuugcagcagacaucccaggcagaaaguguucaauucugggagagcgcuggcuaggccgagcccaggccccuucuccuccucacaagcucucacugcuggaagugguacuggcuccgucgucaguauccagggcacaaagccgaaggucacaguucucuggaacgcuccccucuguccccagcauccaggggugggcagcaauuugguccagggagggccucucugagggccucagggagagacaccacucaauaagcugcuggcacucugcagagagaacagggggucagaguccugcugcaacacugcccugcccccaacacggccccagccagcuucuacaacacaccuggggagacccuccuccggaaaaagagccugccgcgcaagaucuccucauccugcucaaagggaauguccccacacaccaugucguagagcaguacacccagagaccacacaguggcagaccgcccgugauaucggugauaucggauccacucuggggggcuguacacacgggugccugagggaagaaucgggauuagguacacaucaggauauauacacacuggggggugaacacacugaacaacgggccuucauuagcucucagccagccuccauggggccucugagaaucuugcuugucaucacccuggaaaaaccccaacacagcugcaggcgggacucaggaaaggagggacauggagggcaggggaggaacaggagugaaggggaggugaaggcccaccccuaacaggccccaaggcaggagcgcgucacaugagcuccggcuccaguuucacaacaaacagauacaacguaagccacugggaaccaggccugguguucuagcuccucccgccccggcucgccuugcucagcucugcaaggcucggaaaggggaggagaggagcuuagaaagaggaggggcgggagagaugggaggagggaggagaggagugggggagccccggcuuccccgcgcuccgcaaugcggggauuucuacugcggcgcccccgcgcuccgcacgcacgcacgcacgcaagggaggcccgcgagcgcccuccccggcacagggaggggccacggcgccgaggcggcuggcgggggcccugcgucacgcgcguaucgcgggucucccuggcugccacccaccguccccagacccugcgcccucacaccgcagagggcuaccccgguguccccagucccccccaccccucccguaagccaggcguggcgcguggccgccuaacagucgccggaacgccgcaccaccugcucaccaucaaagucaguguagaccguguccuugagcaccgcgcccgagccgaagucgaugagcuucagcucucccgagcgcagguccaccagcagguucucguccuugaugucgcggugcacgaccccacaauuguggcagugccgcacagcggcaagcaccugcgcgaagaagcgacgcgccagcggcucguccagggcgccucguucagugaugaagucgaagagguccugugccggcucgggucgcuccagcaccaacaagaagccgucgggccgcucgaaccaguccagcaagcggaugacgccgcgcgcgccgcccgccgcgcccaccuugcgcagcagcaccaccuccaggggcacggccacuccgcccugggggacaaggcggucaucggacaaagccaaggcaacccacacccgcaugccccgcacccgcacgccccgcacccgcauacuuacgagacugccccacucggucacccgcuccuucaccacgugcuucacagccaccugcggggaaaagagggggcgacacgcgagcggucagacgggcggccgagcguggcgaucguccacgcgggugcgcccggagccacgacucaccgggaguccgucggcgaugcggcugcccgcguagaccgugccgaagccgccgcugcccagcacggcgcccaccugguacaccuucucgaagcucuccuugucagccuuggcugugggacaaacaaucggguugaugaugacccaaagccaccccccggcccccgcccaggcccccucccugguccccacacauaccuggcuguaggaucuucacugggaggugguccacgccgccaggcccgcagaggugcgccagggagccgaacuuggacagcagcaucgcggguggccucgcgugcggugccgccucugacccguccggcaaggacgcgggagggcggucuuccugaccgcagacagcgcggcggaucccacggccccgaggccgagcgcucagcggggcagccgcgcggcgcaguugcccgguggccgcgcgaaagcgcguagacggcagcuggccgagcagcucacacgccccggccgccucgccccgggguuuuggaccacggagauguguauccuuccgcggaggcggggccgccugaagcuccgccuccuuccgcccgaggcucgcuuugcgguguggcuguuuugagucucgcagggcggugcuggggaagccggacgcucccugucguuucaccaagggcugguggcgcgcggggacgacgacccguccggacuagcuugccguaguagagucgcggaggugcacggcguuccgcggcuuucacggcgcucucacccgcccugcg

SEQ ID NO: 12225 - RNA, 3975 nt, Mus musculus
uaaaaauagauauuuuauuccucagaggaagauacuacauuggugggggcgaggagccacuaauagcuacaguggaaggaaauacugauccggugggcaagggcgccuaugagaagcuggguaaaagagaaaaaaggucggauaacaaaaggacuggcgagcagaacagaggagcagugagguggggugaggguggucucugcaacccaggcuggaacccagcacaauaaauaguuuuauuuacauaaccgaacgcguggcucugcggccacauuucggugcaaauuauuuacacagugaugaggaggcaggacaggaaggggugggaggaggcugagggaggcaugguucacagcuguucaauggcuccgaggcagagacaaggagaauguaggguuuugcugcuggguccagcaaccuccuuucccacuuagcuuuccgugcccuuucaacucggaaacucuucagcuacaggugggaggggaaaggccuugaagcccagaggugcugguuagagaacucaagggaccuauagggacccgagagacaaggaaaggugauaauacccaaagaggucacagcgcaaaauacaucaggaaccgcaacaccuucaagaguugaccuccccacccccaccccagaagaagaaucuuucucucacccucuggccaaauuggggggcagugcaaaaggagucucccucaaagagggagggagguaggcugggucagggcccucaggauggcaaaaggguucgagccgacucaggcaagugguuucaggaguccccagguaggaggugggagagauggaucgcuaugaacccugggacuguggcuggacgcgguagggugggcaaacaucaggaccagcgagugugucugagaacuggaagagagcguucccguucccggaggcgcggcaccucauagacacucgugcagaacgcgcgugugcgugcaguugcggcagcugacguggcagcaccaguggaaggugcaguugcagcgcuccgugacgcgcugcgugcgcgugcgguggccucggccacagcacagcagcucacagccguccagcgcgggagacgagcuguugcaagcucguccagcugugccagcugugcccaggcggccacuguacgugcagaaguugggcgauuucucgaaguagacgaggucgugaggggagggaggcuugugcgcggggucuucgggcuccaggcgcagcagcuccgcccgcgaggcgcgguugcugccucgguugccguaaaggacgcgggaggcgccgucgaagcggucgcgcagcacgucgcccacagcgcgcagcgugggcagccgcauccaacacgugcgcaccgugcaggagccggacaucccguggcauuugcacucuuggcgcaucucagagaacacggucugggggaggaggggacgaggggaggagggaagaaaaggucaaagccaacaucccacgaaccaccacccauacuuccccacccccaccccacccgggucacgucgaugcuguggaaacuucagccaagguccaggugugacuaagcucgggagagaggaagugcaaaauggcccgcugagauagggacauucggccagacucugcuccacgccagcaagucacuuuuaucuuucaaaagugugccauggagccaucucaauacaucccacguguugauagccugcuaaucucuucuguucugucaucagcucaggaaccucuuugcccucaaccaccaccucuucucugucuucccuccuagagucccacucucucgggaagccccuucccugugccucuguccccgugcaccugucuuacaucuccccugccauugguuccggacacaccgacguaccguucgcccugccucguuguugugaagguucaugaggaagcguaggucccgccccuucuccccggaguccacgaacucucggccaaagaggcgaccaaaaucgauguugucacugcagcccccccagugccagucggggcccccagggccgcgccgccgguagucgcaggugcaggacucgauggagccuucggagcaggagcgcgccacggaaugugugaccccggcggaggugauugcgaagaugaacgcuguuucucggcagccugugggugaagcgaccccgcaucaguugagagaaggcguggggccaacucagcacccuguuuggaagacuugguacccuacaguccaacauccuuggagucaugugugcgaagcauggaaugcccuccucucuaagcuuuacugagacuccagagccuuagcagagcagcuccaaggggagauucccaaguagaacaaaucugcauagccaagaucgcuacuaguauuggcagugcaaacuuugcugggugcgaagcacaacccuagcuagcccucagagaucagcuucccagguaccuuugaggaaggcuagggaaaaacagcugucgcccagcgcccacgauccggaauucccuuucugugggccaguggcucagcaacguuaaagaucaugcucacaacgcaaggcuagaaagaaucuggugcugaccuacgguaacugccggcaccaggcgauucucaguuugaucacauauaacccugggaugucuucccugccuucgcccgccuaugcccuggagaugacccugcuuuucccuuaaucccggaagcgucgcuuuccugggcacccaccucgguugacgaucuugccgaagagguggggccccggagcaguggggcaguuccagcggcgguuucggaauugccauuugcacucucgcacagcgcucuggagcccuccacucacgcugugcaggauccccggguucugucggaucagucgccgcugcuugcggcucagcagcugcagacugggcucgagcaccagcugcagacucuuggaauccgucaacagguucguggaggaggcuauguucacgaugccccuggcgggaugcauaaggguucaguccaggggaggggaccugcauccuaaccauacaggcuguaccacccuauccuugccuggcccugagcuccagagucuagugaguggacagaaaaggcauggcuaccuuagcucuuccuuucuucaagucagcccccgaggagaaaccccaccugcagccuugcccaccuugaaaaacuuaggaauuccacucccucaccucaaagcuaauaucugguuuuuuuuuuuuuuuuuuuuuuuuuuuugguucaagaccuaagggacaccugagcacccaccacagcgagguugggaccuguugcucagcagaaacggggucguauuaaaugggaauggucucugagccugguguaucugggcuucugcaugccaaugaugugcccccacuucagcagagcuaguucuaggugugagcacccuggaugugaagucacaaugcacgaggggggucuguagguuggugauccccacagcgugggagcuggguaaggcccgugccuggcucuuugccccaggacaaguggcggaccccguacuagcucacuuaccaccaucggccacuacuguuggcagccagggcugcgggcagagcggucagugccaguagcaacguaguagaaacccagcugggcagcagcgcccagagccccauggccugccuggccuugcugguucugugcugcgguucugacgacugugguugcuguccgcgacggugggacuggacacagcggugagggcagugaugcgaguucccaggcuggcucuaauaagucuggaggcgggccgcaggcagcaugguucgcuguccuggcugcugggcugaagcagccacugcgggaggcaccgccucuuauaggccucuuauaguugcggcgcugacugcagugagaagaggcugccccuccgggcccgggcggcacuaaaagcaccagggcgcacuggucagggccacagacaaugaguggcgagcgaagcuguggcu

SEQ ID NO: 12226 - RNA, 30090 nt, Mus musculus
uacaccagagacaugauuuauuaaaaaaauuuuaauugguuuacaaaggagcuacagacuacauugaaacuaaucuuuguacaaaaggcagagagauugagauagagauauagagaaagagauacugagauccccaaaacacccagggacaaaauuagggggagagagacgaggaagauacaaaaggaacaggaagacaagagauuaacaucauacauacucaagagugagggcagagaacaagguaagugacuguuuagaaguauuuacccucacagcccuggugauaacuggauuggaacccacaacaaacaucgugagauuaaaagguuuaaaggcaacagugguacagagacugguuauugccaguauuaagaaagauaaacugguuuuaggcaccagauuggagcacuacuccucugcccagagaugacagacuugggagagggaagcaggcccuagggcagcugccuuuggcuuccucagaccauuaucaacauauucugacuuugugccuagucuuuagcuagguaagggauauuaggauguuauugggagaaaagagucaucagaaguaugaagaacugccauuacccacaauuuucaagagcaguuacuggaaaagcuguguagauagaaucaguucccuaguggagaaggcacagugugauuccugaaggcaagauauaggaaagcacacaaccaagcagauguaccucaagucuucucuaucuguagccccagccuaauuugccaggcuccucuaccuccacgagcugagacuuagaggagcugaaggacagaugaaucccaagacaaggaagguugggcuguuugauaaagaaggggcaaauuggaaaaaaagaagcagcuucucucucacaugagugcuguggagaaauccuucugaguguguggaaguuugaacagagaugacuuagggaaggaauggagccgaagacugccccucuucucucuucccagucuucaaccuacaacacaugagccaagucugaagagggaguaggaacguaaaggcugcuuaaugucuuuuugggggauguuauuuaaggaaggcagacaaagacaagaaacagcucaaccucaaagcuucuacucauccuccuagaugagaucuguaccccggagcagagccaagagacgcacagucuucuaaaccaaacuaauaaccugcccaugcuuuaucagcagcuuucaaagcaauguuuuccggguuggaaaagugccaugcccuccucucccaaaguaacugcugcuaccuuuauccuuguaaguuacuggcucuucuaagagaagaugaaacucugagauuuccaacauuucugcuuucaaccccaagaggcuacccaacuuugucuauggaaaguaaaaccaugaaagaggcccuuagcugaggcaggcacacuauccucacucccucgguaccugaucucuaaaucacuucucaacugaucccaagguccaaaaagacauuagggcacuuaaaauugaaugaaacguuaaucauguagcaccagggcuccuucaaaguguaacagaggccugauuagcaccuccaaagaaccccucaaaaaguguccaauuuuauugcggccuacaaagaucugcagcguccaguauucacauaaugugaaguauuaacaauacaaaauauauucugaaagucaaacaccugcaguucauagugcuuucucagauuuguuaaaaaaauacaaugcuuaguuuucuauauaggauauacaaaagcaaaaaauauauguauauaguagaaauaaaucagccauaguaauuuacagcuuuagucucccacccuccccaaauuauaacaccuucaucccauacuucagucuauauuuucugugauuaaagggucuauuuauucugagaccaagcugagaaagaaccauuauauugcguuuugaauagcaccccgaagggugccuguuaggaggucccugaaggaagauggugaguugguccuuucuaggaaaaagaugacacagucaaauaguuuguaaaugaguacaaaugggcagccuaggacaaggaaaugaaugcuuuaagauuacuauuucugcuagaugugguggcacacaccuguaaccccuaacacuugaaaggccaagguggacagaucgcugcauccuggacuacauauaaauucagaucagccaaggguaccuagaaagaccuauuucaaaacaaaaaacaagauuauauugguggucacccaccacuuugcaaggugccgucauuuuuuuuaaaaauuaagugaaaaaucaugaaggcuggacauagugacauauacuuguaaucccaacacuuagaaggcaaaaaaauuauucaaaauuccaggccagucugaguuaacagugaauuccaggcuagccugggcuacagaguaaaacccugucucaaugagacaaaacaaacaaaaaaccccaaacaacaaaaauguaaugaaaagaauuucagaaucaauaugcaugccaguuauguuaaauucugaaggccaaaaguuuggggaaagguuauuuuucagucaugagacccugacuagaggaauguagucucuuaacuuuagaaaaggcugagcggcucacagacagggagacaagagcggaaacugauuccauuuuauggucaaauaagacaccggagaaggaaauuuaaaaagcagaaagaaucugauguaaauuaauucaugguaauguguuaauguagcagaugcugagggucaaucaucagcuuuucacccaagagagaaaacaccaucagauaacuuauccaaaggcuuauaguccucagcaucucgaagccggcuuguaacuaaucaccucauacugaacaagauucuauuucuugaaauuuucuagcaaaauacugcacacuccacugaguuauccugcccucuuccuccagagaugcaaaguacaugauuauaaauguaaaauaacacgguuuguuugaguucugcuuuucuuuaggaauaaaaggugugaugguggcugaggacagauaacuuuuacgucaacauuaauaacaugugauuuggggacagucccuugaaauauuuccugagucuugauaacaguauuaagucugcauagaaaggaccaaauggaauaaacuaauguuaguauuucaagcuaacaauaccauaaacuuaucaagaaccuaguuuagauggaauuuacauaaaauguauaauaacacuauaaucuauuuguagccaagauagagaaguuagaauaaggaauccacuauagauuuggauguugauuucauuuucaaacacaaaaauaguuucuucuuuagaaagugcacuaggauauccccccaaccccauaacuguuaaccgauuuagcauaagcagagaacugaccuuaggaacauacccaaguuuuaugaccaauuucuagauacuggaccugaaaggcguuuugaucugaauuuauuuuccaacaauuucaaauauaaguucucaucugcauguagauauauacaggcacaaauacauucacacgcagucauacaaaaacaauuuaguuucucuaucagaucaggguaauuuuuuauugcaggucucuuuaaauauuggcuaacagaaaaccuauccccaaccuaacagaucucacacauacacucaaccacucccauacuuccucacagugaaaagcucucugacaagauagcacaaggucuagagagacaaugcuuuaauggcugggccuugaggacaauucugguugcauuuaagucucagugccaaacgcacugaguuucccugccgauaaaauguuuggaucagucucuucuggaaucaggccauagagaaagcaggauaauuucucccaguuucuccuauaauccacagugguaagacaagauuucuuuuuguucugggcuaucguucccaugauugugugcuucccuuucccuuaggaaccacccaaguauaucuaaggaagaguuaagggggacuuuuuuuuuuuuuuaaagaaccacuuuugccacuggcacaaguuuugcacucuacaggauggaaaauccaaacagguucacuggcugaugcuccuuaacauuaaaacaguaauaggaaggaacuacagaaauguucaaaagaggaaguguacuuccuuucagagugugaacucagaagcccauacauugaggcuuauagcuauuuggaagacaaugauacugaaauccgaauaauuccacuaacuucugaacccaagacuaagaguuauuuccuuuucugagaacaucuuuuucauacugaaagcugcugccuacuauuugaccauuuuggaaguauaucuccuucaaagggccucuuguacaauuccacagaaagacuucugauuucugauguuuagaacagcuaaaaaagggagaugguuuugacucuccagcacuaaggugcuugcgucaguaguauuuugaacacucccuccauagcuacuucaagcaucagacuauacuucaggcuuuuccacucuguugcuggaacuaaagucuuuaaaauauuaacacaagugccuaauccaggaaucacugucaaaaacaacacaggaagugaucgugugaggaaagggagacaaggauuaagucaggaaaggagugcaaggagcugaucccaaauaaaauaacaaaauuaagaaagaagacacauuauauauguauauaugaacuaaaagcagaaaguaugaaugcuuacucuggugggaugccaggacaacauuuauaaggaaagcuugaugugucaugauaaggcucagccauugagaaauaaggcaauuuuuuuaaaaaaaagaaaagaaaagaaaagaaaaaaagaccaagguauuuuggucacagaauggucuuuuuccuccucccagccagccccugugaaagcaucucuauauauuuuuuaauauauauauauauauauaauauagaaucuguuuuuguuaaaaaguauuucaaugaucauauauauuuaucaaggcaugauggcuuuaggaaaagggggggggaauccaucaugggagagcuaagagggaaaaacaggaagaggaggcugggguaagaaguguaagaagaaccugggaugagauaaaugcugaucaaaggguggcaccaacagaauuuucacuaauauuuuccauuuucaaggagucaccagugacauugggugccacaaucccaucucuuuuuuuuguaccaucucccaauucuuccuaccaccaagcacauuaaugccucauggcucucucuuccagaugucucuuggacccaugcuaccuugcaucccgggcuuaguggguauuggcccauaugucucuggcacugggugucuaaucuuagaaaccauugccacugauauuaauggacugcagcucugucaccugcaugacguugaugccacuguuggcaagacgggcaauacccucuggacagauggccuccauggcuaccauauuggugguaauaagggcugaaggaguggcagugccuucugaaccugccccacuguccaggggcaaugugcccacacucagggcuacaccugggccucccuucuuguucuggugagucuugauaugcuuugacaggugaucacuccucaugaaacgcuuagggcacucagggcaggcaaauuucuucucuccuaguuuaaaaaaaaaaaaaaaaaagauaaauuagccaaaaagcagucagaacaaaguugagguugauguguauccuucuggacuaauucaaguacucuuggagacacgcuuaguuucacauauacauuguuuaggaauuucaguuugcuucaugggcauaucauuucuuuuuucuuuucuuuuuaugguuuuagagcuuuauuauagaaagacagaaagagagaagguagaaagagagaggacugccauggccaaguggagaaaggagggaagggagggggagagcuggagaugagaauaagagaggugagagcuuaugagcucauuucuuucuuucuuucuucuuuuuuuuuuaaagauuuaucuauuuuauucaugaauacauuguagcugucugaagagggcauuggaucccauuauagaugguuaugagccucuaugugguugcugggaauugaaaucaggaccucuggaagagcagucaaugcucuuaaccacugagccauuucuccagcccucauuucuuuucugucuacuacuuucccuuuucccuugggucuuacucaccuguauguguacguuuaugucucugaagcucguccgaacguguaaagcgcuucccacaauaugaccaauuacacaugaauggccucuccccuguaugccagcgcaagugugcucggagaugugaggucuugccauauacuuugccgcauccuuggaugugacaaaugugcuguuucuuuuugccaggaucuccugaggcucuaaaaaugagaauauuaugauuuaucacucuggagcuagaaaguagggaaccaagaaauuagaauaguaauugucagaagcaauuacuuaacccauuccuuuguuuuugagaaagacucuauguagcucuggcuguccuggaacuuacuaaguagacaaggcugaccucagagauccaucugccucugcuugcauaaaacuagguaggauuaaagguaugugugccauuauaccugucacuaggacuuacuuuuauaugccauuccgaagaaagacacaaguggaucuucgugaguucaagggaagacuggucuacagaucaaguuucaggacagccuaggccugucacacagagaagcccuguaucugucucucuguuuguguaucaaaauguuuuuuagauuuauuuauuuuaugaguauuuugccugcacauauguaugugcaacacagcacaccggugccuacugaguuuagagaaggaugguaggucuccuggaacugaaguuacauauggcugugaaccaccacauaggguacuaggaaucuaaaccaguccucuggaagaacaaucaaugcuuuuagcugcugagcuauuguuccagccccuguuguuuuuguuguuuuguuuauauuuggggacagaguuucaauguauaguugaaaugaguuucuggcuguccugaaacucacucuguagaucaggcuggccucaaacucagguaucugccugcuucugccucccaagggcuggaauuaaaggcaggugccaucacaccuagcuuuuguuuuuucaacuuuuauuuuuauugggagcuagagagacugcucaguaguuaagaguacuuuugcucuuccugaggacuggaauuucauuucaagcaacuacaaccaagugacccacaccaccagauucaaagacucuaaagucuucucuggccuauuagcugcauauaaauacacaaauaaaauuuuuuuggcuuauuuauuuuggagacaggguuucuuuguguaaccuuggcugucuuggaacuugcucuguagacaaaaaaaaaaaaaaaaaaaaaaaagacugugggaucagaaaucuuguaaagggguaauauaguacauuugaguagguccuauuaugcagcucuuguuucugacuucucauugacucugauugcuagguaaauguucuaccauggaguucaucucaaguuugugaguuuauuuacuuacuuuugcaacaaggccucauuguauagcccaaauuaccauagaacuccuuguguagaacaggcuggcucuaaaagugggauuauccuugugccucuguuuccugagugaugagauuacagauauacacuaccaugucuggcuccacagaauguuuguuguuccagacagaaucucuuuuauuuagcucaugcuggucuuaaauugacuuuuagauuagacagguuucaaaucugcaauuuuucugcuuccaaguacuguggcagcagaucugugucaccaacaaaucuagcuucacugacuuucuuacaugaauuuuuuuuuuguuuuguuuuuugcacaaaguucuauccuauuagcccaugcucucuuuuuauuauuuuuuaugugcaugagcaguguuugcuuuucuuauggguggcuacuaauuuuaugcuggugcuggcacaugcuuuuaauuccagcacacaagaggcagaggcagguguaucucugaguucaaagccagccugguguuccacaacagccagggcuacauaaaaauaaauaaauaaauacccuaucuugaaaaacuaaaacaaaaugagccacuccuucaggccuaaauaugaagguaaaagaaaagcauggaggcuucuccuuguaaucucugcuacucgagagacagaagcacaagaaccaaaaacucaaggccaagauaggagauguaucaucugauuccauguaaauuaaaauaaggagcuuagagaagaauuauaauucagaacauggccacucuggcaagagaucauauccaaagaucuucuaggucuaugugauccgagaacucacuaugccauccccauuggaagacaggcugggauacagacaugccuuuaauccuaggagacugaggcaagcauaucucuugaguucuagucaguucuguucaguuaauggaauucagaggcaguuuacagggagagguuuccccuccccuacagagacagguugaagagaguuauaauaagcuagacacaguuaaagacagaacaagugggcuggagagauggcucagugguuagguccugaguucaaaucccagcaaccacaugguggcucacaaccaucuguaaugagaucugaugcccucuucuggggugucugaagacagcuacaguguacuuacauauaauaaauaaauauuaaaaaaaaaagaacaagcuagagaauaaggagucaaaaggccgggcgugguggcgcacaccuuuaaucccagcacucgggaggcagaggcaggcagauuucugaguucgaggccagccuggucuacaaagugagcuccaggacagccagggcuauacagagaaacccugucucgaaaaaccaaaaaaaaaaaaaaaaaagagucaaaagauuagaacagauugcuaguuaguuugagguaaagcaaggaaauuaagugagaugcaaaaagaagcccauuugaaucagucagcuuggaggggaguucugagucagaauagcugaauugagccagcaaaaaacagcuuacucagcaguaaaucucagaggcugaagguuuccaggccuaguuuaaaggacaauuaucuggugaauaaaaguuacauuuacaggggcuggguguggucucacaccuuuaaccauagcacugcgaaggcagaggcaggagugucucaaugaauucaaggccagccugguuugcauagugaguuccagaaaaaccagggcuacaaaaagacaccuucucaaaaacaacaauaaaauaaaagcugcugagcuuggcagaccacgugacuuuaauccuagcacuugggaggcuaaagcaggagaggucaaauagugagaucuugucucaaaaaacaaaaaccaaccaaaccagaaaaauacaauacauauugcaaauaccuguuaaaaguccauucugacucuucucccccugccccuaaccuaaacuuuuccaguuuauaaucuucccucccuaagcuuaucauucccacguaacccugccauuuagacaggugcucucuugccucucauauuuaucuuucucacuuucuaccccauucucucuccuguuauggccaaguccaaucuacugguuguuauuuagucuacuuucucuccuugcucugaacucuucagugccucuggcuguaccuuaccucauuuuauuuuauuuuuuauuuuuuguuuuucgagacaggguuucucugugcagcccuggcuguccugcaacucacucuguagaccagguugagcuccaacucagaaauuucccugccuccgccucccgaguacugggauuaaaggugugcaccaccaagcccggcuguacccuaccucuuuaucuacaauaaaaaccuuccccucaacuacaccuuggagaagucauaguccuguucuuaacuuuaucucaaaacccucauuuuauuuauauacucccuaugugggguuaaauagacacaugugccaggugugguggcacaccuuuaaucccagcacuugacaggcagaagcagguggauuucuuaguuggaggccagccuggucuacaaagugaguuccaggacagccagggcuauacagagaaaccaugucucaaaaaacuaaaaaaaaaaaaaaaaaagacacauguacuuauuauaccuccucaggaaaagucugucacaaaacaugggauuacagacacgugugacuacaacugucacucucuuucucuucagacacaacagaagacaacuugggauaccauuacagaugguugugagccaucaugugguugcugggaauugaacucaggaccucuggaagaacugucagugcucuuaaccacugaaccaucucuccaguccucuccuaucauuuuuuccucauauuuuuauaagaaagaaaaaaaaaguaaaagaaaaauucuauaaucaagaaaaugaacucaccuucccucacugucuuugcaauaggggcauguacaugcuucccgacgaguccugcguccagcuugggguuggagaucagagcuauucucuccuucuccaccugcugucucaucauguaucccaucaccaccagauccaugaagaccaaguugaguuccaugaucaccugaaauaaaaagacaaggagaaaggugaaaaggcaggacuaaauagcuaccgaaauuucacaacagagucagccacgacuggcucuuuuuuuuuuuuuucccguggagcacacuuuuaaucccagcacucaggaggaagaggcagguggauuucugaguucgaggccagccuggucuauacagugaguuccaggacagccagggcuauacagagaaacccugucucaaaaaaacaaaaaacaaaacaaaacaaaaaaagcgugugccaccaacugcccggcucuaacuuuuaacuacaguucuuccaugagugauauguguaggaugcuugucuaaaucaaaggacaacuuuuggcaaucggcuuucuuucuaccacauggguuccaguaaccaaccucaggcugucagccuugacagcaagugccuuuaccugcugagccaucucacuagcucauaacacaccauuucuucaagaucugugugugugucucugucucucucugagauuuauuuauuuuauguauaugaguacaccacugcucucuucaugcacaccagaagagggcaucagaucccauuacauaagguugugagccaccaugugguugcuaggaacuuaacucaggacacagacagugcucuuaacugcugagccaucucuccagucccgucucucucucucuuacuuuaaucugacauaaggucaugcuauauuugcccaggaugaccuugaaguccuagguucaagcaaucuucugacucaaccuccugaauaaguaccugaaagacugccaagggacuacagguuuaaguuuacauagcaguuccaggaugaccuuggcuaaagagugauacucaugccaaauacgaagccaaaaugacaucaauaucauucuggaaucuuuucuccaccccuuuuaauaauaguuuuagaacaguuuacucuuaaaacaugguacuacuaguuaagcaaugagauaaauuaaagauuggccuuccugugaugaaaguagauaggaaaccagaggcacaguguaaugacagucuuggccaaacccaacuguugccucuagcaucaauuucugaaacaacuauggauguuaaacaucuuuucaguuucuucuaaguaaagaaguguggcuaaagccacaaccuuccaagaucacuaagagucaaaaccuuauucuuuggggagaaaaaaaaaaaucuugggaauuacuaaaguaugaugaagacaucaugaacaucaagaacuguaaagcaaaaacaaaacaccuucuagaacugauccgagggccuccacacaauagacaaguauucuaccauucaaaaagcuaguuucuauauauuucuaaaaacuccaauuaggcuucuagauucccaucucucaucuugcugugaaaaacacgacaaaaacaaaaaaacaaaacaaaaaaacaaacaaacuuggaaauuaaaggguucacuucaucuuacaacucuuaggccauacuccauccugacagggcagaaugaggcaagaaccaagaggcaagauugacuuaaucuccaaggcuucgucauccugcuuacaccauacccagcucccacugugcuggguccucccauaucaaguauuaaucaagaaaccuacagacuugucuacaagugccuuuaaucccagcaccugggaggcagaggcaggcagauuucugaguuugaggccaaccuggucuacagagugaguuccaggacagccagggcuacacagagaaacccugucuugagaaaaagaaaaaaaaaaaaaaaaaaaaagaaaagaaagacacaccagaagagggcaccagaucccauuacagaugguugugaggccaccaugugguugcugggaauugaacucaggaccucuggaagggaaacuaguguucuuaaccucugagccaacucuccagccccaggaccuaguucuuauaauaggucucuuaacaaucuuauaguccuuagucuguaacuucagcuccuggguauccaacaccuucuggcuuacacacacacacacacacacacacacacaaacacacacacacacacacagagguagacguacaaguacacauaauuuuuuuacuuccucccuucauguuuaucucucucucucucucacacacacacacacauacacauacacauuuauauacacacaccaacacagaaacacaagauuucaauauggaggccuggaacuuagugauucaccagcuucugccucccucauaccaguauuaaaagcauguccaagccuggcggugguggcacacgccuuuagucccagcacuugggaggcagaggcaggcagauuucugaguuggaggccagccuggucuacaaagugaguuccaggacagccaaggcuacacagagaaacccugucucgaaaaaccaaaaaaaaaaaaaaaaaaaaaaaagcauguccagucccgggauaaaaaaaaaaaaguucaccaugagcaggaaagacaacucaaucuggagucccuuuacagggauugccuaagaccaucagauaaaaagauacuuacauuaugauucauaauaguagcaaaauuacaguuauuaagaauugaaaauaguuuuaugauugggagaucaccacaacaugaggaacuaucauaaagggcugcagcauuaggagaguugggaacuagcucagauuauuggcugcucagaggaccugguuuugauucccggcacacucauggcacuucacaaccauuuauaacuuuaguuccaggguagucuuuccaucaaaucuaaauauuaauuuuaguuuuguuaauguucccuaacuaaggcuugaguuuugacauuuaucauuaauauaaaggcaaaagcugauggcacacugaugauacucuccuggacuccucugguacucagcacccauguacauaaacauggguguacaaacacagucaggcaaaacacccauacacauaaaauaaauuuuaagcuuacaacuaagaaaauccaugcuaggaauaguagaacauggcugucaucucagcacuaccaggcaggugcaggauagugaaaucaaaaccaaucugagcuauaaagugagaucuugucaagcacaugaacaacaaaaaaagcugaguucauaagcaugaugggaagccuuacuuuuccccuuguaucuucuguaauuucucuguaguuaaaacauuuaggggguaggguaugggggacuuuugggauagcauucuaaauguaauugaggaaaauacauaauaauuuaaaaauauuaaaaaaaagaauaaaacaaaaaaacauuuagacuguaacauucucuuugguauauuacuuuuuuuuuuaaaaaaacugaaaaacugccuagguaugguuagagaaggcucagaggguaagagcacugacuguucucccaaaggugcugaguucaaaucccagcaacuacaugguggcucacaaccacuuguuuuuuuuguuuuguucugguuugguuuuugguuuuugguuuuuuuuuuucaagacaggguuucucuguguagcccuggcuguccuggaagcuggccuccaacucagaaaucugccuguuucugccucccaagugcugggauuaaaggcgugcuccaccacugcuaggcuucacaaccacuuauaaugagaucugacauccuccucuggugagucagaagucaacuacuguguacuuauguauaauaauaaaugcaucuuuggaccaaagcacgcaaguggugccaaccagagcgaaugugguugaccagagcagagcgaguagagguccuaaaaauucaauccccaacaaccacaggaaggcucacaaccaucuguacagcugcaguguacucauauaauaaaauaaauaaauaaaucuuuaaaaacaaaacaaaacaaaaaacuaccucaaagaaauggguagcuuuccuuagagcuaaguaaucagcaaagcgguguuaauggcuuucaccaguagaugucacugugacuaaaugagacagcguuuuaaaccuaccagaccuuuaagagaaaaagggacugcucagauacuagaaacagaagauauuuugaaagucuuuccaucaaaucuaaauauuaauuuuaguuuuguuaauauucccuaacuaagacuugaguuuugucauuuaucaugaauauaaaggcaaaaaaagcugauggcacacuuuuuauuacaguacuccagaggcagaagcagguagaucugaguuuuuggccagcuugguagaguugaguuuccaggaaauccagggcuucagagaaaaaccggucuuuaaaaacaacaacaacaacaaaaaaaaaacacaacaacaacaaacaagcaaacaaaaaagagaaaaaauguaguucaugaugcugauugucuauaauuccagcacucaaaaagugcagcuggcaggaauucaaugagucacacagauagggucauaaacaaaacaaaguaagacaaaaaccugccuuaacuucccaacugcaaggaugauaagcaugugccauuccuggcuauuguguacuuucagugucaauucauucucucucacagcagaagcacaauaaauuuauagaaguaaaaaugguacucaaagcuagguguggugguguaugccuugaaucccagcacugggaaggcagaaggcagacagauuuaugaguucaagaccagccuugucuauauagggaguuuuaggacagccagggcuacagagacacccugccucaaaacaaacaaagugaacuauuuccagcacucaagagacuaaggcaggaagauaaccacugaagccaaguaugggcuacauaaaauccugucucaaaaaauaaguacacaaacagaaguauucaagugaacuauucuagguuucauugcgaaccugcagcuacaacauggaggcuuaaagaaccaaacuuagggguuaaagagaugguuuuauucuuuaaaaaaaacaaaacugccuacucuuucagaggacucaggcuggauuccaaguaccuacaugauuucucacaaucaucuuuaacuccaauuuggcuucugugggcacauggugcuaagacauacaaaauaaaauaauuauuauuuuuuuuuuuuugcuuuuuuuuaauguucaaugguguuuugccuggauguauguacauguuagggugucagauagcccguaugggagcugcaaugugggugcugggaauugaaccucuggaaaagcagccaaugcucuuaacagcugaaccauggcuccaacccccaaaauaauuaaaucuuuaaaaauaaaugaaaaaaaaaagaaauaaaagaacugaaacuuaauuuuuuuuuguuuuuuguuuuuguuuuuuuuugaguuaaaauacuucuaaacuaggcuggugagauggcucaguggguaagagcacccgacugcucuuccaaagguccaaaguucaaaucccagcaaccacaugguggcucacaaccaucuguaaugagaucugacucccucuucuggagugucugaagacagcuacaguguacuuacauauaauaaaaauaaauaaaucuuaaaaaaaaaugggaugcagaguauuucuuuaaaaaaaaaaaaaauacuucuaaacugaacuuccaaacuguaacaagaaacuugucauuuucccauucauaagcuguaauucuuuucucuagguacauucuuagggcaugcugagcucaguauuucugaagaguauuuaauuggcucuuguaauauacccugccuucaucagaggcaucaugauauauuacuaauuccuucagaaaaaguccucacuaaagacuuuuaguggacagagggucagagacugccugccaaggaagccaaauuaauuuccagcaucuaccucaaaccucuuugauuaaaaugguuugauacacacacacacacacacacacacacacacacacacacacacacauugauuaaaaugguuugauacacacagacacacacacacacagcucaacaaucaacaaagacgggguugcacuugccacucuuguacaagaaagcucacaaccauuugaaacucuggugcccggggaucugaugacacucucuucuaaacucaaguucaaggcacaaauauggugcacacaaacauacagguaagacacucacacaagcacauaagaauaaccuaaaugaaugaaugaauaauacagugaaggaucuaaagaagucaccugaugucacuucuggcuucuccauauuccuacacaccaacacagaguugggguaugcuagacaaauacauuacaguuacaggccccucaaaaaagauuuggggaggccgaucucaaaggaguaagccagagaguaauuggaggacacucaauaacugcucuggcuuuccugaaauuacaugcacacccacauaggcacauguuacacacacauauacacucucaaauauuaaaaaagaaaagccgaagccggccaugguggcgcacgccuuuaaucccagcacucgggaggcagaggcaagcagauuucugaguuugaggccagccuggucuacaaagugaguuccaggacagccagggcuauacagagaaacccugucucgaaaaaccaaaaagaaaaagaggagucaggcgugguagcacauaccuuuaaucccagcacucaagaggcagaagcagacugaucucuaagucagaagucagccuggucuacagagucaguuccaacacaaacagagcuacacagagaaauccugucucaaaauaacaaaacaaaacaaacauaaaaugcuuccaauuucagcacucaggagggugaaauagaauguccaugaauuagaagacagccugggcuaucacgaaauccagucucaaaaacaaaaaaauauucaauaugguaauauaaaccuauaaacuguugucauauacacuugggagaaagaggcagcaggaucagaaguucaaggucauauuuguuacaucuugagauauaacuauaagauagccucaaaaauuaggaaaaggagaccugaaggcaauauccagaaucacuuagaaaacuggugaaaaacaauaaaaguuuauuuguuugguuuguuuguuuguuuaaagcuuuacuuaugaggccagccuggucuacagagugaguuccaggacagccagagcuacacagagaaacccugucucaaaaaaacaaaaacaaaacaaaacaaaaaccuuuacuuauuuuauguauaugaguacacuauagcugucuucagacauaccagaagagggcaucagaucccauuacaggugguucuaagccaccaaauaguuguuggaaauugaacucaggacaccuuuggaagaaaaaucacugcuauuaaccacugagccaucucugcagcccaaaaguuuguuaauaauagcuucucagggaaaaaaauaagaaagguagucagagguuggucuguagagaacguacacagcauacaugaaguccugaauuugauccucaguacugcauaaauugggcagaacuuugggcacuuacaaacucagguccuagagcuagggagccagcucaguggguaaaaaaaaaaaaaagagauugugccaggcaugguggcucacgccuuuaaucccagcacucaggaggcagaggcagggggauuucugaguucaaggccagccuggucuacagagugaguuccaggacagccagagcuauacagagaaacccugucucggaaaaagagagauugugguauaaacaugaguacaugaguucaaaucccuagcaccauaugaaaagcuauauauaacagcacauguuuauagauccagaauuagcaggaacagagauaggcagaaccugauaauucaaugauucaccagccaaccuagcugaaaauguaaacuuccaguucagacagagacucucucucaaggcaauaaggcugacagagauaaagauggcuauauaaugaguuugagguuagucuagacauuauaaaacccuaugucaaagaaauaaaauaaaauauaaaagagucaaaggcuggagagacugcuccgugcuuaagaauacuagcuacucucccagaggaucuugguucaauuuccagcucccacauggucagucacaauaucuauaacucuaguucugggggauuugaauuccuccucugcauugggcaccaggcauguaauaaguguacagacauacaggcaaaacaccucuacccauuagacagagacagagaaaagagucaagaaaacagaucacauuggauacaugcuuuuaauccaaaggauagggaggcagagguaagcagaucucugaguuaagucuacagagugaguucaggacagccagagcuauauaaagaccauguuucaaaaaaacaaaaaaaaacaacaaaaagaaagaggacuccuuaaacaaaacagaggcaucucuauuggauuuucauguucaauaguauguaggaagaggagggcuaagggaagaaagguaggaacuuuaaaauaaguuccuuauuauucucccuuccuuuacccccauccuaccucagaccaggcuaaccucaaacucagagauuuaccaguuucccaaguacuauauuaaaggugugugccacccccagacagcuauuaaguugccucauugauuaaaaaucaauuuugacugggcuugguagcacacgccuuuaaucccagcacucgggaggcaaaggcaggcggauuucuuaguucaaggccaaccuguuuuacagagugagauccaggacagccagggcuacacagagaaacccugucuugggggggggggggggggcgcaaauuuuggagcuggcaagauggcucagcggguaagagcacugacuguucuuccuaaggucuugaguucaaaucccagcaaccacaugguggcucacaaccacccgaaauaagaucugacacccucuucuggugugucugaagucagcuacaguguacuuauguauaauaauaaauaaaucuuuuuuuaauaaaagcagcugggugugguggcacacgccuuuaaucccagcacucaggaggcagaggcagguagauuucugaguucgaggccagccuggucuacaaagugaguuccagaaaagccagggcuauacagagaaacccugucucaaaaaaccaaaaaaaaaaaaaaaaaaaagaaagaaaagaaaagagcaaauuuuggggggcuggagagaugauucaaugguuaagggcucuugcuguuuuaaaagaccagaaucuaaaugaaggcuuaccaccuccucaaacaccaaguacauaugugguacacauaugaacaugcaugcaaaauacucauacacauagaauacuaaaaauaaauuuuuaaaaaaaggagcaaaucuuuguugugaccuagguauuuccuguuuaaaaaaacaaaacaagccgggugugguggcacacacauuuaaucccagcacuccugaggcagagacaggcggauuucugaguuugaagccagccuggguuaggguuccaggacagccagggcuauacagagaaacccugucucggaaaccaccccccccaaaaaaaaaaaaaaaaaacaggaguugaaaaugagcuagaggucaaccuggguuauauaacacccuggagauagauggggagaaaagagaauaaaaaggaaaccagagguauuuucaggucuucaaaaggggaaaaauucuauucagggauuuuuguuuuguuuuguuuuuuguuuuguuuguuuguuuuuuucgagacaggguuucuuuguauagcucuggcuguccuggaacucacuuuguagaccaggcuggccucgaacucagaaauccaccugccucugccucccaagggcugggauaaaaggcaugcaccaccaccgcccggcuuuauucagggaauuuugguuuuuuguuuugaguuuuaaguuuugccauuauugaaaauaagggcuagucucaaauuuacugucaacacagcugaaaaugauuuugaauuccaaauccuccagucucccaagugcuuuggauagugcuaucauauuguaucugguuacuuaacugaguuaaaauggccacacugcaugcauaaagcagcaugauuuaacaaugaugucauuuagacaaagcaauuggaaugaacagauaggaacaauugaaaugaagacugucuuuucauaucuuacugcauuucaaagcaauaaaaguacucauauuuaaaauuuuucucuuuaaacagaagucaucaauuaaaaaacacuguuggggcuggugagauggcucaguggguaagagcacccgauugcucuuccgaagguccgaaguucaaaucccagcaaccacaugguggcucgcaaccaucuguaaugagaucugacucccucuucugaagugucugaagacagcucaguguacuuauauacaauaaagauaaaaacaaaaacaaacaaacaaaaaaaaacacugucacuucaauaaacaaguguguuagauaaaaaauauaguaacaggagucauuugauaaacuacauuaucuuaaaacugaaaugucucucauaugagcuuuugcacaaaaugcuaauucuggauaaauguggaugcucauaucuguaaacacucauugguugaaacaggaggauuaccauaaauuugcagccagcccauagucucaaaccagucuaaacaacaaaaaacuuaaucuccggagggaaaaauacuuuaaaaaaauuuuuguauuuauauuuuaauuucauaaacauuuuaugauuucuaaagugaugcucacaugcacuagucaaaaacacaacuuuugcugagcggugguggggcaugccuuuaaucccaacacucgggaggcagaggcaggaggauuucugaguucgaggccagccuggucuacagagugcguuccaggacagccaggacuacacagagaaacccugucuccaaaaaaccaaaaaaaaaaaaaaacaaacaaaacaaaacaaaaccacacacacacauagcuuuuuaacaaauuaggucuaagcaaucugagcccaaucucagcuagacugcuggcaaaccaaugccaguaucacauucaacucaacugugagacaaaacauguuccugaccccaaugaaacuuagcagauguagaauuuuuauuuuuagugccugaaguuuucaugagugaauuguagacaucaagauuaucuguucuauucucaugccaaacccagcucugcacuauuagaacucccaagaagccaaccacauucuaugauucaaagcugccccaugcacacccaaggcaaguuucaagaauugacugaggaggaagagaugugaaguuuaagacuacaaaaugagagcguaaguucucauaaaaaggaaaagguauuaaaaaaaagaaaaaggcuuuggguuauuuaaaagcaaacaaaaacaacucuaggaacuuaccuaucauuucacuuuuggaaacuaaccucaguuaacagaguggucccuucccucacuaccacccagcaggggcaaagccugaaaaguaugggacacagaaguagggguuuuaucuagguucuacauuaaugccuuggcuuauauauuuaacauaagaauuaaaaaaaaaagucaauagaaaauccaaagcauuuuuuuaaaauaugacuuuaaaaauaauguaaccagaaugagcaugaaacacuauuauaguucucuuccccucccccucauucccuuuuuuuuuuuuuuuuuuuugagacaggauuuccucuguguagcccuggcuguccuggagcucacucuguagacaaggcuggccucagaaauccaccugccucugccucccaagugcugggaucaaaggugugcaccaccacugccaggcuuccuucccucuuaugguguuugauuuuuccagacaaggcuucccuuuguagccccuggcuuucauagaacucagagaucuacuugccccugcugggauuaaaguccugauccacuacagcccagcucgcucgcucgcucgcucuuucuuucuuccuuccuuccuuccuuccuuccuuccuuucuuucuuuuuuuaaagcauuuuugauccuagaacuugggaggcagaggcaggaggauuucugaguuagaggccagccuggucuacagagugaguuccaagacagccagggcuauacagagaaacccugucucgaaaaaaacaaaauacuaaaaaaaaaaaaaaacgaaauggauuuucuuuuauacuguacugugaaaaggaugaaaguauuguuaauguuuggguuuucuaauacauaccuaauccuguaucagaaaagaggguaaaauaagauauucuguaacaaccaggaagucuaagucucuagggaacuauaacauuuuuuaaagauaaaauuugaacaauuagccgggugguggcgugcgccuuuaauuccagcacuugggaugcagaggcaggcggauuucugaguucgaggccagccuggucuacagagugaguuccaggacagccagagcuacacagagaaacccugucucaaaaacaaaaaacaaaaaaacaaaaaaauuuaaaaaugaacuacauguaucuucaaaaacauauuaaucaagaaaacauucuuauuuuacaaaaugugcuuucuaggucaaaaugcugagcaaaccuggaccagcucaacacgugaagcccacauacugguggaagagaaucaauucuacaaaguuguccugaccacuagauauauuaaauggcaaacuucccccaaacacgauugagcaauggaaaugcuucacaacuguuuucuagauccuaaguuacaaaccuuucagaaaucaaaauggccgggcgggagugguggcgcaugccuuugaucccagcacucgggaggcagaggcagguggauuucugaguuugaggccagccuggucuacaaagugagcuccaggacagccagggcuauacagagaaacccuguauggaaaaaaaaaaaaaaaaaaaaauccaaauuucuagcugguaccauuguaaucagguuauccuuggguacagaguaugaaucugugccucaucaccaaaauauaauaguuccauguugaccuacaugguaauuuuuuaaaaacuuauuuugggggucacuacauagcucaaaccagcacugauccucuugccuuggcuucccuuaggugcugagauuacaagggcagagaauaagcagccuuauaaauugacaaauucuaaaaaugccuucacuuuuaugguucugacuuuuggcucucuaaaaucuuauuguugguuuuagcaggguaguuuuuguuuuguuuuugagccaaggccucccaauauagcuagcagcuaagguuucuuagccuuugauuuuuuuuugguaaguuuaugguugggguggggcguuuggaaacaggguuucucuguguggcccuggcuguccuggaacucuauaaaucagauaagccucaaacucaaaaaaucuaccugccucuaccucccacauacuaggauuaaaggcaugagccacuacuaaguagcaacuagacagccucugaacucacgauucuccaguacaaccucccaaguugugggauuacaagaagaggucacuguaucuauauauucaaugcuuacggaagguaggguguuaaagaccaacuaggaaaauuagauaugcaauugcacaccucuuaauuccagcacuaggagacagacacgcagaucucugaguucaagguuggcguggucuacauagggagcuccagguuagccagggucucuuaguaagauccugccucaaaucugagcaggaggauuucuaaauucaaggccagucugaucuacagacugaguuccaggacagucagggguacacagagaaaccuugucuugaaagaaaaaaaaaaauuccugccucaaacaaaugaacaaacaaaacaauaaaaaacccaaaacaugaccacccaaaacaugaccacccaaaacaaaaaccagaaacucaucuuguuaaaaaucuuucuaagcaggcgugguggcgcaugccuuuaaucccagcacucgggaggcagaggcagguggauuucugaguucgaggccagccuggucuacaaagugaguuccaggacagccagggcuauacagagaaacccugucuccaaacaaacaaacaaacuuucuguucugaguucgaggccagccuggucuacagaaugaguuccaggacaggcaggacuauacagagaaacccugucucaaaaaacccaaaaaaaaaaaaaaaaaaaaaaaaaaaaaucuuucugaggcuggagagaugacucagugguuaaaggcacuagcugcucuuucagagagcaagaguaugguucccagcacccauuuauuucagguggcucacaaacaccuggaauuccagccucaggaaaucagaugaccucuuccagacuccaggggcacccacccauccaaacugcauaaauauacagauauaaacacauacauauaaauaacauuuuagggaaaaaaagcaagaaagaaaagaucuuucugaaauccauuaagccauuuuucccucaguucaacucaugagaaaacuguucaaguugaaucaucacaaucuguaaccuacuuggccagaacuagguuccugaaccaaaauguuaaggaacugcuugcugccuccugcuccugacacuugagaagcagauacuaccucaguuguaaugccuucuccaccaagaugggaguauauuuaauacuuuuaaucagauaaaacugccaaccaaaauaaaccuccugauccuuaaaggacaaagaaaagcacagcacauuggugcaagccuaaaaucccagcauuggggaggcagaggcaggcaggucuauagaguuaguuccagaacaagagagcuacucagaaaaacccugucucaaaaaauaauuucucauauggugcugaacauggauccacagucuagacucgugcuaaauaagcauuuuacugcuuagcaucaauccuagucuugguuucacauucuaguuaucuuagauuuuauuuuuauuuuauguguauuaccuaaauauaugacugugugccacauucauacaaugacaaguaggcuagaagaaggaggaguuggaucuccuuggacuggagucacaguugucagauaccacaugggugcugggaauucaaucuagguccuuuaggagagcagccacuuuaacugcuaaaccauccaucucuccagucucuguuuuacaaucuuuauuuugagacaagguaucccuacuuaguccugacuguccaggaacuacuacuuagaucaggcuggccacgaggucacacagacccaccugucucugccucaugagugcuaggauuaaaggcaugaaccaucacaucaucaggauccauuuuuacuuucuuaaaaggguguuucugaaaaccaauugcaaaccaaggggucagagaucuaacaacgaguguacagaagauucagaaggccauguucaaucccuaucauugcuggaugaagggaaaaccaaaaagaacacgaaauauaugacugagaauccacauggaucacuaaggcauaaaauauuuaauacuggacccuaugcagaaagcacgccaagccuuaguuugugguaccaagacacuaggaaguagagaccacaggaucacucagaagugcuccuuucucaucagaacauauuucuauugauuaaguuccaaaugucuuaacuaaaaaacaucuuacacuugcuuggguguuuagccuugaguaaacaucucagaaaguucuauuucccccuuuagauucaauaguaccagggaaguauuaguuugugauaaaugcaaaggaaggaugucuuaccugggguguuugcuauagccaaaggcaggccuggaagcuggugcaccuggaucccugaaguacccaaugcacugagguuaauggucuggaggccuggcauggaggagaguugagcagcauucacagugacugugccagcaggaauggaggcagcugaggcaauggguguuagggugguauuacugcugcuagucugccccaaggaaacacccugcauaggggccaaggugauugucugggcuuguggguucugaacuugaagauucugcagcugaagggucugccaacugaccuguccauugggccccacgguugguguccgaaugaugaugggaccagaguuuugaacagccugaagcuggagguucugaaggguuuccugggaaauagcuugaguugugaaggucuguccggacaauggugcugcuugaagggccugaagagcuuguccuccuugaacuagcugaggcugaauaaggauuuguuguugcugugucugcugacuuugcucucccucuuucugcugacuuccuugcagcgagccuccugaugucugguucugcuggauguucagagaaucagacccuuguagcccaccaacccucuggggcgucuggccuugagaacuagucccugaugagccacugcugguaaaguucauaauucccauguugcuggugguaguaguuguugaauaacuauuggcauugguaaaaaaggagcuggaacuagcuugugaugacaccaagcuggcagaacugauggcagucccugaggugacaggcugugagcugcucuccugggauccagagcugcugauagugccugccugagagcugggagucaggguagcugcagaaacgcuguugacagguagcaaggugauguucccauucagggccacugguacauuggucacauacugagucuguccugagagcacauuauuagcaaggccuugaagggggacagccugcuggaguagauuuggcauagcagcaauaauguugcccccacuuccucuauuugggaugaucuguugguuugcaccugguaugaucuguauuugaccagaaccauccugcugcacuugggccccaguggcagcaaacugcagcugcugcccaucaacagucuggaacugugggauuacuugauacugaauauuaggcauuacuccagggagaccugucagaacuugcugguucuguaaguuggggguagcagccacaacauacugcccaccagagacugugcgguucuuggaagacucgcugccauugguacuguugccacucuguuccuuugagguagggguagccccagaggaggaagagaugaucugccagccauuggcacccugugaaaguugugcggcugugaggucaaguucaccugugcccccugacugacucggacccugggaguuguugcuguucucauugggugacucaauucugcugcagguugcugccagcagagccaaaggagauggcugggauuccuggccagaagagaggaaaggaguuaguggcacccaauagcuggccuagggggcaguauucaacagacaaaacagcaacaaugcaggaauauagagcaaaaaccagaaacaaaaugcucacuuucuguauacuguuccaacuuucguaucuggggacccucuagaucaccuaucuuucugaguguacuucccuacuguauuuuucuucccagaauuuuugguuaaggaaguuucuaagaauauuuauacccuuucaacacauuccccauccuugaucacucaccugcccuccuccgccaccacugcugcugcuacugccugugcugcugcuucgagucugagaaaaggcggcaccgccaccauugccgcuacccccauuauugccaccaacaucuuuuucaaucuucaccacagcugucacuucauccauggagugaucuuggucuaaaaauaauuacaaaagaaauaaauuaaguguauguguguguguagggggggguguguuaaaaacaacauaagauuuaaaauuaaggauuugaccgucagcaaugacugacagaacaguuuuuaaaaagaucuuagccagauaggucuaaauauggugguaagccuaaaaucccagaauuuggaaguggaggcaaaaguucaaagaaauccucagcuacauaguaaauugggaugccaaagccauagacacauagcuuaauggugcccaagacaggccacuauuuuccuaugcacaaauuaaccccagaaaugacucaaaaauugcuuuggaagcuaggcauggugacucacaccuauaaucccaagacuuggaaggaugagccaggugguucaccaguucuaggucuuccaggccuacagaguaagaacugaucccaauacaaauagcccuuuugagaaagggaauuuggaauuucagugucucagaaauaaagaguugcuccuuaggguugauagcacucuuaaucccagcacucaagaggaagaggcaccuagacagcuaaaagucugagggcugcaauaguaacuucgaguuacuacgaauaccacauagaaccuaucucaaaaaagaaaaaaaaaaaaaaugcauccuggaaggaaaaggagacccaacauguggguggauggaaagugugcuaaaauuaggacuauaagagaugaagaaagaucuaguguaaacaauaacaggaagggacugagaaagaguaaauccuaagagaaggugaggaaacaucugagaggacagguaagggucuagggauuagaacccagguuuggggcugaggaggcgguccaaagaaggaaggggcgguuucggggauagaggcguggcaagggcgggucggaugggggaagggaaauuuacgggggugcgggggagggcccggggcaggcugcgaccggagggcgggcggaccggggaggcgguuggcccaggcggggccugcacuggucgggccgcccccgcggcgccagcccccgacgggaggagccucaggcggccggccggguagugggggguaaggcccgucccucguggccggggcgggcagggggcgggcgaggccacgcugcccccucccccggggcggguagcccaucccccuccuccuccgaggccccgccacugccccuucucccucccuucccuccgccccgggcgggaccaaggccgccgccgccgccucccgcccgcccccccucacagcggggaccgcccggucgguccucgcgcgcgcccccucacuccccucccaccccuaggcucggaguggacucauccuuaccgcucaugguggcagcugaggggcgagcucaaggggguccuguacggggggguuggggggggccgggaaaaacgcggacgcugacgaggcaagcgaacccggaccgga

SEQ ID NO: 12227 - RNA, 10059 nt, Mus musculus
cuuggaaaguccuauaagucugccuucauuugggaggguuccaauaaaguuuggaguggccacacagggcugcuuuuuaggugcauuuguggaaauuauaaagagccuucaagcgcucugugcuuguccugcugugugagccgaggagccugccucuugccacuuccugcacuuccgccugaccuccacaggagggaagcaggagcccaggccuggcugagccccugcugagcugcugaugcucuuugcucagcugccacauccaagucugcucuuuacugagccagcugcacagccuuaccugggguguggagcucccaggcuuccuguuagcuuucuugggaggcaggguccaggagcucuguugccccagugaagaacauuggucccugauuuuuauuggcuuuugggugcucccaguuauucucuuacagguucaguuuugucucuuaaguagggacagucuuucuaagugauagccuguuaauucuuuaucaagagcaguauaucucgaggaccauacagucucacugagaauuacagugaagggaaggagggcauuguggggguguuggaggcgcgggaaggcuuaaacuugaagcaaaggaaaguucccuuuuguuuucugauaugguguagcaucuaccuggguuaaaaggcaagaccugccuaggcauuugcagacuuaauguaugaaagcacauauagagaauuagugauuuucaaauuuauaccgaaaauagaccaaagaucgcuagcugcucugaugaauauugcugauagguuaaaaaaaaauagcuccuaaaauuuuacaaucuccagugcuguguaucccuuccccagggccuuuuaggugaaagcagaacaucuggagcagaugcagcugccucucagccuuccuggggaagcuuguccccgagagaagcugcagacgcucacugggccagugcccgcgcuauguuuccugagacaaauuccugggaugaggguacauugugacuggaugaggggcgguagaguuaggcauggugguggaagggucaggaaacaggggguggagcugggguggagauccauggguggugggcaaggcaggugaaggagggaaggguguguguccaucaggagcaaggcuuggagaaggaggaaguccacccuggagguugaaugccagggagccuuuguugaaagcuccgggcgagaugucugaggcuuccagggucugaagugagguuccagcaaagagcccaugaguuccauucacagguccguguguccuguucagguauccagagauuuggacuggggaccuggagguuugauuuagcugaccaggaguaaucuugacucugaaucccugaagccugcucagaaguccagggccagcaguucuggcugugacacugaaguucgucuccaacaauccagaaguccuguuugggaacuuguuuagugugaggaguugagaaguacugcuugggacagcugugguuggcaggguccgucugacacagagggugggaccuucuaccagaagcaggaagcgcaccuuuccccgaagcaguuguugcaagcucaagaagagggcauugggguccuugugagcugugguccugcccuguagaggaagcugagggcagaggaugggccugaggccagugaguaggcccacauaucaggccucuucugaauaaggagaaaagauuuauugccagcacccagguaucacgucugggaaguaucacuccguauaagccaaccuucauacacuggaagcaccuugaaucccuugucuucccccagguccuuaggaacugaauaaaaggguaguuucuauagguuuggggacuuaccuggguuccuaggaggcccugcagggcccccaagaggaggcgaaccugcccagaaagcugucccaggagggaugagaggcaggaggguuccaacuguccucgugcugccaucacucccuccaguagaagggacacugccccuagaauguccugugccuugcucuguuccugggaaagaaaaaguggacugcuuaaaaaaaaaaaaaaagugcuaagaauggguggggagcccauaggaguagccagaaggaugaaucauaggagcugagaacuggacaggaugagggucccacccaucacaggaauuccuucacagucuccuaauaacuggucauuggccucugcuucagcaacuccaguguccaucaguguagccuggucuugcauagacucuuagaaagccacuccaccuugcagcagcuuuuagcucuaggcugcagcauuguagccuuauucuuuucugauacaaaacuguugcccacagcacuucuaaguuaaauguagcaacaaaacugucaccauaacccugaagaugaagggaaggggcuuaacaaauggcagagcugaauaugaugacacaugccuguaaucccagcacuuggggggcugagacagggggaucacaaguucaaggccagucuggaauacauagguagacccuguuacaaacacagagcuagagcuauaauucauaugauucauccuucuccugacccagaaucccuaggagacuugaaaaggggauucuacauaguacagguaugugccaccuggcuugcuucugcugcuauuguuuauuuuuugagacaagcucucacuauguagcuuaggcuagccuguagcuccucaucuuugugcccggcucucugagcugcuaggauuucugguuugugucacuaugcccagcaaggauuugaaucuugauuuugccuuaauuuagugauacuuucugcuuuaugucacuugugggcagcagaucagauuacacaccaacuuaagaagguugagaagcuggucagugauggcgcacgccuuugaucccagcacucaguaggcagaggcagauggaucucugaguuugaagccagccuggucuauagagcaaggauagccagggauagacauaaauacacccugacuugaaaaaccaaagaagaaggaggaaaaugaggaggaagaaggaagaagaaggaggaggaggagaagaagaaaaggaagaagaagaagaaaggaagaaagaaagaaaggaauaaagaaaggaagagagaggagagagagagagagagagagagagagagagagagagagagagaaagagagagaaagagagagagagagcaagcugaguucuugaaauggcucagaggguaaaggugcuguggccaagcuuaauggcucugaccucuauguggcaugugcugccauauauauauauauaaacaaaugcauuaaacaaaaagauugaacaagaauaagaguaggucaaaaguauggacaugaagggcuucuaaccaacuuuuuaugguauucaguuuuaaaucuuuuuaucaugcauauauauguacuaucucauauauauguguguguauuauauauauauacaaauauacauauauacaaauauauguguauauauaaauauacauauguauguauauauguguauguacauauacauacacacauguguuugagauagugucucaucccugacuggccuugaacuuucagagaucuguuugccacugcuuccugagugaugagauuaaaggcaugaaauuaaaguccuuccuauuugauauauuggucagaaauuugucauuguuuucuuaagagcucauuauaggugaauguaaccugggauaagguggccaaguugaaaguaagacuuuuuaaaaauucaagaauuuuagggagcaggagggaucuguaauaacaagacgaucuaggaaaggcaauguaacacauuuucuuccuuuuuuuugagauggaagucucacucuaguccauccuggcccggaacauccuaggcuggcaggugugaggccagcaugccugaguccaggagccucuuaccgucuggguuuuccauucucccaggcuaaaguccacagcaggcagcagaacagggauagacaaagggucgacgucgggacacugacucuguuaagaaagaugggggcaggaggaaaaggcugaaauggaagucaggaugguggccccugacugggguggucuuccuuaguaccaugcucaugcuggagccucuaagagaccaaugccaagcauagcccuugucagggcuaagacaugguggucucgccaaagacaauacuggagugagaggaacuguaggcccaagucccuuaacucaguuacauggguaaaaagcagggggcuugggguugcucaccagucggcugugaaggaggugggagucacgcagcaguuuauuuaggagucuggggucacaggcaggagcuacggggcuggacagaguuagucuugccacugcaagaagcauggccgccaggagcaaaucuuggaugaggagaggugacggugaaggguggauaaggagaaacuuauucucagguggugacucagggauccccauuugggccagaccugaaauccaggggucugcuguccagacagaccccuuuucuaggggagacugggguucccagcccucugcccaccugcccugcggccaagccauucuugaacuugucccuagcccuucauguagccuuaccagucagcuccauucuggccagggugucuaacugaaguggcucccuguauggggccucuccccugaaucuuuccuggggccauggaggcggcuugagcuucugugcuucuuucggcagagucgggugggagagaggugggccaaggacucuguccugaaaaugacagaaauagugaaucguucaucagguuucaaggaaaagacuuucuggcacgggaaacgggugcuuggaggccuugaacugcuggccagcuagggccagagcuguuuguguuccaacuggucccauauuuucuugugacugaagcauuauagugccuccucuuguaacagcucuucagugacucugauaagaucuuggugccaucuaccaauuguugcccugcuaagagcagcgagauguuacgcacacauuuuaaguggacucaaauucugagcauugguuguuagcugggagagaaugugggacgggaauagagagggguguuguuaaguuuggagaagaguggaaaaugggucaccaggccaagaagaaaaagcaaaugggcaggcaaauggacacaugcacuaaggaacgguguugggagugggacugaggcagacuggguaaggacauaacagaccaccagaggcaggaauuaaaagagaaacuuggacauucuuucccuuuuggcccacaaauaaaacccaggacuuuucuuuggauuuucaaguacucaagucaaaguggguaauagaacuaggacuucuuuccugaggccagagaccuggguggcacuuacagagcaagaugauaucugccucacauggcuuccuucaccuuagacacugccagcguuuuuuuacggcaacugcaucugccucccugcccccuccagaucccuuccaggcccuuccugggacccucgcuuuucacaaguugagcaaagaggcauuaggacccuccucuuuucacaaguugagccgagaccugcaccugauucaauauugggaucuccuguaggucugucaacagacacacgccccccuccuguuacccucuuuccgugccuuggcucaccugacccagcuucccagugccagacucagaaccuuaagcuaacaagaaugaccauaugagggugggaauuaggauuacguuccucuggacaaaguucuccaggccugcacgcacccccuuucuuauuuucucauggccccaaagcagccagaccuaugcugaauucugagucugugaauaaucccucauaaaccagcuacccaacccccuuucccugcucuguccugcuccucccauucugggaaggcuccacucuucuugacaaaggucagugccuguagguuccaguuugcuugccccucccccagcuaagagcccgguucuuuuuuguucuucauaccauacccccacuuaaccccaaauggugcuugccacucaccggguggagaagggccucaggacccaggugcacagcaggcagcacucuggggaacaaguagguaggaagacacugguugggguacagccccuccucuguaguagggucacaagccugcccaggccacuuccgcccaaucagagagcagagagccaccaagcccaggugaaggcucccccggaaaugacgacuucuuuuccugucuacugggacuagagcccauggcuggaccaugguccaugaauagagcccagcuccuccacccacacacacucuagagagaauuuguauagcgggaacugucucauguccuggcgacaugagaaccugggaccuaagugagagagagaagaggguuaguccaggagaaaucuggcagaauacgguucucucugggaaagagaggucuuguuuuagauggaugaagucucaguuccuggcucuccaaauuucuuuucccugaacaguauaccugcugcugaauucugacagcaugcuggcuugcuugcuuuuccuucuauauuccccugcuccagaggagugucuuuccuggcauuuccccuuuccaacuggcaaaguagguauugccuauauuagaaaaugaucacguuaucagaaagacaguauggacaauaugugggacccgggaaguaaagggauauguguuugguuaagauugagcccagaggggcuggugagauggcucaguggguaagagcacccgucugcucuuccgaaguucaaauaccagcaaccacaugguggcucacaaccaucgagaucugacucuccuggagugucugaagacagcuacaguguacuuacauauaauaaaaauaaauaaauaaaaaaaaacaaaaacaaaaaaaaaaaaaaagagcccagagcugggcagugguggcacacuccuuuaauucuagcgcuugggaggcagaggcagguggauuucugaguacgaggccagccuggucuacagagugaguuccaaaagauugagcccagagcaugucuugauucucagcacuugggaggcagagguagguggaucucagagaguuuaaggcuagccuggucuaccuagugagccagggcugcauaaugagaucuuauuuaaaacagacagacagacagacaaacagacagacagacagauugacugggcucagucuuucuacuagggguacagggaccuggagcgcuaaacccccucagcucugugggcaagccugcccuugauugcucaaugauccucuucuaguccuaccacuauacaugugacaagagaaauaaccaggcccaucugucccugucuuaggaaggacagcugccgagccucccccacaaauaccucuuugcuggcuccucucuuccuuuggcccuggcucuagcuccugugcuuucuccccagucccugucuccccacagucucuguccucagggaccuuguggccugacccuguccucucucccuugucuuccucaggcuuucucugcgccucagagaggaugggcuaucuacugaggcguauggccuggaucccggaauucuccaguugaauaagagaugccuucuaagauuaggaagccuagugcugggauagugggaagaacggugcgcgcgcgcgcgcgcgcgcgcgcgcguguguguguguguguguguguguguguguguguguguguguguguaggauggggaggcuugucuagaaaagcaggacaaaggagguggggacugagcuggagaggaagagggucaucucuuggaugaaggaaaagcaugagagagccagaggugguaguuggauggacuugagagcagguuggggugcuggugaauuaugacuccacucagggaagcacugcuugauucugggaagcacaggcuagguuccugucccugggaagugaagaaagaggagagaccuuagaagggaaauaggaauacagccagagugaaaggaagggggugcuguggguccuagguagggguggaucggugucauuuucaaagacaaguccucauccuccagcggcccaucucguucaagagugccacaggcccgaggcucagccucugcccuucacuagccugagccucuggucuugggguggacaccaccuccagggguggucgcaaggagcgugugugggggugucgaggcccgccucuccucucccucuuugcgcccccuaguuccucccuucccccuacccacuccgcuccccccuccuccagucccucccuccuccccugccgggucccagccugucccccucccccacucgcgauccggccgcugcugcugggccggaccccccgggcucagccgggcuccuuguggagccgccgccgcgccccguuugcugaagaggaggccccgggcccggacgccuggcgcgggcauaaaacgggccagagccggcgccuagggcacuaaaguggaguacggcccgggucagcgccccuccgcccgcucucucccgccccgcccggccgggagccgaccaggcgacugugagacgagccccucgccacugccccccuccuggccccggcccccuccugccggcccgccuccgguccggcccuacucccucuccugcucccuccucccgcccgccuccccagcugucugcuccgcgucaugccgagccucccggccccgccggccccgcggcugcuccucgggcugcugcugcucggcucgcggccggccaguggcacuggcccugagcccccagcacugcccauccguuccgagaaggagccgcugccuguccggggagcggcagguaggugggcuccagggggaggugcgggaggggagucugacuccuggcaagucuacauccacagggagagggccccgggcgcagguggcuucgcgcagcgggagggugggaggggaaagcagaggcggcgaggugcacggugccaagggaccaugggccuggcgggcagagcccggagcaggcauuacggcacgagcaaccggacagcggccgccagccaagcccguccccgcaggcugcuccuucggcgggaaggucuaugccuuggacgagacguggcacccggaccugggggagccuuuuggggugaugcgcugcgugcugugcgccugugaagcggugaguggauaacgcagcugccugcccuacucuagaggguagcggaacgcugguguccuaaguaguagacucggagaugcucaggggaaggcugguccgcaaaucggaggaaaccgcuuucaagucugcgguguugacaguuauugaucgcccacaaugugacuggcuuuuagccaacuuccccccucccguuacaguauugcuagauaaaugacauuauuaguucuacuuugcagacagggacgccgaggcucagagaaguuaagaaacuuuggacgggccauguaacuuguaaauagcagaauugacugucugcagcccuggggucugaugguuucauucccuuaauuuuccuauguucucugccaucagccucagugggcucgccgugggagggguccuggcagggucagcugcaagaacaucaaaccucagugccccacccuggccugcaggcagccgcgccagcugccaggacacugcugccagaccugcccgcagggugaggcccgcugugcccggaguuaggaggguggaaggcucuacacuagguccuguacgacuugcaucgcggaggaggacugguccuccugguaccuuucugaagccagccgucuuauuccuuaccccggaugcagagcgcagcaaucuagauccacagcccgcuggccuggucuucgaguauccaagggauccagagcaucgcaguuacagugaucgaggggaacccggcguuggggagcggacccgugcugauggccacacagguaggcugggguggaggugggccugaugaaguuugagucccgcggcaaggcuugacagugcucaggccaucuucucuucucgaagacuuuguggcgcugcugacaggacc

SEQ ID NO: 12228 - RNA, 32493 nt, Mus musculus
accucaaggaaaucguggcaagauggcgucccuggaucgggugaagguucugguguugggagacucaggugagccgcuuaacccacgucugggacuaccaacacgcccgagcuucccgacaccgcucucucuucgcuguuuacccccccagcugccuagcgcuuaggucgacagcugaaauuccuuucaagaccuuaaaacuacacuucccagaggacuuugcuccuuuugucgacgugguggcguggcgggagguggggggcgcggagucuauggguggaaaagggacuaguuccacucacuaucacuccuagugacccucuaggaaaauuuuugcuuccuguccccacaacccuagguucugcuggccuagaaguuuugguuccagagaggggagagcuccuaccaggagccacaaaaaacauuccaguucuuccacugcaagcuuuguugcuggggagugggugugggguaagacauggucucacuaaguaguccugacuaacguagaacuagcuauguauaucaggcuagucuaaaacucacuauauaaacaaggcaggccuaaaaugaagagauacaccugccucugccacuguauuagucaggguccucuagagucacagaacuuauggguaguuucuuauaguaagggaauuuguugaugaccuacggucuguagcccaacuccccaacaauggucagcagcagcugugaauggaaguccaaggaucuagcaguugcucagucccacaaggcaagcaaacgaagaagaaucuuccuccuuccaauguccuuaaguaggucuccagcagaagguguagcccagauuaaagguguaggccucccugccuggugcugggacuugcuuugucccagaugaccuugaacucagagaucuccuugucuuagucuccugggauucauagccacuaugccucaagauccaggucagaaacuugaaucucccagccacgagaucaggaucacagugagcccuccaauucuggauuguaguucauuccagauauaguccagcugacaaccaagaauagccacuacagccgccgaccuucuuuaagacaagcucuccccuuggccuggagccccuaggcuaaggcugucaggccaacaaacaucagggauugccucucucugccuccccagcacugacauuagagacgugugccucuuugccuggcugcugugugucaguucugugaacacaacucggguucucaugcuuguagggcaagcacugagccccaugcgguucuuuuguuuguuuuuaaguacacuuuguauaugaucacaauaacaacaugguauaauagagaaagucauauggcuggcaauagugcucuaaggugauguuguuguuugguuuuuuuuuuuuuauacuuucucaguuuuugguaauagaguuuuuauaauaaaaaguaaauauuaaugauaggucuauauauaacauugcacaacaaagagauuucccaaguguuugauacaauuaacaacagccagguaaaugaaugagugacuccacacccgcaaauaaaagacucauagccaugaaaauagaagacucaucucuuuccucuccaccuagcucuugaagaggugcccuuuaguguuaaugaaaagauugccugagcccaauagaucuaaaagggggugaagcauugcuucaaaauuaauaggcaugaugaaggaaagcaaguggaauuaccaucaucgucauucagaggauaagucugggaccaugugguuagcugcuuuuuucagaccuacauguaggcaccaaaguccuuugaguaugguagcauggcaucauggauccugucacgggagguauucaaacaauuuguuagauguucccuggcuuggaagaggugguauaaaugucccauuuaggguuccauguucagcugacuaaagagaccuuguaucuuuacagguguugggaaaucuucacucguccaucuucugugccacaaucaaguguuaggaaauccgucauggacugugggcugcucgguggauaucagagugcguguucuuguuuaguuuuuccuuagucauacuaagcauaaguccuucagaucccgugauuaauuuauaggacuuaauuaaaauuaacacuaauaacugggauugauuuagcucccacugugugucaguacugucauuccuuguuucaucuuucuuaaacugugaaauacaaacacagaaacucagucauagaggaguaaauaacaaccaaauucauucaacucgugagaagcgaaaguaacacgugagcccaguugucuguuugcacaggcuuuuauuuuaaacacuagauuuggagugauaauguuaauauccuccauaaauaauaaaguuaguaucuuccauaaauaguucugccuaaagcuguaacucuaagacugcaaauuugggccuagucauaccauguaaaggaaaaaacuuccagagccuugaguagacugucuguucugugucacaguuagguacucgauagaguuuccacuaaauuaagucauaauguuuaauucugggcaagucugucaucuguuggcacguuuucuuaccacugaauuaagaacaaguacagggccuuguuagaacaacucaccaggucaacacccuugcuguugaggcuaaggacccaaguucaguuccuaccgauucacaugguggaaacaagaaccaacuccagcaagcuguccucuggcuuucauauguaugcccuggcacgugcacucccacaaacacacacacaguaaacaaaggaaauggggacaaauuaagaagugauagugauauuaccagcuguuuuccucuguccuuugaugcugugugguguaggcucugauauacugauuaaaauuuuucuauucaauuaguuauuauucccucuuaagggaauuucuuuucuccagcugcuuuuaagagauuguguguguguguguguguguguguguguguguguguguguguguacuguuuugccguaaugcuaaccuaaccuaugucuuggucuaccucagucuucuacucagaaguccugcucaggaugcccucuccucugucugucugucugucugucuucauucccuccacccauuccuauugauuuucuaguggauuuguuguuuuuaacuuugaacuccauccucauauauccuuuuuuuucuucauuuuucucacugccuucugcaauaugcauuuauaccugccuuccaguugacuaaacaucucucaacugugcuuaauauguuaauauauagacucuguuuuucaaauaauauacauuaaauucaguaacaacuuuuuuaucaguauucaaguuuuucaaaaucuuauuuuucauuguggauuucauuuuuaauuaauguguuuuucacagucauuuuguaguuucuuuuagauuauaguuuguuuuuugaggauaaacauccuauuuguuauauaaguuauucuacuuuauauagaaguacaucuuguaugauuuguaauucuuggaaaauguucuauccuuuauagauuuuuuuaugugcaucaacguuuguucaaauguaugucuguuuaccacaugugugcagugccuacaggggccagaagaagaugcuagauccccugggacuggaguuaccauggagcugcccuguguggauucugggaagagaacccagguccuuugaaagacuagccggugcucuuagccaguagccaucuucccagcucuauguccacauuuuucuaaggaacccacgugccucuuuauggaagccuugugugcuauucugugcaaggauccuuguuuccuuuugccuuuguugcugccagagcucuagcaauuucaauggcacucaaaguuucuaucucagcaucccuguggcaucugagccucauggcuuccaaccacuggggccugaggcuuccauuucauacauaucuucuaucuauucugcagcagcccacccacagucccugaccucuggggacaguucuuauagccuccuccuccccuaacugaggagcucaucaaggguucccauuucaagaugaaaauggcaguaggguccuuaucacucgcccacacauccuuaaaagcuggaaaaugaguccgcuauuccuguacagcagugagacuccaggcacuugcuugaagcugucuguauccauguccucuccacaauguuucuucauuuccaacaucuagacauuucccuuccuuuuucuuucucucucacuaguuuauguucucucucucucuccuucucuccuuccucccucucaaaauauuuuuauagcauuucuuugaguuugaaguagaaauggacuguaucauuuuagcuuacuguguuuuuacauucucagcuacgcaagaaaaccagguuuaagcaaugaauucaaaugcaguuuuguuaagguuugagagacccagugacagguucugacaacccuuucuuuagacuuuacuaacucccuuccugugaaagaucacagcacauuagaaagaaacuuagauccuggaucaauugccuuucuacuuaaagaguuaccuuaaacuaaucaauauaccuccugaggccuacuucuaucauuuauaagagagaagaaaauuacaucguaccuagcuuugacauaguuuuccgccccuccuucuauccuagcccagccuguaucccuguccccacccagggccagguagguucaugagaucaccuucugucuugugcacuuucacuaugucuuauuaaaguggcucauauccaggacguuuuagaauaggugcgccuguaagaauuaucugucuuucauucccaaucccaggggaaguuuuuaagcacagagucuauauuuauauuugugugugguuuuagggauuugugcaaaccaaagagcaccuuaccacugaguuauauccuagcccacauguagaauuucuuguacauauguaucauuuuaaaaguuuccuguacuaguuuauugaugagaguuuguauccuaaauggcuauugaauuuuauuuauucugccuucauaauaaucauuauuuuccugcuuuacucuguuucuugauuuuauacauuaaacacaccuugccauccugcacuaaauccaagcuuuucucucugucugucugucugucugucugucucugucucucugugugugcaugugucucucuuagauccuuuuauacacuuacuuuuauuugucuaggguguuuuaccuauauuuuauagcuauguagcacaugaacuggaguuacagccugcuguccucggcucuguggggacugagaaccaagcccagguccuuugggagagcagcuagugugagcucuuaaccccgagccaucucuccagcccuguccucuccaagcuggucuugacauauuaaucuagaacaguguucuaggaucuagaaucaguuaucuaggauuuuuucagauauuugcacccaaauucaugagaaguauuagccuauuacgugaccuuuuucuauuucuuugugggguuuugauacugugccaaccuguucuuccaaagagcuuuauaagauugaugcuauuuaucauuugaauuuacaagugaaacuaacugagccagugauauucuaugagagaaguuuuuaaguucaauaaagaaaacaagaaauugauggcauuucuucccuugucaauuuuggagauuuguauuuggaaaagaauuuguucauaucaagcaaauugauaaacauuguuucucugccuuaguugcuuuuaaugagacaauucaacaauacaaccacuacugcacauccuauaaaaucuauaggcgaguuaguaucuauaguauagaugauuuucuauuuuucuuucuuuuucuucugguauaaguaacugauggccuugcuuuuaaaauguauauuuauauauggggcauauguaacauggcacacauguggagggcagaggaccaguugccggaguguuuucuucuucccccgcccgcccgugugggaucuggaaauugaacucacguucuuagaguuaguagcaagccagccugaguuuuauucucuugaucaguuuugccauggucuagcaaagacaaguuucaguuuguuguuuucuuucuaugcuuuguguuuuuuaggggguggggguauaugugcacauguguguaggcacauaugcaagguggcgugggaaaaugggaacuuauauguggaagccagaaguuaaccuugcauggcaguccucaggaaccauccaucuugucuuuuaagacagggucucucuuuggccuggagcucaccaagugggcuaggcugucuggccagcaaaccccaggaagccaucagucucugccuacccuacuuuugggauuaugagggcaugcagccacacccagcuuugaaaacacgggugcugggagagggaacuccggcccucaugcuugcccaggacuucacccgcugagcagucucuccaucccuguauuuguuuugucuuucacaguaaagccaaugccucuuuagauuuaauuuacucuccuucucaagcuccuccuugaaaugaguaguugcuucauugauuucuugcaagcuucuuacagagcucugaggcacccaaacgucugucuaaacacagugucagcugccucguuaucauucaauucaaaauauugucuaauuuccauugugauuucuccuuuggcucauuuguuauuucaaaugugcuuccaauuuccaaacauuugacaguguugaugaucuuguaauugcugguuucuaguuuacauucccugugcucggagaauaucuacuauauaauuccuuccuuuaaaguugacugagauuuccuuaugucuuguuuuagggucgguuuuguuaauuauuuguuaaguagcucauuucuaagucagaaagaaagcacacaugcauucucugucauuacugugugcagugugcugaccauuacauccagcuuaguaagcauuuuguuuaauuaucucugcuggguugcuuuuuuuuauccguuucaucauuuauaaggaauaaauguuaaaaucuuucacuauuugugucaauuugucuuuuguuguuguuuaauucugccuguuuugauauuauaugcuaguuugagauugguuuuugguuuuuuuauuuuuugucuuuugaauuuugcuuuauuagauaguuucuuuauuuacauuucaaauguuauccccuuucccaguuuccccuccagaaacccccuccuccugcuucuaugaggaaccaccagacugauuuccagagugguuauacaagcuugcaauccuaccagcaaugguggaguguuccucuuucuccacauccuuuccagcaucugcugucaccugaauuuuugaucuuagccauucugacuggugugagguggaaucucaggguuguuuugauuugcauuucccugaugacuaaggauguugaauauuucuuuaggugcuucucagccauucgauauuccucaguugagaauuccuuguuuagcucucuaccccauuuuuuuuuaauuucuuuuuuuuuaauuagguauuuuccucauuuacauuuccaaugcuaucccaaaagucccccauacccuccccccgacccucccacccacccacucccacuuuuuuggcccuggcguuccccuguacuggggcauauaaaguuugcaaguccaaugggccucucuuuccagugauggccgacuaggccaucuuuugauacauaugcagcuagagucaagagcuccaggguacugguuaguacauaauguuguucuaacuauaggguuguagaucccuuuagcuccuugucucuaccccauuuuuaauaggguuauuugguuuucuggaguguaacuucuugaguucuuuguauauauuggauauuagcccucuaucagauauaggauugguaaagacuuuuuucccaaucucuugguugccauuuugucuuauugacaguguccuuugccuuacagaagcgcuggaauuuuauaaggucuuauuugucgauuguugaucuuagagcauugguguucuguucaggaaauuuuccccugugcccauguguucaaggcucuucccaacuuucucuucuauuaguuucaguguaucugguuuuauguggagguccuugauccacuuggacucgagcuuuguaaaaggagauaagaauagaucgaucugcauucuucuauaugcugacugccaguugaaccagcaccauuuguugaaaaugcugucuuuuuucuacuggaugguuuuagcucauuugucaaagaucaagugauuauagaugugcggguucauuucugggucuccaauucuauuccauugaucuaccugccugucucuguaccaauaccaugcaguuuuuaucacuauugcucugcaauacagcuugaggucaggaauggugauucccucagaaguucuuuuauugagaauaguuuuagguauccuggguuguuuuguuuuuguuuuuguuauuguuguuguuguuguuuucccaaaugaauuugcaaauugcucuuucuaacucuaggaagaauugaguugaauuuugauggggauugcauugaaucuguagagccaucucuccagccccugagauuguuuauuuugccugaaggauuucagggcguuugaacucaaguuuucagaccuaugcaacaaguacuuuuaccuacugaguagucuuacuggccccuggauuuaaccuuuuuuuguuuugguuuuguuuuuuuguuuguuuguuuguuuguuuguuuuuguuuuuugagacaggguuucucuuuguagcccuggcuguccugggucucacuuuguagaccaggcuggcccggaacucagaaauccaccugccucugccuccugagugcugggacuaaaggcgugcgccaccacacccggcuuuuaacuucuuaucacugcaacgugucuguuuucugucuggcaguguuuguuucuugaaguuuaaguucucugauccugaaaugguuuaaacaacuauuuuuaguguuucuguauugcauaauuuuccaucuuucauuuaacuguuuaaaugucaugucuuucuaaugugucuccugcuagguaggacagagacaaauuuuauuuuaauggucagacugguagauuucguccuuuaauugaucuuguucuggauauucuaauuuagagauauaccuggccccaaggaaucugcauuuuaagaaccaucuaaggugacuuaaguagagauaaguggggugcuagaucaguuuucccgaugaauguagaggugcaguggcuacccuagaugcucaccaaagccugcuagcaacuggcaauaagaacagagagaagggaguauaaauagcaguccagacuccaaaggacacaaaucucguagguaaugguagaguaauuaacugaaaguaguuuuggggauaagcaaagcauuucauauuuucaacacagaaauaagaucgucaaagaauaaacagcaucuaagcgggcauagaguuguuucuucagaaucuaagcgggcauagagucguuucuucagaaucuucagugggcauacagagucauuucuucagaaucuaagagggccuagagucgucucgucaggauagagcuaguuauuaugauauguuauauaguuauuguuauauguuauauaguuauuguugauacagaaaagugaggcugagauggagcagguuuuuguaauuauuaggucagacuccagaaggaaaguggaaauucuuggagggaggaaauaagaggacaggaauccagggaagccccuccucuauguguguucaaggaagaaaacaguguccugaguauaacuagcagcaaagaucccaaaacaggcguugucucugcagggcccuucauguggagggaaccugaugauuuugggucaguccuagagcaugucagccaaacucgcuaauucucaaaccucuggccuacugaaguaacagcaauucucugagaaacaucucugcuuuggggguuaccaagauaagaagaguucccuuguagucaugcugaaccauaagggcuuggcuuuguuuuguuuaaucuauaagauaguucuaagaccucuggauagcaugaagcugugcaaagggaaaccagaauaaaagcuauaguagacagagcguaugcaauaguguggcugccuuacuggaaucguuauggugcuggauaaagccagucugacuugaauuauguucuucaagaauaaggcuuguaagggcugaaagaggccuagcuuguauuacugcacauuguugaucucugccguccuucuccaagagggaccuguuuccugagugaaacauagguaaaaggcauuuugaaaguauaaucuaaaguugucauagaaacaucaugacuauuauacuagagugagucguuguuccccauagaaaacugauuaaagcguauaaaggccugaugaaugucuugggagaacccugacuguuuauaguacagcugcagugucuguguuacugagccugccagagggagaucucuaggacuaaaguggauuccugaauaucugcucuucagaacucuuguacacaguuacccuguuuagcucaguuuagauaucauaagagccaacuaaaaauagagaagaugaaagugagaauagcauggugucaagugcugcaugaaguuaaugaaucuucucaauaguuauaacccucugggcccacugauuccacgcagagccugcagcuggauugacgaggggguuuuauuuuguggcauucuugacucucuccugguuuccgacuuugucaccucaaaucgaauggccugaugagcgagcacacggcugucccuaauaaugacaagaugcuucgagcuuaaucuucucacagauuauaaauaaggaaauugauuugucauuucuaguucacuuuaaugggauuuuaacucucuaacuuguacauugcauacaaucaauacuuauugaauuucucuuuggguaaggaaacaaugugcaggcacuggggaaaaauaaaaagguauaguuucuauccucacuagggauaugaaguggauuuacuuggagggauaagguuuguauaucauggucuuuaaagugauaggaacaaugauaacuaccaccuauuuagagcucgcuguggcuaggaguccacauacacgggacuucauugaucauuucacacaacaguucugugacauggguguugguggugccccucccugcucagcacaggaggcaugugaggcacagaggugcuaugugauuugucaaggucauguugcuaacaaguggauagacuugggauucaaguccagacagccugaccuauaagucuguaguucuuagucaugguguuaccaccucuuauuuacugcacagaauaaauggacccagaauguaaggaaaugaguacucugauggcacccaguaugguaacaacuggcuucauguggugacagacuugaacugaaugggccauaucucagugccuuaguaguuacaugcugcuccugggcaugcccaucacugaggacagcacaacagggcaacacuagugcagaagaugauagcuguuuaaagagcgugagcugugugugcaaaacgggauucuacuagaugcugaugaucgaguggccugaguuacuggauagacagacuugccccuccucccaaaggguuccaucuuagguagaagagaagaugauaagaaauuaaguucugccgggcgugguggugcacgucuuuagucccagcacucaggaggcagaggcaggcggauuucugaguucgaggccagccuggucuacaaagugagcuccaggacagccagggcuacacagagaaacccugucucgaaaaaaaccaaaaaccaaaaaaaaaaaaaaaaaaaaaagaaagaaauuaaguucuaaacauggcaaaaaacaacucaucuaugagcugucuaacugaaguugaccagaaagcaucugauaaugaggugcuuaaguuccagguaauuuggaauugcugucguguguguauagagaucaaaaugauggcagccaaugaguuuaaaagagaaauaaaagaaaaccuugggggagguuguuuuuaaagaguuauaguuccuaaaagaaaggucagagaaagauugaucaaaguaggacauagccaaaaggaugaacuacugccugagcaaacaugggaagcgccugaacagggguaguacugggcuucacuagaaaacgccugagauaggaggggaaacgaaaagcaaccauuggguuuuaaugaggaggcacuaaccuauggaugagugauugcauguuagugaugaaaaccaaauggagugacugggcagccaggaaaagauacacacaggcuuaaaucauaagccaucuuuuaugaaggcuggaggcuggggaaaaggagcgaauggugcagaacacaggaaggaacuacuuuauggaggaaugagcccaacugaagacaagugagaagucguggaaagagagcaaucgacagggaccuuuaccccauuaauugaaauguccaggauacccguugcaucucuuaguuguucagagucucccaccucucauuuucuucaaacucuguccuaaaaauuccuccuggccccuucuuucuaggggugacuuuauaggcacaguuacuaagcugaacuuguuaacauccauucuuguuuaauguguauuauuauucuuauugaauuuauuuccuuuuaaacauuacagugaagugcuuaaauuaaaugaccccauguuuagucgugauuuguugaucaauagaaaugugagagggagcaggacggaggaggguuccaguucucuguaauucacauaugcuccugcuuucuuauuuugaugaucugacauagccacauguuaucaguuauuuaugucauggagcaaacuagcaguucuuuuaauugcaguauagagugcuaauuuccauucucgaaaagagugcucaacuucugugacuugcuauuaucacuuccuaucuuguugucuuugguuuagucuguuccuuaucuucuuaaugucagugugacuaucuauagaguaccacauguacuuaaauguuguccuggccaacagauuuagaacuaaacaagugaauacagcaaaauacaaagcauucuguugagugugauaugugagguuuaguggguuucacaacaucucuaacaauugaguugccuuugccgucaccauuacuuaaagccaguagacgcuuuagaacuguacagugcaucucccucaucagaggcucagagauucugggcuaggucauggcagucugaacaucuaacccuaguaccagcauaguuccauucuauaaaaucauccuucuccacuacagagcuacagcagaaucauguggagcuuuauaugccuagugcucaccccaaagaaccugauucugcuagccuggcauguauauuugucuuuuuggaagggagggacugagguguggugaaucaugcccucucuguacagacaaggccaacuucaaaugcaugauccuccugccucaaugucucuagugccaagauuacaaguguacucaaccuaccugccucuagauacucauuuuuuaaguuccuuagaaaauucugguguauaccuuugaaucaucauacaucugguuauuguauauaagaaucuuucuaaauaguuaaauauuuugaauagcuaaaugggcaacaaaagccuugaucgacagguggugggggcauacgccuuuuagcacuugggaggcagagacaggcggauuucugaguucgauaccagccuggucuacaaagugaguuccagaacagccagggcuauacagagaaacccugucucaaaaaaacaaacaaacaaaaaacaaaaaacaaaaaacaaaaaaaagccuaggucaugagggauaaacaaugacccugaaguguaauaugacugagaaagccacuggaugguuugagccaaagguugagaugaucucacucagauuuaaaauaauccccucucacaacuguguaaaaagcaaaugagguugggaugcuucuaguagggagucuggccaagggacuguauguuaguuuauucagaaaaaggaguaaccagacacaucuaucuaaaugauaacagcuucagaggugacaaaugaaaccuuggguauguucuuaaagaugaaaggaacagaauuuguggacagaucagacauguaauagggaaggagucaaacuucaauccuaagguuuugaccugaguuacugaaaagauaucaaggauaucucaaccaaaggauugccuuuguuaagaugagaaaacugggaggagaauggguuuaggaagaagacaagaauaucaguuuuggggcuggagcgauggcucagcaguuaaaggcauuggcugcucuuccgaagguccugaguucaaaucccagcaaccacaugguggcucacagccaucuguagugagaucugacacccucuucugguauaucugaagacagcuacaguguacuuauuaauaauaauaaauaaaucuuugagccggagugaacagggccagagagagcagggcugaccagagcaagcagagguccuaaauucaaugcccagcaaccacaugaaggcuuucaaccaucuguacaacuacagugcacucauauacauaaaauaaguaaauaaaucuuuaaaaaaaaaagaauaucaguuuugauagauuaacucugaagugccauuaaacauuccuaguggugacccaguuaauaugauggucuaauauucucaggauucauauaaauuuuagauucaucaacauacagaugacauugaaaucacaagaguagauggaauugccaaagagcagggauugacagacaugaacuagaagaaggcacuguaaugacagaaugggggguggggggcaaaggaacucugaaacagacugcucaguaggaggacacucuagugacagaauaaggggacauaaggacucugaaacauacugcuucaggggagugggaggggcccugcagaguggggugucacugaagcuaagaaagauugcaaaggucgggguaaguaaauggucagauaaaaugaaagcucauuuggcccuggcguuagcaauauggagauaguuggugaucuugaucagaagcacuucaauagagagaucaugcaaagccgaauagaaaggaguucugaagaguaugugauagcaggggaucugaugcccucuucugaccuguguggguacccggcaugugcacaguacacacauacacagaggcagaacacuuaggcacacaaaauaaaaauaaagaaauauuugaaagagaaugugaggcccaguaauauuguucaguguggaaaggugcuuacuaauaagccugaugaccugaguuugaucucuggaacccauucuugcacaaguugaucucugacugucacauguacaucaugguaugugucucccaaauaauaauaacuacuauauccauauguauuaaaaagugucauaucuucuagucauaagcugcacucgugaaaucucaacaauauuguuaccugaacaagaccuacauuauacuaccaguugacaugccaauguggguggagggaauuuuacaagguccuaccucuggaugaagagcuacaaguaaucaguugcugcuaaggaagggagucccccuggcaggauagccaaccccaaguggucagcucuacucagaucuacuuaugggaacaauagucgggggacagacacaauagcaauuggagaggcagagagggaaggauggaaauguaaguaugcuacucauggacugaacuuucaaaaaauuacagugaaaagaguaaggaaacagagcuggagauagagaaccuagggaaccuucucuaugaaaaugaacagagaaacagcacagaggcugaggaagacaaagugcauuguauguuguugaaaauuauccagcagaggagauacagugcuugagagcaggaagaccuguauaacugcaucuuugcaugaggaaauggaaugggguuuacugugcagagcauucaaacuuagccuuaggggcauagacaggaaaguguucaaggacguagaaagagcaggugggggaaguucuuacuauuacugucacuguuauugucacugucacuauugucacugccacuaucaucacuuucacugucacuaucaucauuaucaccgucacugccuuugucacuaucaucacuaucagcacuguugcugucacuaucacugucauugucacuaucauuauuuuguccuaggaaacaaaguuuugggggguuuuuuguuguugguuuuuuuggggggagugggaggucuagagaagagauacuggaaauuucaagaagagaagcuaugacauuaucagggaaaggaaaguuauguccaggagcacacuuagauuugagauucaguucagucuacuaggauguaauuuucugaacuccacauucaggauggugaauuuuggauucauaauggaaaaagaagaggcuguugccaagauggaguguugucagauguaugucguguuagaaaagguugagagucauagagaauguaagauugggucaugggacuugugcuuaguagggagggaacgaaagcuucagaacuaggaggagauaaagauauucacaucaagugugggucacaugacacagggugaaagacuggaguagcguuagcguggaauaggagaguaagcaggaaagcucagcuauggccaucagagucagagagcaggcugggacaggaagggcucuugcuugacuggauuaaggugggugcucaccaguuuguccuauggcuuuaauaacaauuuuaauuaaucuguuagguucaugacuacaaagaagggaccccugaagagaagacauacuauauagaacuaugggauguuggaggcucugugggcagugccagcagugugaaaagcacaagagcgguguucuacaacucuguaaacgguaagugugcuuauuucucccauguuuuaauggucuagaaguacugaucaccugguacgaagugccaccacaugcuggacucaucuuaccgugagauuuaaaucugaauuccacagucucauuuguuaccuucuggugccaaccagggcaugguugccuuguuucaggguuauuccguucuuacuuuuuauuuauacguauguaguauauauucguuuuagaagcucagcuguaguaggcuuccauauauuuuucaaaggucuuuagugacauuucucccucuccauacuccucaacccuacucuuccaccucaauccagauuuaaccuucauguuccauuacacccuuuuacccucgaaccagcucauuuuaucucaucucccucuaaacccccucuccaugacccaccccuccauaguucucuggccucuguaggcaugccacaugaaauauaccugaaaguaaauucccuuuccucuucccacccugaugauccaggcuacugaucucagcagaaagccgacgaagugucuguggcccuuuagaauacauucucacagcugucaggcuuucaucuggcacucaguugacuuuucuagaucauagucuauuaaaaaacaacacaaaacacuucagccuaaaggaaaaaagaagaauuagaaaaaagaaugcccaaacacccuuaagagcucaaaagccuucccuacagagccucaaaagauuaaaauuuucuguuguucaucuaauagccagcgugggugacagcaugacauuccauucuuuggcccggugagauuuuauuuugcuuuccucuaaucuugugcuaucggaaaacuugacuguaaaaguaugcucaccucagcaagacaugcacaacagcaauaucaguaagcauucugaugaggaugggauaaaucucacaaggcccuaccucugggugacgagcuacagggugacugaaggccacaaaagagaaacagucuccucuagggaucugucuagguuguucaaccucaaggggucagcccugaacacggaaacauacaagcagcacuaaauacacucugcaggcuguaacaauaaaugcauauguguaacaauaacuaaagaagagccaugaaguugagagggaguggagacccaggagaaguuggaagggauagcagaagggguggaaauuauauaaauguacucauuaugaaauuuuuaaguaacuuuaauuuuaaaagagaguucaggccugggcauaguggugccugccuuuaaucccacacucuggaagcagccuggucuucaaagugaguccuggacagccagggcuuauacauagaaagccuaccucaaaaaaucaaaaacaaaaauuaaaaagaguuugaaaaucuuuggcccuuguaucucaagaugauguucuaaauuccaauaggcauugaaguuguuaucuccauuuuauuauguaauuaucuauuuugcuuaucuguacgugauauuaguugauuuugagcuauuuuauauuuuguuauccuuuaaucucaaaaaaaaaucuuuccuacuauucauacuucuuuuuuuacaaauuuauuucuuuuuuuauuuguauauaguuuuuuauuauuuuauguuuauuaguguuuugcuuguauguaugucaaugcaccauguguguacuugaugucugcagaggccagaagagggcaucuggucgccugaaacugaaguuacagguaguuguaaacugccaugugggugcugggaaucgaaccuggaucuucuggaagagugggcagugcucuaacugcugagccgucucuccagccuauauguacccuugccucccuuuucuuauucuucucuagcagacucuuugcuaguugacaugagauugggcaucuucacaguagcauggcuguagacucuuuucccuaaaucaguucauuuuccucccucauuguccuuugucccucccuccccccuaccaccccccuuuauuugcacuuuaaggcagugucuugcuguguugcuuugacuagccccaaacucaagcucuccugccucagcuucccuaguguagacuuauaaagcaugugucacugcagugagcuaaccaaaucucuuaaagaagcaagcuuacauagcuagcaaugaauuuaaagaacaaugaauuuaaagaacaacaaaguuaaacucuugaguugaugguauucaaaagaccgacaggagaguguuuuucuauuaaagaacaguaaccaagaggccgagagacagcccagcuguucagagcacuaacugcucugggacaggacccagcucugauucucagcacccacaugguagcuccccacugucuguaaucccugcuccaggagcucuaauauccucucugccuccacaggcaccugcacaugugugcagagacacacaugcacaggcauaaaaaugcacgcuuaagaauagaagaauagcaauugugcugagcguguggcccaugccuggaucucauaucugagaggaggaggcacgaguguuacgaauucuaggccagaccacacuacacagucagcaaagccaguauccucuuguaguaagacccugguuuuguuuauuuuuuaaaggaaaaguagcaguuauaaaaauuaaaguggugccauuuuaauacauuucaccagugcagaaacgguacaacuuuugaguaauguaaucuguuaauaaauaauguucuucauuggugaagugcuucuauaagcaguuccaagcacaaaguaggcacucaggggcuacgagaugcagaguaaaaagacauucuuaauauuuuaugacauucugauagccuuuggaagaaaaaaaaaacauuuuaaaaguauauuaguggcaaagcuuucuaguuaguuauuuguaagcauuuauaaggacaguuuggaaugcuugucugauuuuguuagucauacuugaauacagaucacuaagccccuaagaugugcgcuuacuaagcuugcccuugcugacuauaaagaggugcuaauggcaucacacuaccugauucuuuuaggcaucauuuuaguacaugacuuaacaaauaagaagucaucucaaaacuuauaucgcuggucauuggaaguucucaaucgggaugcaguuccaaccggaguccuggugacaaauggguaagccuagaauuacuuuacaauugguuuuaagugugauuacaauccugagaaugcucuuuaugaaauauuccucugaaggugugucauuaguccuauuuuagccucuacuuggucuuuccauuaucugaauggcauguuuccuggcagugguguuuauuuugauggaaucucauuacuuaguuuuccuacacugcauuuugcccuugguaucauaucuaagagcuguuugcuuaaucucauacagguuuucuccugcauuuccuucuauaaguuuuauaauaugggguuuguauuagauuuaugaucugcuuuaauuuuauauaaauaaugugauuugggcuuaaauuugaauguucaccugucccagcaucauuugguaacaagaguauacuaucuccauugaaucaucuucauucuuuugacaaagucaguugaccauagugacaguacaggucgacuucuguacucuguucuguugauguaugcaucugcucccuugaaacugugagcuaacauauauauuuuagaguuucugucagguacuuggucacagcuacccaaaaauugcuagugugguagauccugacugauuuucagauauugaaccacccuuucaucccaugguuacagugaauucauucuuucauuuuagauguugcugguuuugauugaauguugucuugcaguuuuguuuuguuuuuuuuuuuuuaaucuguguucauauggaauauugguuauacuuucuguucuauaaugucuuuggccuguuugauuugaggauaauuuuggccucaaugucccucuauguccuguuuggggaaagauauuauauauauuugauguuauuucuucuuuggaugauugcuugaauuuaccagugaaauuuuggggcuugcauauuucauuuugaaagguuuuuaacgucagauucuauuuuuuuuuaauaguugccgaaugguacauguauuuuguuuugucucaagugaauuuggcaaauuugagcuguagaggauucaugcauuuccuuuaaguuacugaacaucugugaacaggguuguuuguaauauuauucguuaucuuccuggagucuguaaugacaugcgcauuuucaucccugaucuugcuaacuuguguuuucuuuuugcuucccuuagacaugcuacuaguuuguugauguucuaaaauuuucagauauuuuaguuucacugauuuuuacuccucaaaaaacuuauucuuaaauuacaaguaagagauggcuuauuuauaccagaaaauacucacaucaauguucagaaauucaagauggcauaauuguuacagauauagaaacuguacuuugacucuguaacuucauuugguccucuagcugcaccugcacacgcauuaaacaacagugcauugguucuuuauugcugcauuauuuuaacagcaaaugaucuggaagcaacucugagguccaaaagaaagucuguuaaauaaauaauggucuaguuauauucuggaauacucuacuuuaacuauuuaagaaagcaucaggaauguuucuauguaggaaaauagagaucuacagagaaugcaaaucaagaugcagagaauauacaucauuucccuuguaaugugcaagagagcguguaaaggagugugcauguauuugcauacagcauccaugaaaagggcuguagcucuagcucaguagagcauuucccuagcauacauaaggaccuagguucauccuuagcaccacuuuaaaaaguaaaacagcaaaucgaaagcccuauuguaucuuuuauuucuugcaucuuaaaccuucuuuauuuuaguuauaguauuaagaguaugcauagcugcuguuuucguuucucagagaauuauugugcauauaaaauuauguguuuuuuagagaaguucuagccauagcuguccauaauaaaauucuccgucaguuuuucacauaaugauuauauccaggucuaauuucaauuggauguaugauuuuuagugaaagaggugauaagaaacaucaaagacaaugugguauaauuuucuuuuaaaguuaauauuuaagaggugagucauuauauacaucuguguuucaaugaauauaguucuugaaaaaaugaaaagcuaaaaagaaaaaugaaagaucaagguauauauacuuacaugguaaucuacaaaagaguauauacgauuuuaaauagcagagauuauguauauuaaagauaguauuugauagaaaacacaaaacuuuucaagaaagaauuugugaauauaagaaaaagaaauaauccugaagggugguacccugaaaaccuuauucucuauaauuuaaauuucaauccaaaccaugucucccaagugaggaguauguagguaaccagguacuaguucauaggccuugaacuuguguugguuuccauacaaauaaaacagauauguaaauucaaaacaacucuguucugagacacaacuacagcugaggcucugcaagaugagugugaaagguggggagaccuagugagugacccucuccgcccagcucaguuagagugcuccaaaagacagaggagugcuaagccggaaaaggagccgcgcuccaguggguuuuauugauuggauuauacagcaucgauuguucaaaagcagguuugcugacugcuguaaauugaacuuauaacguguuagaagucuagaucuacuuugcuucuaauaggcaaauagaauuucaauuaauuaacaacaguggacuuuauguuccuuucaguagugagaacuaucauuuguaauugcuacucaauccuuuggguaaaaaugggaagaaacugaauuauaauagacccccuucuaacacuaagagauucugauggccgauccucugucucuuaugacugucauguaaggauaauucuuugguacuggucgucuugccuuuuagaaucaugcuuuuaacauuucagcaguuuuccuccgcuuccauccaagcugugucucacucaggcgccgcuuccccagcucuuuucacucugaaaagguuuuuuuaauuacucauagccaggaauacauaugcaagcuggaggauuugugcaugaagugccugcauuccuugcuaggcuccuggguuuuccacacacugagcuuuaaaucuacuuccuucuuucacacugaaaauuuuugaagcuguuaccuacugaagacacugcauuauggacacuugagucacaugaucaugguguacuugguaggcccucagccauccuaguuaucugcuauaaagagacacagaaacagacuuugaauaauaagaugaagaguuggaauucaauagaugaugggcugaucaugaagauacauuaaagauagcaggagaaaaaagauuuauaggugacgaugagcagcaauaaguuaauuaucacuaaaguuguguaagcaccuugcauuuaaagaauacacaucuacguugggaagguaaauucuauucuccucuucaugguuauuuaccacagggauuaugaccgagaacaguuugcugauaaccaaaucccacuguugguaauagggacuaaacuggaccagauucaugaaaccaagcgccaugaaguuuuaaucaggacugcuuuccuggcugaggacuucaaugcugaagagauuaauuugguauguacuuucaccaaugugugucuagguuauauucuaggcaaagcagcuuuauacucaaauccgcagcucaccaauccagaacaaaucagagucagccugucuagacuaucacaugaaggucucuuucacuuugaacuuguacacugggcuguuggaauccucaagcuauauucugcgaauaguacaaaucauagccucuuuuuugaaaaaacuuaaaaagcauaccaaacucaaaauaauccuaucaauuaaggcauacauugguuauuguuguuuuuggaagaaaaaaaaaaagcucuuaaucccagcacucaggaggcagaggcagauggaucucugagugaguuccaggagacagagaaagccugucucagaaaaccaaaauaaaauaaaauaaguaaaaugaaagaaaaaaaccucuuaacugcuuaccacaacugcuuaauuugaagggcacacaagcagauguaugaggaaguugcacacuguaaaccaggaaugugucauaaggacugauguauauaaagucuuacauauagaaacucugugauagcuagcuuaauuagaacagaaugcuaacgagcuaggaaacaacgcauauaaaccaauucccacuccccagaacaagaccucgcccgcagccucggagguggagaugaguuaucgaugcucauaagcaggauugccacgcugucaguacacuguuguucaggugugcagugcugacugagccaguggccagcacuuggagggcagcuguucuccagaugcaguuguaagguuuacagguaucacaucacacguaauguagguacuucuagcuccauuuuaaagaugaagucaaauaaggcgcuccgacuauacaacuuaagucccuuucccacuugauuacccuucaacuaagauuuaaaaugaaggugcuuugaaaucauuuauaucaacaguuacccaaagcucacugcauaguuauauuaccaacagcaccuaugaauguuuauaaugacugcucuucaagucagagcuuugugcucagaaugcuggcaggagcucacuguuaaugcuuuguuuuguaaugugguacugagccuuacacaugagaaacacuuuaccacugagcuggagccuccgccagaucauucaagugagucugauaccuuuugcucagugaauuaacaucuguaaacauugccucuaccugucugguucagucucugccugcccuccauuguuucuuauauuuuauuguacaguggaaugugcccccuguuugcauuuaccaccauggaauggucaauguaaauaccccgguagucaguguuggauccuagugcucaaguggcucccuaccauauagauuauaaaagugugcuaucucuguagauuagugcugcagugacuuuauuugcacauuauuugccauuaaauaugcauguuuaguuccaguaguaacuugaauauguuucugaauguaucuuugucuagugccuacuggugucucugacaaccagcuagacacauuauuuguccuuaucuuacagaggcuaggccggcuucagcuguuagcaaaaccaaaagauaagcaguaggacagucucccaaggacuuacauaugacaugucuuuaguuugucaguguguccuuucacaacacaacagaaacaauacuagaaguggcuaaugaggauacaaaaaauuaaagugcaggaaggcagaugaauaugagaauugaaaauagagucagacaagcaaacguagaaccucaaacugagacuaauauggugguagcauuagugcuagcucaccauuacgccuacaaagaagccugaauccaacacacauguaucaagaguggagucaggauuucucuaugccuuuguaaaugcaaauuauuuaacuaaaaguaggcacuaggguuauuacguauauagucuauuuucucauguguguuuauuuaguuucuggucguuuuccacauucacacaagcuguuuagagcuucugauuuucaggcucucccucagccaugaucaauggcagauggcuuuuucagcuccaaaauuuucauccuaaaaaggauguaguuucagauuuccugcucaaccuaaauuguggagcccaguaguuaauuuuaugggggagauggcaacuuguuugauugccauuugauuuaggguuuuuuuuuauuuaguaauuuuaacucuuacuuagagucgucauuaaauguucugaugagguaaucaauaaccauuucgcaaaaccaucuaaugcaggucuaagguugauuucucaucugucccaacugguacagaaauguguucaaacauuauugcaaauucagcaguguguacacggugagauacccggguaguuaauccacacaugggauuaucuguauuaaauuaaauguuucugugcuugaaaauucagucugauagcauuuguaacaaugagaaagagaacugaugccccagugccugcugugugacaggcgugcaguaccucuuugcauuucacaaaacucugaauagaaucaucuccguuucacaaaugaguaagcccaacuuuagagccauaaugacuuaagcaggguacacaaucuggaaacguuggcacagauacuugaagacagagauuacuggccuccaagaugcugauuccccuaguauuuuaugaucuuuggaaacuauuguaauuauaagcaguuagcccccuuuccuaccuccccacuccuggcggggggggggggcggggggggugagaacuguuauaguugcugccauuguuuaaagggcaauccuugaaaugcuguguugacauugcuacuaaauggauuagaaggaaauaugugggccuggcuguuacagcaagaaucauuucagaaacugcucaagaggcacggagggcccacagaugcuugcaagacacuuaucuuuaugaaggagucugaaugauaccuguacaauuuggucuugguggcauuugagguaaagaucaaagcugacucgcuguuauuuacaagguguugugaugacuuagugucccaggcugugcagccuccucugagcucugugcuuccuacguaaagaaucuuccuagauaauauaucuauuauuaucagaaccaguaugccuuuuguuauaugaagaaagggagaaauuccuuacaacuguuuguucuuuggcuaaaucuuauuuucauguuuccaacuauuauacagacugcauaguucuuaacucguuaaacacuuagucccuggucugcaguacguguuuacauaaauccuguugaugugauuuuguuaacauaugcaggucaccugaucagucccuugguuuuguuaacaauaugcuaguaauuaaugauggguguguggaguuaguauccuccaauauugcucagaugacaggacuaaauggcugcaccuucuuugccuuccugcucacguaucauaaucugaguauugcuuuguauuuugugagcauuccgaugacuuauacagaauggcacuggagccucacuccuggcuuuucucugugcgccuuugucuuccaggauugcacaaacccacgguccucagcugcaggcuccuccaaugcugucaagcucaguagauuuuuugauaagguaauggcuucaauuaaguuauuuuuaaacuuaacauaugauagcuuaaacucuuuguagaaugcuguguccuuuuguuccuuugcccaaaacuucacagccugaauaccuguuuugaucucucuuaucuguuggaauaauugcucaaggccugcugacguacuuacuccaucgcuagcgcucucuaagcaaagaguaaaggcuauuggauugaguggggguucuuaaaaagauaggagucuuccucaaaacaguuuauagucagcuguuguuuagugcuuuguguaauuacgucucuccagaggcaccgaacagagguuaaagcccuuuauucucucagcuaugaauauuuuccauguaaaugucgcuauuacuuuguaaagcuaagcugucuccuggagucuguuguuucccugugaggaacaucugcacccuccugacacugagcuggagcccugcucaucugcaucuccaggcuaugcagcugccuuaccuccugcccauuucgcauagcagcgcaauauaggacuuuguucugcaugaauuacugaaaaaaaucaucucuauguuaggucuagucaaugcuggaaaaauugcucaaugguuaagagcaguugcuacuccuucaaaggacucagauuuaggucuccaaacccacagagagcugcucacaaccaccugugacucuagcaccagcgauccacuacccucuucuggccucuguggugcacaugcaagcaagcagguacacacacugcacauauacauauaaauaaacauaaaauaaauaaaguuuuaaaauuacagauguuccuuauggaauauauauauauccaguaggggacugugguucucagaggccuaccgucuagcuagggccugggaaagugacagucucuguucucccuugcuaggcugcacagauauuagccuuuucuugggaagugguacaaggaacuauauauucucuccauauuguuuucaaaucuaaaauguugcagcaucugcuugguuuagauccguguccccaucuaauacaaaacccugucccuuaaaacagcauccuauagaucuggguuugaucuggaaaggccacauaguauacguuuauguguuuuaaguguuuuuaaagcuaagagcucuuaagucacauccuagagaaacaauggauuuuagacuagcauagccuaaguuaucagcaaagcuucauucauaaauagauagauagauagauagauagauagauagauagauagauagauagauagguugguuuuaagaaaggaguaauaugcauaagagaggacuucgugaguugggggugaacaacucucagcaaaagaguaagcuagcuuuguugucuaagucucaguaaagaaugcaucagcaaaacgauuggcuggucuuacacaacguguacugaauaugaaagcaaaauacauggcaauacaggucugccccauuuucuguagagaaaaccuuucagaaugccaaggcugcgucgacuagaggugggcuggguccuccagauuuucuuagcuggugauaagucuaugccugcgugauaaggugacucuguccugcugagaacgaggaaaggcaucaguccuuugggggcuucagggacucaguguuucaagguguaugcuaaccagaaaccagguuuucuaccucaaaggccaaugagugcaucuuuguccuagucucauaugacuucaaauacuaacucagacacagucuccaggagcgaaaaccagaauaauuucucuuaggcaauugugagcaagcuucccaggccugaaaggacagguugugcucugugucagaaggcuucccagcuucaucccuccagaugcgacugucuuaguccaucugcaccucaucuguaacuuacuugauguuucccuugcagcagcaccucugcaaccagugcagugucuacagggauagacuggaaauccguauuuuuuauacucuccuucaucaucugaaagcaugguccucaaacccauuguguuaggacgugugaguuucuucacacgagcugugauguuuuauaagauacauccacugcuuuagccugucuucccccugacaaauucagcaagcccugaaaggacugcauaagaauagcagcgaagccugugagggaaacccgcugacugcuugaugcugugugcuuguccacaggcaggaugcacagaauccucgcugcuucacgcagacccgucuugaggauugcagcagugcuguagcgauccuuuaggagccagcuggugggaaacucggccugauugcugcuagggaccuguugggacauuauucuguccuuauuuaguuuccauguguuacuuauuucugaguuuuguuuacuuuugaagcaaagucuuacuucauaaacuagaauggucugaaacucaccaaguugcccaggcuugccuugaacuccuaaucccccuggcucugcuuccugcaugucgggauugacuacaaagucucauaaugauagaguguacaccguauccuguucauuggugaacccuuccuuccuuuagaaaugaguagauaguaauggaaauaaucucacucuuucaauccgguuagcaccagguuuuaagauugugugcaugcaugcaagugugccuguguauguguguguaugcacucgugcacgugucacauauaccacaaguaccugcagaagccacaagacggugugggauccccugaagcuacuugcaggugguugugagcugcccaguguaugugguggaaaccaaauuccaguccucucaaaaagccacaagugcucagcugccgagcccucccucuagccccagcaucagagucuuaacucacuguauuaaauguccagagcuguugaaaaggguuuuaauuuggcaauauguccuaugguugcauuaaugaaaguuauaaauuaauugcuuuuucuggggaaguaugcugagcccuaaagucuucgucuguuuuugcagguuauagagaagagauauuuuuuuagagaagguaaucagguugguaucugucuuuuucuugauaaagugacaucuuaaguuuugaaaaacagccgggcgugguggcacacaccuuuaaucccagcacuggggaggcagaggcagguggauuucuuaguuccaggacagcuagggcuacacagagaaacccugucuugaaaaaaaaaauuuuuaaaaacaugguuucuauuuuuuccuccagacgggauuuuguuuguuuguuuaauuaggaaaagcucucuauaggcacaggcaacaugaggaucugcaggacaagaaaaacccagggaugaggagaggcgcugaccuaaguaaagaagcccccauuuccucaagggggcuucaagucguuuugucuagaguccuccauaacagacacugcguauaaaguccaguuggugauuccaggagauccguccuuucuagauggcccugccacugauuuguuggcaaauguuuucuguauuuguagaguuucuuuuuauuauuuaucauucuaugauuuucugauuggaagcucagagagcaucaggcuggcaggaguuuaguuuuaacauaugacucuuucugcuacggcauaacaggguucuuucuugccuacagauuccgggcuuuucugaucggaagagguuuggaggaggggcacugaagaacuuccacugugacugaguggcccucagcccuggaagagcaagggaacagcagcaguguccacagcuuccucuugcuguguagggacauuaacuucucaggcuuugggaaaaacaucucaaaaugcuaccucacccucucuuggaaaauugaaaggaagcagcggcauggaagguccuagcucugcccauucucuguauccucaccacccugucccugauuauagcuuauguaaaagccuugugacgacauaaaggcuugucaaacccaugcaguaaagaacuggagacaagggcugcagcgaaggcugacucuuacuuggaaccagcggguuuuacaggccugcgauuuucccacacuugcugcugaaggcuuaauuaaguacuucagaaacauaucuguguuguuuuacuuccugaggggaaaggucauguuaaucagcccugaguuauccaccccaaaccaucccugccauuuuaaaagaagccaaaugguguuauuucauuuucuccauccucauuacacacagggaugccuaagaauagcaaccccaucuccucugcucucucugggaaagggcuuagugucugggaagagcgauggacuaauagcuggaguuaaauagaaauacaaauuaauaauacauggcgaacagaccagaagagaagggucugugagacucuaacagcuccucugcuccaagguugcagcugucggaaggcucuuucugcuuucuguuuggaaagugggugaaaucugagaccuguacaaggccaguaagacagauuauugccucuuuggugguucuuuuuguuuuguuuuguuuuguuuuguuuuguuuuguuuuuuuuaauuuucuuuucccaguuugguugguuguuguucuguuuauuuguaaggaaauccaauuccuggaaugucccuuaauacgaugaacaguaagcuaagacuauuauccuugucuuaacaauguauuuaugagaagucaauuacgucccagaguaacgaacucauauacauuaugagcccguguuugagguuucaucaucacgcugcaacguuuuuggcggugguguguauguauauguuugcauaacugguugucauuguuucuuagcccaucuuuuuugcugguuuaaucucaguuccuuaguuuauaaaauugguugccaaaaaacgacuguaauuggcugcuguguucaacaccuuguuuccagaugcuccugucugcagcggcgccccgcuuccugcuccccgcuccccgcucccuggcuuuguaccuaauuaaaaaaucaugguaugaauaua

SEQ ID NO: 12229 - RNA, 176499 nt, Mus musculus
gcuccgccccacgccuuggucuccggggauggcucaggggugggguggccagugaguggucuccuccuccggcgggcgcugcggcggccucccgaguguggcgcgggacugccgggcgggcguggagcuuuuugcacgguaauugccgcguccccgcgucucgguguuccuagaucucgguggcuccuuccccggagcgcucuccuagggcgauuccacagaguccccacccgagccaccccagccagggcagcguguguguguggagugggacccgcgaucacgcguggcucgggacggccgcggugacccgaguagaggaaggaaugggucaucccgggguuggacgucucuugcuggcucgggggcccugcagcugggcgcgggccaucagggagaggggacagcccuagcuuccagcugcugucgccgcugcgggccugagccaaguggggauuuaaacagcagucccuggcuggcccggggcccgggagggagcggacucuggcugaucgccgccggugggaggugcgugcuacuggcgcuagaucgggcaggcugugggauugggaagccaggacggggucuagggcuacuuuaucuuugcugaguuccucgucucuuucccagaccccugaguggcgggcuagaggcccgagccuggaaaggguacagacguucugaaacaaagcuuuggaccacuugauaccggguaggcagaagagggaccaccggagaagugaacuccgcggugcgugcccgcccuugccggguucucaccgcuuuuuaagaagggguugcuuguugguuuguuuauuuggcucuagggaaaaacuacucaccucacugcuuuaaagaacuauuuguguguccgcagcugcuggcuuuugcgggggggggggguguugggggaauggagaggggacgcgcgcgcgcggggcgcgcgggggggguauccaaguccuccgccuuuguugacaagagacgugucccuuuugcguguguggaguacuuugcauuuauguaauaacuuggcgaaaucaaacagcgugaaggaggcuacugaagugaggcucccaacgugaauuuuaggaguugcagcucuaguauuucgaaucuggauuacagcagaaggggggggggggacgacauuguguucuuaccuguuaaaaguuguuuuguugaugauguugagcuguagcuucauagaacacgggcagaggaugcaucuuuaacuuuuaguauuguaagagcaaaucuugugucauggcuccuaacuuggaggaugcccuuacucaggguuacuaaaaaguugaaucugggacccugggcuuugucacagagacagcggagaauaucauuaauggguacaagugagccuguucaguucagguuccuguuggggaaauacuuucauauccagcuaacuuuuccucucuugaaauucuaucuugcaaaaaggacuaagauuccagauggcaaauucuaugaauggcagaaauccugguggucgaggaggaaacccccgcaaaggucgcauuuuggggauuauugaugcuauucaggaugcagucggacccccaaagcaagcugcagcugaccgcaggacuguggagaagacuuggaaacucauggacaaaguggugaguucagucaguguguguacacggcccucagcacccugaaugcgauuucuucggguuuuauuuauauguauggcuaauaaucacuauuauggugaugagcuuuguauuuagguugggccauuuuucuucaacucuguguuugcaaaaguugaauucagaggaaagacuuuuauuuuuuuauuacucuuucuaacuuauuaucuugcuuuucaaguuccagagccccuggguauuacuccaauaugcaguuuauaccauuggcuacuuuugcuggguguauaguaugguuuggaaguuugcuuagucuuauguggaguugccuugcuacuagauaauauaaggcuaacaagugaacaauaggcucugcuggagcacacuuaggacaagcacaugggugauguugaaaccuuuacuggggaaagaaccagaacuccagggaggauucaguauugaagaguuugauuuuuaucccuguaaacucaucuuuauuaagaaaauauauacauauauacauauauauguauacauauauauguauguauauauauauauauauauauauauagucuuuacuguucaggacaucgguacaguuucuuucaucuaugauuccauuuugaaacagggaaccuuuuugguugugcguuguuuauugugaaaggaaaauguaugcuggaggcuguguggggcugagagugucagaaacuucugugguuuuuuuuuuuuuuuuuuuuuuuuuguugcuuuuagaugagcucuaguuucacaggaagaaaccaaacuggauggcaguucucaguccaguuauaagggcagugugcauaccucccagggcccugcuggaaaagcuagcugucugaggaggcuugggacacagauguguugguguccuucucggcacacauucauaacuuuaugauguugagaagaaguugggcuaugcuuugcugaguuugagacauugacaaagaugcuccuuuugaaugaugaacaaaggcguguugacaucauuuggugucauuuaccuuggcuuugguuugcuaccaaagacaaaauuggcuacaaagaagccacugagaagaaguaacaauucugggaggugacacuaugggcuuuauuuucauguauucuuauggagauuguagguaagauaacuaaaccauggcccugccauuggauggccacugauaucaaacgcagcgccagagcauuuuuuuuaaccagguaaauagccuuaguauggggcuucagugugaccuauuuaagcuucugccaauguuuucacauuguuauguugaagugcuccagacggaaugacgucaugaugucagaacauugcaacuugcugcuugggcucagguuuuggauuuagcuuuggacacuucggacugaagaauugugcagcuggaaaaacugcaugcaucuggcaagcacaugagcugucuuuugcuuuucuacugagucuucuucugaaggucacccuuacugccugagucauuaauuggugguaggagaagaaauucaagguuuguuccaguuuaucuguugcauaaguaggcaacagaugggugccauuucaaaagggaguugguccaucagcaucguuucuugagauguuuaguauuuguauauuugcgauugagcucuagagcauaaaaaagauuuauaugguggcguggugagcaacaguuacugucaaguggucagugaaauaguaaaaaugaagugguaugcauaauuuugcugcauaacugguuguuaaccaguacauuaaucgcuucuaauuauuucaccaugaauuacaguaaaugccugguuauuugacaguuaaacaccuggcauuguccauuaacccuucuguggguuuuaacuuggcuucuacagcugaguuugacccacaaggaacuguuuuaccccaagucucuacuuagugggaugugggugccaguguuggcaaagggacaacaauauggcuuucccuagucaucuucauuauuugucauagaugacaaugugcauaccucuguggcuuuguggaggaaacucccaucauuugucaauagaguuuggucuacuuauuucuacucuucacacgcacuaagaguaaggcacuggaaaugacuauuaccaauuggcagcauauuauuugaaguugggauguagaugucuuccccagcauggguucaucuccuucuguuugacagugaugaaggaaguggaucauaauagcaacacuaucuggugauucuucaggaaauuuauuacuaguacagaaauaugaccaucugcuguaugaccuagagaagcagcagugugaguuuacuuugugaauacagaacagaagguuucacgucugauagguuguuaaagaaaagucaggcuuaagagugaaguugcaccguuuucuuuauggaaccucuuucccuggggaggucuucaaagcauugcuuucacguaauuacuaagcaccauaacucauuuuaaagggggcagagaaucagucuugggcagcacaggauauaucuuagaaguguauaauuuuaucauuccuugaccucuagaacuuaagaaacucaacugaaaagucaguugcaacuaaguguucuguuuucccagggcagccacucuuuccaaggucacccagcauaggagaaaacaguuguuccuuguguucuuuguaaguuguguaacguuuuuguaaucgguagugcagaguucacaguagugcaugcccugagaaaauaacaaauggugggaucccaaaagcauaccccuuagauaguuuucuggucuuaguucuucugaugagucuaagagacugacucuaaagccauaacgucaguggauggcucauugauaacacugacagaacuauucuagaauaauacacauuuagguuuaaauacauacaaaaucguuuguagauuuuguuccuaaguugcuacaggcauguuuccaucaacccuuaaacacuuauugaggguuuguugugugucacugagugacuauuacugggggugagugggcagacuagguaagccauaaccuauuuuuggccuguaaaccaggaggacaggauuagagcuggacaagaguuguaauugccauggggugugaaaagggcugggguaaaaaccuaaaaaaaaagguaccuuggugucaggauagaggaugcuugcuucccucuggauuucagucugguuucugcugccccagccuuuuaggaacaacauuauucugcuccuguuagaaaugcugaagcgaggggaaggaaaugguugcucaucggugugguuggagucaucauuuauuaaugugagguuccugagugugguuugcacagagucugagccaggugauggaaaacagaagaaagcauuuuccuccuaauagaugcuaaaugcacagaguguacauggaugcucgggaaauuaggaaauaauuacuugaugauaaagagccaagcaagcugaguaccugcuccuugucuugcuccacuugccguuuauuugaaguugaguuggugcaccaguguuagaugcucuuagaaagagaugcugucacucggcguuugcuugccuuucaccuauuguauaccgcuuagccuuaaaguaacuuugugcguaaucucaccagaauuaaauuuaaugucugucaaagaugcaugaguuauguacuuauacauauuuuuaaaauaauaguaccguaauaauacuuuuugcaaggugaguucuucaguacaucugagaaagagucuacaagauuuaaaauauaguucccugaccagcuccugacagcggagcagcugugcuacccaccacggggcuacauccccaggguauuucugacuuuuuaaaaauuuagcucuauuuccuuuuucuuugcaaacaagaucucuaaauugcccaagaacucucucuuguagccuagcuuguaggcuuugaacuuaugacccucgucagacuccauaguagacuccaugauauacaguccuauaucaucagacaugaaaguuuuggaugcuaauucugucugucagcuuuccagagcauuaauaaagggaacaccauugauuugccuuaugcauggauuuccuuuucuuucuucaaguccuucauuagacggauccugggccccauuaaaccuugauugaguuuaauaacacacuagcuguuggggcaauuuugcuuaucacugaauuacauuuugaauuugugcugacaccauuggcuugauucuaaaguuugcgacuagugacaccuggaaaagcuuuauuugccauaguaaaaguuugaaaguagaucugugaagaguuaacuuggccuaucccuguaauagaaagcaggcauauaauggaaaccuuaauugugacugauuuguuaacucuuaaaaauauuuuagccgggcgugguggugcacgccuuuaauccuagcacuugggaggcaaaggcagguggauuucugaguucaaggccagccuggucuacagagugaguuccaggacagccagggcuacacagagaaacccugucuugagaaacaaaacagacaaacaaacaaaaacaaaaaagaacauuuagauuuuccuuucuuuuaaaaguuucuuauaugcugucaauuucuuuaucuuccccucccccacacccccaaauucuagcccuggacagacaucguuuauaaauaauaucauacaguauauuaaauaagcacuauaacaugaugcaaauacuguuccuaguagguggaggugacuguugcuugcuggaggugagaagcuggugaaaggugcugucuguguucuaaaagauuguuugaacucgaggggcuggaaaacaucuuucaccgaaggaaugaagagaggcuguugugugagaguaaaguagaagaggaugguagaaguuucaauauuaccaaagaauuuggauccaguuaguuugguaaacauauaaaguuuucugaggggggggggagagagagagagagagagagagagagagagagagagagagagagagagagagagagagagaucaaggccagucuuucaugugcuacucugcagagucugaagguuggcgcaaugcaaggaagacuagggaugggaucaggaggagucacagcaaugugguuaagaauuuauaaagaccugguccuggucuagagacuugacaguggguuggguuuagcaagugugucacagauguggaagguuauggggggaaaaucugcaguccccgagcaucuugaggguucccgaaagaaagagaagacgaagugaaaguggcuugagguuuucaagcuagucaacugugaaggcaguggagcccuuaaggagauggggcccaggaagggaaaggccaaacuugaugguuggcaugucugucuguuguguguugaguaugaccuaugagagagaaauugauuuugaagucagaaaauuggguauacaguuccgagagaauuugaaaccaggaucauauguuugucaguuguguuucuaggccgagcaucucaagcuguagcacugcgaaggaguuaggaugcagaucuagacucagagacaaaggcagaacacccgucauggggagcaggagggauauuucuuuagaguugguaaagagaugggaauuaggacauagaauagcaauggaaaggugaagaaagagcaguuguguauuaaucucuacaucuaaacauagagaagaggauuccuucaacuucuuacaaagcuacauuuaagaagagaaacuaaacaggguaaaacuuaggaagucauuggauuuccuaaucagaggcuauuguugacuuuggcacauugauuucacuugugaugaggccaggguaggaugugcguggagauuauuuagugguucuacaacuguaacaacagacacagagcaagcugugguagcuugaggguuuauugaggguugaacuuauuaauuuuaucgugugucucugugucuguccaucuaugcaugaacaaggcuuccauuguaccagcagaaggaauacaugaagguguagauuacagugaggauggagaaagcucuauggaagcaacuaggaguggcuaagugaggcagacagguauaguuuccacauaggcaggagggaaaugagacacacguaggggcguuuuaagugaauauauacaucucuuuuggguugguaagaaguaguguaagaugguauuuguaguguuuaagccuuaucuuuaaaguuguacauuauagaccagucuuccaacaguggagugggugaguuauaugaauugaaguggccuucuggcuccucccuuuacauuaagcaucaucuuacgcacaugcugugaugacaaugguugcugugccaucuucuuugcuccuauuuauggcuuguuuuuuuuuuuaaacuauuuguuggaugccaguuuuuuuuuuuaaaucaaugaaagaaacuuuagauauuggaccaacauguacagcuuagcauuucacauuugaguaguuguuaaacugaaucaaacuugcacacaucagcaguuaaguuaguacuaguucaaagauaaaauuucccuccgucuuuaguucuuuucuugagagucucuuagguuugaagaaacuagaagauggccauguaaacugacuaaaauaggggccugccuugggucuuaccccauauagaacacccagacucuuuauaguggccugccuuuggucucaccccuguauagaacaccccagacucuuuacagauuucauguagcauaaaaaguuuucaccaacaggaagagcccuuaaacuaucuugauguugagugggcuaccuagugccuuuaugaccuuguguuuuuauaaaaucuccaugggcuuuucuuugcugugauggaauauaauguaugaagggagaagaacaagaaggaaaugagggauggauuuucacugcauguugugcugagaacugcacuucuuauuucucuuuaaaagucuguaaaucagugagacuucuagaaggaagcagccaguuuggauuguacuuaaugugugucccuuguauuaggacagugcugcacacuguugcaggguguucucuuucuuacaggaaguaaaucacaaggguguuuauuauuuacauuuugcacuaccaaacucuucuccaaauuuuguauucaguuuuggagagauuuauucaauaauuuuaugguuaucuuuucucucucucucucucucucuauauauauauauauauauuuuuuuuuuuccugcaaugucuuaacucuuuuccuuguagccuucucuccaucaaacacaugcuguacuucuuuuuauacaaagugagaaagauagaccagugaaaaaaaccagauauguucuccaguagaacagaauacacaauguguauuuuaaguauaagcaguuguuucguaagugguccuuuaaauauuaacucccuaaagguaaugucauuguaaaacguaacagaauuaaacuucucaagauuccacuauaaccagucuuaagcucuuggccaguuuuauaugcuaacuuuauuuugcuuagcuaauguucuguaaaaacugcuguauuauuuuguacucacuauguaauaguaugucuucuuuuauguauacuuuauucuuuuccuaggaagcuguugaguucagguagaaagaacauacagacauugagaugcuuuuuagacccguggcuuugguguagccgaguaagaagccucugagguuuccagaagaagggcucucacacucuugucuuuagaaucagggacccuauuggcgugcuccucccuggggaggacuacuucuccugcucccagcuuuagucacuuguaugcaguucuuuguguagaauugaggccucugcuuuggcgugaacauugguguccucccugcucaacucauuuuuggcuggucauguuagugagacucuacagggacagcuucucguguuacuaggagacacaagugcccaaccaagucccggguucucugacucucacaguguuucugcccuugauugugcauuguuuccuaaguccuagguaugggaauguuuuagggauguaaccacuaggacuuguccagugacaaaugcucagccaacccugaaaacauacauccauguacaauguauggacuugacagguuauauauaugaauauguauguacaugcagauacauaugugcguauaacaacaacugaugaaaauagaaguuaggaguuugaagaagagagggaggguuauaugggaggguuuggagggaguaaagagaagagagaaauguaauaaaaucugagagaggggggguucuugggucuuagcucaguggugguagaauauuaggguccuaucuccagcacacacauauaaacauaaaauacguacuuggcuuggagacuaagugacucaauaugcuuccaguauccaugaguguuccuugggaugaaguacguuuuggaaugaaaguuauuuacaguauagucacaguugcuuaccauugacauguuuuugguuuguaaaacuucuuuuguacauuuaggaacugauuuccacuuuauuuucgaggugugcuaggugaucugaaacucuuuauuuaccuuuuggcuggacauuuuccuuaagacacagcuaaaaaucuuuuuuucuucuuuuuauuuuuauaauuuuuauuauaaaguuuuuaaauuuaaugaaaauuuuuuuuacuuauuuacuucagaaaucuuuaaauguaacauuccaaaguaauuaauggcuugaaaaaaucuuauagcaauauuaaauucuguuuuuauguuugugccuuggcuuugauaauguugaaaaaugucuaauuauauggucacauacaucuguuuuuauuaaaauacauaaaguauauauauauauaaaacaauaauguuauguauuugaaucaacauaaacuauaugaacauagaguaugcauugacaucuuugaauauaacuaaauccuagugucuguucuguaguguagucucugaucccuaaguuagucaucuggguacugagaaguuaguccuaaacagggugcauuuccguguuuuaaugcuagcaugccacaacaagaaaaguucuuuuagugauucuaaagguuuguaaagacuucagucucaaaauccuugggccagaugaugggauauucagcuuaauuccaaaccugaauuucuuuuuugauuaaaaagaaaagagucaucauguuaaccaauucuuuuaguuaucagugccagccuuaaaaugcccuucauugaauaacauagugagguuuauuucuuugugaaagcuccuuuguuuucccaccagcuuucauuguagggugcagcucagauaguucuagaacuuacucuugugguaagcuucauuuuuccccuuaauacacugguuuuagaagggcuauuuuucuuucucuggcuuugccguuccgugcacauagcaagcacucaauaaauauuuauugaauggaauugaauuugaccugcuuagaagucauaguccugggguaggauuauucauuuucggcaggagcggcuauaaaucacagaguuuagcaguaauccaucugaugaagugcacacccgaaggcacagagugguagcucagcucccucaauccugccuccucccguggaaaguuugagcacgggguagcuuucagaguccuggugcgcuaagguacacuacuccuuccaaccuccuucgggucuucugaacugugugcugacagccuuccugugugcccauccucuagcacaacugcaugaucccguuccuuuacccuggugucucacaagccuuuguauuaugauuuagcugcaauauuuaggcgugcguuucuugaugcucuugggaaugugacuuagccacggccuuucucccccagagcuuugcaagguccuuugucacacuucuagguucugugauccuuucuuacgcccccagacuuucccaccauacugcugcaugaggacaggucugugagugacuccuuugucuuccuucugccugagacaaugccuguuauguacacguucuucccuugaacuaacaaaugggccaugaaguucauguaaauucgcaaauggaauaaaauaaaaauggaaaugaguuuagaagggaaucauuaauuauaugccuaauucuaauuaaauuguaauauagccagaagaggaacccgagauucagaagaugcaggcucuuguguuggauuaauguuuuuuuaacugucccuuaaucuuuguaguucuuagcuuuuuuaauccggaaaugaauggauuggaugagaucuuuucuaagaucccuucaagcaagaauuacauugcuccuaaguuaauuauauagaacgaggucuccuuugccagacuccuugaggcagggagcguguuguacucauccguaauuuccuggcacguagcucaguaccugguggaugggaguuauucagagaguuuuuguccuuuaaucaagcaauguguuuccaugugaaauuauaauuggaaaaaaaaagcaagugacuaaaaugucauauaaggaauagugaauuagauaugauauguaugacacugaaaaguaucuaccaaagaacaauuacuugucaugucuaacacguuugugauguuuuucauuaaguaguuaacaaauuaaccaauggaacaaaugaaugugaggcugcccuuuuuacaaguuaauaauugaucagucugugacguuuuacaaggacauguugcuaaaauucagcgguguccaccgugagagguugguggaguucuugaaauucaccugugcucugguugcucuuggcuuuaagaauugaaauacuggagcggguaagaugacucagugauaaaagacacuuguagccaagccugugaccuaaauuuuaucccuuaacccacauggugggaagagagaagcgacuuaaucaagguuuccucugacuuccacucagaugccaacacacacacacacacacacacacacacauacauacacacacacacacacacacacacacacacacacacacacacacacacacagauccucuuugucauauaucucagcucuguaagcccuuuuacucuacaaagacuugguauuacuuaauaagggagauuccaucugaccuuugccaaaaaaaaaaaacccaaaaaaaacaaaaaaaaaucucuugaggauuaagguaguauucuuauauuuaaauuaaacccuuaccccucauuuguuaauuauauaccuauagaacucaauuaugaaaauuaagcaaauuauauagucaaaccauuuauaaaaagugugugugugugugugcgugugcgcacgugugcccgugugugugguguuucuuucauuuaaggcuaggcucacaauuuaaaagacaagugugugugugcauguuuauacacugauuuuuuucagucaacuaaaccuguuuauuaccugcuuauuuauuaguugaguaucgugugcuaagauccuggccuuaggaacuguguacacagugggagaaaauagggaaaauaggggcaugcaacaggucauugugagaauugauuucguucauggucaaugccuggccugacaauuuaggccagagugguuugcuuguuuguuuguuuguuuuuauaaaaaauauaccuaugcaaaugugauagucugagggcuguuuauuucauugcugacaaauuuacuuugcguuccugcuuucuaaagugauuauaguuuaccuauuuugaguuugugauaauacuuuuauggggucuagaggcagguguugaaaccugaaacuauugucauuuggagggucccuacuaaaguacuauauaagucugauuaugaaagagaauuuucuuuaguguuaagcaaacaacaaaccccagcaaauuaagcuuuugaaaagcucccaagacugcacauguugauaaacaugucugcacugcuaucugacaagcugccucuugcuugcauacuccucuguugccuacaugcgcuuccugcccuggcuuccuugauccuauuuagauagcauauugaaauagaccuucucacgcccgaagcaggacagucagugcuuaugauauuugcguguuuguguguaccugaagccuuguguguguguguguguguguguguguguauauauauauauauacauauauauauauguauauauauauauauauacacauauauauauauauauacauguacauauuauauguuucaguaaaaguuguguaucuguaagauuuauugcaauaugauguaccucuguagagaaagagggaguaaacaugucugccuuguuuuguaguaagaguggcuauagucuuuuucccuagagacuucaauuugcaaggugacacugugaacugugguucucugugcuuuguguuuggcaucuagacuugugcauccccuuugaccucuaucccccacuuucccuucuccucccugcccuugagagccaucauucgauuuuguuucuacguguuuuacgucuucacuuuuagagucuguauauaaauaagaucacauagcaucucucucucucucucucccucccucccucccuccuuccuucccucccucccucucccucucucucucccucucucgcuuauuucagacugccgaccauaauuucucuauuuauggaacugacugcaugcuuugcauauaaauucucuaaacccauacugaaugucucucuaacuuggccuccuguuagccagguuccagaaauguccuuuggccacuccguugccacccaaaaggagguucauugugaugggaaggaagaugcaggaucauuuauuuauaguguuuaaaauuguaugcucugagaucuuuuauaaaaaccaaacaugcacaaaaccuagaggaaaacacaucagaaggacccaggggccuuacgcugugcugacaugauagaagcuccugccgguggacauugcgccugucaugagugcuggacuccuaccuuaugaaugcaccaugcaguucccaaagcucuuuuuaaaaugauugaauugguggguucccaaaacccuagucacaaggaugaaaugaacugguuuuuauuaauggcuaaguuaccuuuaccuuaacguguaaaggugaaugccguguaguuuuaaauuaccacuucuuucuucucuucuucuucuucuucuucuucuucuucuucuucuucuucuucuucuucuucuucuucuucuucuucuucuucuucuuccuccuccuccuccuccuccuccuccuccuccuccuccuccuccuccuccuccuccuccuccuccuccuccuccuccuccuccuccuccuuauuuucuucuucuucuuucuuauuuuuuccuggaggaaaguauuuucaguucugcaggcagcccuuccucuuuaaugcgcacugaaugcauggcaccugguggaguggcugaacggugcauguuucauaggucacguguuucuaggccuauuagacacuaggaagagagacaggcuucuuuagacuugacaccuguuuaacugcuuaguaacucaguugugaagguucagaaauagugcauucaaauauuaaagucugugaaaaagcuuuagccaugaacuuaauacagaaaaguagcgucuuaaaauuagauauucauugauugcuugcuuucauauaaaaccauauugguguuaccaggccauuaguaacuacuacacuguguucuauuagacuguacacucuaggacacuauggaaaagguaaucaaaaugauuagaggugaaaaugaggauggaauauagcaaaguuugccuggaauaagaaaacgggauuuggguguuguaagagaaaaguauuuauagauacuuucuaagcagauucaauaauucagaucacagauuguauuauggaaaggaaagaggacauagcucuguucauuuauaacuuuccuaugacagaaaauaguauaguauccauaaaguaauuuuuucuuuguuuuuagguaagacugugccaaaaucccaagcuucaguugaaaaacagcccaccguauauacuugauauuuuaccugauacguaucagcacuugagacuuauauugaguaaauaugaugacaaccagaagcuggcucaacugagcgagaaugaguacuuuaaaaucuacaucgauagucucaugaagaagucgaagcgagcgauccggcucuuuaaagaaggcaaggaaaggauguacgaagagcagucgcaggacaggugagcacgugggauuuguacuguuccuugugucacguucuucccauuguuuugugucucaagguuaacagaagugcccuucauguguucuggggacuaugcaguuuccuugccuguuuccuuuuccuauuauuuaaguuuggcaaaaguugagguagaaugucgaaccugagccaauggucuugcuauucucuggacuccuuuuuagagcacuucauguuucacagaaagacugcccacgguaguuccugcugcuuccugccaagcaagccgucuuccccagcuuacaucuuuuauauggauuuucauaaagacaugagaauaagcaggucuucucccuagauaagccacugacagaacaaagaaacaaagauuccauccugguccagcuugguaaaacagccugauuugggguuacauagcgagguugggugacugugcucaugagaagugucacugcagaguaccacccuagcauggaugauggcucugaaguuguguucuuagaaucauaucuucaacuacccuuccucuuccuauaugacuccucaccucucgucaaauaccaagagccuugggucucagaggcaauggcagcuggacuaucagaugcuccauuuccguggagguagcuaucacaguaugcuuuugucuauuuucuugucaucuguguggggucaacguauccuguagaugaucguagcaguaucaguuccgggauggauaugucaugcucagcauugagaauggagcuucacugcugggccaucuuugcuuuaguguggcauacacuaccauuagcauaggguucacuguuuuuauuguucugugguuuacaaacauacacuugucccaugucuacccauacccuguaaaaacucccuguguuaggcuggguaaguggcucaguuguuaaaggcuauauauagcacacuauuaaaaugacaagaaauguucuaccuucaaccuacacagugugcaguaaguaacuguucagacugguuucuugcuggucuuuuuauagcuugacagccuccuuucuuauuucauggaugaugacauuguauguuuguacuacaguuuguuucuauacucacucuuguguugaaggguaccuugauggcuucaaacguuuggcaacuguguuggagcugguaggaacauucaagucaucuggggaaauccuuggcgcauggucauuagaucuuacgacuugccugugugaauucuauccugacauagugacuguguuguuuuccauucccaccaguaaugagugagauuucuugaugcuuauuugcuucagcaucuggugugagagaugcaguacauuagauucccuucgaaucucuuagugaaguagccgggaguagaugcucuuucagcauacauauuuugaccauuaagugagaaacuggccaggaaagacugauaugaaauuaaguuuuaguccuuacuuuauagucaggaaauguucucguucucugucuccauucuugucuuucucucucugucucugcucuaccccuuucacccacccuacaaguucucguguagcccaggauggccucaacuuccuuuuuaaaauuuucuuuuugaaauguuuauuugacauggguggcuguuuugccugcccaucugugugaggcuaucagaucuucuggaaugugugcugggaauuggaucugggucaucuggaagagcagccagugcucuuaacuguagagccaucucucuagccuggccucagacuuucuagauccucguggcuugccuugaacucuugaugcuccugagucuccccgcugaugcuacuggaauaucacucugacucuauguggcucccaguccuugugagcucuaagggcaugaauucaagcaccacacagugcaguguagaagagacuggguuuacuacagagaaaaguagggcacucuccagggaugaguguggucgguagcugaagugaucacuaugccaaccuccauucuuagauaggcuuuaucuaguucucaaccguuucuagagcagaugccuuuucugaggggggauuuccccuucagaugauugauaggcccacuuaagggucuaggcaaucccgcgccccuucuuuacaagaacauucccuaacuagauagaagucaguaaggucuggguggcuguuuagaaugcuggguuuccacuugaauccagagauaggaucacauuccuucgaccaguuaaguccuccaacugcaguuccuguuugucaagauugugagauaggggucucuccucacuaaccuucagaccugccaguguauacauauuuacuuaaaccaggauguugagcuucugaagcaggaugcucuaucuagguaagggugcguugauggcuggcgucuggcucuuuaggguuuggauugaaauagcugucuccagcuugauaauggaacugauagcuuucaccuuuucugagcuccuuucaauuuagcuagaauauuaaccaaucaaagaaguauuuccagcuggaaagcuaguaugaauuaagauacguaaugucuuagcguuagcugaauuaauuuaccacucaguauuuaaguuaggaaaaucucuaagagacauauaaucuuucauaucagaacacauaaccuccuugguuugagaugguuuaggguuguguaauggaaaauuuaguuaucuaguuacauaggcucugaaauuguuuguaagagcuggccaaauaaauauacagagcgugcaaaaccaucacauucacgcaccgcaaaggccucugccagagguaaaaugacauaaauguugaucucaaaugcuuuccagcucauucucaguccuaguguacccguggaguacagcgguucugugacucugcguccuccacuuaacguucuuggaagacaguuuauauuucuugagggcagugaacguccuggcugccuuucaauuguaaagcucaaagccuccccagggcuucagacucagugagaguuugaauggccacaugauucuagcagcaagguagauggagagagaccauggcguggggugagguuguucuucgggcuuuacgugauggaccaaguuguugaaauccagauggugauguaaacuuuuucaaauaguauuuguaccacuuacaaaaacaccaaaccaaaacaaaaccaaaacccaaaaaacuaaauugcuuuuacaaacaucacuguaauuccuauuuagauauagccucgaaguucuugguauuccugcuaagcacuuuaugauaucaggaugccagcaaaguguguaacucucaggucaagcacuuggagcagaaggcguguuuuagcuggauguaagauucaggugauaaacucacaucugacuuuuacguguuccaaagaaaccugaagcauguuccaauucagcagacauuuuauaauuaucacuacagcaacugucuugcauuuacaccugugucaaaaaaaaaagaaaucacaggacacauauaaaauuuuguuaaggguguagaguuccacagacagugguaggucacauaagacuggccauaaauugcaucugugccccugguuuaaguauccagguaaauuuaaguauuccgaagucuuaaacaucaacuguaagaggaaauacaguaguuuguauucugggauagcauauucccuuauugaauuuuacuaucgucuguggucucuguuuuuuuguuuuuuuauggucuauagccaaccuuugaaaguacacauucuucugugcuaaauaauuuucuagugaugauuuauagugaaccauuggcauaugacacagacuucugaucugugucucucuggcagucauccacuugugcacauucccuguggagcguccuugggagucacaaaacugacgugagguacauucucgcccguggagcccuguggcauuuugcuuuguagaaccuuacgggaaauucuaagacuguccgugaggaaguucagcuacugaauauacuguucaggaaaauggccacugaugugucaggcgcacagguuauugggaaucuuagacauccuuuggacuguccucucugauuccgaaccgacucacuggucacaguaauguuguucaguugacacugaggaacagcaguagaaauagucauuuugaauuaaaaagagcucacaccagcacugcuucaagugagccucuauuggauaaaguuguguuggaugagugccugugucgagaugaucaaugucuauguaucugcugugucaaucagugauggacuucuuucuggcuuuauuuuaaaauuaaauguagauacauaaauuaaaaagcaaacauugggucaucaguucuggaauguggagcugucuuaguugacugaauuguucauuucaugcuaaugugauguaagcauguaaaacauguacaacaaaccaauguagaauaagcagacagcuuucaguguauuucuuuguuaguacuauggaaggagugagguagggcuuuuagcuagguaaagugccagugcugcccaaagagacaucuaaggcaccaggaaacuuuguugcacugagaauggcaggguaaugguuucugacucaggaaaggcccaugggguugggggacugcacuugauugguccagccacgcuccuuugucucucuucucacauguuagggaagcaauugaaccucaccuggcuugaguugaugugucuucaguuggguguuuaaccuguucugaacauguguuuuugggaagagauauguagugaagugugaccuaagaguuccugucagugugcuugggggguguagcaguaacuuguagagaggucuacuuggggcaugggaaaaggagacuggcuccaguugguuuggggaaugcaagagacauaaggguuaguccuggggaccacggcuauaucccuuucuucugugaguuuacugguacuuucuucagucguuuguuuucauagugaauuuaucuuccaccaguaaagugagcaucagugagcugcugccuaaagccuggugucggacagccauguagggauaguccaggaucaugguuucaggaguuaugccugcaagccgggucuauaaucccuucccucccaggagcuucacuccugaaacaagaccuaaaguuaauuuacaggagguagacuaacugcauuaggaaagcugucuguggagaaaauaaaggcuuuaaaagugcacacagagacaacauagauguugucuuacuaauaucauuuuuggguucucuuucaguuuuuuuguacaccaguguagaagaagacaaauccauucccagagaaaauggagcaagugcucguauaggaggggcaguauucuguucuuucgcauaguaaugcucgcacuuauuaagguuuaaugggaggguauuuccgcauagagaagcuaauccuuugagaggccagccuauauuugaacugcagaaacaucaggcagauuuucccauugucuacugacuaagcugagcuaaggaaaaccuguuaucugcuauguuaaugagcuguccuuccccuggaggaccuguuaccacugcgucuccugcuaaccccagucugggcuagccagaauauuuuccaguugauuuuuuuagagacauaguuaagcaaaaaaaaaaaaaaaaaaagacuuggaauaaaaaugacaacagaaaaaacaaagcaaccccuucaucccccgcccccaacaauaauuacaacaauaaagaguaucuguaacaaacaaugcuacaaaaaaaaagagccuccuuccuuuacguacacuaugccuucacuguuuaaguaaugugguguguauuacgguguuuaaauuuaggucaggcgugguguccacaccuauaauuguagcacugcguugacuugaggcgaggaaguaaauuuacugguaucuaaugcugccuguucuauacauaucuauuuauuaaauaaauaucuauuauuuaacaguacaugaaagggaauaguuuuauuuauuuaaauagacuauauuuucuacuuucuaauaguggaaaauuauagccuuuuuaaauucacaaggaacagagauauaaauuacaagcaaaaaaaagugguuucuaaguaaaauagacgacaauuguuuugagcagcaguguuuuaauauagucacugacuauuuaaauuuuguauacuucucuguauucuagguauuuugucuuuuuaaauacuaaacgagauaauuaaaacauuacuauuucuauguagaaauaugucugcccacuaggauauggaauuuuauuuuuuaagaaacuuaauuccuaggguugauucacuguaaaugagugaaguaaaauuuuuauuuguucccaauaagaauauuuucaugcaucugagaaauuaugaauagccuguaacccuuggaaaugaaagggauaauuucuuuaaugcaucauuaacauagaggucacaagaaaguuauuuggacaaauguuuucagaguuaaacaaagaaagacuguuagggugggcaagcaccuggagacccuugacaaagacuuuauggcccaguagguuuggcuaacugcaccucuguugcuuuguuugcuagauacaaaguaguuuuuuguuuuuguuuuuuuguuuuuuuguuuuuuuuaguugauaguugacuuguagcaaguucuucauuggugucccuuuuucaaaauuuaaaagaaaucaaaauuauucauauguaauuuggaacuauuccgcuuaaaacacuuuagugaaauauuugccuguaacccagguaucuguuacuuaguuguuucauuugauuucaacuccacccuacuguccuuuagccuuuaacuccugguuccauguauauaguauuuuuauuuuauuuuagucuuuaguaucuuucaaguaaagaugacauuuuauguccauaccuuaucuggauuuuaaaauuggggcauugcuccuggugauuccagcuuguuaaugguuaucaauuccggagauaaccauuaugcgacaaagcuguaaacaaaugcacaagacuccaguggacuuggcuuacgguugaguaccuuuuauguuuuucagguuuaaggcagcuuauugaaauugauguuuuccugccuguaaauaucuggugaugcucagauuugauaauuacaauccagaagcacuuaagaaagaaagguuguuuuuaguuucguaauaacaacacucccgcaaagaagauugaugaaugaugucuuucaaguggcagauuuguuauuuaguuagagaaagcuccucugccaguuccucacaaagcuaauuuagagucuguuuauaaagcaggcaagccucugcaguguuaaugcuauagcccugaagugcuugcaugucuacccugagaagacucuagcuuuucagugguuuaacaaggaaguagauuuuccaggaauccaaagggauuagcauuuagcacuaauugggggaggguguagauagaacagagcucaaggcuagcugcuguauaguaaaacaucccucaguuuucugaauccauuuucaaucuauucggucccucugagcaucacuguuggggcuugaguucuugucugucuagauacaaguacaucagucuauacaugugcucguuucgacaagguacacugaggagguccuuaccaaaagaauucuucauuagggacuacaguaaaagcauucuucauuagggauuauaguaaaagcauucuucauuagggacuacaguaauacaaacagcagcucacacaguugggugaauggaaugauggcucagagguuuuacugaacaguguuguucaaaaucaaucccuguuuuccucugucuuccucuccaauggagugcuaacugaucgugguaguacugcaacacguacacaggcugccacaagugugccaugcauucauuucuuggaacuguuauaacaaagagcaaccaccuggauggcucaugcaagagaacuuguuucucucccaguucuggagguugaaauugaaagcaaaacaucaugccaggucuugcucuggguaccucuccaggagggcgugcugccaugucucuugcagauuauguuagguuuggucuuccuuggcauguggaggcagaacuucagaaugagucuacaccaacacaugaugucuccuccugcugccccccaccccccacuaucccuuaccuuauucuuccucuguccaaccaaaccuuuuucucgggucgucagucauuugcuguuugaaaugggucuuacugacccauccuaaguuggcuacuucugcagagacacuauuuccaagcaaagucagggucaccaguaagggugagccuagaauuucauuuaucucuuuagaagauacaguucaacuccuaaaagugauagauauggaaguguaaauucguacuacacaggagaagacaguuggaacucauuagagugucauccaagugugagaaacuuugcuggauaggauacgccaagcaaaauuacuugaaacucuuuguggaaaggcuuguaagcccagacuaguuuugccauuuuuagaaucaggaacguguuagaauuaaucugcacugauugauuuugauuagcaugcauauguugaaaauuaugaugaaaucaacauugaucaacguuucacacauggggcagauacauuuuuguuuuaauuuuuaaaagccauucucuacuuugaaaaguuuuagaacuauaaacauauuuaauuacaauuuauaauauuaacaguuguacuuacucuugauuaagaauccccguuuguuuuuuauugcaugauaaaugcuggcaggcuaauuuaaauaagcaggacuuacaucauuaaaucuguacacaaaguucuuugcuuugcagauaaaacgaaguaggaagcguuugucauguggcuggcagacaguuacagguccacuuccugccuuuaacauuacaacucaaagcagugcgcuguguacaauuuuaagucuaguuauagggaauugguugagagaccucaaaugagaguaaaugacucuaaaaguagcuugagucaagguugcccugacuguagagccauguaguaacuauguuggaccuuguuucugggaaacagucagcuuugccuuugcuguaggaaggaaacguguaaauuaauuggcaggacuaugguccacgaaauccuauuuacaaaaacugugcugggguugaguucugccuguggguuguccuuggccagcugcugguauagaguacugagcaaggugcugagcacaaagcuauuaaaagugucaacagagacaaguauaugugucaccucguugugaaaauauguggugaauaaugacacccuaaugacaguuuuucuauguaauuagaaguccaugcuuucuggcucuguaauuuccauccuuggagauugagcuuugucuuucuguuccccuccugggcggagauuuuuugauuuagcugcauucccucccccucccccugaggcuacagaagagagggggaaggaggaagaggacaacauaggagcgguccaauuaucuuuccuuuccuuuccuuuccuuuccuuuccuuuccuuuccuuuccuuuccuuuccuuuccuuuccuuuccuuuccuuuccuuuucuuuccuuuccuuuccuuuccuuucuuuuccuuuucuaaucuugugucuaaaaaaccaaagcauguccuagauuucucccacucaagguuuuggucuacugaaaauguauauuucaaccuccauuguagaggaagacagaggagcacagggacugagggaaugugcuguuagcugggaaagucuguuacaacagauaagcagguauguacaugugcuagcuagaagguuauuuucuggcgugguuuagccuuaaggcuucauucuuuaaaaauauaucuccaaggacuaccaacuuuuauguucauccgcuucauuuucauguacaagcagaaggcaagagaaucuuuggucacaaaauaggacugacuguuaguuucucaacucacagucuaucagcugugcugagucuuugcuccaguuccuacaggacagagcaggaccuaagguguaucuugcaggaucucuaaucuucaaggacagagucugugauagugaugaccuuugcccugaaaggagacuuuaaauagccucucugcugacaguaaaugcucccucugcuccaaggcagacauaguuacaucuuaggguuuuugcuguauaagugcuccugggaggacagacuccugcuuaaggcgguaagcaaccauuggaggauucucagggaaccucagaaugcguugucagugacuucucaggaaccaugacugugugaaguuucggguucugagugcuacguaaaacauuuuacuagcauuauuauaaaauauaauauuuauauuguggcacgauuugaaguuguuaguaagaucaaaauuuuggauuuugacacuauaacguauaaugaacucuguaugggugaaaucucacaugagcuuuggaaaucucucucaaauaaugugauaucaagauggacaauggaaacuuguauuugggguuaauuuaagaucaauccuaaggccucgugugucucaggcaggcacaucacugaacuacacuuggucaggugcaacuuuuuauuaugcaccuuuucagcauuuguuggcucucuagguggaaaaugcagacaaaugauuaaaugaauguaggaagaucgguucauuucauauuuuguuaucuagucuuuauagaagagaaagcaguuuuauuuuuuuaaauauuuuuauuagguauuuuccucauuuacauuuccaaugcuaucccaaaaguuccccauacccuccccccccacuccccuacccacccacucccacuuuuuggcccuggcguuccccuguacuggggcaucuaaaguuugcaaguccaaugggccucucuuuccaguguuggccgacuaggccaucuuuugauacauaugcagcuagccgguagugguggugcaugccgguaggauuugcugaaggaggcagaggcaggaggaucacgaguucgaggccagccugugcuacaguuuuauauucuuuuaaucauuauauaauaugaaccuguguuucaacccaaauaacugacuugcuggauaaggaagaucaauguucgguguauuagaagugaagugauauugcucaucuucguuaucagucccuguacagcagagaucugcuucaggcuaccuagaucccuuuucccgcuggagggucaguguuggcuggaggucucaggacaggagcuguguguaugugcguccucaugggauggcacuugguuucucugagucuauaacugcaggcaugagccagguugaugucacaugccuuuuccagccuuucuuaccgaaggacucauuggaacuaugugcucacuuaaggaccaugaaaauugcucuuuucucaucuucaugaaauuacuguuaauaaugcccaucagcuggcuguucagagcagugugcucuguguaccaagacugucucuagccauucucacagucccaaauaggcuucuugaaaacuauuuuuccccaccuguuuuguagaccccugaguuuggggggaauguugcuggacaccuaaacuuuuuuauuuucauuuuuuauuuaaucucuguaagcaagguaucauuuuaguuuaaggaaauagaagauuuaccugaguaacuuagccccucauuccuuuggucaccuuaauccucuuacgauuuaaaugguauguggaacuuccagaauuuuaucaccugagaucugaaugucuauagauaguuacaagaaaugugugcuguuucugaccucuggcaugacuuuagagcucccugccagugaaaucaaccucauaaaacuuccagggagcauugacuugaauagaauccugaaugcuuucagggcucucugcaguuuacugugcccuugugcugcucacuagaggaagaggggucccacccagucaugucaacuaacacuugacaagaagccugcuccccugcaagcccucugagaauguucccuggcagagaugaauucagacccccuuccccuccuccuccacaccagccacaugguucucuucuuaugccuuucuuuuauucucccucuuccuuucuuucuucuccccucugaaguuucucuuuccugcuucugggugaagcgccuacccucccucaugcucaccuccagggcuucaguguucucugaccaaucugagcagacugucuuguguuccuuugacacauguagcccuuaucaaggacugucaugugacggucagcccugugucaucacauauugcugucaugcuaaguaccuacugcugucauauuaaguggugauaagugguggcauuacaaauauugagaaaaguuuaauucaguuuuuuuuucuccccuuccgaucaaagagaacaucgauggauuaaaggaaaaugagaaagcccuugagagugagcaagguuccaaggaaggaauagccuucaauuaauuuaaaggcaaaagucacuucuguguauuuccacauaguauucaaaacaguguucagacuuggcagauacauauaauaguugcuauuucucccaauuuccauauuauuauuugaaaaucuugauuuaaucuagauaaagagcuucuauugcuuggaaagagguaaaagguaaaauuucacauuggaaacuagcaaaaagucuaaagucggucauuuagaacuuguggauaaacaaugccaccuuccugagauuuggcagccggggccaguuccggggccaguuauuuuaaaagaaaggcacguggguaaauagauuaauaucacugcuguuuauugcagaguagucacaauucagggcgcugucuuaacugugugucuaucuuuagugaaguaacguuuguggaaaaguuagaggugguuacacacagcgccucugccugcuccugcaugccccgugcgcaugcgcagugagcauucacagcucucccacucaguggcuggcucucugaaccccugcgagcuguuuucacuuccuuuaaauucuuauauuaacauuuccuuaaagacuuuuuguuucuguucugugcugcgcucaugacccuaaauauaccagcuuacaacaacuggggaauccuccaaaugugcgcuuucgacaugaauaacgugguuuuguuuggucugcauuauugacaaagguccuugaucauaacucgugguucgccuugacagaacaugguuggucuucccugcuccagaucccccuuagaguagcaggcaucguguucuggaaacuauccugcauugcuguugauagaauuucuugauguguaggauaugaugugagaauuccguuagauguucgggaaaguucucuuguaccuucuuagugucucuuuccccuuuauuccuuuuaaaaggcauucuuggaggcuuggcucuggcauucuugcuaacuaugccuacccccuccuuuucuucuguauaagcaaaguggcuuugaggaacaucugagacguuuucaauguguaaacagccuuuuaaagaaauagcugcuguguucucccaucacaagcugacuuguaacacuugaaagacaaacagaggccuguguguucucuguuauuguugcacccccucacauagcugucugcguuugucagcaguuuguuuugacucauaaugccagggaggggguggcuugguguguuuuugucaguuaugcaguguaggaugucaguuaucucaaaguuaccauuauguuuggcugcugucccucuauguaaagaaagccucagcauugguuccuguuucucaggccaguguuggguuuugaaacuugcccuuaaaauaaaugccaaacuguuuuucucaucuuguaacccuggaggucagaggcuggcucucuuguuucauuauugucucggugacguguuugugguauuuccccagacugguuugagaaccuaccugaacugcccuuuucaaguucccguugcucuucuagaguuggggaucuuguguauuccaacaagguuggaaacacucccaaaucaacauuucauuuugaaagcgguacuuucagacccagaugacucuccuacauuaauucguauggggacaucaacgguuguuguacuugacagaggcagggacccugggcuugacagggacgccauucuucaagagaaagugucccagguagccucuccuaacauucuucccauuuccuuagaacacugacgcucccccaguuuuaggcaaacugucaucuuucccagccaagaccaccaaccuuaggaaguagcaggagcuuuggaggugaaacacaaaggcaaaugcuauugaucuuaggccaccaagauucucauuggauuugagucaguacagaugucugcuggcuccgaugacugcccgccauguaaagugucuggcugccaccucugcuguguguauggcuucauccuaacagcaagugcauacgcguuuacugcagccugucucuuaugggggauuaaaauagccagaaggccugaauaccuagcauuuuuaucuaguauuucagcgauggcgaguucauggggugaggggugagacuguguuugcugucccgccucucaagccaugaccuuuaacgagggguuauuuuagaaaguucccaauucacugcgggucacuggagcuugggcagaaguggggaugcacggcauuuucauagaucacccagcggcuucucuaccugagcuggaacucauggauuguaaagauuucaagcauuugcccugagucucugugugccuccgaguauuauccauuugccaaaggcuaagcuguguucaccacaccccucucuugucauuccuuagugugguguggauccaguucacgcucgcugcuccaguccugacagcuaacugugaggccucuucugaauagucagugccuaggauuuaagcuuuauuuuguguuugugggagcauccuagcugauaguuuagacguugaacuccgucuuacaccuuugauguccuacuuuguugagggguguucaagucagaagguuucacagauaagaucuuggaacccagcugggggucaggaaagacugcuugugaggaaauacuuuggaucuaauguuaacacuccugucggggcauggauuggacucagguagagaaguguaccacaggagacauuuaaggacguagagaagcacuccuaaguuggagucacgugagaacauguuuuguuggguucugaguguucgauggcuaagcacuguagggaaugggagacuggguguacuguagggaaugggagacugggugcacuguagggaaugggagacugggugcacuguagggaaugggagacugggugcacuguagggaaugggagacugggugcacuguagggaaugggagaccgggugcacuguagggaaugggagaccgggugcacuguagggaaugggagaccgggugcacuguagggaaugggagaccaggugcacuguagggaaugguagacugggugcacuguagggaaugggagacugggugcacuguagggaaugggagacugggugcacuguagggaaugggagacugggugcacuguagggaaugguagacugggugcacuguagggaaugggagacugggugcacuguagggaaugguagacugggugcacuguagggaaugggagacugggugcacuguagggaaugguagacugggugcacuguagggaaugggagacugggugcacuguagggaaugggagacugggugcacuguagggaaugggagaccggggcuuuggaucaggcuuuccuugucccuuccuccagccuugaucauggucuuguaaguggcagacguuugccucccgccugccuguaccuugagcugcccuuuaucuguucuaguuagcaugagguugggugauacuggcuugcauguuuguauuucacauguuucaccuuauuugaugcacucgugugaaucaacuuuggauaaaguuugacuggcaaaucuugugaagguacuuuaucgugccaugaauuaacuuuuuauuacagcauggagaauaucuuugggaaaaaaaauacuuuaauaagagaaaagguugcuucugccugucccagaagcuguuagaauugggaacaaaacacccauggccuuacagagacaaaguuuggagcugagacaaaaggauggaccaucuagagacugccauacccagggguccaucccauaaucagccuccaaacacagacaccauugcauacgccagcaagauuuugcugaaaggacccagauauggcugucucuugugaggcuaugcuggggccuggcaaacacagaaguggaugcucacagucagcuauuggauggaacacagggcccccaauggaggagcuagagaaaguacccaaggagcaaaaggggucugcaacccuauagguggaacaacaauaugaacuaacuaguaccccggagcucuugacucuagcugcauauguaucagaagauggucuagucggccaucauugggaagagaggccccuuggucuugcaaacuuuauaugccucucaguacaggggaaugccagggccaagaggugggaguggguggguaggggagugggugggagggcaugggggacuuuugggauggcauuugaaauauaaaugaagaaaauaccuaauuaaaaaaaaaagaaaagguugauuuagcucuugguuuuggaaagucauggacauugucuuugaagucacacaguucuagugaggagcuugugaauggcaauaggggaggcagacauuagucugaauuccaguccugaguagcaacagagagaauggccaucaccaguuguguucuucuugggaaaguccuucaugacaacuuaauggccacccuguaagcuaccucaugcucuaguggccuauaguucauccacugugagccaccucucaagcuuucagguuuuuucagccccucccacuacugagcucucaucagacagacccuuaguggacucucaggccacagggaaagcacaccgugugguuucagcgcuguguugguugggguagacacguggccucacauuauagcugcaggugacuuuagcugucaguaccacagggguuuaugucuuauuuggauguccuacugucucuuugucccugaaaauacaaagucagagacuguaccuuuuuauagacuuuaccggcaaacauaucagagucuguuucucucauuucuucauuggagaaacaccuccgggacgggugggggaauguuuuuaaacuaguuuucaucucuuuugugaugcuuuguaaggcggaaauuguaacaguauuaccaacacuuccugugacaaaaagaaaacaguacaggccuugguagugcugaguuaauggaaaguauuaucuccaggggagaauaguuuccgccaggaaggauugcuuccucuaggagacggaguccaaggaucagagcauguggccugcaaacagacagccuuauuagguaauuguagaggacugucugggaggugguccaccgugguucauggggucguuaacguugcugccauagccagugcugaguucuuaggguuucagcaguaggacugcguggccgagaagggcgauggagauugucaaucacugcacauauucucuucucuccaugcgcuuucuuuuuaauauccaaugaauucgauuucccuggaucaaagucccagugaaaagaaaagcaagugaauauucucaguaguuggacuuccugaguguauagguaauccaaguaaguccauguacacugagauagcccuuuaaaucaaaauggucacaauguuauugggcugcuuugaacuggcguuguagcaauaguaaaugauuuuauuuccuuauuaauuuuaauagcuagaguuuccuuuagaguaaggguaaucagaaaauuugaugauguuuggaaaauuugaauacugucucaggcuauuauaaacucagauacucuagacuaaacgaugugacauuuuaaagcagguguuaauuagcuuugagaagguuucccuuuugaaaucauggccaugccaccaauaguuagaagacugguuaaguccccagcagauagcaaucauuacaguuggaaggagagacggacaggguggaaccuugugcuaccacguguucugcagaaugagguaagggccgaggacuaacgcuggccuuccuucuugugacaaaaaugugggaaagaccauuucaccuaaacuuccucuaauaauguguaauuugucagaagugacaaaaccacauuggaaaagcagcccacauuuccaaaguccauauuuugggaguuguauaaaaucagccuucuuaaauaugaguuuuugaaucacauuagagacuaucuuagugucucuucugcaguuuggacuccaggaauggaagguaaauuugaugguuacuaaguuguucuucuuuuuuuguuugauuaguuuuguuuuguuuuuugauuguuuguuuuguaauauucaggaggacaguuacuuaagaauuguagucacuggcauacaguagcauuucagauccagacauaugacagagcagugcccaggaggcuucuguuccugagcggcugaacuguuuucucacccucuugaacaccuucugccugcugcaauaggggacaccuguuucguuccuagaaaauuuggugugaaacacuccuuugaccuuucuggaugcuuggcuaaggcaucuugugacugacgagccuuucuuuuaaaagguaguuuguguucagaacugaaagucaacuuaaacaagcauuucagucaguuacccccaaaugaagauguggcauguuugucucaggaucgagagugacauuaaaccuguuagugucuauuuuuuucuauucaauuccaugcuaaaaaauaugggacucacauauuauuuuuguuguuuguuucuaaaacuucuaccuuucacaugacuugauguuuaaauauuuccuguacguaaaaaugagugagcuuacuuccuggcucauucauucaauaaauuccacguuauuuuuuacugaugagcauuacauggcacuuucuacugccaacuauaauaaagguugguaguugcuuccaaggucuuuuuucugccuaccccuguucuguaggaaguauuuuauacauccuaaguaaagggaauauuucacagguucagauggaccuaguguggccuguguccauguucccccuccauucucucuuucugucucugucucugucucucucccgcucccccgcccgugugugugugugugugugugugugugugucugugugucugugugucugugugugucuguguguagaucagaggcuaguuuggguuguuuuauuuuuuucccaggaaggcucucuaauuugugucuugagaccaacauugucaauggaauguggauccagguagacuaggugacccgugagugccagagauccuccuguuucuuucuccucuaacuacaagcacacacauucacuuugugcuuuuuaccuggguucugagguccuuaggcuugucuggcaaguacuuuauggacugaacugucuuccuaucccuuaaccucaagaccucaaagagcugaaagggaggugaggguacuggcguucuuuuucccauuuccugaucccugcuggcucaaauaugaagacgauuaacuaguaucccggauuccuucaggauggcacgaggaguauaggcacuuaauuauccuguggacucuagagggaaaagacaucagugucagacauucuguauuuugucacgcacugcgaaaucuaugugcucaaaucucucuucauguugacggugugugcuauuucuauuacauucuuugauguucagguuucagauuguauaauaauauaugaaggcauugucacaugaaauauuaagcuuuaguaacuauaccugacuuaaaccauaagcaagcauugaguucaugaauuuucagcauuauauguugugauuuuuauuagacaguuuuaucuaauguuaaaccauuugaagacuauuuucagucuugaucgauuuaauggcccaacugagauuaagcaggguggugucuacccacaaucaagaucuccuaucuuuucauucucuaucuuccuguugcucugccuuucuuucuguuccucuaugaaccuuuccuuuccccauguacauuguauuggggagugguaagcgcugguaugcucuaagaggcuacuucacucaucggacuuaaucgaggccaggugccuggcaauccuccugaacacacacacacacacacacacacacacacacacacacacacacacgcugaucaaauugagucagcugcuuggggagcuugcgggcuuacauuauaauggauggaaaaaugcccugugcuuugcaaccuuuuaaacuaaguaauaacauuuacgagaaauugugaauguuaugggaaccacuuuccaugugggagaugacuacuaagaaaaaaaguuuccuaaugaugaaugagaguuuuucaaaagcacgguuugguuugucaucuucaguucaaaaggcaacuuacaucaucacacuggggaaagagauguaguagcuaaaugucaggguagguccccaaauuauuugguuguguuuugugacaucgagagacagugcccuugguagaaucauuguaaagcacacuugaaguucuauguggaaaaaguugaaagaaggaccagaacauucuauuggugcccuuuccaagcuguguauuugugguugugccaaauucugcuacgucuuggaugcagagcuguaagugccuacagauaccagacaucucauaucuuagcuuggcagugaacauauguagucugccugauagugguccagccauauuuuguaauuuauuucauauaugaaagggaaaguaaaaggaacguuuccuuuccuguggauaugggguaaccugaauaucaaagcucaucuccucugagcuuggauugguuuaggagucacugcauuugcguguccacucuugcuuuccuguucauuuucagacaucuuuagugucguacaucugugaugugauauuagcaggaauauguuuucacuacagauuuucuuuuuuucugcucugucauuguuauuaucauucuaugcagucugcaguuuaccugggagggaccaauggucagaaacuguuagcacugcucgacucagcccuccaugcauccauuguguuaccuggaaucucuaacucuaguuugacauuccucaggcacacucccagucaugguacauccauauuuauuuauuuauuuuguccaugaaacccacuuuagaugucuugaguguuuuuuuuuuucuucccuaugccacucaaugcguugucucuuaggucucccagguuucccucaucuuuucccuguuuggauccauuaaucacaggccaugccagucuuccuagaaauguucuaacuguauaauuugggcagucuccuaacucuugagucuccgagugucccuacuucagaguggggcauuauaguaaucaccauagugaacaugggaggauucggaaggauacugaugcgugaguugggagaguucugaaauaagugacaguugcucuugucaucaguaugacaauuacuugaaaaaauagaaauaagacuaguggagaaaguuggugaugaacuaacgaaagcuuaaaaguauggauuugauauuacagaagauguguggaaccagcagagguuccuaagcccugaagugauaucacuuaaaagaccuugaaguugugauuuaaaugguuucuauagugaugggaaagaucaaucacuaauguaagaagagcuguauuuuguaucgagauguagugcuguuuccaggucacugugucuuauuucguguuuuaucucccuccuaacugacauucuguuucaagcuucauuauugcauaguuuuauuacuucuuaauaaguggcuugaagaaaucauuuuauguauguagugacuguuaguguguucacuucauggucaaggagaugaagcaaaauuaaagucgagucauuuuaacuuuccagaguguuuguguuuguuguuuacuucauugaaaccagguugguaagaauuuacauuuuguuaaguggauuuuaacuuucaggaaucuuuaugcccuaacucucucaaagacaggauucagguuuaagugaaacggaauggaaagacuagggccucucugcugcugcagugcacgauuuauaucucgauaaaaugaagggugugaggucaccucuuauggugacaucauccuuuuuauaucaguguuuuccuggcuuaacaccaggaaguguaaaucaagagcagaucaaaauguccacuaaugucaagucaccaagcgcuuuggacuuuucacgcucugucaggagaaaggggcuugacucuaaaauccgaagcaagcuuuuagauggccacaagcuucuagcuuguucacuugccucacccccagguuguuagccuuuuuguguauaugugcauauuuguggguguaugugcauggccauaugaaggucagaggacagcuugugggaauuacuucucucucuccaccaugcauucugggcacucaacuccggucgccaggcuagcuagcccuuacuccaagaguuuucucuguuuacgcaucauacuugagcuccugcauagauauuggaggagcaggccagccaaaagggaauuggcauguaccaaacugcucuaauuggaguuaguggugagguccaggacggagggcacuccugagcacuagggaggugcuggguuuggcucugcuggucuaacacuuccauaaggagugggaaccucugggucuugcuguaagguggaaggugaaguuacccugucaguaucuagacugaaggggaaagcugaaggauagcccugccuuuacugugcugucugggucacugugugcgagcuguccauuucuuccacauuucacccagagucacacaguuggcaucucgauccgauuuuaagaacccuuuaggagaaaacacaugucacuuggcgucgacuccaugcugggcaccagggaaagucacacacagacacacagacacacacacacagacacacacagacacacacagacacacacaccacaccacacacacacacacacacacacaaacacacuaagacugagagaugagggcagaauucacaaaaugcccaacacuacagauuuccagagccaaggauauguucaugguauuuaauccucuuaggacacaaaucugugugacauuugagcaagguuuuagguacauauuugugaacuugcucggauggcagacuaccauuuucucaugcauaagcaaaagagguacuugguauuugaauuggcaucucugguaugacuccacggauaucauacccuccaaggucuuuccuacagaaaauugccuuucagagugaagguuaagcacccagcccuucucgcucuuugaauauugaucugagagccuguguagggcuacaggcuccaaggccauuguaagucuggagcuguugggggggggggugguugcgaugcugaggcccagaagaaacacaccccugggcuucaggcugagacuauuuucaucaccagcuucucaggaggacagaaagcagauugacagaagcuauggccacaaguauaacauaguaauggcgcuggugaggggcauggggauuccacagucagaaggaugcaauagcaagggagguggcggguagggaacacuguaauguaggucccaaagaguagaagauugaaggagccugguccuuuuuuuuuuguauucaggcacgagaauuucuguccuagaguucagaggacccagacacaugggagcuccagcauaagaggucaguugcagcugaaaacaaagagguuagcuguaacccaaucagagaaaagcccaccuguuccaucacagcugcauggccccauccuacuagcaguaggaagagucuacaaggcuacugucuagcagucucaaaauaaguugauugauuugaaaguaaauuuaguuaaucagauaaugugaaauuucccaagugucccuuaaacugagcccccuuuccucaaauuucucuccuacuguuauagaaauaguuuguguguagugaacugugguagccacaaaugggaauucagagcuacaaagaaacaaaggccugucacugcaucuggcuaccucaccagaagucgcuuaagcggucugagaggcuucuguggccugagagguagagauggcauuaggccaggggacugacuauuuuaguggccuuccuauucuggguggcuuuugucagugacaccagucauagccagaaacagcuguuucuguggaguccagacugccaucuauuuuuaguagaagcugggagaaugucagaggugauguuugaguuucuccgcccuuuugugauggucuaagauuaggcuguuuagaccuucugcccucugucauuucacuuauugaauucaagcacagccuuuuaauuucagcacacguaagcucuggggccauugaaccgguucuauaaacaaggacuuuucugagccacagauaggaauacaagaaguacacagauagcgugucagccagcaguugguuugagaggagcaagacuugggaggcgucucugcacuccccugaaggagcaggucugcugcuuugauuuaagaagcccggauguuacagagaacagcaaaugcugagagcuuggugaaagcagcuguucaguucucuagacauugcuacucuguaagcuuucacuauguuguauguugauuaaacaacagguauaucucagcgaaaaugcaagauagacaagcaaaacacaauagaauauuugggaacaaaggauaacuguugacuaggaagacauuuucauuggaggccauauuuucccauuguaucaaaaggguccuuguuuuaccuggacucuauucuaaguaaguuuguuuccuuuggcccugagugugcuucaguggguaucagccucccagcuuguaacugauugugaacauuguuuuccuuuccguuuucuaauuccaagggaagauaaccaaguuacacuccuuccaaauagcucugcuuggguacaggaucuugaccagcuagauugggcaagauuuagucaaggcuguuaggaugcugccuguccugagaagggaaucgucgucauagaacaguuacgccugcugaggcacacccuuccuugcaugcaucuuuccuugagcaccuuuccaguggcuacccauuuagagauacuuaaacacccuguguacaucuuguguacaaagacuauauguuuguagacuaauacaaaaaguagaaaacauaauuauagaagaaguauauacuagaguuuauaugugugaaaaauggaaauugagcaaaugauggcuucauauaaugaggcuuccuuuuguuauuauaaugggcuuuauguguuguucugggacuaucaugagguuguuaagcaaaacauaaauaaagcaaaauccgggagaguguauuugcuggaguaaugcugagaugcccacauguaagucugcucauguuugaacuccaaaaaggaggaggaaggcacaguuaggaucuuggaagugcgcuaaucuuguucuuaaauuggcucccucuucuuugguguucccuaagccuacaaagauacuugaaaugauagaaaaguauuuaagaaugaaaggaagaaauugagaaugaaucuugauuuguuguuguuuacacuucaguauuuggagucagccauggucacugucuggacaaccacagugcucucucuagaguguucuuggaguauagcacagcugcaguaugggggcuaacacuucugaacugugaugaccuuugcugcacaaguucccaaggaucugcacucugagugugaauuuuuaacagccauuuaaagacgugugugugugugugugugugugugugugugugugugugugagagagagagagagagauggggaaaguacuaacugguuaagucauuuucucugauccaugacuuuuaggaaggugaaugaauaagcuuugaauuguuuauuugacauugaaaaauuauauggaucccuaagucuggugaagcaucaacaaaaaaaaguauaugcucauauauacauauacauauacauauacauauacauauacauauacauauacauauacauauauauauauacaccccacacacauacccucacaauauauauguguguguauauaugugaauauauaguauauauacauaauauguguguauauaugcauauauaguauauguguauauauacauacauacacacacauaaaugacuugggaauguuaguggaauccuuugaaguauuuuugugugaauauauuuuagguuuuuacauaaaaacuagaccaagaauuaaauaaguuuucuucaucuucuguaacuaggaaaauagaaacauaacauuuuucauuuuuuggcauuuucauauaaaugauuauggaaguauuggguguuaugguaucuugugauaacucauaaccaucacuucgugucucagcuuuaagaacuuuguuaaaauauucuuuaucaauauaucuauaaauauucauucaaaagguuaacauuuugggagcuagggagauggcuuauuggguaaaugugaaugcuguggaagcaaaggaaccuaacuuuagaucucuacauagaagccaguauugagggguggggacagaaagacacagggauuccccagggcuugguaacugcuuacacaaacugaaaugguggagaaugauagacaucagcugacauccuccucuggucucugcauguguuauacagagggaugcacacccacagacacauuuacacauauacuacacgcacaaaucacacacaacaaacaucaaacacacucaugcauaucacaaacagcagacaaaucacacacaauacauauuacacacaucaugugcacacacaacacacauaucacacauauaucacacacagcauaucacauacacagugucucacacaauacaaauauacauauccuaugcacauuucacacugcacacauauuacaugucuuaaucacauucacacauaucacauaugcauauaucacacaucacaaauaucacacauaucacucaugccacaaauacuacacauaucaaccacaacacauuauacaugucacacacaacagacauaucacauaucccacacacauaucacaaauacagaguucaaguuuuaauuuuauaaaauuaaaauuccaguuucuuuucuaggacaaaucaaaauggagcugcaaguaucauaaauagacaauaaaaguauaaagucuuuugcaacacguguauuuucaucacauuucuguccagucucauguacuaugagaacucucccuguauugguuuuucuuggguuuuaugcuguaaaaaauuuuguucuauacuccuagauuuuucauuucuaguuugcguguacuugaacuucacagauauuaacuauagauggguuuaaaauaaauggccauuguuguuuucauuuuuaaugagugguuuucuuuagucgccacaggauggaguaggggauaccaggggacagacacaggacuuagugacaccaccugcagccauggcaguucuguucuuuuauguuacauguuuuuccuguguucaaaugaaacauugcuccugcuacuuuacucuauaugcagacaaaacauucaugagcaugaaauaaauaaauaagucauaaagacuuaauagaacuucacucuaaagauaaagauuuaaucuagaaauauaguccuauuacuauacaauaggaaagaguaugaauguggcuguguggcuguugaguacgcuaucuagugacacugaaagaaagcucuacuuugauagauuuuuuuuaugugugucauucagugaaaaauuugguuuauaguagauuucuguagaugagaguuggaaguuucuaggauuauugagucaaauaaacacacaccacacacauacacacauacacacaacacacacacacacacacacacacacacaacugaauuguuccugaaugucuuacuccuuacuuucaccccacacuggauacuaaagaaucgguuaauuugauuuuuuuuauuugaggagcuuccugcccucuauuaaaguaaucacaauuuggcuguauucaguugguucacaaaacuaaaucuagccaagugauccccaacguguuagacaaccagaagccugggaguguuaguguaaaugcugauccagugcauggaucucugcuguguaggcuaagcuguuaugaaaucaagugagagauaacgagaguuaucacaaccuuuugguuuugccaguggucuuguuuauugacuuagucauuuucuccuaucagaaaagaaaacaaaaacaagcaguugacuagcacaggagaacaguugaaucucuaaauuacaauucugcacucuacauuucuaugcauacuuuauagccggcuaaagauucugaaaucauuggaugaguuuaaguagcugaauacuuuggucacucaacaccucuuaccuaaauucacuuuucuccucuaguacauucuaugguacucaccuggacaaaaauacuucuguugaaacaucaggaguguuugcuuccauaauaaauaggcuagacauauuuacugauuacagucauuaaauuugauguuugcauuaaacaaaacaaagggaaccaacuuucuuggggaugucgauuuagcuauuuugccaggucaucaucaucuggauucuaguauguacauuuguuuuuuauugugucauguuuuuucucauuaucuucaaugaucauagaaacauuaaggcacauaaaagcuuugggugggaaauuuuaauuuuuuuuccaaacauacuuagacuugagguuaccuugauuuugugcaauuguucugccuuaacauccaacugaguuuuuuuaugauaguaauagcaaugaaauaguaaugacuaauuaucccagcagccaucaacucaaucaaaauguuugguugaauuucacuugaaggcagacuuuugaguaguuuccaguaccacccgucaccuuucccaucuuaguaauucugagcccacaggacugucgaacgauuugcaggagggugucuggcugugucuguguucuccacugaacagaaugaugccugauguaaaggaggagagagcagauugccagaaguggugcgggcgccaagugguaauggcucuacaggcguccagcagggauagcugcuauucuucgcccagugcuucuggguuagcccacccaugauguccuagugcugauuccacaugcacugcagcuuagcaccugagaggugaaucuuuuuccacaaaauuacacauucucuacucuugcuccuuaaauuauaaaugcacuauugcuuuuggcccugcggggcauaauuuucuaaaucuugaaaaauuaauuucugucuggcuacacugaggaauaauugacaguuaaaacgaauuugcaauuuuaauuugaacuaguuuuauaguaaggagaaauaugacuauuuacaaggaaaagaaaagguggcuuuuaaugauuuuucucaaaauaccuaugcuuacaaauucuguuguaagggugcugcagccugacucagauauugcucucucgggcuagguuauaacuuagauuauucaguaaaauuuaucuguguagugaguuuucuuuuaccccgagucuggaauuaucacucuuuaaaguucuuuccucuaugaaacaaggcuagacugagauucaccucccgagacucauguuggagguugccuuugauuuaauuuauuuuacuuucuuauguuuuguuuguguuugugacuaugaagugagauauuuucuagacuuuuuuuuuaaaugaauuuguuccaguuuucccuuuuggggaaaauggacuugccgcuguuuccuuguuuauuuaguugccagauuucaccugucugaaaauguuguugcaggauuuuagcuuuaacuguuauuggaauauuauuaucuuugauuuaauauauaagcuuuuauccuucacaucauccuugaaaaugcauuuuaucaucucagguuuuaaauagauccgagauguaaaaggcgaugacuuuuauguauauuuuguagagaaaggaauugacaaacuggccauuuagguggugauuaaguuggaguaagaaauuagggcucugauauuaagauuuugaguauauuugacauugucaucagggaacggcucuaucuuacauaacauucauauuggaaugggaagagcaaagaagugucugccauuugcucuguacgugucuugucucaguuucccuguguucuuacuccuuguagggcucugugacacucuccuguccucgcaagcagagucuugcugcucugcauuuccuccuauauugaaaacuaugaaguaugucucucagccagcucuguuuguacuggcucagaaaacugaguuuuaucaacuuggaucugucucaaaauugcaaggaaaggccuacuuuuggaguugcucagcggggcuccucugcaauucaggaaaaagccuaauuaagguuuccugaaacugccuuuuaaucacugggauuaccaugaaaaggaacguuucuaaucacauacauaucugcuaaugcuuuucuugugguaucugauuacuuugauaauaaaaaguagcaauaaaguggagaguuaauggguuuuaaacaugugguuucugaaccauauaaguuguggaauagguacgcuuagugaguccaauagaguuuuaaacauagacugugaagauguaucacauacaguugaugaauagucaaccucacccaacgguuccugggaaguggaggcucuuguauguaacagaaaguagaaagaaauuaaaaucguguugugaccuggacauuggugagucuccucuguggcuucaggugauccuuagcuccugauuggcucuuguuuucugaagguaguccagcuggugaguuacagaacgccucuucaaaugugaauccuggguaccgagagugaaaauuagccacuuuaaauaaaucuauuccacacaggaauaaucuccuguauuuuaaugauaaaauuccacuguuuauuuucacaagggagaaaauaagguugcaggccagggaagcuccuaguaguauucgaacaugcuguagugacuguuaagaaauucaguugaugucgaugaccaagagaacacauucucuaguagcuacugcuuugaguuggcuccagcgcagggcaauucauuagcagcuguugucaguccauagcagaacucuuuaaccuacuuggcagccucccuacaugagcaaugagcuucuuugcagaguuugacuuuuggacuugaugggauauuagcuuacaguucuccaagucaaguacacaguacuaaagguguuccuucuguuuguguccaaaugcgcaaaugucagacuugagccuggcugcuuugcgacuuuacuuuguucuugauacugagcgcggacugcugguuucuuagagucuccucucauuuaucuuaagagucucuucacuucaggcaucaaaaacacauguggguucaguccacauggcuguuuuguuacuuaccauugaauuguguguuugggaccuucgaccgucugaacccuuaucuguuugauaaagaaauuacccaaccaggauuuggaaagaaaaccaggaaaaaaauaaauaaaaaagacagggugguaguuugcuggcccagccugggaugugucugcauuccuaaaucccugccuuuaaguuuauggcuauaacaaauauaaacagcagugaacaagcacgaagagcuuuuauuacacacacaggaguuaaagaugaaucucagaugguggugaggauuacauuagucauucauacacacaaggucucucuauauaacccagccuggcuuggaacuuuccggcaauccugcugccucucccaccugagcauugggugcuaagauuacaggcuguguugucauggccuuuggcuucccugguauucguaagcaaguggcuacauguauacacgcuuuaccggguugagaaaagucucccagugcuuucggaugaguagugaguacuccgguguggcagcuaguucucaugcugaccuugcuuccagggaagucagccgacuguugacacgguuuuuaguagucauauuccaucugugucacugaguugggcuacauuaguuaucucccaaugugccauucaaauguugugucuucuguuuacaauuuauuaaaauauaggggaguauaagggaaugaaaguguuuaaagacaucuuuggggugugcuuguuuucuguucucaucuucccacuucuauguauguguguguguauguguguguguguguauuucuaaauacccuucuguguguugccccucugccagugcugcccaucauugaacguggcauguagcuaucauguaguaauaaguccuagauuagucagugugggcgugacccuguccuagugcugguucuuucugcauuuucacuucagcaaguggcauagaauggugcauggagcacucaugacaacgggaaugggaacuaugaucacugucuuuauccuuauggauuuuggguaaauggauacucggaaaaugugucuuucaaaugaagaccacaacaugaguacacauguugguucuuagaggaacaugucauuaauugcuaaauuuuaguaaugauguaagauuuggaggaagaccauuaaauauuuuaacuugaucauauuuuguuaaauccuuaaguauacuuuuuuuuuuuaaaaagaaagacaaaacaaaaccaaccaaacaaacaaacaagcaaaaaucccaaccuuuuaccuggaaaagauguaguagcucuagcuggccuuuuauuuuuauuuauguguaugagaguguguuugucugugaaugugugugugugugugugugugugugugugugugugugugugugugugcaggagccuguggagucagaagagcgugccugauaccuuggaguugguauuacaggguugcacguuacaugugagcuaccugacauggguguugguaaccuaaccaaacuggguccucuauaagagcaauauauccuguuaucugcucagccuuguuguccacaccccaugcugaccuugaacucaaaucauuccugcuucagucucccacaagcuggagcuguaggaaggugacuucacuucaugucugcuggcagauuaucuuaauuacacacacacacacacacacacacacacacacacacacacacacacacacacacagacacccuuaugugcaagauauuuucccaaugaauuuuuuagaaggucuucaugaaggaggcugauaacacuuacguuuaaaaaccuaaucucgaccaaauagcuagaggaccaaaaauggccuucagggagauucuauaagcagcuuccuucugggugucauguguccuaaguauacagagaaggugugcacuugucggccgcacagugcuaguguaacaguaaguaccgacugaggugcguggagauccuccucccaggccucuucucccugcuugugccuguguggcaguggagggacacuuugcugaggugguugcucugagggcgguagcucaucucccccgagcucucuaccagguagguggccguggguguuccagccugcugcagaggaucagguuuguacaaaaccacaacagaaagauccuauucuuuuaagauuuaaaaaaaaaucuuuaaauauaugaauaauaacacauugaagugaaaauuaaauaccucuccuuuuaguuuuuaaacacacagcaaauugcaauuacuaaugaauagaccuguauacuuuuuuuuuucaaauucuucuagauuacaaaaguagguuuggcuaaaagaaaaaugagaaaauacugaaaguagugucaucugugaugaaacguuucucucuugaccguaugugguuuuguauacaaaaccuguaaagcauuacugauagugcuuguucaacacuaacaaggaauaucuuuuguagcucagccucauuuggauugcuuuauacugggaaaagagagagagaaaaaaaucaauuuuguuuucaaaacauuccaagauauuggucagcauuuugcaugagcuccaaguuaucuuacaucccuuuucugcaguuuucuccuauuaauuuucaguucagaauuaaccaaacugcuuuagugaggguuguggcaacucucauaucugaguggcuuuucagccagauguuuggaacagcuuagauaggggccaagccccggucuagcucugugaccuuuaaaaagaauauccgcuuccugacacuagauaaggaucucccacucaccgccucuuccucuuuagagagcucuuacagaaucaguucauuaaacuaugugaagugacaaauuaugcuuuugguuuaaagugguggucagugaauauuugagaauagaaguaccuuuccguggagaauuugguuucguugugcucagguuccucugcaugcugacugugucuuuuguuugcuugcuuguuuguuugcuauuaguaguguuugcuaguucaccuuucuaccacucagccguaacucccugccuuaguuaagcucgguagguucuuuccuaagacucuguguugaccagugcaggcauagaaguccuuucuuuaguucaacgcaugcuacaguaaacugaaaagaaaaaacaaacaaaacaaacaaacaaaaaaccuccccaaacuucugagguuugagacccagaacaaguuuuauuugguuugcucuuaauuuaccaaccauuuaacucuuuaucuucucaagugccugcuguguacagacaacucuggggauguuguaauuccugucacuuguugccuaucuuaaagaauccccuuuuguucucauuucccccucccuuucuuauaccuuuuccccuuacgagcauucaccagugacaauucuuugaauauaacguaaggaacuggaaugguagaauucuggacaaaacugugggaucucccaggcccagaaggauuaguuccaacaucugagacugggacuuugcugggagaugaguggucucucaacaguaccaugaauuuggcauugugaagcuauaaugcuguaaacacagggcuucuaauaugucuuagauggggggaauaccuuagcaguggguugggucagaugucuucaagugagaugucagggaaaguaugguuauagcuuucaguuugugagaaugaauguucagaaacacagacuuuuaaaaauuaggccaucgcuugccucaggugaugaaugaaguucucugaccugugcuuuagaaagauaguccugaaagaauuuugaaaacuguauuauaguuaauagaauguagccagagggaugacuauagauggcuauaugacugcgguuuacauaaaugaccauggacucugaaucaccaguuauguaacaguacagaggcaaaagacagcaagugaagaggaggaacagcaaggacgaggagcagguacagugagaaugaggugcaggugcacugaagaagagggacaggugcagugaggauggggagcaggugcagugaggaugaggggcaggugcagugaggauggggggcaggugcagugaggauggggggcaggugcagugaggaugaggggcaggugcagugaggauggggggcaggugcagugaggauggggggcaggugcagugaggaugaagaacagaugcagugaagaugaagaacaggugcagugaggaugaggaacaggugcugugaagaugaggaacaggugcaguaaggauagcauguucagugauaaugaggggcaggugcagugaggaugaggagcacauacauugaggcugagcagcauaugcagcgaggcugagcagcauaugcagugaggcugagcagcauaugcagugaggcugaguaacagguacagugaggaugaagaacaggugcagugaggaugaggaacagguacagugaggaugaggaacaggugcacugaggaugaggaacaggugcagugaggaugaguaacaggugcagugaggaugagaaacagguacagugaggaugaagaacaggugcagugaggaugaggaacagguacagugaggaugaggaacaggugcagugaggaugaggaacaggugcagugaggaugaggaacagguacagugaggaugaggaacaggugcagugaggaugaggaacaggugcagugaggaugaggaacaggugcagugaggaugaggaacaggugcagugaggaugaguaacagguacagugaggaugaggaacaggugcagugaggaugaggaacaggugcagugaggaugaggaacaggugcagugaggaugaggaacaggugcagugaggauggggggcaggugcagugaggaugaggaacaggugcagugaggaugaggaacaggugcagugaggaugaggaacaggugcagugaggaugaggaacagguacagugaggaugaggaacaggugcagugaggaugaggaacaggugcagugaggaugaggaacaggugcagugaggaugaggaacagguacagugaggaugaggaacaggugcagugaggaugaggaacaggugcagugaggaugaggaacaggugcagugaggaugaggaacagguguagugaggaugaggaacagugcagugaggaugaggaacaugugcagugaggaugaggaauagguguaguaaggagagcaugugcagugaagaugaggagcagguucagugaggagagcuugugcagugaggaugagguacauaucuuuuugagaugauugaugugagagcacacuagacaugggauggccacucacuguaacaaaagccguaaaggagucuaucugauggauucaaaagccaucaacaggugauuaaagaugagagaggaaaauggaaagaaagcaggagauaguuggagcuggaaguaggaccucaagagacaacccugucuaguggauccauauugugaacagaaaacauuuuaagucaucuagcagugauuuuagaaacauuuuauuaaauaauuuauuuugcauaaaaugucuaaauuaucuuauuauauuaagagaauaauucuguucucuguguguguguguguguguguguguguguguguaguagagcacacugcauggcacaggcauggaggucagacaacaacuuguaggccuugguuuucuccuuccacugugauuguguaauguguagguccuguggcuagaacucggguuuucacguuuguuggcaggugccucuaucaauugagucauccugcccacccagaauaaugaauucuuaaugaaauaguuuauauguuuuuaauucauacugucuuaaaauaugcuauguauuuguccuaaccacauuugaagugcagcgucucacaugugucucaugguaauuguuuccacaguuuauacuuaagccauuuucaaaagucaucuacuaucuauguaaagugcugcagcuggguaguuuaaauaugcagucagagugccaucugagugcugccaguuucaugggauuaaguuguagcuuaaagaaagcauacaggccuuuggaucaaaagaagaaacacacugguagcauuagccaacaugugcuccuguaauagcaugccuuacuauuuuuauuaacuuuuucaugcuuuaaacaugauuaaacugcaguacauuuuagaggaaaugcaaauuuaaaagaaugacauugacagauuuguaacuccuucaagguguguaacaaucacaaauccauguuuuuuccagugacucuuagucauaguaaucaaccuccauauuauuuuaaguuuccccuaauguuauauccuaccucauugacugaaauuagaaugacagaacagauaaauacagcuaucacuucacggaacugcagggaucaggaguaaaaguggaccacagcucucuugugucccacacugcaagaugggucugcuuccagguggguuucuggcuaagcaccaagggucugaaggagguaguccacuccaggaaaaucaacgcuggcugucccucuggugugcuuggcacuuuuuagaggagauacacuugauaggagagagcagcacggggaugggggagaaauggagccacacagaguaccauaggaagaagaaucaguaagggcuugagaaagauccccaggccucauaaauccacagccucuuugcuuaagcagcaagccuaaagaacuaaauagagguuccauaauuauucugaagauuguguauuuuaaaucucguggguaauuaucacagcuaaaaauuacacauuacaauaaucacaacuagcaaauuaccuggaauugcuugcucaguggauaucuuucagcacccgaaauuuguacauaaaaugacuauucaugagagcuauuuauaauggagugcuuguuagcacuggcugguguaaagacuuuacugauuucucuaauugaauuuccaucaacaccgcagguuucaguguuaccugucuaagucaaggaguuaucuuauccuuaaauaaagcugugaaaguguacuggugaaaugaaguaguauaucaaaauauauauguguaucugucuguauaggggcuggauuggauuucuuguuaaguguucuuucaaauuugacuuuacccauuaaugaaugauguauguccagggugccggugcucagugucuuggcugcuuccauguggcugcauccugacauaccauuaaugcuguaccuaaagggccaguugcacaucuuccgauucccucccacacacagagacaugugaaugauuuuugugaguagacaccuuuagauuugaacuuggccugugcucugaguccccuggacucccugggagacuccauugaauucagcauuuaggucuggucuuuccuuuggcccuuggcgcucugacuuaggugucagucggcagcccagggggagaggccacuguucaaccucucuucaggcagauacuuaaaaagucuccuagagauguaugggauuucucuacuagaaagauacggcaugaguaauuuugcuaaggucaaagaugaauuuuugaaauuaaaaagccaagggugggcuguuccagcuggguaugacaggaugugggaagauacccuugugcccgaagcagcaucacuguucaaagugccgagagccugggugugaaccuugcagccaugcaugcggguuggggcaggguggggccggggcacuggagguagggccggggcacuggagguagggacaagcagaggaagcucccaucauguaugacgcccacuuaaguggggauucaagugucucuugaguauuucaaacuuacaucaccuuagaggcauguuaugagacucucaaauuauuaagguaguucagcuauuuuuugaugacuuugcauuguugacuucuugccaaaaaucauauuuucacacacaugcucagagcacucuccuuuucucccuccagcaucccuuggaucuuugagaaccuuuucuaugcucaggcuccaggcgauugugacuagagguggaguccuggccuuggcaccauuucugaggcaugugguugaucaagcacuauauauauaaaaucugugcccacuucugagagcuuuuaaccagcguaacucugcugcugugugaaacagguuagcguagaaugugcucuugagaaaagugaugauggcagguuagcugaggaguccuaaaggugggcagugggaagggcaagcaugcugugggacuccuugcuggucccuguaccauacagaaagcagcacauuucaaaggcauguggugauguugcagaacaauucagaguucuucagaaaaugaaaaugguagacuuucaaaccugucuucauguuaaugcuuacuuaaaaggcccagugacuaauuugacuaacuccuuguuaaaagauuucucauuuuaacuuuggauacaauuauacuuuaauagcugcucacauuuaaaauaguuuuuaaugcauugaaauauuaaauaugugauaugcuuuucucauuaaaauuucugucuuuuuaucacuucuguaagugugguauuuaacacagcgauuaacuguggcuuuaaugccccguaccuauguuuuggcagcaauuaaaguuauagaccauuuaucuguucauaauaauugcugcuuccuuuuaagccauuuuaccaagugccguaaagguuauuuuuauuaauaagccaauauuucugccucaaagaaagggcuaauccuuucugaaguuugucauuuaacuagccuaagucaugaaugcuuugaaaagugguucucuguguauauggacaaaaguuugucaguuaauuauuuaagaaauguguucaacaggucauguccaggauuuugacuuuuuaaaaucaaauuaauuucuaugaauaaauauuucaccuacuuguguguauguucaucaccugugugccugguacugauguaggucaaaggagggugucagguucccuugaaaugaauugacagguaauugggaccagccauguggggcuggaaaccaaacccgugcccucugaagaacaguaaaguacucuucaccacugaccgagccaacauucccacucgugauuguauuuuuaauuugcugauguaguauuuuuuccuucucucucagucuucaaaauuauuauguaaacuuaaugggucaaaaauaauuguuuggggcacaaaaaaucauuuugaauaauuuuucuugaaucauuuaaguguuguugcauuuauuuccuauuugauuuguguaguaguucacuaacuuuugcuuuaucuuucuuuuuaguuuuauuuguuuuauuuuucuagacuuuuaaaauauauuucuagggguacuuuuuaaaaaagugugugcuguuuugauaaaaacauucuaagauaaauaauuuucuuucugcugaccugguuagucuugccagugagucccacaggaggacacagagaggaagaggaguguuuaaagucacaccacagcuuaggugcccucugaggcucaggcaaacgggggcuagguugggucaucuucacaguaagcauugguuucccagccccuugggugguuuguuugugcugcccaccuugaggucccgcugggugggugcuggagacccuccuggguugucugcaaccuuggcuccaugaugaaauucccugggaaguuuaaccgaccuugaucccugaacucuuccccaggaggcuuugcuuuaguggugcagggcuuugcugcugucugaagaucuguaaaaugguuuggugagucuaacacgaaagcaggauucaagacuguugccaccacuuuuuaaaauuuuuaaccaaauagggaaucugaagcucaaaaggaguuagugacauguccgccuccagacugacacaauacagacuguaaucuuuacauugcuuaaguguuuguuaguuuguuuuuuaaugaggacaucuaaguuuuuugaaaauaaaaguaugugcucugguguuucuaaggaacucucaaaaaugccucacuguuuggcuuaguccaggaaaaugacaaguauuauuuuuuuaucuguuuuaacacaggaaaugaaacaugggcauucauaguaaaaccuauagucuucaccuuagauaugaaauucaggaaauuaaggagguagauuuagaagagucauguguucuaugaccugcccacaucgucugaaagaauaucaaacaaaggaugaaggcaacugagacucuguuaggccaggucgacauguuaguaauuccaaaggagaacuguaauguucacguugugacaugagucauuugggggacaaaguuccauauuccugcggucaggguuacugcuuucagcacauaugacauaucaguaacauaauugcaagguagaaacuagacuggcauuuuaauaauggaguuuucagaguuaugaaaggggaaauacugagaaaauaguguagacaaacuacauagcccauauauuuagaaagagguguauuggggguauuaagugagaagaaaggugcauggugcuuuuuauuuauuucugucuauauuucauuacucauuaaacacacagauacccaacaacccuugcuacaguuuugccagguaccucucagacugccuguguaucugccugucuaucucuauuugucugucugucugucuaccuaucuaucuaucuaucauguuuaaucagaguuguugucuuucccagacuccaauuuaccaucccauggacacaggcuacgaugaacaauuauuugcugaaugcaguuacuauaccuuggaccuagggcagugguuugcagagugugaaguauagaccagcagaauuaucagagaugaagacagcucuggggagcuugcuggaugaagauauucucagucccacccaaaaguucagacacaccuguacuaaggcgguauucugaagaccgccaugauuucugaugcucauuugcaugagaggaucaucacauuuuuuuucccccaugaaagccuaaaauaaagaacaagaugguaaaaagaacauacucauauaugccccaggagcaucuacagccaaucucuucucugaggcuaguuuguuaucguugugcgcugggucuaauugcuucaaagagcacuuuuguuguccugacuggcuugacuacggggauucuguggucugugaugcccagcuauggguggauggcauugaguggcuucacuccauauucacagccucagaaggaugucuggagcuucccuccaccugucuguucccucaguaaguuugguuuaggacauucacaugguugcaauggacuuugucacagcagagaaggagacucaucaacacagggacuuucacgaucucuguuucucucucguaauuguuacuugggcuguuuaaaggugccuugauuuaaagguggagcaguggucuuuaucucuauauaaaagaagcaaaaguaaaauuauaauuaauucauauaggcaagagaggagcuuguuacuacuuugugauuuauucaauauauauuugcugauggauuacaacuugggauccuuuaaugaacagaaauggcuuuaaggcaagguggguagccuuugagaaucauaggaagggcauggaggccucugugggaagaagucugacuuaccccaccguccacccacccaccccaccguccacccacccaccccacacauaaacacuggcaagugucuaggggcuguaacaucuagcuacugcucugcacuggggaucagaaguuugcauaaacucuugucacugaaaaggagcacuaaagcggagaaagggucaguucucaguguugaaagaggaagucguucccccacaccuaaccucagucuucaacaucugcuucugacuacagacagggggggaggacagacagaguuaacucucccuuuacucagcucuugucccaaacaguuugaucuguuuuuauugcgguucgggggucagauguucuuguuaauacuuggguagcuggagaggagaaaguuguaguaauucuuuauggcuuucugagaaguuacaaugccacauaccaacguuuuaaaucuguggauaggguaggauuuagucauuccuuuaugaaccccaaaggcaauaaaugauuauuaaauccagugugcuuuuguguuguuucagagauaaaucaaaacaagaacccugugaaaugguucauucauuuaccuagugcauauuuuauuuuguuuuaaaauugcagccuacuuaucucuguuuaaguaauaaaugcauaagggcagaauccagauugaugugguauccaugugauuuuuaaaaacugcaaguuuaggaaaacauuaaauaggaccuuauuucuuuauucaguauaacuaaacgugaaauaguguuuuuuuuuguuuguuuguuuuuguuuuuguuuuuuuuugaaaagcaggugcuuuguaauuugaggagauggugcuaaucuagcuggccucucugaaagauaaaagccuaccugaaaauuagaauaagcaguaguuggcaugggcuagcuguguuuguggcacuggaagggagcucagggauuaauggcagcugcucucauccugauacauauguucaaggaaaacgcccuucgcaucagcuucaugcauacaugagcgucaauuagggaugucuaugcaagagaaauguguacugauaaaaucagcuguugcccaugucugaaucacauuaaaaauugacauacauuacaaggucaaaucagguguacuuaugccuauauguuuuacauaugcauaucacccauuugucagcauuuucauggguuacugaauuuuuauugaauuggacuuuauaaauuagcuaauugaacuugucaaagggaagacgaugaauuaagaaaauauccuauaguauucagcuagucaccacaaaacuggaagaaaaacaacacaacaagccagcucucuuuucagcucuagguggcaagacugcugggaaaguggcugguagggaccuugggucccaggguauguuccugagaguucaugaaggcacauaaugucuccgcuuccuuacacaaugaaagagaaaaauggauccgucugucuccccucucugagaccuugcugagcauuguuuaugagaugcuuucuuugcugcagcaugucauugguugcaguuggcucaccuuugauacuaugcagaauucugccacauucgguuucucugugcuguugauagacauuggucuuggguaguguuaucaaugugcuugugugguuuuuguuuguuuguuuuuuguugguuuuauuuuuuuugaugaacgcacacauauuuaugauggauauccgucugucugucuaucuaucuaucuaucuaucuaucuaucuaucuaucuaucuaucuuucuuucuuucuuucuuucuaucuaucuaucuaucuaucuaucuaucuaucuaucuaucuaucuaucuaucuaucucugaguaagauugcugggcuguggaacauggaugcacauguaugcauucuuguucaauagaauauacacauauuuuaaauacaucgucauauguguacaugaugccugcuucuaacaauuugagcacuuaaaaaaugaguugugucuuuuuaauaggcuagcucacaagaaagcauuuuccuuuugccaggaaacaauagcagaguaagugugaccucagugcaccuggaggcucauccaguccgugcuagucuucagcuguuuagggacauuguguugaccagucacagaauuucugaguuuacagcuguacgucuauacuaugaaaauagaagcaaauuacuucugagguuacuucugucuacagcuuugaaacuaaaaguguccugacagaagauugcaaaagaauuuguaaauaucugcaaucucugaaggaauauaacuucccagcaaggauuuuuggauauuugagguauucaguuagcaagucugacuucugguaagaaguuaauuaauguggcacucuguuaaaauaaugauuguucuacuaacauugcuagaaguuuuacaucauauucaaaauugaucaaaaacaaaacccacaguaaauucaaauacuuuggcaacuuacaauuuaaucuccccacaaguguguguuuuguguuaaaugccuaaugaguuagaugugugcuuucuuacaagucucacucuucaguucugcacguguaccccauugugaccuuuucugacaucuaacaggucgguugccaaguugaaaagucaugagcugcuguuucauagggaaauagcaaccaguugcuagcagggcauacuuaauuugggugugguggagcugacuuugacauuuuucuuucagcucuuucucugaacuuguguuuguaccuaacuggauuccacgacuguggaaguacaccagagcucugcuggacacuugggaacccacccagggcuugccugugcccaggacuggcacugguggauagaacgggcaucggagagucuucugugaggcugaaucucuccucaguuaaggcacacauucuuccccugcagccucuagccuuguucuugcagcaugaaagcauucuguagugacaaagagauuauaggucccaugcucacguguuugauggagaaauaaacaggacuccugugucacuuucccuuauuuccauuguugagcauuugagaguccuguaaauaaaagcaucuggacccagugguuuauagaagacuucaccaguugcuuuauauuccuagcugugcuuccugcacggcugacuggcggaggcuuaguuaguuuuacccuugauuuauugcucuaagcuagcucuaccaagaaugucuuccugccuuucacauucucucuuuuagcuguaaaauggacuggcaccucccuuaggauuucuuagcagcugauuucaaauucugcuacucucuugucucuuuugacucuugugugucccccacuccaccauaggcuacacuaacgucuuucucuugauuauuguccuccggacaaaguacgguagcagagcuugauugacauuuucccaggacauuuguuggaagggguaagcagggacaggggaacuugccaaguucccuuuauuacuaagcuagaaggaauauaauagugggaacagucaagucuaggaaagaaaguaggugugcauuuacaggugacaguuuucauguaucauugccacaugucacuuguuuuccuucuuuggcaaggcuaagguuaggaacagccauacuggguggaucccuugcacuuaggcaucugaaaugguaauggaaagugauggagcugauugagaauuugcuccuuccucagaaagcuguaggugagccacaggaaccccagagcaggaaugcaugcccucugccagucggagagaagcuagacauuucccaguccuuucucugacaucccacaaugguauuuuaucagaagguucugaaguaucacccagcagagacuuacaggauuaaacugggguguggugauuuggggaucagccaucugaugcugguauuuacaaaaguaaaaaguacagacugucccaggacaaggccuucaaguccuguggugagucucucuggcgauugagcaagaggggugacaaaugaaaguucuguaagccuugcccuugaagucccaaguugaaacuaacacacuguagaacaaccguguuaccgcccacgggugaugugauugggcuucuagccugcuggccgugucaccaaggggcugauagcuguggagugaaggagggccaaaugaaaccucucacauaucuucagggucuuagaccugaggcuacuuuauaugcagucuuacaagaagaaugauagaaaaugaaagauuuaagugaaaauuguaaauucuuuugacuuccugucuaaccagugauuuuuccgaugucagacuuaucguauuaaauccgcgcccugacuuaguagcuuugagguggggccucagacucugcaugucuguagcucugaacugcuggggauauugcuggccugggcacccaguguugagcaguauugucagacauuuauugaagcaauauccacacugcaguguuuagcgucccuucuuucucccuugguguacaaugguuucuaaaugaugacauaugucauucucugugguaagcauuaguugucuuauuggaagaacacugaugaagcucgaccuuggugaggaaaauuuagaugcaacaagcacacuuccuguccuuucugguugcacacuagugcaggcgcaugccagcacuacacuuccauacaagacaaucaacagccgucuagaaauuggaguuuugugcuauagagugacacaagaacuguauauaggagacacaaaacucuuagugaaacacuacaauacucagcuacauucuguuuuuuaaagaacaaucuagaccauaacuuagagaguuaggcuggguguguacuugagagcuuagaagacauucccugccuggagccucuccaaggguacgugauaggcugcucuuguguguuugcacuugauuguguucagccgaguauucuauuuucagucaugaagaaaaggauuucuucaccacacuagauguuugucuguugacucauaacuggaacugagagaauuacugugguaucugaaaugaagacacaucuuuucagaaguauauugggaauggggugguggugguguuaucucaggcucuuuaagauggugauaacaccuugggcugaacgucuucaaggcagaacaccugcucugugugccucucucuguguguuacuguuuucaucugcuugcuuucuuggucuguuaacuguagaaugaguucuagcagagacacggagguuugcuuuguguucccccucaaaauccaucuacaaucuaaaacuuuagaaagcuucuucaacaaaguugguaggugugcauaaagauccaaggguuccuugucauuaaggucuuaguugugaaacaauggauggaaguaauuucugcaagucccuucuuagccccugaccaugcacgccucacugcuggaaucccagugacauuugcagaugaugcuccaagcuacuguugggugagaagauggacaggccuggguggagagaugacuuuauuucuguuguguggucuuccugcuuuaccagccuugucccuucaugccugucacuucugcuccaaaaccugcuguauccucagccucaucuacuccugcaagcuuuuucucuuugcugaacugucagcuuucaugugucauguucucccucucuucugccuuccuaacccugucagaaaggcuucagggcgcagcaggcucuccuugaccuccuguaguccagaagcacccuaacugcagcccagugagucggaguuguauguuuugcucucccaguaguuauuagacuguagaucagucagcagggagacugguagcuuucacccucuguggcagugguguagaguagaaacaggcuccagcaaguucucaacgaauaucuauugaaugaauaaagggauccagggugaguggccuuccauguucauagaucacaauuucuaagcaugguucaccagucugaauguacagagaacugacauuuuucuaagguaagauuuuagacaaggaagcauaagccuguguugagguggggagaauauuuauuauuuauuauuacuauuacauuuaauauuuccucauagucuagucucuguuccucucccguucugccacccuccaacaguuccucaucucauuccuccucgcccaucuccaagacgauguccccacacccccacauucccccacaccccaccaggucuccucauuuccuggguccccaaaucucucaagggcuaggcaugucuucccuuacugaggccagaccaggcaguucuccgcuguauaugugucaggggcauugggccagcuaguguaugcugccugguugguggcucaguaucugagagauacugauuaguugagacugcuggucuuccuaugggguaaacuuccuccucggagucuuccagccuuucucuaauucaaccacaggggucccagucuucagaccaucgauugggugcaaguauuuuccucucgcucaagucagcuacuuguugggccucucaaagggcugccaugcuuagcuuccaucuguaaucacaccacagcaucaguaauagugucaggccccggagcugaccccugggauagguccauacuuggacccgucacuggacuuccuucucuccagucuccucuccauuuuugucccuguaguucuccaagacagggacaacccuaggucagaguuccugacuuugggauggcaaccccaucccuccaauugaugcccuguucuuuuuacuggaggugaaccucacaaguucccucuucccauuguuggggaggugggagguggggagacccucuagaauguaccagagaccugggaggugagagacucucaaggcucaaagggagggagcugggauaugaaacuauuaacuagugcucuguuaaaucuguuaagcccuuaucucuguguaguacuuggagcuuucaccccucuccuuuaguauuaaaaucuauaagaaauaguuaaguauggcauaccuacccaagauacacacacacacacacacacacacacacacacacacauauguguguguguguaauauauaauugguauaugaucuuuucauauuucuaaguuuuaauugaaagauuaaaguuuuuuucucaauaugcugauuuucuuguuucuguuaaauuuuuuuuuuuuucauuaugauaugagaauuuuacugauguguuaaacuuauauuucuuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugcguguccaaugggccucucuuuccagugauggccaacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacaauuugcaaauucaucuggaauaacaaaaaaccuaggauagcaaaaacucuucucaaggauaaaagaaccucugguggaaucaccaugccugaccuaaagcuuuacuacagggcaaaugugauaaaagcugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauauggguacaggggaaaaauuccugaacagaacagcaauggcuugcucuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaagaauaccgaauggcagagaagcaccugaaaaaaugcucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuguuaaauuuuaaaugacuaucuccagggcagaaguagugauuacuuuugcuacuuaagguuugaauuaaauccagcaagucuuaccauggcaagccaucuuccugaauagucaucucacuaaaauugucucccugggauagacaggaacgauggucuguuuagcagcauuguuagauguccuuuugaaauuguuguuguauaguuugggcacaguugagaucuaaaauaaguguucuuugaaaaguaugucguuaauguugguaagccagggauuauuaauagugcuugacuuuuagacugagaccccuuuuagacugagcgaauacaccuagacaagccaacaucuaggcugaugucuuaucuaggcuuacgucaaauaugguuauguuaauuuauugccaggagacacagauuuagauggcagcucaauuaauggacuguugaaaagucugggaacauuccaaucccugcuucccuuuuagucagugucaggagcugcucugccuuuccccgaguacuugagacuuguagacauaagucuguuguuugucaggguaagucaguggccuagcuuaaccauagguucacgggugcuuaggaaugcuuuggaagugaaaagguaaaaguuguugacauaaggaaaaccagccaaccaaccaaacagucauacauacaugcauacaugggccugugcuauuuguagcuuuagauauccauagggaaucuuggagcuguaccccucugcaauuagggaagaucuuuaggccuuguaaauugguaguacuguuugacauaagccgacuaugaguaacugaaauucacaacccugaaugcagacaaucugaagaauuaugcaugaugacagcaugguaaauuauccacuaugugaacuauuuagaauguaauguaagcuuauuuguaaguuauaugcaauauagaccugacuuuauucccaagaugucucacuauauacaaacaauuuuuuaaucccuccacccccacaauuacagaacuacaauacucuuugucagaagccucaugagcaagagaugcuauagaaacagugaaaaucuaagacuuauacuagguaugguuuucccaaugcagucauaguacacuguuuagcaaaccauuccaaacucgguggugugauuuaaccucaguuaugcaaguuacuguguguucuggauaguuaaucuucacguccugcuggcuggggcguugguucagcuggaagauccacugggaaguuaugcauaacaugcagugcugcucugcugcugggggccgauggaaacaucucuauacacacuugcuuaggcuuccucccaaugaagcccgggagcacgugcagagauauagguaaaacuuggcaucucauaagauccccucucacccaugucacuucugagccugaagggugcuaaagcagagcaggccagaaggugcuuuagauagaaaggggggaacgguuuacaccccgugaugagaagagugacagaaucaucuuuggccaucucuaaccucugcugaucuucuaaguuaaguccuguuacaaugugucuauaaagacuugaggaaaccauggcuuacggaggauaagacagugcccugcaccauacaguugcuaagugguuuaagcuuaaugcuagcuguggcuuugaugcccgcagagagguuuuaaugacuguggugagcugacagaaaacacuaccuggaucuuuccuuauauuccacagccaauagcugaggguaguuuuauugacuugaggaauuagcccauuucagucagacuggaugacauuuuuugagaagcuaucaugugcucccucugcugccucuccagaucugaauauuucauaauuguugggaaagguuagaggcaaaauucugacauuguccuguccugcccucauuauauauauuagucuauuuccuuaccaagagcagauauauccuuugaaacuggauguucccagugggcacccucuguucugcuacagccuacaguuuucaugugguuucaauauucucauguuuacuauucauuaacaugaaacacagauuuuuagauugacccuuuuuuccuguuguucagugguuuuuguuguuuugagagcagucauuacucauggauauucuuuuuguugaaaaaggauaaacaaaagaaaugucagagaugacaacauuuguggagaacaaaguaaaaaugaaggccucuagaugagcuaaugacagguuuuaugcuuacaauaacuugaguuuucuguauuugauuccugguuucagggcaucugucuuuaauccacacauguuggggagaggggagucuguaaauugaaaauauggcggcagcauucuccuugcacuuuagcacgguuuguaaaguucacucaccuuaggggcucuucagggcagacuucucuagguaccuccugaucacaagaaaauguuaacccucccacugccuguuacggagccuuugaacauguucuacaacugccuuacucacacguguuuuggaugagagauguuucacagaagacccaucucuagaaucuacagugaccagcacugugcuguccccauuauaugcugguauucuuuuaacuggcuguguccuuugagauaucgauuccacauauugagggaucggccauaccucucagggcaggagaaguuacaccuggaaggcccccaugguuagaaaccuguguccauuagguucauaacguuugcagcuuuucuuucguuguucagaggagcaucaacuccuaagaacugguggguuacuguagguguuuuccucgguuucuuugcccuuuuauuuuuccccuggaaaaggaauaacuggcagagauauccuugcggaguuccugugugauaaugccgcuugaaacuguuuucauaucuuccaucuuguaaauggaagaaaaguauggucagcagcguugucugcucucaaguagcuguaucuuuguuguuaagguaugccgaaaugcauugugauguccucauuugacaaacuucacaaaacucagaggccuuucaaaaguuccuaagagugucuuggcuaacuuuuuagagccuguuaugaaaguaggagauaaagcuaucaaagcgacuugagaacauauucuuucucgaccguuuuuagauacgggcuuaagugucucuccguuauacuuugugcuuuuuauuuuaagaguauggaugugagaacccuucuuuggugguaaggaucuaggaaaacauacguguaagguuugggaaaacuuuggagggaaauggugagugcagcccuucccagagauuccucugucaguguucuccugaguaguuuauggcgaguguagcagaaaagcuuuuucaugugaaagccaaagcugguguugccaguggggcucuacagaugguggagccugugcugggacuggaaaucuauuuauucuucuacaagcacauuuggcccuugccuuuaaaaaaaauaaaaaaaagagagagaucaauguaauggcguuugagugauguuuuuguuccuuguugaaaauaagaauauuuaaagauuauaaagaaguagaaaaaccaacuguagugaaucugcuucucagagaugacugcugucaauauuuuucuuguauccuacuauucacuguuuaugaauuaucuaucacagaugaggaaauauuaauauaguuuuuuauuaauuuggcuuuugucaucucguuuuucuuucuuccauucuuccauuuucucccaguguuaugauugacgcacauaccugguuaugccuaccaugaguaggccuggguguggaauggugaauuaguaccauuuuugguuaucacucauagggcagcugugguugauacuucagggauggcccaaaucucgugucuuuccauucgucuauguugcagaaucaguaguggggugagcuggcccuuccaacuucugcauguccuuugucuuucccuugcuccauuccaggggaacaauguggagaugagacagcaggcuaccgaagggaaaaacuucccgauuuccaaaugggaaggagguucugaggaauuguuagugugauaggguacuggaugcuuccccaggaaacaggacagauguguuuccgcugcugcuguccccgcagacugcaugggagaguggcagcucugguuucaauuagcuuggugacauucugcuuugccauucaugaagacagaagucacaaugagaaagcaugagacaaccuccgaacuuacagagcaguuuaacguuuuuaugauuuaguagagucuaagauugagcccuauauuauuuuaauuuugcuagaacaauuuuugguaauuuuacaaauaauguuuaucaagguuuggaagcauuauuuauaaaauuuauugguaugugucuguuugacuguguuucucucugugugugugaucacauauaacauuucuaucugguuuugggaacuguuuugagugguagcaaaucuuuccuuauaauuuuaaaauauuuuaugaucucuucauagucaaauguguguguaugauguauguauauauauaucaccaacaaaaacuuuugugguaaaaaguacacugcaauauguacaauaugcuuagaaugugccuucacuacccuucagggaagaccauuuaggggucagguaaaauggagccuucacagucaguugaucacaaggagaaaggccagggaaaacaugacucaagcauauuuugauauagaaccggugcagagaagucaacagaaagaggcacggggagacugugccugggggaaugcauagagacuugguggcuggcuugggacaaacucagcgagagaaauuaggaaaggcagcuggcccucgggucaguagauguucuagaaaauacuggaaaauuauacagcauauuuaguuaagugaaaacaaaagggaaaccaucaaaaccauuaaaacaaacaaacaaauaaauaaaacuaguaagcucaagaauuuuccaaguaaacagaaacuaagauuuuuuuucugaugugucugugauaagguuuuguuaugucaugaagcaaacuauguauuacuuuuuauguuuuuaaaauuaaacuggauuagaagcaauaaaacauggacaucauauaaauagcugcugcacugcaggguugacauuugccuuaugcuuuuaaugguagguuacuuugggucauaaguaacagggaggaucuaguuuauuaaaacuguuuacuuuauuuuuauuuguuugugugugugugucugugcgcgcgugcgcgcgaguguggacacacaugccauguguguagaggucaguggaugaucugcaguugauccuccucuucugccaugugggagcaggggaugaagcuuagguucucaggcuuggccucauccaucucugcccgcugagccuucgcuacuccacguucacuauucuauuucaacugcucuucuucugaagucaaguuugauuuguuuuuugauacauguuacccaggucaugcaccuauacuugaguuucuaguauuucuuuucuuuucuuuuuuuuuuuaaugugccagugaccgggcuauggcagcugccgagaagaaacagcccccaugcauaaaucaaaggauuucucuugcccauuguauccacuagaaagcuguaccuacacaacagccuccagcaaccacauugcuuuuccugcaauaauuaauagucugguguauauuuuaaagauuuauuacagcugaacucugucacagaugagguuuuuaucaaaagaugccuaauauuuaagaaaagaaggguuguuuauguuacugggguaagauuauaaagcuauuagacaaaauaaaggugggagucauaauauaaugcuuuaguagauuguaauggaaaaauuuccccauaaaaccauuuauaggaaucaacaaauauaccuugaucauccugcuuugguauuacugugaagguaauauggccagcauuaaagaaacauuuaggagcuuuauggaauauguaaguuaagauuuaauauaguccuucucuuuguggacagugcuggugcacuccuagaacauuucaaagccuaugagaacaacucuguucaaccccagagccaccacacccagccuaauucuucucccuccuugagcccguugaucacagacagcauuccgcaccucucugggaaccuucaauuccuuucucagaugauugcucucaugggguucugggucucucuuccuucauuucuccuguauuuucaucaucuuuggagauccccaaacccuuuuagguguaguuaacugccucuuugaguccucgguccuuaaaccaagccuggauaugauagacagucacagagaucuguagaguaaauaauugaauguguguucagcugcuugucaauuguuccugaguauggaguguguacuacagucuuccuaaagugugcacaauacuuuauggcuguugguuguguagaugaaaucuauauuacaaagggaagaaaagcagcccaccucaaugacuguaauuucuuuauugaucauaacuucuccuuaugacuccucuagaccuuuggcuccauaccucacuuacucauuagaacaucucaaggagcagucauuuuagguaacauuccaggaugaggaaacugauuucaaaaggcuuaguaacguaagacuucauagcagaguaaggauauggacccaguaauaacagacuacauagcuaaacucuaauguaggguauuuaaaugacuaccccacauauuugaaugugaaugucuuagaaacuauucuaaggauauuaguugugaacauagcguaauuucauauuugaguguuaaggaugugaugguaaauuguccauuuguaauucacccaucuguuuuucucaugggcugaaucuuuauuuuuaucggcuuugcccgaauggaagcuuguauauagcagaugcaagaagaagauauguagggauaaaagaaugcuuacuauggucucugcuuugggcuacaaauuugagcuuggcuuuuguucuagcagucuucuggguugaguuaauauuuaauuucuuuuuaaaauuuauaaucaacuuucauauuuaauuuguuaacauuuuaauuagcccacaaacgaaugaaauuuaucauagcauuuuucuacuuaucgcuauacuuucuuuuuauucccacucuccucuguaucuuccuccccccuuuuugcuggcuuucuuucucuccccaaguuaaccaucacucuacaguuuacugggaagcuagcugauacagguacauugcagagggccucugcuccagucucuuucuggcccuccuccugacuugucuguggcuugaaguaaauacugagucuucaguaguaaaucguugcugagcucuuccacuucuuucuucugauguuucacuuccauauuggacuuuuaaggggaaucuucuuuguuaguccccuuagagguauggcaggucucaguauuuggacagagucgcggaguaauaaucagucuuuaagacugucagccucuuccuaauaauagacugacuguuuucagaugggagaaaugaaaggcaagguuuccaccagccaagucuccucacuccccuaggaaucagagugccccaggucaacagcaauccagagcacucuaugucacaaauacaauagaaaugguucuuagcuggaugugaguuuccuuuuaagugccucugcuuauauaugucaugugguucuuugguuuuauguuagauuguuuacguaaagagcuagauacacaugcucuagcuuucaagugugagaaaugaauuauuaauaguuuuggauaaaauaccugcccugucuucuacccaaagcagaacauucucaugaaguuuggacuucacuaaauaaauaucuuuuaauauuuuugauuaauucaguauuucugccuuuuuauuuccuccuccauuugugacagcuguuucuucaauguaggaaaccagcaucgugcaaucucauuagauacauguuuugugcaccucucauauuuaguggaugccaccaaugaaaauuugagguuauuaauucgcuuuucaacauuuacucaugacgucauaguggccauaauuaaaguggaccagaacacggugaagugucaugaauuauuguaaugcuuuuuucaugcuaaaguuuuuuuguaccaaaguucacuaaaaguagucuuauauauuccuguaucaaacuauuuauucuuuguccuuuaugauguuggcuagaacaagcuaaacuacuuagauuuaucauaaucagugaagugccuucaguuuaagucauuuauucauucuuguacaaccacauuccacaaccuugcuugauugucaaagaaauugauucacaccauugacagaagauacaggguuauaaacugaagcuaaaacagaagagugucggggcaucaucggugauggccuugacauguggaugaauuauaguuauaagauuguugagucuugguuagcacaauuuuuuuuuuuuuuugguugugguuggaaggagacuuuuagugauacaaacuaguaauuaguaaucaugaaaguccuuguuaauuagucaucauuuccuaucauaugguggcaagucagacggcuuucagaagggcugucucacuguggaaugauuguaugauaggaacaaguaccccagcugcagacaacguguucugugaggcuuucugucuuccuuuguacuuaaacggugagaaauaaugcaauuuuguauuuugaagguugaguguuguuaaaagcagugugucuagaauacagaguuuguuagagaauuauauaaagcauguacuucauagaaaaguacagauaugucacagucuuuauugugacauuaaauuuauaagauaauagauacauaauucacuaucuuaacaugaacuauaaccuucauaagucagugucguuggcaaugauauuccaagaauucacauauaugugugguguguacuaggguguguguuuaaauauauuaugucagaauucuaaauucuggccuauaugaaaauuaaaauaacaugauaucaaugacuccaaauaguuuuaauaauaugaauugggguuucuuuaaaaaauacaugucaagugggaggugagagacucccuggacucauaggggaggaaccuuugaugaguugccagacaguggggagagggaacauguggagcccacuuccagugggaagacgggauauuugugggguugccaucccacagucacaccucucacccauaauuguuccugucugaaagaauuacagggauggaaauggagaggagccugaggaaaagaagauccagugacaggcccaaagugggauccagcucaaggggaggucccagggccugacacuauuacugaggcuauggaaugcugacaaaaagggaccuaucaugacugcccuccaagggacccaacaagcagcugaaagagucagaugcagauauuugcacccaaccaauggacagaagcugcugaccccuguuguugaguuaggcaagacugaaagaagcugaggagaagggcgauucuguaggaggaccagcagucuugguuaaucuagacaaccacuuucaaacacuggaucaccaaacagacagcauauaccagcaaauaugcggccccuaacacacauagaguagaggacuuccaggucuguguucauucagagaugaaccaccuaacccucaagagacuggaguccccagggaguuuagaggucaggugggguggagagugggggcauccacguggagauggggugggguggggaggaggucugggauguggagcagccagagaguggauagggaggggcggggaauggaauauggaguauaaaaaaugaauuauaaauaaaauaaaauuaaaaaauuacaggucaaauauauauauauuugucaggcugcuuugcauggccugaggucauccauuugaagguaaaagaacuguacacacaaagaaagagccacuggauauacauacauauauauguguauuagugacucuuagagccucuagauuauaaauuuaaaaacucuuguuauuucuguuuuaaaguugaaugucuacuaagucaguuguccgugggcaagcugaaucucuccaucuuucaucuccuggggcucagagagccgagauuacugguaaucacugacuuuaugcuucagacguauacgucgcaaggcaaaaugagaaacauuuggauaugcuuagagaacaaagacacaaggggauggaggcaagcaguuuagaaaauaaggaacaguuggcuaaucuuaauuauaaccauauucauuuuuuuuucuuucuuaugugucaauuggaaguuuguucgaaaacuaacccucuuaccugauaaugggacuuaauucauugcagguuuucugcggugacuuuauguuuugucuaagcauaaauccugaagcgcuucuacaguugagggaacccacacuuuguugcuuggauggagaacaguuugcuaucauuuuuaucuggaugggacagccaggucaaucuuaacgauucagcucaguggcagauucgugcuuggaucagguugugccgagcaucaacgcagauguauuucagagaaugaagauuuaucuguguacacugacaguaaagcugcagauugguaacuucugacuccuuagagaugaaauugcguugauuaaguauguuaggagacuacuggauauuuuccuuaaauugaaagauauucugacaacacauuuauccuugauugcuuucucuuuacuuuuacucuccuguuucuugaguaucuuggcucccccccccuucaucuuaucuuuuuuuguauuuuuuuauuagauauuuucuuuauuuacauuucaaaugcuaucccaaaaguccccucuacccuccccucacccugcuccccuacccucccacucccacuucuuggcccugucauuccccuguacugaggcauauaaaguuugcaagaccaaugggccucucuucccagugauggccgacuaggccaucuucugauacauaugcagcuagagacacgagcucuggggguacugguuaguucauauuguuguuccaccuauaggguugcagaccccuucagcuccuuggguacuuucucuagcuccuccauugggggcccuguguuccauccaauagaugaccgugagcauacacuucuguauuugcagcuacuuauuuuuaaacauguuuuaagaagacuaggaucuucgucuuuaaucacagauacauaguacaccaugucuucuaagcaucuuuucccuacugucauuaaguauagauacgggagaaaaaaaaugguuaaagcaacacgaauuuuaguggcaaagacauugcuaaaauagaaaguuuuauauauagcaaauuaaauugcucuauauuuccuguguauuuucuugaggcaguugcucuuacccuaguccccaacacacauaugcacacaaaauggcuuaagccucaaaacaguaaguguguguaugugguggugguggugguggggugaguuuggguuggugauugugaguuuaaaaaaagugguaaagucaauucaaaguuaaaacuuagauuccuuuuuuuuuuuuuuuagcauucuguguuuccuuugcuucgucauuaucuagcacuaguuuauucuacaacauaguuuaugcuguauacuucagaacuaguaagaacuauuacuggugacagugugacuugugccccgugaagcacacauccccagagcauccggauuagaauaugggugccugcuguuccuuccuaccuuaagcagcucucacccucuugucacuuuaucccucugagacuuuucguucaauuccuguuggcucuccuucccauauagcagucugccuaaugagggacacaaguuagaaugucccaggaaaguuuggaagugcuugcuugcaaaccccaucauuagggcauuuaguuuguagcuagaagaggucagugaacuugggaagaccucgucucacugauuggcucucucuucaugucaaguccaaacuaaauguuuuuucacccuauuucccaucacaucuucuuucccucugcugugcuucagugacccaaagugagaagcuuugcuucuaauacuuucugggcccuuucugcuccuccccagccucuucuuuccacuuugggacacucgugugccaugcaauuacaugacuuucucaacucuccucuuuugucaaaauuucccuugcuuuuccggauagaaguagcacugugucuuggcauuuaugucugauuaugcuucccauggguuucucuuucucauuaaacagugagcuuaaugaaugaaauucugugauuuuccuugcucauguuucuguuaaauaaucacacggauaaaggagaaaauaagagcuguuaagaauguaugugaacagugaacauuaauuuagauggaaucucagaguggcauuaacccguuuuuaggcucaugaaugucuacuaagacucaaguguauauaugcugaauuuuuuaaaaauauagauucccauuaaagauuccaugcauauauuuacuucccuuucucuuuucucuuguacuugacagacggaaucucacaaagcugucccuuaucuucagucacaugcuggcagaaaucaaggcgaucuuucccaauggccaguuccagggagauaacuuccggaucaccaaagcagaugcugcugaguucuggaggaaguuuuuuggagacaaguaaguagaaauugcuuucauagucugcauccaucuuuccagagucaccuaauugaguguauagagaacguacuugguaauuuuuauaagauuugaugggguuuuuguuuuguuuuguuuuguuuuguuuguugaaaaaggacauuuuuccuacuuaaguguuuuaccacugagcuaugccucaaaccuugaaauguauuuagaauaauggcuccugguauagccaacaaaacuauuuguuaauaauggaacauauaaauuauguuguuagaguacaugucagauuagacagaauuuauauucugagagaauuuauugagucauuuagcuccaagaagcagagacacauaaaauaauuucuguauguaauuucuuaucacuuaauacucaucuaggauauauauauauauauauauauauauauauauauauauauauauauacacacacacacauauauauaauugaaagguauagggaaauauuuacuuuaaugagcauaaauaagaccguggagauaauucagugguaagagcuugcugugcuaguagggacccagagcuugaucuccuaguauccacauaacuguuggugugcauggcggcucacuguaacaccagcacacugcagcucacaaauggcauuccugaaguaagcugucaagcuagacuaacugagguggugagcccagggugcuaugaaagaucuuccucacauaaggugaagggagagcaaguggguaagacacacucugucuaccucagccuuccucagguauacauccacacaugcauccauagguaccaaaggagcguguugagcuuagagaacuuaaaaacguaucaaagcaaaacugagguguaagaaguccccuagaucacucaguuaaaccuguguguauugucccaaaccccacucuguuuaaagaaaggcuaccugccagugucaucaggaagcugccaagcgaagacuagaagaagauguuucuuuuuucuuuuuuaauauuuuuacuagguauuuuccucauuuacauuuucaaugcuauccuaaaagucccccauaccuucccccaauccccuaaccacccacucccacuauuuggcccuggcguuccccuguacuggggcauauaaaguuugcaaguccaaugggccucucuuuccagugauggccgacuaggccaucuuuugauacauaugcagcuagagucaagagcucugggguacugguuaguucauaauguuguuccaccuauaggguuauagaucccuuuagcuccuuggguacuuucucuagcuccuccauugggggcccugugauccauccaauagcugacugugagcauccacuucuguguuugcuaggccccagcauagucucacaagagagagcucuuucuagguccuuucagcaaaaucuugcuagugugugcaauggugucagcguuuggaagcugauuaugggauggauucccagauauggcacgcucuagaugguccauccuuucgucacagcuccacacuuugucucuguaacuccuucuauggguguuuuguucccaauucuaagaaggggcaaauguuucuaaugagcacuucuuacucagauacagauggccaugagcaggguguguguuggggcaugauagucugaauccaucacaauuuauuuaacauuuggaaaacuuugugcaauguggcccaggugucaacaaaggaggcauaugcuucuucagugacgucauagguucccuuuacaaagagcgccuugggaugcucucuguagaguaugcugcccaguagggaggaagacugguggcuuccucauggagaaaaugggguuaaugccucugucugccacauaaauuguaaagucagacauguaaagugugggcugagcuuugagcugcucagugcucucagauuagugagugaagcaucgcuuuaaucugugucuuuuccuuucuaucaugaaaugcuugguuuauauagcuucuaccccaacuagaauauaaauagagcaauguuuuuaauuggcauacaauauuugggugccagaacuacauuuuggcuugcuguuugagaagcgguuugcuacguagcuuaggcuagccugaaauuuaagguuauucucaggcugccgcccacgugccaggaucacuguugccaggauccacuccuuguuuggcuugaaaugaauauuaaauccuauuuuucacuuccaauauuaaaauggacuuuuugaaaugaaagggaacaauaccauuuuauuccaguaguaugaacauucuggguucuagaaauccagcuauucauaacauuucuauauccaauuaaagugaaggauuaauaguuucauccucaucugguaaugggaacuacagaagcagagaguauacucaugaaauauguaugagucugcaaagcagagaggcagauuccggaagacugccagccuccuguauuaacacugagaacccagagcauccauggugacuuucaaaaucacguuucucucugaaaauguauagaacagguuguucacagaaauucauuuugaaaacugaaaacuacguuuuguuauaaagugcuuuguuagcagguucuuaagaaacgacagcuuugcucaauuguuuuuagaauuauauuuacuuuguuaaauaucacagcacagugaauuaugaauuuuugacacuuuggguuuucucugcuuagcuacagacaacaagggccuguuauuguauagaacuguuaugucaggaagucacuuaaccuacaggucaaguacucccccuaccuccucagcccucccaccgcuugcugagucuacagacugaggaaggcuguaaauugccuuuaacguuuuguuacuuuuaggaugaacauucaguuccaggcuacugccagaauguauacagaaauguauaacuagaguucuaaaaugagcaacaccuuugggagauguuuggagaagcgcucuucacuguugguuuuucugucgucccugugcuuuuugacuucgugaacagugcugacuagucuaccuucccacugguugaguucuuucucuuucuucugccccaaauucuucagacuuacuugauucucaucuuaaagaauuccuguugcuuauccccgauaaugaugauaagugaaaacgauuuuauuuaaucuaccggugacuuuaaacuucagaauaguauuguuuucaaaaacagacccauaggagguugucucuacaaacagucagauuaucauuuuauaaauuguuuuguuugcugcuuaaugacuguuauugugacuuacuucccugaagggauagucauuucuaacaaagcauuuagaaugaauuaaaauagaaaacaaaccauuguucauaagauguuaugauacucauaaauauaauuucaggucagcccuuaugaaagcagggaauagaaaaccagcuuucaaaccagagcccuguucucugccugcguagcagccauuagccccaucugcugagagccuugggaacacagaaugcccaugacaaggggaauagaagagccugccugugccagauuauuaggggacuccauuuacuauuucaaaaguucagucuuaucuuuacuuccuauuauucuauccaccaggagauaauagcaauauguaguaaaagagcauuauugaagaaaucugucaaaguaaguuguacaaaucuucaaauuuuguaauaauguuuauaauccagaaaagaaaguaccguuaauccagaaacauuuucagucuggcacauuuccuaacucacacaaguauauaauugccuaagaaacagggcaggaggguaaguaaggcaggggagaggagguggaagggaaucgagggauggguggaggaggacaagugggaggguugggaagagggaugaaggggcuaccaugcccacacucuagaaguucuuuuucuaagcaggaccaguaacaauuggaauugcagggaugguuuucaagcaaauuauuauucaaugaaagcugaugggcuauuuaauucucauggcugucuucuucuaauucauccauuaccaguuuuauucuuuuuuguugguuauuuuauuuauuuucauuucaaauguuauucccccuuccuguuuucuucuccacaacauccccuauugcauccuccuucccccugccucuaugaggguacuaccccacccacccacccacccacuccugccucauuccccuaauguggggcaucaagucuccacaggacgaagggccucccuuccuaaggacgcagauaaggcaaccuucugcugcauaugcagcuggagccaugggucccucugugugugcucuuugguuggugguuuauucccugggaccucucaggggucugguugguugaugcaaaucccuuuagcuucuuuaguccuuccccugacuccuccauuggggucccuguacucagucugaugauuggcugaggucaguuuuacucuucaaguugaaguuuagacacuccccggcuugcuguaacagccuuuauacuggagccucugucuucaaucacagcuucugagaucagugcaaccuguggaaagcagaagcuguccaucauucuagacuucuggcagaacugcuuucagggauauuggcucugagaucaugucaagccuuuggccuuaagaaagguugaucucucucucucucucucucucucucucucucucucucucucucucucucucucucucucucucucucucucucucucugcuucacccuccuccaaaaggccacacccaggucaucuauauuccaguguuuccccuugcucucuucugucuucacgcuucagucuguuaccuuuccuuccacuaccugggugucucaucauugugcccugccacuuuggagggucccugacagacugucugaagugcucauccacauucuuauugagccaaacacccagguucccauccauucuucuagcuuacaugguacugugauauguuccuguuucccagcugaggaauuuccaagagacaggacagucuauuugaagacagggacugucucauuuagcuuuguuuuugugggccuggcguaugucuuagaauguaugggcacuaguauuuauucacaaucugcaugcauaguuggauggacagugucuguucuugguucuguuuguaaugacuccaucauuguuucucugucuuuucuuuuuuuucuuuuuuucuuuucuuuuuuuuucuuuucuuuucuuucuuucuuucuuucuuuuuuuuuuuuuuuuuuuguugucucuuuucauucuauaguuuuuauacauuucuacaacuuugccccagaaguuuacuuucugguuacuucucagucacuuaccagcuuccacacaauuaacuaccugacucucuguacucuugcuaauauuucugagugcacauaguugaguaugauuuuacaugggcuuguccugcacuguuaauuuuuuuacaguuaugucaaauucugugauguuucuuuuuggaaugcuaguucuguuuucauugucuucuguaaaaugcuucuccacuuuguuuuauguauauguguaauuugccugaaguuauaucugugcuuuauauacauguauuaccugccggggccagaaaaaggcauuggauccccugugacuggagucacaaucgauugugugggguccuaggaaucaaaucuggguccucugcaagaguagccagugcucuuaaacauucagguuucuguccaaguccauuuccaauacaaucuuuacacuuuuuuccaagugguuuucgugcuaagguagccuauaggacuaugcacuauagagacacccuguuguucuugagcacacacgugaguauaugagaccacuuuccuacucuagguucucuuccuuggcugacacuccgguaacuucuguucgugggacucuuccagaggcauuagcacuuguagcuucucaucuuugcuccaauuagcccuaucccuuaaagauaguacuuuugcucagacuauggaacuauccucauagcagugagacuauggaaccugaagaggucaucuccuguagccaggcaauggcccuaguggagugauagagacaacaacccacccagaaaacuuucaauggaaaaaaucuauccugucuacaagaaaggcagggcuaaagauggagcagaaauugagggaaugaccuacacggguaggugcugauuauuccuaauugguucuugauugugucaauaaagaaggcuagagcuaauugcuuggugaaggguaaaggugggacuucugggucccagaaggaauagaagagaugcagggaaggaaguugcuuuuggcagcuauacauuagaaggagcagaaagccagucauguaaggccuuagugcacuuagggccugcagccucugcagcaggugggggccaaggaguugugugggagcuagcuguuagcugauaacauuggcaaaggauagucuuugcccagcaauuguguuaucugguaaguuuuauauuaaaaaaaaaagauacuguaaucucaggaauaaaauucucuugaaucucuucaaguucuuccaucucaggacccaacccuccccuaaauguuacaaucagguccacugauuuugaauaagcccuuccuggccuccugcauuuacuauuuuuaauauuuuauuuaaaaucguuuggauaauuaucaucuucucaguccgugucuaagcuuuaugaacugggguucacugcuuugugucugugcauuucagcagagugugugcugugugcuuucaugaacauuggauuucaucucagaaggauaggggaagaagaggugcagggccucuuaguccacacacaauagagauggagacacagcuccuaccugggaugggaggaaacuagacuggcccugaggcccugccgcacucgcccuucacugcagccucuccucacucugucacugggcacacuccuuggccugccaguggaucccuguccuuuugucuaaagugugugccugugagacggugauauaaucucuugucugguguugcuguggaaauucaacacgauaaaagcugccuauaaagagggaaauagugucuggcucauaaugggccaacuguauugugaaguaauuacguaguuugggucuuugaucuuacuccaaauaucaucuauguauuugcucauucuagaauuaauacaguuaaucuuugacuuugauggaacuuccacaccuggcaauggaaggcaaaccaaaaggaauuaaaaauaaaacuugaguugucccaagaucaugucuaucccuauauaaaagugaguuaaagguccaugauuuugcugaccccggggaaaauggccuuuuuagagcucaguuauugcuucugccuuugauuucccgagcaagugcuguagacucucuuugguuucuuguguucacuguucacuuuuaauaagaaacaaggaaaauuaugucuuuuccucuccauugaguaagauauauguucuaggcuguuaauuaguucuuuuucuccauuauggaaaagacaaucuaauucucucuaauuaauagagagagugcacaguugaaacugaguauacuuauagugaaacuggacagcagguucacuagaaaaaaauaacuaagaaaugaaauaagcucaaaaauaauuucuuuugaaccagcucccaauuuugucuguuuaagcaaauuauaguauuuuaucucaauaaaauaauguagcuuaaauagaaauugaaauuuuuugcuaguguuggacucauuaucuaaaaugcaaaaguacaaaauugugacauacuaauuauaagcauucuuuucagauugggaaugacagaaaauaaaaaggugauaaaugcuuaaaguucucauuugacguuaggaagugccuacugaaaaccggaauuguaugcuucauuacugacuuauuaccaaggacuuuuucagcacaggauauuacucaauucaucuuuauccuauauucauguuuauauaaauuaucuaucuccauuacuauacuaauguauguauucacaauaugcaaaacacacauaaagugauacauuauacuauaacauuuuaaaacuauauacagggggcuggagugauggcucagagguuaacagguguagcuguccuuccagagguccuaaguucaauuccuagcaacugcauggugguucauaaccacauauaaugaaaucuggugccuucuggcugcaggcauacaugcagacagacacugcauauaaaacaauaagucacacacacacaauguaagaauaauguugauauuugcuucacauccuggcaagcaugugugcauaccucuaguaucuaagacuaccaccuccacaugcacuucauuuaaauacagaaaaugguaagguccauauaacuucuuuguacaugcccacucaauauuuuguucaucuccacuccuuuaaccucucuuuguuucccaccucucuccugcuacccuuucuauccucaacucucaccucugcuuucauaaugcaccucacacacacucacucucauacacacagacacuuucauucucucucucucucucucucucucucucucucucucucucucucacucacacacacacacacacacacucacuuuaaaaaauaaaauauaaggcgagaaguagaaacaagguggaguaggggcuggugggagaagugugugauguggaccaugguaaaagcuacaguaaugggcccugcuccuuugugagacaaaggugagugcaaaggguugcaacugagcugccuucugucauuuaucuagcuuugccuucccuccuuccuugaccucuccuccccucccuuucuuucccauccucccuccuuaucucccuccaugugucuuccccucccucacucucagccccaucuucccucccuuucucugccuccacacuuccuccccuccccacucuuagucccaacuucccuuccucucucucucugccuccaaacauuccccucccccucucagucccagauucccucccugucucccugccuccuguaucccccuccaccuuucccucauuuuuguguaugcacugcucaaugagaaaacugcauaaaugacauccuggaggucauuaauguuuucugaaugaguucucaauauuaugauaaucacuaaaacucaaaauggugucucuaaacuguuuuugaaguauaguuuagaaaaauccuuguguaaccucuguuuaaaacaaaaacccaaaagagaaugagaaauuauguaauuaaauuuuacuuugaaaaaauuuaaauaacccaaaucacuccuuccuguaaaaccccaaaauccauaauuuucuuuuccauaauucuugccuacuaauuaguuuggaguuaauucaauaaagaacguguuuaagauugugcauccucauucucagaaauucuuguauguuuuuacuuuuugaaccauuaaucuuaacaaagcuugaaugcuaauauuuuuaaaggguuuucuauaauaguuuauaaucucauuguaauauuaaacauauuucaaaacauuuggaauaaauuacaacguacuuaaaaagagaccucauauaauauucuuccaagacaagcuguuucucuuugaagcagagauccagucuguugagcccugagaaccuuuguacuguucucccucuguccuggaugucucuucccuggcugcaggacuggagagagaaagucugggaagcuggagauuggaaggguagguugcacaggcggcauucuaccccacacccccagagaugauuagauugguguguuuauugcccauuggaaaagaucuggguucguuaagugccagguucuguaucacugacaaucacacagugcauguggagccacugggcaucuucauagagagaauacaggcucagggaacacagggaagacaugggugaugcucucaccacugucuugcugugaauaauacacaucuuuuuuugcuaacccaugaaacugaaaacuaauuuucuagaagcuuggaagcuguguauguaccccacacuccacaacacccuagaaucacuuucugcuggcaggcaaacuaauugacuuaauagcaaaguaauucuuuuuuuuuccccuacagucaacauauagaaauguguuacugacugcuaaauauucauuacugacugcugaauauucauuuuguauuuugaauguugauucucacugugaagaacaguaauggauuucccugcuuaguuccaguucugcucuuacucuucaguaauaauguaguguuucuacagaacauuaagcaugaccugugcguccagcuacuggagagagugaggcaggaggauuccaaaaugaaggugugacugggcuacacagacaguucauguccagucuucgguacuuagugagaccuucucugaaaauacagaguaaaaacaauguugaggacauagcucauggugugaauggcccuggguugauagagagggagggaagagggagggaguauugggggggagagcucagugauuucugacuguaguagaaggacauuuugcuagaccuaaauaugugcaguuucuccagucaggggcuuagaauauugcuggaugcuuauuuccuuugguuuuagacucagaugucuaagaggcuucacucacucuuaucugacuuaauugggcaauauuaagagauucaagaggaauuuuguuuuuauuacuggcagaguggguguguguugugugugugcacacgugcacuugcaugcauguguuuguaacaaugaggucuuauuuuugaaaggaagaucauuuucaaacaaacuucugugguaugauuucccauuuuucaugugcacauuauuucaauuuuaaguaaucugauuguagccuaucaaaggcagcuugcuuuaaacaucaacaguugcaucccaggcaccuuccagauguuaaugaacuuucugagaaaaggcaaugaagacuagcuguacuuuaggaagaugugaguaaauacucaacacuuuaagaccagagucugcucuucuaugguucaugacuaugacauggaaaaacgacaacaggaauuuuaauucaauuuuauaugugauguauuugcagcuucucugccuaguccuuucuaccaguaaaccauauuuccaaagugaaagaguaagcauaagcauugcaguggugacuggggauucccuuaguuaguuguuacucuccuguuuaauaaaaaacaguuaagaaacuggacuuggaagcauggugaccauuuucuuagagcuugagagaaaaccaguagggcaggcaagcuggaaaucucaguaugugccaggaggagauaacuguggacuaggaaggcaaagacccaugccuucacccucaggguccaagaagauugcggugcagauauggaggucagcaggcagucuauggcagaaugcaauggggcaagugcaucccagagagaauaaaagcuauccaucaggucauguugcgcucaccuuguccagcaagaaaaacgcaacacgguuggauucuucucaacagccuucuuuauuucaggaacaccucuaugcuaugggaaccccggaaacccagggaggacugcuuauauacaccccagcacugggaagagcuauguguccucccgggauuggucagucugcuggcacuuuaauuucuaugcgcccgcucgggagggguuggcgccagauucgggccagcgccugcgcaguggcguuguuuacagugaugguguacuggaggccggcgccaucuuuuaggcgcccaggcugccuacaaggucauagaaagauaucuuauggagagagaggaaagaacaagagugguuuaaaaugugagagcagaguuauguggacauaucacaguguuauugugaaaaucagugacagggagugagugaaaacauuuccuuaucuguuccugcaagcauaaaacucucaauguagaucucagacuggacaugagguaauuggucaauccauagagacacccugauaaugcuauagcaaacuggcacaggcuucuuugaauaggaaaaauguguaucacaaacgcuuucgguguuuguuuguuuguuugauuuuuguggaaguugagaagugguuagaucuaguucugaacaucucugggcaccaugguuguuuccugugaaauaugaguaguccuauagcaugugcaugaccccagugagccuccucugccccuccugcccugcugcaaaacaauuguuuuuuccuuagcgauggagcaguggaucaauggccgcccgauaacaaucuauuuucacauccuccaagaaaugcagucauuacaaaaaagauuggauuuaaguaauaacuauuuacaaaacugucaacagacucaggaauccgaguucuaauggucugcauccauaauaaaaacagaaaaucagauucuccagccuccugagaaccccaguccauugcugagugaagcuagccuucagcucggauguucugacacagaguaucugcuggguuagguaaauacguugaagaauucaacaaaaaauuuaaaauaagaauaagguaaauacauguaggacagauuuucucuucaaagcugagaugacauugcauaugaaugaacuacaaucaauuuuaucaacagccaccaccacagcaaaacuaacaaacaacaaaaguguugauuugcuuacuuuuuuauuaaucauuuuauuccuuuacauuacaaaugacaucccccuuccugguuaccacucuacaaaaaccccauccccucugccuuccccucccccucccuuuugccucucugagguugcucuuccacccucucacccacuccuaccucucaccccucuagcaucccccuacacuggggcaucaaacuuccacagaaccaagggccaccccuccuauugaugccagauaaggccauccucugcuucauaugcagcuggagucauggguaucuccauguguacucuuugguugguaguuuggucucugggaucucugggugguccagucaguuaauauuguucuuccuauggcauugcaguccccuuuagcuccuucuagcucuuccauuggaguccacucuuaguccaaugguaggcugugaguaccugcauuuguauuggucagacucuggcagagccucucagggaacaaccauaccaggcagguucccgucaacaagccaacaagcacuucuuggaaucagcaauaguguuggugucugcagaugggauggaucccaagguggggcauucucuggauagccuuuccuucagucuuuguuccauuuuuugucucuguuuuuccauuggacaagaacauuucuggguuaaaaauuuugaggugaguggguggccccaucccucaaauggaagccuauuuacugggggugguuucuacagguucuauuucauuuugggugguauuuuggcuaaagucauccccauuaggccccggagccucguguaucccugacaucuaggaguuucuaguggcuaccccccaguucuccaucugccccaucccaaaaucuuuuuugauauucaauagugauuuuaauguaauauuuuaagaauucaacauacaauuuaagcuuaauguucauggauagaagcauggauggcauuauguaaugaauuuucaagaugaggacauacagauaucaauacauucugaauaaaguaucagaauauuaguggccccuccucugagaacccacaccuacagccagacccaaguagucaccuccugcccacagaagucucacaucggaggguguugacgucauuaagaauuaaacagcaugugauguguuucuuuuuaaugauauugguucuucucuauguuaugcucaugaaagcucugcauuccugcuugcagcaguguuuaauucauuucucuugcuccuuuguguagauauucauucuacucuuuguggcauuugaaugacuaucagucgugaacggcuguauauaccuuuucaaaguauucaugcaaaguauucaaaggcccucaucuuuagcaggcuccccaaugguuccuggaguacuaguagucacuuccagcaggcagugguucaccuugcuccacaccccuuccgcacuuuucaaaucccucaucuuuuuacauauuucuugggagagugaauuucaucagauucacauuuccuuuuuucucaugagcagugaaguggagacuaugguuguauguugguucggcaucuuaguaauuguguuuacagucucuucucauacacauauccccccacacccaagcacuccucacuuacuguaugcuuugaauguuguggguccuguuuaaauuguaugccuaguccacaugugugcagauaccuuccuguaucucuucuaagaacaucuuguuucauucuuagguuuaagauguaccucaaguugcugguguguagaggucaagauucaguuccauccccuauuuguguuugucagaccaccagcauuuguggaaaacaucuuauugucaccacuucuuacaaauaguugaccuuauacagcaaggcacugugugugguuauauuugcuucugaaauggcaguuuucccaccucugcuuguccaugucuugucaccacaguguugguuaaugugaaggauguaugauugcuccuguucuucuaaagauuuuuuauuuaaucuugguuauugguguuucgccgugagguuuagaaucuguuucuacugcagcaaugccucuuggggguuuugacugagguuauauuaaaucuauagaucaauuuaaggagaagugacaagcuucugauaccgagccuggcagccuccugaaggguuuaucucuguaggacuuuucuauuucugacugcacaugugcugaccgaguguaucuucugguagcuccccacccgcucaccccauauguuuuauaucuucagguuacagugcgucauucagaaguuuauaguuuuaugaucuagguccaguuucuaaugauauuucuaguauuaugaagaugcuaaacauuggacccuuaauagcaguaauuaaacaaaaucuagcuuauuuaauaaugugcuaugaacaccuuuacauguugcacauuguucugugcaauuccaguuucuguaaugcagucuuccauucagucauuaagaauuuauuugauuuugguuuaggcuauuacauguagcagugcuaugaagagacagguaagagcucuuuacagaaucagauagguucuggaccagugcuagacucuaguggugcaugggcuaugaaucuucuuaccaguuuggccucuagaaaugcuguguaaauucucuucuuuccacaaguguuuacaagcuccuguuuccagacaccaucauuagaguucauagucacaccuuuauuguguguuuuuuccccacaaguguugcaccuaaaacccauagccaucggugaacuacaaguaucaugaaaaugcuuuuucuuccuuugguuuuucuauacugaugucauaacuccuugauucauuccuuucccuuaaaauugcaagacuuccauaugaaccugaugcaugcuuucucuuucacauaggugacagccuagaugacgaagccaucucuugauugcugacccacugacccccuuuauguuauguuuucuggcaucugauugguguccuuuucuuauuuaucaaaggauauuuguuuuugucuagaaggauugagauauggcaccuacuaacagaaugauagcauaguguuauuuaccaugguguuuucucuggacauuauaugaaacaacuuuaccuuuuuguaaauccuuaagauuucugaauuguaggugagcagugguaagcugugaaggaaucacagcucuucucuuuacugcgguuuuaaagagucugagaucauacuauugaagcaaucgucuggauacccacuggucugucuaaccugccuuguauauugaacauuguguuuggucaaguaagaugacccugcagacaagcuuaauccccaugaacaacauuauggaaggagaaaaucaacuaugacaauuuguccucagaugccuccccacucuccagaugcacacacuugugugcauaugcacagaaauuaaauauauguuauaaaaaugaaauacuuucugaguguacuuugaugguuuucugccugcagcuaaugugauuuauagugacaggaggcaaaugaaagaaaguaaauuuucugggauugugagauaccaaagcucaaguuggccacuuugugcuucucucugucucugcuucucuucucccucuuugccuuugaucacugccaagacaaacaaguucacagauaccugugaaacauuucgccaucaacauauucuccucuggcaucaucuuaugacaauugauaaucaacuuuguaaaguagacccaaggugcaagaguucgaaaacucuguauuuuuuucuuucuuuuaaagagaucuuugcauuuuucuucuguucuuuccucaugaagcuagucugcccccaggccuaccacccccuacacugggaaucugcugaguccacaaaaguggagggacgauacaguaaugauccgguguaauaaaccagccaaauaaugcucugguuucucagccuucuuuuccagcuuuaauuaaggcucuaaugaauauguacuuggggcuuaggguuuaucacaaaugaacuaugaucaaaucucauuacacagcuaguguggaaaugugucuuuuuauguuggaaauuauugcucugcaguuguauggcagaggaaaauuuuagaaguagcugaaauauauauuuucgucuggaaagucagagauauucaaaguagguuauaaucugcaugaauguuaaauauuggauaugaugauuuuaggguaacaucaagaugcuuauuacaaccauuuuguuuugacuuuauacuuuacacacacaaaagagugaacuuuuccacuuggccaguuucuuuacaguuuaugcuuuuuaaauaaaauaauauugugcuuuucuagaaaaaaguugugucuaugucauucugaaauuaguaguucuuugaucaccauuuucccuucugcaaguuaggacuuuaguuuucugugucugcuaaguauuggaaacuuuaauuugggaaaggaauauuuuccucuuaggcaacgcuuucauggucaugcaaugcagcugaccuaacuacauaucuacacgugucuauuaaucaauaacugccuaagauugcuaaauacuuuccuugugcuuuuaugacauuaccuuuuguaaaccuuaaucagagugugacguguguuucuccuaaauggccucugauguggugccucucuucaguucucugugguuuccuguuuuuuucauacauagauuaaagacuuuugagguauuaaguaucuuaacuuucuucuuuaauggugcuucacaccuaagcuuucgugcaggccugucuugcuauuuuguuuucaggcuacuuccuacaccacucuguaaucacuuggguuuguguugggcaguccaucagcacaguuuucuauuuuccccauuuggaucaucgagggauaucucuguaugucccucaaagccagaggugguguuaggccuuuccauaguuaagugccucuagugucauugccaggugauagguauggcccaucaguggcucugagagaccagcagaaucaacacucauuuaaaaacucauuuaaauugcucauucucuggccccuccccaggcccacagauuaauuuagguuccaaauucucugugacaauaagcccuuuaaaugacauagucugugcuaacaauuuacuacuguagauaaugauaguaauucagaauauucaaguuauaacuguaugugaucuuuagugagaaaauggggauugagagaggccaaggaaauuuucgcucauuucugcucaguuucuccagagacaaugguaaagaaaaacucaagauugaaacauguacuaucuuucucacacaugcauauagcucuuguguccuguuuugaagacugaaauauaaauguuuaaaguaugaauaguuucuuccuuccaucuauucaugaguaggaacuuggcaugaugaaaggaggaaagguugcuaagaaacaaaugauggguguuacagauuuucauauugggaaggaggguggucaagggcugggaauggcugaguucuaaaagggagagacagauguucccccaaaucuguucacuaguccucaaaaauucugaagcaugucagugcauggcuuauugaaacuguugcaguaugauauauaauaagauauauugauugguaggaagagaauaaaccaaauccuauaagaugguuacacuuaugaaagacacuuucuaguugcauucauaagaaacauaaaagaacauguguuuucaccccuacaaaaagcaucugggaggugggaggcgguugauaauugaugauuagucuaucuucagcaugcaaauaaagaguucaggguggcuaacacuuggacccuagugcccucuguuugauaugcauuuagauauccaugaccuggauauccaugaacuaggauuccuagcaaacacagaauaaucaagugaccauauuccguggagccugaaucaugaaccauauuuucaacuauuccaaugcaagccugcuacugcugauguuauggcuuccaugugcugccgugaggcucugccgucgauggcccugauucccugacuccugcuuuucccuugcacagaacuauuguaccauggaaagucuucagacagugccugcaugagguccaucagaucagcucuggccuggaagcaauggcucugaagucaaccauugauuuaacuugcaaugauuacaucucaguguuugaauuugauauuuuuaccaggcuauuucagguaagauauacccuuauuuuaucuaucuagccucuccuucccucccuucuuccacagcuccguauguguuucuuuucucucuuauauacacaguauacacaaagguauggacaacaaccucagucuugguagccagucauuuuauuaauguaagcacuuggucguuccucuacgcuuggacugaguccucugguacaagcuuguauaucggguuaugugauccugguagguugcuaccauucaugaaucaugggaggaauucaugaaucaugggaggaauuguuuuuaauucccuguucuuucauguuguuagccuuuuagcccaauggcugcuagauugaaaacuuuauaggugggugucugccagagguauaucccaacaucucuuuggcugugacauucuuuggaucagaagauaaacaguaaacaggccacuguucuaucuacauaguauauuaugguccuauagcacuuugcaacuugcuuuucccuuucaaccaguuguaacuaauauuuuuccauaccauuagauauucuucaucaguauauuuuaaaauuccuuuaugauauuauaucacaacuuuauguuaauauuaauuuauaaaaucuauucaguuuguuuuuuuuuuuugcuuuuuccaauaaccuuuuuuuguguuuucaauauuaguuucacaugauguucuaaagcaagugacauaauacugaaauaguuuuuuuuucuuuucuuauuucacauauauaucaaaaccaaauucucuaaaugcaaagaauuaaagcuuguguuuucacaaacuucaaaacaaaguuguguguuuuguauauuaucuaugggguugaauucaagcacuuacaaaauaaaaucauccuuauaaagugauuacaauccuaguuaugauaauuauaguaaaugugguaaaauugacuagaaaccaagcuuauuuguaugcuaaaguauuguuuuaaacuucaaugugaucuauucugcuuguaauguaauuaaguaaacuguuagauuaugagaguggcuucagguuucccauacuauggauuuuuuacuuuaccucuggcugaaaaggcugauguacugauuucuguaaccagaaaccgcuacaugggcucaaguucaaguagcuuggugagaggagacagacucuggcggacaacacggggcacauuuuacuuuaucacgauugagaaaccaugacucuccauccacuggauguggaagacgaaauuaaauacugggcaguguauguguuuauuuuacguuucuaguggcuuaaugguuguucuccuugauguauauauguuguaagcccauuuuaaaauuauuuuuauaauacaacuguagcguguaauuucaaaagauagaaauaagccuuguagaaaaacauguugcucaguaguuaucauuuacaaccuaaagcuccugacuuaaagauuucugaucauuuugaagagcgaaggcuucacuuuuaauagagaagagggagagggagggagagaugacugcagauagaugauguuucaguguggaugucaagugcucuauugccuccuucacacauaacuguguauagacagcuucauuguaguuaaauguucaccuacacuacuugacuacuucaaggugcauacauuaccuuauauguaguuucacuuaaaaauggccaaguagccuuacgauucugagguuugcuuaucuuguguguguucgcuggggugugaacaggaaagugaaagcauagguaauguagcagcugugaugaccuucaccugggcagaugauuggcaagcguuuggaaacaguccauuguaucagcgacucaccaagucugacgaguccucggauuucagagggacuucucauucccucugaauguacucacuguuuaaauacgucaaccauaaucaucauacgcaaggcuuuaaauaagaaaguuguccugugggguuugggggucugaaauagaguagcauggcuguuuagaaagcagugaaguacccaagagaugaaguggggacgguacaggaaguauaggaccacgucaccuuugcuuccucccacccucuuccuaugucugcagggaacugaagcaggugcugugaaguugagaaggaaguggcagccuugggugguccuccuagcuccucuucucuccggaggcuuuucccuccucuuucuccucuucagcucaccaaagggaauugauagaaagauaauauaagucaugcagugaauccagggaucuuuucccccucucccuuccccaaagcugcaaguugguuucuuuucacauuugccuuauugcaggagaacccugggccauugggagauaguguguguggcagguguagaauaaggaagggauauuuuagagaaccuguuaguuaaagugugaguucaagaaguaguagaauagaaaaauaucugagaggaaggaagccaucagugauaccaagccuucaaggagugucugacuagauugguugagaccccucuucuagcauaacacagugcuucucuuaaaugcaccucaguacauucuguuauuuauuaacagccucccagaauuuugugaggaaaagggguuuccuuaaaucccagacaagugaguuauagaauaauuaaagcauuauuuuucucugaagcauuuauuucuucuauuuuaagcuggggggggggggaugaccuccgacugugugaauuuguugccuucacaacacuacugacaccuccuaucacauaaauauuucugcaauaagaagcugcccucuggcuuaauaucucuggggauggccuagccuucaguuucaucuuguuuuuuguuuuuaguuguauuuugaucugcuaauugguucucuuuaaacuuucggauuagaaacaauacauaauuucaagaauggaugccgacauuaauguaagcagcucugguguuuguuuguuauucccucuagauuuguccuccauagaugguggagcaaaacaauaaaaugaaaacugaagugucuggcuuggcagucauuccucaguugccuuuuugacaugugcugauauuuucccaaguauuguuuuaugcaauuucagucaagcccuaagaagaaaauuaaaaacaugauguaguuuucaagugcagggccagugucucugcugcuaguguucuuggggcuccuuucuaacccaauuaguugugucaguguaacgaggaauuucccuaaagaguauucuuguuaagucaaaaagacuaaauggcucuuuauuacuaaauuauucuuucuuguuauucuuauuguaagagacaagguccuugcagaguucugccuuauaugccaggaacaugaaaaaguuucaaaacaaaugaaagcccgagcgaacuugccucacguaaucaagaccgggugccuguuucagcagcuugaaguuggggacaugagacaccuccucucuuuuuuuuuucuuacauagaagauuugagugacgcgucuggcagaacagauggagcaagcugccagugcucugggauaaauguagcuucagccuuggaaguauugcaguaugauucauccacaccccgcagcaaaguugccuguuacuggcugccucucgucucuugccgugguaccuggagagacaccuaauuagauuaagagagauugauggcaaacacauguuuucgugaaaagcuuuccucucacugagcuuccuuucaaacauuucccagguccauuaacugggcuagcauaaagcaaguguggggucuggagccuguuaccucagaaggagccuccccucuaaagcaagccugccgaggugcaaccauagcaaccugaugaccguguaugugaugcugccuggaugacugggauccaggccugagcagcgcaggaaugcuccuuggccuuacauggcuuguggugauuguguaacguuuuccagaacacuuaacuuuuguaacguggcuuccuguuauaugguuuccuguuauaugaggcagcaguggacagaacagaugggaaagaugaggacuauagagagauaauuuuagguaggagggucuaagagggccucauugaggaagaguugguagucaucugauugguugggauuugaaaaauucaaagauccuaagguaggggaggguuuuguauuugagacugguagaaaggccauuggggcuacaccaagaaaagccaaguaacagugcugccaacauguagaaaaacagccaaggauccaaccugaaggccaguuggucaaucuuucauuucguagugaucacaaauucucuauuggcugucuacuugguuuuccuuuugcccucucuguuguacuccaaagaaauauguuuucuauuuaaacauguuucuuuaaaaccaaaaagcaauugccuauuugucauuguuuacaaagguugaucuaauacuuauauuuacuuaaaaauuaucaaagagccuuucuuucccuaagcaugagaaacagugucaucggcguguguucucuggguaauugcuuuccauuuauuuauguguuuagcccuggggcucuauuuuacggaauuggaacuucuuggcugugacucacccgggauacauggcauuucucacguaugaugaaguuaaagcucggcuacagaaauacagcaccaagccuggaagguaagcacuaaucuggacgaucugcuuaaggagaaaacgcccugcuguucccagcucugagaauuacccauagccuccaaaggcaagguaguagggaaagcaggaagacugacugagagggugcauauuaauugagcccuuaaguugacuuuuaacauugucaaaagucaggagcuuaauaaguuuaaagauucuguaauccucaguucucuuucucaaaucugucugggauguuuucacaguaguuuuguuggguacacaguguuccugcucaaacuuacguauguauaauugaacccuugaguauuguacuuaagacaaaaguaaguaguuuacuuaugugugcauuauuuuagcacaguguugaguaguuucagguagcagcucugauuaaacagaauauucagauaaguacauaaaaguauaugaauuuaugauuacauuccaaacuacucccaugcccuugucaguuuggcaugacccacuucuuuacaucuucaaaguguuauguuuugcuuuucaaguuacuaacccaagugacuaucagagggcuugguuucuagucaguucugcuggcaucguccaagaaaucauuccucacgggcaaauaagagacuggaaaaaucuaucuuucucagcucagaggauguucacacaugugucaccuaaauauguguuaggcacacaaucaaugacaucuaagaaauagucaauaauaccuaagcauaguccuggggacaauaucagugacaucagagauacucccuggaagacuuuacguuuuagaguuggucacuguaccauuagacuguuccauuucuaugagaaaauguuuucuuuuuuuaagucuauauuucugcuagucaucuuuauuugacuuagaauaauuaagcuuggccuuugacacaguuuucucaagucaaagccaagaguuuuaauuccuucucugauaaugaaaaugcucauguuccuaaagauuuaauaugacauauuuaaagaagcuagugguaugaaaaaaagucagaguccaauugacgcccucucuguaaaaccuacagacaugacucugcugacccagagcaguggucaguuaacuuucguauuuuccaaaguuuagaugaaucauuuugcuucauucaaaguucauucaaugaaaccaauacuagaaagcaaauuauaguacgugcagugugcuuuuacuauuuaaaauacauagaaaaccuccuuaugaacagauauucacucgcuuuguaaaauauccaucuaagcagcccuuucucgucaaaaguauuuguccucuggccucacauuuaaaaauaaaacauuuaauuccauuccaaggacacugugguuccuucaguagugauuuaucugucauaaauaaauaaauaaauaaaaugaaauauguaauaugauauauaucauacuauauauuauauauaaauaaauauaagacuaauaaaucauuagcuuuuugcccuaaaagaauguuuacugagcaugcagaagggccugcauuugauauucagcacccuuccaaagaagugggaaucuaagaaaaucaucuuuucgugccuuuuaguauuaaggguggcuuucaaccaugagcuacguuaugacacagaucuaucagauuauguuaaucacaccaguuugcagaacaagguacaacagcugaaaguaacuuuacuucuuccuaagggaggugagacccgcaggggucagcagccaaugacuuaaacaguguugggcaaauggaaucgagcagaaugcugagagaaauaaaucgcucuuaagugucaucuguggcccucacaauguguuacuaauggcacacuuuguagggagggcuugaacuccucaguaaugacugguuuuagaaaugccaucaugaaacaaugcaggaauuucacaaauauucaagaugcauaaauaggcaaucacuuuaaaaaauaaauaaauaaauaaaauguguaauaugauacauaucauacuauauguaauauauaaauauuaaguggugaauuuuugaauuuucuuuuagcaucacauucaacguguuuucuaaaauacauaggccccaccaucucugagauuucuacauuuuguucuuuauuugaaaguauuaugugcacuuuuuaguaaguuuuucuaauugggaagaaugauuuacugaguguuagguaugaacacagugugaugcaggucucccuagaggucagagaggggaucacauauccuggaacuggaguugcacgggauguaaaacaccuuggugugguugcugagagccaagccuagguccucuucaagaacagcaaguguccuuaacugcugggccauuucuccaguucauuccuuaauguaacaagugaucuuccaaauuauaauuagacacucuauauuaucugagaacaauuuucauuauguagcauuugucugauuugaguggaaauauuuuccuguuucugauuaauaguauuaguaauuuauauguaaauacuuuaucauuagggucacuuaggggcaucaguuuauacuaauuugaaaauccccuucugagaacucuuugaacaaacucccuuuuuguucaaagccugauuuucuuguuaacugacauguaauuguacccuucaccauaugagguuauuaaauguagcaacaaaccauccuguaugauaaacuauagcagcaugugaaguuuuuuuuagugcacucuauuuaucaauaacuaaaacaugagaaacuuuucuugcuuuucccccugauguaugcauucauauaacaacuuaaauauagccaguaggucuuaagaugacuuuuggucugauugacggacagauuguauaguccagaucccaauaucuugauggcaagauugaguggcauucaauccuacaaagugggauaauguacugaaauaaauaaaugaugauggauuuaaaucaacgccaguaucucccuuuauuggaaauuaauuuaagagauuuaucacucauuugaaugaccgguguuugaauuauguucgcugccuuuggaaaauauuugaauggcagguuguguagaagcuaugaauguaucacaugugcuuuguaauugauauaguucagcuccuuugaaauuuguuuaaagaugaaucacugaaaggcuugcaagaaaacauuaaacaagucuaugaccaaauuuuaaugccuaaaugguaaaguaauauauugaauuccuguuucaguuuccaugguggauaaauuaauuauuuagcuauuugcuucauuuuauccuucuccaaagaugauuuaugucacagcucuaucacagcagccacauccccacacaucucuuugagggcgguaauaaaucucuugguaguuuccagccucauuuauuuuaaauagaacucuggagauacuuaaaugaacaagaauuauuaucaguguuucuuacacagauugauaacacuaagguacaguaguguuagauuguggaaaaggauugaaauuucuaucaggaauucuaaaugaugcugcucaagaagacaaaauauuaacaaacuguuuacugguuggcaugccuccuugaguuugaacgaacaucuuuuuaccauguuucguaguuacauuuuccgguuaagcugcacucggcugggacaaugggccauuggcuaugugacuggggacggcaauauccuacagaccauaccucauaacaagccccuguuccaagcccugauugaugguagcagggaaggcuuguaaguaugagcaauucuuucaacuugcaaauuucauaacuagaaacugucugggcauagagcauaccaugggcauagagcaggcgaguaaggcuaaugaucucauaguuugcgguuuaccuuaagacgaaccaauagcaauaguggugccuucaguguguugcucaugccuaagcugcaauuuuaugaccauaauuacauagagcagacacaucccagcaucagaaagcauuacuaaaacauaaaggcacucuuaaaauauguguauaaacuauuacuacuucagaguacuucauuucuguuauuuuguguaaagcuaaauugaggcugccuuuuguguggaguacuagauuuuuuuccuuccuaagucaaagaaacucuuugcucuguuuguuacugugugagaauauucuguccuauaacuccaauuuucuccuugucuagcagaauuuucuaauauugauuacuaugcuguuuguagacacuucauuuaaagaagguuuuucuuuugucaucaacauuuugcagacuuuuucguuaaaauagucauuacugugcacuuuuaaacuuuuauuaagcucuacaauauaaaaaauuuucaaaaggaguaacugugaguucuagucacuuuuauugaacuaguuauaccagcaauaacauuauggucauguuuuacuaaaaaugacauuuaaugacaauaaccuugacuuucaguauacuuaugaacgaaaaucccuuauuguagcuuuagcucaaguuagauucuuaguagaaaaccuugauccgcaaaccugucuguguggcuuuauugaagucagugaauuguggaauugucauacuuuccaguuuuucugacaugcaugugcacauauuacaaggugcauauuugggcauugugcauaugugugccuaucggcaggaguggacagaguaggagagaaagacagggauguugggaaaggacaccaugggagagcuucauuauucaggccauagcuauggccuaaucuguuuucucuccuuggaauuuucaacauguaauaaguaugaugcaguuugaugcuuccaagaaaguauauaacaaucugcaaguagagcuugauuuaaacaguuuuaggauaggcuauaacucacuacuaaauuaacuuucuaacuuuaugaggacuauauuacuaauugauuuuaauugaaaauauuauauaguggauuaguuuauauuauacuuuuccuaugauugaaaaaagaagugcaagaguaugguguugauuuaugggaaaaggacaaaugaaaaugugaguuuaaauauagaguacucugauuaaacugaacacacugaagccucauacauuaaaauaauauggucucuguuuaaauucaguuaucuuuauccugaugggcggagcuauaacccugauuuaaccggauuaugugaaccuacaccucacgaucauauaaaaguuacacagguaaggagaauuuuuggaaagauaauaauacauaucuauaccaccccagaaauaaauguaaacuucuaccuacauuguguucaaaagcaugccccaguguuuaacaugauaacaucaggaauucugagaauacgaauaaauuuuaugauuucuuuuagauacauuuuuuuguuguuagugauaaugcuuguaaucuaauauauauauauauauauauauauauauauauacacacauauauacacguacagagagagagagaaacacauuuuaaguauguucauacauugauaaacaguaaaggucaaaggugguagaaaauuuuuuauugguuuuaguguccacagucuugauaugcugcaguaugagaggguaccaguauucauggaaggcuuuucauagaugacugccauuccuaucaauguauagcaguuuuauaauguauauucuaauauguauaaagggauacuaaugagagaucacuccucuuucugaauccacuuuguaaauugaaacuggcugggcaugacuucagaagacaaacaccuuccuggcaugccugagcucuuuaguuugaacuccaguguuacaaaauaaaauaaaucaguuaaaguguacauaaaucuuccagaauauugcgcucccuagaguuucacauaaaauagccuuacuccugagaaugcaguaaauucccugcucgugacuugagcaugcucuaauugcagaccgacucgggcagaucucauugcuagagcaggaugcucaggcguucauucauaaguuggcauggguuauuugguaauaauucuuuuccacuuucuuucauuuccuuguccuuauuuaguuuacuaaauaucuggcaaauaucauaguggacgagauuuuuauguauccaugcaugcauucauguauguguguauauguaugcacaacuagaacauuacaaaguuuuaguaaucacacgauaagaaugccauuuauguauucuauuucaguaucuguucacugagguucagugugccaaacauucuacacucgacucagccaguguuuaguuacucagaugcuuacuguucacauccuucagaguuagaaacuuacucucgaauuugagagcaguaccugaaaccucauggugagcgaacgcugcgcucgcacucguggacuacaguaagucaggcagcaagcacgcaugaggaacgaacguugcuuauccuucguccucagauuccuaaagaugccuaagaaauaaaauguaacauccagaugacacuuacucaguuugucaguguagacaaaaaagaaaagaaaacaagaaaaaaagaaaagaccgagucauuuauauugucaucuuaaaacuguacguacugccuguugcugguaaagcaaguucuuucuuaaagcaauagcauaaaauaaauuaaauaaccgagagcgcuaagaaagaaaagcuuacauauaaacugaugccaggaguucggacguuguaaaaauugauuuuuuuagaccaaauugugaauaucaauuuaaaauguguccuuaaaugguagcagaauucugacaaguucaagugugggauauuuaccauaagucauuguauuuuagggaauuccauaugacgacuucaugcuaguaaaccauuaaccgccggcccuucuucccuguguuccaggagcaguaugaacuguauugugaaaugggcuccacuuuucagcucugcaagaucugugcagagaaugacaaagaugucaagauugagccuugcgggcaucugaugugcacuucgugccuuaccgcguggcagguacugccuuguugucugucccguucacacuuccccucucagccuuccacaucuuacugacucaggaaguaauacucagaacuguuuuaucuaaaauaguaacuuacauuaaaaaaaaaacuuacuauguugaaugcguaaaauugauagcuuugcugcguuuuauauuguguuucuuacaugcguguaacuuaaguuccuguugauuauaagugguucugcauccgucuugccguuagugucaugaugacgccaagagagaguauuuaccaggugagcgcuuccagucagcucacgucgugcuccugggaagauucugaaguucgguggaccacagcagauacagcuuacgcugcugccguccaucacauuucucuucuccugagccaugggucaugucucacacguguuuaugguugcuuucaugaaaccaaaacaggggaaucagagaaacaugacuuugaagcaguuuguacccaaacaggcaauuuccaguuuugaaaaacguaaucaaagacuaucuuccuuccugcccguggguagucagucacuaaauacaaaaugagucagugguuuagaauaaggccguggaaaagcuguuuucccaccgaugacuuuuuguugugguuuaacuguugcaacaguuggggauuuaaaaugguuauuuuugacacaauuccaguuuuagcuaacuauuuugaucacgccaucuugcaauuugcucuuuaacggagcccuguuaaaacuaggaguauguugcuguaauuuggcaaucaaaacacuuaauuuuuaaaccucagcccucucauucuuuggccaucauuuucuaacccugaauuccgauguaaggggaaauagagcaguaggggagcgaggaguaugaaaagagcugugucaaaggucaugguaccugugcaacuuguggauuggugaaaagauguaauaacuaucacaauuucaaucccuaugugaagagagcuuaaaaggugguguugaggagacagugaagucuagcugaugggauacuucuagcugauucacacacuucucugugcacucacaggcaucguuaucaccccagucaaccugcucagcaucuccauggcuguccucuccgacaugcuuuuaguauauauguuuccuuaaguuuuuuuuuuuuuuuuuuuuuuuuuuuuuuuuuuuuuuuugcaaucuauucauuuugaagaugaaucugcaccuuagagguaggaagaaagggacucggugugacaucaggaagaguuguucucagccaauggguacccaccuugcuaggucuguuaacagccaucauucuguaaacuuagcaagggguuucuugaaacugacuugcgauaaauuuugauuugcugccaaaagucagauucuucugcaccuuaggacauuucagaugaaacuguacaaagugcgguugaccuuucaccuccucugacugccuguguagggguauuuaggucugcuucaccugacacgcaugcaggaugccaggaugagugcugaacugagaagaagucaaguuguaucgcuuuggucuaguaaugccguucuuaggcauuccugagaggggaagaaagcuucuuuuuuugcuuuuguuuauuuguuuguuuguuuuuauuguuuuuuuuaaaggaaugcauaaauuuaggauagugcacacccgggggccucaaaucugcaauacggccauguuaugcauucugggaauugacauguuugaucuagugcugugcuuacuauugggaagguagaugguuuaacauggugcuauuugcuugacugggaugaaagcuauuguuuaauacacucugcauauguagcuuaccuuguagccuaaggugggucuuuuaacuguaugcuugaguguaaaacaagaaaaagugugguaauucuguauacucuuugaaggacugcuuaucaucuuuuuucagcuuucuguaaagcuuuguuucagucugcugcauaaaagggcauggcauucauuccagcuucuuccuccuguguuguugaugcucugccccuuacguuaccacagcuuugccuauaguuccucuuucuagcugauaaucaguucccggaugccuugcauacauuuucauaguaauguuagagaccuuacauguagauauguccaguaguguucauaaauuauuagcccuuacuguuuccccuuuuaauacuuaacucccucucaguuucacuguuugaaauuggggaagugcgugcacgaucaagcacuggaaacaggaggaaaucaguagacguuauuugaaaaagugcuaguaaauuaauaacuuauuaaguaaaauuuuaaaaaguaacuauuucaaauguguucaugaaauugaaauaugucucccguuaaauuacacuuacaccacuagugaguacuguuaucuuaaacagauggucagcuuuugcauauagacaaagaaaaaauggcaaaauuuugauaucuccucacaaaaauaguauuuuaauaaauguucugguucagucuguacaauuccauaagcuucuuccugguuacauuguaaacaugucuauguauacccauuugcagucuagaguauggauuucugauacagggaucgcuuugcauauucauguccgugcauguaggcgguuacccaaugcugauuuucaggucagaugcuaugaaggaaaguggaggggguggggggggggcaugagauucuucuaacuggacagugcuguaaucaucgauggaaaaccucauggagugcuuguuuuagacuguuaguucuucaugagaaggcauuaccuuucagagaccuuggcguccucucucccugacaaugugccugaaaacuuguagccacagguacauguguucugugcuguagacauuguacccuguuauuuaccucugcugcucgcuuaaccucuggcacagauggccacaagaccuggcuucuacuuacuguguucucucaaggaauauuugcagugacgucugaugcacauuuuccucauuuuuaaguaacuugucauuuggacauggcuugaaauuccuaaaguggcagucuggaaucacugcaucucagugggguaucacuagugaaaacucgauaaucaguaaaggugucuacuacgggguaaggggcauuccuacauccacauacagguaucacucaauaugcccugcugacuagguuaucaguguucaaagccuuccaguuagugcaugagcagcaauauugugugaucuuuuagacauguuauuaaaaaaguuuccuuuauuaagagcaaguguuacaaauuuaauucaauuaaaacauagugaaaaaacguucaguaacaagccccuguugggagugucaguuugaggcucacuggauuuaacugauggugugugccugagcagagcacaucuauagaacauuucuuuccuucuguaauauauugucaaaccuugaaucuaaacuuacagauuuacuggaagauuucugaguuucggagcucugggcugaaagaaaggcagguuguaacagaugucucuguguuuuuacuuugcccguguuccaaaaugauacaguacagggucuuuuuuuuuuuuuuuccuuuuuucuuuaaagcuguuaguuuuacuucacgggauuuuccacuguuacagccuuauaaaaaguuaagcuuuuaaggucaaucaugcacagcacaaaucuaucguugaacaacacccuuugauaggaacaaaccugggcacgucaacauuugcuucccgagaagucaagccuguugcuuugacuuuuauuuuaaggaggaucucuugagcagcucgugucucuauagcaaucucugagcagaaaggaaguucagacguaguuucuacuuuaaacucacugcuagaaguuuuauagaugggauuacuaccaguaauuaccugaaacgaguaucugcuucuccugcagcuuuaauuagggacaugaaaccguuuccucuaccuuuacaguucuuugguuaggugugcugauaugaaaaugcuuuuagggaaaugcaugccucccaaggaguuaggauguaucugucagcauccaacagggaacacugaaccuggacuacaaauuauaauguguucaagaaagugcauuuuuagcaaguuguucuucacuaaaauugucuuucauuugaugcccuguuuuaguuuaacuccaauucauuggggacuuaaauuugauguaauuaacagcaaaccuaacaaaggcacaguagugguugcuguuacagucugucagugggugcuccuuaauugcugucauaauggccuauuagucaugccuccaaagaggugucagauuuuuuuuuucauuuucugaaacaucuguguuauuuaauaaauugaauaaccacggaagaguuugcccagaauaccaaguaaguuaaauaauaugcuuuguggagcauuugaagcugaguuucucugggugcggcuucucuguuucacucuugaucaguaaagcucgcgggcaccccucucacuuucaccugucacuaagaggcagagaaaacaucuccaugcagagucccgagagcaucuucuuccuguguacacagucuguaaagcacugcaguaacccagcagcggcacugcacacaggguaagguaaggagcugcgucucucuugacaaaacagaggcaaacaagcaguucugcuaaaccacgucugcgcuuccagaugacgcaggcagcaaacuuugaaugucucacauaaaaaaggccaucacugucaaugccacgcagcuauacuuugaauucugccaacaacccuaguuuuaugaaauggaaacuuaacuucuguggcuuuuccccuagacuuuucuucagacacguuugcaggaaagacuuuucuguguccaaaguguuguaagaaaacagugagugcauucaaauaugaguguggcguuaaugccguacgaucaaauagagcacuguggagaggcaaaaaucuagcucacugcguaugucucagugagaaacagauaugauucuggcuuauuuuaaaagcaacauucgcaugucuaaccuucuagaaacuuuuuaacgaaaacuaaaacaauauuugcuuuuaagaccguuucaaacguacauuucucucuuugccuucuacugucucuuuucuggguuagugugauagaacagacuggagcgucucuuucucagagggggacugaaggaguugggagucuuggugagcuagugcaauggagcaggcgugaggaguacccaggccugagaggagggcggguugacggugagguguaaaucagagaagccuuugaagaggcuggccucucccuacaccuugcugaggcaccgacccucuuauuugugcccagucuagcaggccucagauuccuggccagucuccugucuccaccucccauuuuguccacaggaguggugggauugcagacaggugccacuuaucugcauccaacugucuguuccagucugcgggcuugaaggaaagggccuguaccuguggaaccaccucacccacugcagcaaaaauaaacucccggagaacaagucuaaguuagccuaagucugcuaacuaacucaguagacggauucucacagcaccacaguguauuugagaacugaaauggacaauuugggaacaguauuaguugacaccaacacucuacugugggcuguucuuuuugaagacuuauuuuuauuugauguguaugaauguugugccuguguguugucugugugucacagcuguaucuguggaaaccagagaauggcauugggucccauagaacuagaguuacagguaaugugaaccaccaugugggugcuaagaacugaacccugguuuucugcaagagcaauaaauguucuuaaccucagagccaucacugcugccuaagccaucuaagcgaguugcuguuagucacagcgcuucacuaauaauucagaaagcaaauaaauuacauguguaacgcuuaucuuaagacguuuaagagacaaugugucauggugugugugucugugugugugucugugugugugcgagagagagagagagagagagagagagcaagcaagcaagcaagcaauguggugauucugguaauaguuucaacuugcaguguucauuugcgugcuuaaagacuguuuauaguaaagcagauuuguuuucuucauuauuuuuucuguauuuucuaucauuggauuguuguggccuaaaguuauguuuauguauauuaauuuaagguguuaauggaugguauauaaaucuaaauuacuauaugauggauauauuauguagguaauauuuagguaacuaguuuucacugguaacuucucucaccuuaaauuuugaaguauuucuacauuggggaagugaaagccacugagucaauuagaauagaaggaaucuuaaauacuuccuccuaacauucacaaguugugaacaucuucaggacuaaguacaaaauuauuuauuguucuuucuucuccgguaacauauguucuucgaucuugacuuaaguauauguugacaggaacauuauuuuaauuaucgacgccccauccugaugaguuaugugucuauucuagacauucuucaucuguauucaaucaaccauaugacagaaacuagggcagaggaaccaaagucucauuugaaaauuuauggcuaugccucauuugcauacgacaguaguuaaaugaaagccaaagagugaugggugaagucauaccagaggauacacugcagucagugugagccacuugucaaucaaauggguagucaguguagcuguugacauuuaacauccacgagauguacauauguuagaucuaagaaaagggaucacaacaacagccauguaaacagguuggagaaagaccuuaaguccugguuuauaacagccaugcccgggcuuucuuguguuaucugggugcuguugccuaucaccuucuuccuccucucuccacggaaaagucauucaaucuuaggaggaaagugguagcguaaauucaaacaauccuugaccaaugcugcaggaugauaguucuggaagugagagcaugauaaagaguauuacagcuucuagucgcuguacuaacaaauguacagcuuuaugauugaauuugaauaaaguauuucuaguugcaguaguugcacuuagauuguuaagugacuuguggcuagguauccauacuaaaauauguguauaugaauuuauacaguguacuucaaaauaauagacaggugaaagacaugaaggcauagaggaaacagacuaggcaugaacugaucauuauucaaggugggcauugaauacauguauucauuaugcucuauaucuuaagauaagcguuacacauguaauuuauuugcuuucugaauuauuagugaagcgcugugacuaacagcaacucgcuuagauggcuuaggcagcagugauggcucugagguuaauuugauacaacaguguuuaaaguguauuaggaaugagauguccacauagggcccagaauucuacuuuccauucauuugucacacauucuuguuacagagaacgugaguuccuuuucagcuuacacaugaagagcucccuuuuuugaaugacucgauauaauguagaucuauacagaaacaccaguacauacacacaguacgaacuuuaaucauuacaguagcgagauuucauccagaugauaaugcguauuaaauugguccuguaacuuuaagguucuuuuuguaaaauugaacuaggaagguuuagaguucuuuaaaguuucuuaguguuaaaaggucaaauuaaggagauuacccaaaauggaagaauucaaucuuguuucuuuuaaucuuaugugaaauuaugaaucacaauauuuuuauggccaucagcucugaacaugauugcuauguuuucucucucucuaucucucucgcucacucucucccucccucugcucccucccucucuuucuucaaaaucauauguauacauauguauacacauguacauauuuauccauguauuauauauaauuguacaauuuugagucuuaaaaauauguaaagacauauaaauaauguuguuucuuuuaccaaagcuauucaaugauaauuuuucuuuuugguaauauacauuguaaagaagguauuuagucuguugauccgagagaaguuaaaggaaacaauagaccaauaguaucugcuucauaguagacaucugggaucuguccagagguguccagagaacuuuuuacaagccucugaagccacacuguuaaaggcaggugauucagcuuccacaggccaaguggcuauaguacagucguccugaguuaaguacaggauagcuuuuuaaaaucaugauacuuuguccagcuuuuuuuuuuaaaaaaauuuaaauuuuuaacuuuuuacaauguaauacuaaucuuaguguacaauaucaaaaugccagaguagugacugucuuuuaacuccucugucuagaaggcagggugagagggcaucucauuuugucugcucccuacugggaauuuucaaugcuguuagagcuuagagauaugaauuuggaaggcugaaccaaaccuaaugaucaccaauaaaugcguuucucaacccaaaguauuuuaccaaaucuuuuguagccgcugcuuugaacucuagauugggagguaguucaugucuuccagugguagauuccacaugagcaagucaagacugcaggcucggcaguagucagcuucccacuguugagucagaacugagcuaagucaacugaacgaaugaaaucuugguucaugacuccugagguuucaggcuaugcuuggugggguuccuugcuuugggcuggugauaaagcacaugauggagccaagauguucaccucgugucaccuagaaauuggcgagaaagauuggaaagagggcagugugcugauaacaccuucacugccacacaccaguauagcucacugcauuccaguaagcuuugugucaugaaggugauaaaguagagugauaacugagccuuuuagaggauguauaagauguagaccauaaugcuuuuagccuagaugguuacuucucaauaguuuuauuuuccauacucauuccuuuauuaaccaagauuugacaaauccuagaggauguaagcagaaauauuuacccacaguugguaagcacaagaacuuuuccaaaguagacuucaaauagguugcuuagauuacuauuaauuauugcucuagucauuuuuaauuuugccaggauguucuuuuuauggacuauuuaauuagcauuguuguuuugaagagggacauaauucauuuuucaguauuugaggacuguaaauccuugcucauuagaacuacaaauggauccgugugaaaauuaaguuaagcuucuuuaccuguccaagcuuuauuuuuuugcauuugcucauaaaauauuuuguugauuuaccaccuuugugcucaacugcuucuucaagauauacccaucauugauccacagacuugugaagcauuuuauaaacguccaaccuucagacuucucuagauugguuugagccagucaguuuguugucuuuguugcaggagucugauggccaaggcugccccuucugucgcugugagauaaaaggaacggagcccaucauuguggaccccuucgaccccagagaugaaggcuccaggugcugcagcaucauugacccuuucagcauccccaugcuugacuuggacgaugacgaugaucgagaggagucuuugaugaugaacaggcuggcgaguguucgaaagguaaacgugagugcacgagugcagcuugugugcuacaauuaauacuauuuaauuaguaguaccaaucaauuagucucuauguguguccuuggcugagaaagcauuguugauuuaaaacuaagguucaaauauaagcaguauucccuuuuucaaaaaaaguauagcccucauuccccaucauggaaauuucucuuugcagcugauaaagacaacugcccccccccgcccccgccccaaaaucccacaaugaaguguuagaguugugcagcccagucccagucaaugcacccacagaacaccccugcagcuaaagcuuggggaacacugcaaaguggggaaaagaugggaggaaccagaggacuguggauuuucuuucaaucuaacaaucucagaaggagggagucucgccaacgugacuggguaacaugagcagaacaaggacaacaauaaauaaaaguggaugggggaagaccaugaggccucaaccauacacacauaaccacagacagcuaaggaauacagaguggagaaauagucuuucccagagaaaaguccaccaauaguuuauccaaugaucaacagucagcccugaaaacauacauacaaguaauauuauacagacugaguggguuauauuuaaaaguaagugugugugugugugugugugugugugugugugugugugugugugucucaaugauuaguaaggaaagaggccagacauuugaaagagagcaaggagagguauuuuggggagguuuggagggaggaaauggagguuugugugauuauauauucucaaaaauaaaaauaauaauuugaaacacuacauucaguauuaaucaguucagaaaaauauuagaugaaggggaauaauuuguuuaaaccuagugggagucagaugagaacauuuguauaaaauuaaaaauccaagaaugagauuaacaaauguggagaaaaauagaagauaggaaguuauuuuauuugaaauaguaagauuguacuugauuaccauuuuuguugaauauaaaaguguccagaaacgacauccugcugcucuaucuauaagaagucgcauaaaaucaucucagugaaugcacuauaacuuaagauuugcugguuaaguuagagcacugaccuuaugaacugaaaguaacugcuccagcccaucagugauuacuucacaaaagaaucagcguggcaguugaauaauuuagaaaucagaaaugguggguagauggcuagaucucagacugcccuuuguauagaaauacauaugaaauccaaauuacauggagaaguugaaugcuguggaccucagaaguggcauugguugcuaugagagcaucuguaauuacgggaaccaucucccuccuggcuccugcagacaugacuacucagccacaucccucugagguucacauuggccuaugagcuuuccaacaaagccuuaaggagagcccuuugccacugagguggaguggugaugauggcagccacuuuaggaacuucaaccuaugccccuauuacuauacaguugggaaagaguaggugcagaguccagaggaggccauuucuacagcuaauucaaggcugauucaaauauugcugaagaaaacucuuggaauuucuguccgggaguuccacacugaccucagacauuccauuauccuauuuacuugaaaaaucuuacaugugcagguagguugacaucaccagugucacuaugcuccaauucagcuuugagcugaaaggauguugguucuucacccuguuagauguacauaaguuccauaagguaacucauaggcugguguuuuucuccccuuuuggggauaacaucuguugaguuuuguuuugcuuuguuuaauuauauggccucuuugacccaagagaaaguuguuacuccucaguaacucuaaauaaugaauacagaagaaagaagucucaaagagaauuacaauuugagcguccagacaacuaacauucagccuuccagauaaagggagcagugaaccagcucuguaacaggauagaacuagcucuguaacaggauagaaccagcucuguaacaggauagaacuagaacccucugaagcaaacuacuuagcacccuucccauaaucugcauccucuugcaaagcacgacagcaacagccauuuccuauaauaacuguugaaaugauccaaugaggucacauauuuaagaggcuaacacauuguaacgucaguuggaccacaaauaguggcuauuuuauugccuguauuaauugaaauuaagaaagccgcagauugugacccacuucccagucugaguuaguacagaucauugcauccuguccauauaaaaggagcuacacuggcacaucagggaugaugcuuccccauccaagaagacaucagggacccagcucacuguucugccagucuggccaugccucauguccugcgugagagucauucaaaaucaagaaaggaugcagacugacagugagaauaaaggagcggaugcuguaacauugccuuuauugauugaugggacuuucucccuugaaguaacaauuugcauaucaagugaaauguguugaggugauaaugaagcaauaacauagucacuuugauuccuaucucuugaucugcucagccuaaaauauuccuuaccugacccuuucagaaagcuuguugccccagguauagcuuucagggugcacuuaguuuauugagugccagccuggguaaccuccgauggcaggaaagcauuugagaaacccacaacagcucagacaguucagacaauuucuggggcaccgguuucuagcuaggaagaaggcauuucuguuuuucugacuaaaguucagaguucuacaagaagauugggguguggcugcaagaaaaauucucucgagaacuuuguguaccuugcuacuuagagaaggagaaaacaccugucuuaugucaguuugaauuaaauugaagcuuaggccucaucucauaggacucuaguacuacaaacugagaauggaguacaaggugagggacagggcugccuucuguccucuccagccucuccugauugguucuuccugggacccugcgaggugucuauuuggaaaaugagagacuuucaguaauccucucucuguguuguuuaacccaagagaaggaugcucuccugcauucuuggcucacaucucucaaugauucugugaccuucaguguuccacuccccuacagcagucagauauuuuagaaaugcaauuaaauugccguucuuuaguuuuaauuugaugucaugauuuaauuaaguggcucuuaugucuacuaaucugucuagucaguuaagcagaucaugacuuuuguauuauuucaccaaccuuugccacuuagcuuucauccuuaguuuugguaugggugcaagcauaaauucuuucugaguaguuggaaaaauauugcugcaaaaucauguuucuaugcuguguuuauguguuuuaguacagcugcuguguagacuuauuacagaagacuauaagugcuaaaaccaggccacgucuaauguuuuugucaccaagacacacucaguaauuaucuaaaauaaaccaaucaaugcaugugcaucuucugucugagggugguuaccugaucaaaucucgugcuuuaaaaaagaaaaucauuuuaauuuuaaaaagaaaaaguucaguagauuuuauccagaagugaguuagaaaacagauuauaaacaacuccuaacauugacauaggacacucuucaugcaugcucuuccuguuuuguaagcaucaucaacuuauucuguauuuuuuuuauuuuuagucuugcuuucccaacucaggagcgaugugcaucacugaccaacaggaagauucaauguucuaaucugcuacuuccguugcucgucuuucucuccuuucauaaacugguugaugaccguauugugcgaucguuccugccugucuuaagccuuuugccuuuauuaaaguaauacuccuuccaucauuacauagagaacugagccaacuguaguuucccguuaccauggagauuucacacuuccaguauuuguaaguugcccauacagauuguuuccuuagcauucuuucauuaguaaaauauauuugguaaaaauggugguucaaauaagcagagagaaucugugacuguaaaaugaugaguuguugccuuucuagauaggaagucguuuuaugauuucauucaaaaguguuuuaagauuuuguccagauuggggccauuaucuaaguuucugaguuaugagauuucccaaguaauuuguucugcgugcugugagccccaggaaguaguauagguaugaugggugggaauguuggaguuuucucuguuauuacagggacaauaagauacccauaaugcuagucagauaacuucuuaauauuggaaaagaucagcaaauucuucuuuuaauuguuuuauuuauuuacauuccaaauguugcacccccuuccccguucccccuccaagaguucuucaucccguucccccuccucuuugccucuaagagggugcuccuaccccccccccccgccccccaacacacacacacuguauuccucuucccuggggcaucaagucucuauaggauuagauucauccucucccacugacgccagacagugcaguccucugcuacauaugugccaggcgccacagaccaguccaguccauguaugcuccugguugauagcuuagucccuaggaguucccaggagucuggguuaguugauacuguuggucuuccuaugggguuaccauccucuucagcaucuucaauccuuccccuaacucuuccauagggguccccaacuucaguccaaugauugacuauaucugcaucugucucauucagcugcugacagaaccuccuugaggauagccaugcuaggcuccugucuccaagaacaauauagcaccaguaacaguguuagaaauuggugccuaaccaugugauguaucccaauuuggcccagucauugguuagccuuuccuucaguuuccgcuccauuuuuguuuguuccugcauuuuuguaaacaagaauaaaucugggcccaacauuuugaagguauguuggugacaccauucuuccacuggguacccugucuauguacuagagguggucucuccaguuuccauguccccacuguugggcauuucggcuaaagucaucuccaucaaguucugggaaccucucacaucccaggucucuggaacuuucuagagguucccccuccucccacuccacacagcugcauauuuccauuuauucuucuagucccccgggccaaucuuuugucucccccuccccuagaauuuuuuuaauaguuuguucguagaauuaauauuuaauaaauccuggcggcagauucgauaccuggaucaaugguuuauguauccgaaugaaagacucacacauugccuuuauauuugaauaugccuaaacuaacucaauagcuggaccacugccuaaccuccaugagguuaaucuaccuucugacaauaaucccaaguuuuuauuacuaaguuuuauauucuauuuuggcugcucugggcuccgcucuccuggcuccuucacguggcagccaugccucucuguacugcacucuucuuaggcguggcaucacuccucuccucgacacuccccuggcaugaagggucuuucucccagaggacuaauauauaaugucauuaauaccaucaaacuuacaacugccuucauuuugauaauuacaacaacucaugucaauugaaaccauuucaaacaguuauuauuccuugagauaaguuuucucuauuucugugccuuuguuuccuacauuugagaucaaacgucuugguuagaauacauuacuugccaaauauauaaaauaauugagaagaguuaacaacuuacauguaaaguaaagcaauugaugaggucaacuuguaagugaaccugaauuaguucuguugcauugagcacuguauuuucuaaaaaaagcaaagucaaaugaaacaaaaacaaaacucccaguuuuucuuucacuaagaucgaucauuugaugugugucauuauaggugacuggcaaacacaacuguacaucacuccaaaauuauuugaauauauagcauaggaggaaaagcaagcauuugaaugcuaacgccccaccuuguguccaccucaacuggcagauuugagcuuccugaggggcaagucugucccuuccuuucaguuucagggacuccugguguuggugagcacaggguagcccucugagcacuguuuagugcuuggugaccugcugaugcuguuccuaacugugcuucuccgagccacacgagucccacggccacgugucucagucuagcuuugugcuuagugucugugcgucuggcacucuuccccuccuuguguuagauacaccuguuaaggagaagggugaauggguuaaaacuagaaacgacaauagaaucaugcggaaggcaagcaucaauuguuacauuaguuuuuacauagugaaaguuaaaacuccuuagaacagugcuguccugcugagaauuaaauauuauuaucuugauuuguccaugagauugauuagauuuuacuacucuugccuuuuuauggugaaauuauauugauuuagcaaaaccuggcugcauucuguaauaucucguuacccaaaugguaguccugcauuauuucuucaguacaagccuauccccaaaauaauuuacugcuaaaacaugguucaugcuuuaaaccacacagaaaaugcaaagcuguuaagaugucagguaaauacucuuuuaagcguuaaauaauuuagguaaguuuaugguauacuuauuuucuguauuggagguaaauuuuuaaaaauuaagaauucugcacauuagagagaagaacagcagucuccaagcaguaauuguuugcucauuguucugucugauguaaggagaaauagggguuucagguggaaggaagccuuugcccacuggcugaaauuuguuccuuuaauucccgaguguucuugcuucuccgccaucucuguggaaccauuucugaaucauaugucacccuucccugccuucucaaaauugcuuaugcggcugagugaaccaaaggucacaugaagccacuaaaugcaacacaacuuauuucuagaaacuuaaacuuugcaacaggauuuaagguuguaucgcaggaagagagaggggaugcaaauuuaaauuaaaaucauacauauacuugcaucaaguugugaaauucacacaaguguuuaagguaaaauguaaaacuucaaagaaauuuagagauuaaaguggcuauucaccagccaggaacuggugacccuccuacuagaggcccugcaaggagagucagugucacauugcaugcuuagcagaguuuauuacuuuaauagagaugugcccuggguuagagcugcaugugacacacucuguaguacuguaaaguagcccuucuggcaauuuuguuguuuaguucccugacagacgguaaaguacagucagccaucccuguaacugugcuccguguauaaguuuaucgccugcucagcguuuuccuuaugucugcuaggugguaucugagaagucccagagcagagccccaguggaacauagauauugacuguguuggcuuggauaacgauggucccuauaaguaggcauccgaagacaguggaacaguuugggaaguauuaacaagugugaccuugucacagacaaguaugucacuggggaugagcuuucaggguucaaaaggccacaucaucuccagugucugucagucucccccgcucaaccccugugugugugugugugugugugugugugugugugugugugugugugugugagagagagagagacagagagagacagacaaacagacagauagacagacagacagacagguaaauagaugauagauagauagauagauagauagauagauagauagauagauagagagagagaaagagagaaagagagaaagagagaaagagagaaagagagaaagagagaaagaaagaaagaaagaaagaaagaaagaaagaaagaaagaaagaaagaaagaaagaaagacagacuuuugucuguuuuucuccaucuuuugcuucuggaucaaaauguaagcucuuagcuacuacuccagugccauaccugccugccugccugccugcuugccugccugcugccaugauggucauggaccaucugaaacuaugagucccaaauuaaauaccuucuuucuauaaggucaucguguuuuaagauagcaguagaacaguaucuaagaaaccagccuaccuucucuccacaguggacuaacuaugucuuagugaggcagcaggauggccacacuacuucucucagagaaugccaagaaaugcuuaccacauguuucauuuucaguuucuucccagugucucaauuugaauuucuuucaaaugcuuacagguugaggcuucugggagcuuggcuguggagaaauaugcugcauugguucuauaccaugugcuucauauaaccuuuugcuuauuacugaaauggggcagugcuagagauaaggaagaauagagaacauuaacugucugugccuaaccauaaacugugugaaaauguuugagugugaacuaaacauugucauuguguguaacuucugaauaauacuuuauacuagcuauuuuaaauacuuuuaauuucugaugugcccacaacuuaauacaauaaaugaagaccaagauaauaguuggaagcaaagaaaauagacuuaaaauauuuucuucuauuuuaugugguuaaaaaauuaccucuauucauuaauccucaggcauuuagagaggaauauugacucucugaauccuucccaucaugcuuauuauaauacaagcaucucccuuguucaaauaugaaauucauuaaguagagaucuugcucgaaguaucauaaggcgacuuugauuaucucuguauuguuagaacucucauuaguuauugggagcuuuucuccugcuccauuuuuauaauaaccugccuagacuuagagcuccuuagcagaugucucgccauuuccauaauaauggaucucauuaaagcgucuucuaaagucguucuuuaaagguguggagaaagggaaaagugacuccagugggugagccccccacccccaaugguuagcaauugcugagcaagaggcagugaaguuuaaaugcuuugccucuucggcuuguuccgugaagauuuucuguuaaagucacagauguggauccugccgucuguauggcggucacuaacauugugucuuacguaguaaaacacauugcacauuuugucagagaaguaaaugaguaagggggauugguaggcauaagcacaugaaacugugguucugauauuucuagagucuccaaaucccugcccguggaagauguaaacuuaggagaugagguuagacacauaggcugaugagguaaucuggagacagaaaucaaggccuguggauucugaccagagcugaaaggaaaagaucggguucugaggguacuaacgguggcagagacccaaaaucaagauuaacaaaugauuuguuacucauuucccuaaacuggaaagaauggcccguucuccccagugugaaugguuugaauguuauaucauaaauucuuuguauuaaugccacacauaauaguuaauuucucaguaagucugucugucacuuauucuguaauggaaaaucuguauggucuuuucuuuaaagucuaauguuaaggcuacauuauaauacagacagacaaugagcccagaacaaguccucacagcaggguaaugauuguuaaaugccaggguaucuauucaaagcaccuugagaacugcguucugggaucauauuuaauggugguuagauucucuugguauagugcuaagcaguguagagcagauucaaaacugcauuuuugguaaguaacaagcaucaauagcaauuuguaggaauuaauuuaaaguuuacauagugaaaguauauauuauuugcauuagagagcuaauaagugaaacaaauugaaaaacauguguggaaauuggcaccauguccagggaaacauuaucaguuacaaagaaugugccaauaugcauacuucuaaacuuugcacauuauaauuugggguuucugacuuuuaaacucugccuuagaaaaacaugaucauagaaaagucacuucuaaauuugguuucguauugaucacuguuaguacaagaaaacaauccaccaaguguuucuguuuuaauauguuuguaauagaagacuucuauucuuaauauuuaugcugauuucaguacuuuaagcgauauuagcgguuuuuugcugugauggugaaauugcacauaagcagugggagaagaugcuucucuuacguaccacugcaaauucuuuuucucccuauuuauuuuuaauuagcacaguucuuucauacugucauaaguaugacaacuuugguuugcacaugaauuucuagcugucuaaccccagggugucaccaguuucugacaucucacuuggcgggcaguauguagcucuccgcuuuacuaaguccuugugaggacauuucagacaguagcuauccuauguccuguccugugggauacuagcacucaccugcacuguuagguucauuuucauacucauuaccaaacacccaucuaucccaguccuacccucuggugcucacuguuucugcuguccugugagugggcuuuuuuuucacuuucacauagagaaugcacagcaucugccuuuuaguaucugccuuagcccauaggacccucuaugcaugucaccacagauaucccugaauaauacuccacauucuuuauccauugguagacacagugauuccauaucuuggcugcugugaauagugcuguuguacguaagaggaauacaagacaacucuuacacauaauggcaucauaucuuuggaugcuuaccuaguggccgcucagaugauuuuuuuuuuaaaaaaggauuuacaagggggaaugucauucaccauccccuaaguguagcuugagcagugacucccagagaggacgaagaccgugacgcagcauagaaccuugacuucugcagcacaugcccgggcccucugagauuugcauagcugcuucugaugaaaagcauuuagcuucaggacuuccuuuccauauggaaguuuaaggaaaaaauauacuugguugaacuguguguguuuuacaugucuccuuguuuuaaggcugaucuccguuccuaguuuucccugagcaacauguggaauaaaugcacaguguguagaaucuguuuacaggugugagagaaacccuucaguuuguucccuugguuauccuccccucaaggaccccacugagaucucccgaucugucauucaucauuuacuuuaacaaguaugcagcuggccuucacuguccuccucagcaaggacaggcuguucuucccuuugcacacagguacccagcauccucucugcuucucuccuagugcacggacaggcagaacucaccagucacaucgccaggcuccucaccccuugcccagagaagaaagccucagccagacccucuccagaucccccaccucagccugccaccagugccuccccgccuagaucucauucagaaaggcaucgugcgcucuccguguggcagccccacaggcucgccaaaggugagucagcgccucccucgggaacacagcaggcaguucucugggcuuucuguguaccuauauauuacuuaggcuuguuuauaacaacagugguaaguuucucauuuuauuuauaccaagccugcugucauaucccuugcuuuauugcuauaaaauuacuaugaaaguuauauaauuacucagagccugucuauagaccccagauuugcuuaaguaaauagcaguguaagguauaauaucuauaaaaugcauuuaaaaggucaucauaugcauuacaauaauuugcgugcuguuauuaucaaaugguauuuuacacuuacuuucauaaugucauaacaagaaaaaugccaggggaguguauuggcauaagggcuugaggugugauacauuaucacccaugcugcagguuacucagaggacggaucauacagacugcgcuucaacccaggaaauuaauuacaacaaauuacaauguuugcaaagucauuauuuuacuguuuaauauuaaaggcauaauuuuaacuuaagccuacgguucauuguaguuuuaugcgggauucuuugaaauuuuaaugauaaagagcauguauuuuauuaauguaaauucauaaaaccuuuaauacgauuugcuaauggacuuauagucuaggauugccaaagaguacagcacauuuagcgcaguuuucuucucuuacgcugucucgaacuuggcuucuaucccaugacuccuggcuaggguagaacuuugaauuauauagacaugcagcaaauucuuguuccuugacauuuccuaauguaaaaacauaaacuauuuauuaaauaaacuuuuaaauaaacacuaaaaccucuugaggggcgugcagaguccccuugggaggauuccucuuccgccauuuguccccuggcaguuaagacuggcagguguucuucuuuucauuuuaagaacccagaaagucaugagucugucagcaacugcucugccauuuagaucuucacuguucuaggaaugcuguucaaacugccaaagcgaagggcccacccauauggcugccauuguacuauaaagaggaaaacagagaagaaucuuaagacucuaaauauugcaaauaauuucuguuuucaaaagugaagaagcaauaaaaacuguguuucugaaucuuugugucucuggaaucacaggaguuuacaaauucauugauaauugccaugauaauauaauuaauauauaauuguaacuuucuauuucuuuucuguaugauuucuagaacucuuacauguauaucgucauuuguuuaaaauuguuaguguggaacauugauguaaguuuuucauuaauuuucagauuuuucauuaguaguaaaagaaacauaaaagguuauuagaaauguaauaauacugcauuguggcuaaaauggaaaucgaguaaucugugucugaaggucuuuucaaugcaugguacaaacaacgugcucucuuggauuuguguuuuguccccucucucuuuuagucuucuccaugcaugguuagaaaacaagacaaaccacucccggcacccccuccucccuugagagauccaccuccuccaccagagaggccuccccccaucccaccugacaauagacugagcagacacuuccaccauggagagagugugccuucccgggaccagcccaugccccucgaagccuggugcccucgggaugccuucgggacuaaccaggugaugggaugucgcauccucggggauggcucuccaaagccuggcgucaccgcaaacuccagcuuaaaugggaggcacaguagaaugggcuccgagcagguucuuaugaggaaacacagacgccaugauuugccuucagaaggagccaagguaagaaaaugugcaauacagaagcuggagaagcagccuucgagcuuucccugggaggcuuucugcuggggcugagauaccggacaguguuuaggucgguuguuuguaccuggauggcacaguacuuccuccgugcucuuuaacuagcuccauguucuggacagugaggagcucacuuaacguugaacacgagggaagggaggaaaagacugucccuguauaauaacgagaugcagacacaggacagcuggacagagauagguccacuuccucacuguuuugcugagagccucccccaugcauaacucgguguuauugaagggacuaggucuucuugcucagucagaaucgggaauguugaaucacugcacguaucauaaaccagucuucugauccaguccagagucggaccucgcaccuuauaaaacaugacccaauucacuccuguuugccaaucaaacuauuccuuauaaugacauucccacacucauuuaaacaggaacccucucuccccuacauuuagggacgaaucuaagagugcaggcaucugaagaggcagcaccagcagccauugagacuagaacacugaguggucuccccagaaagcauccugaaauucuuucuggugcuuuauucugguguuagcugugagaucagaucuguguccucucccucuguacugaaaagaauuucaccucuuuagcucagauucaguuggccccagcuuuuuauuggcuuuguuaggagguguaaucuaguacuuuaaaacucuggauuguauuuaauguguucaucugacauuuagaaaacagcuuauuggcacacagguguaaucccaauggggaugagaaguuuaagguuacucuggggaacucaaggccgacagggcaacgugagacccugugucacaugaaggaaggggaacagauacaaagaaacuaugcagugccauguacuuacguguguguguuugugugugucucuguguccgugugucugugugugcgugcacuugcauguuuguauacaaacaccgugauggugaaaacuuugcuuccuaacaucacuccuacaguggucuaucagguauccuguggugaaaagagccagcucucacaggcaucauacuaaagccgagagcauuaguugcgaaccacaguugccagugagcugccauagcaugguuuucaauucuuuaagguuaauucacuacagugugaguguaaggagaaugcauauagaaaaaaacaguuugguaauguccucuagacguuaagagccuguccucagaggacuucccacagccuggagucccagcuggagagaauuucugggauuugguuuaguuuguguuucuccuuuagucucuguuggcucauuugugcauggugacgcuugucaugggaagagccuugaaacaagcucucaugugaagagacauuuauccucagggugcagguuacaaguuauuucugaaugacuucagaaauacauaguguaguugacaccacggccaguucuuugaaggcccccucuuucaggguucuuuuggauguugccauaaauguaaacacaaagcuggccuuccagagcaaggcuguuaacuuuuucagauguuauaaucugaaaagugggaugaagacuuccuuuggguauggauuuauauucuguaauauuaacacuaguucucauauaguaguaaaggguucaguuuugguucuguugaggauuccaacuacaaaaguuaccucuuacugagagguggauuuucauccuauuucuaaucaaccucuuggauagucccuggacuuggauucaaacucuucccuaauuuuuuauuuuugucucaugauugaauucuccuucagaggaggccucuuuuuuuuauuuguuuauuuuuuuaauuagguauuuauuugauuuacguuuccaauguuaucccaaaaguccccccacgcccccccccacccagucuccuacccacccacucccaauucuuggcccuggcauuccccuguacugaugcauauaaaguuugcacgaccaaugggcuucucuuuccagugauggcugacuaggccaucuucugauacauaugcagcuagagacacgagcucuggggggguacugguuaguucauauuguuguuccacuuagaggguugcagaucccuuuagcuccuuggguacuuucucuagcuccuccauuggggucccugugauccauccaguagcugacugugcgaaugcacuucuguguuugcuaggcccuggcauagucucacaagagacagcuacaucuggguccguucagcaaaaucuugcuaguguauguaauggugacagcguuuggaagcugauuaugggauggauccccggauauggcaguuucuauaugguccaucuuuucgucucagcuccaaacuuugucucuguaacuucuuccauggguguuuuguucccaauucuaagaaugagcaaaguguccacacuuuggucuucauucuucuugaguuuccuguauuuugcaauuuguuucuuauauguuggguauucuaaguuucuggacuaauauccacuuaucagugaguacauauugugugagcucuuuugugauuauauagcugaguaguacuccauuguauaaaugugccacauuuuuuguauccauucaucuguugagggacaucuggguucuuuccagcuucuggcuauuauaaauauggcugcuaugaacauaguggagcauguguccuucuuaucgguuggaacaucuucuggauauauucccaggagagguauugcgggauccucugguaguacuauguccaauuuucugaggaaccaccagacugauuuccagagugguuguacaagcuugcaaucccaccaauggaggaguguuccucuuucuccacauccuugccagcaucugcugucaccugaauuuuugaucuuagccauucagacuggugugagguggaaucuuaggguuguuuugauuugcauuucccugaugauuaaggauguugaacauuuuuucaggugcuucucagccauucgguauuccucaggugagaauucuuuguuuagcucugagccccauuuuuuaaugggguuauuugauuuucuggagcccaccuucuugaguucuuuauauauauuggauauuaguccccuaucugauuuaggauggaggaggccuccuaagaggacagacucuuuaaggucugugcuccauuguguguauuagcguggcugugcuuacauccucaaagauuauuucauguugcaacaaaacugcuguuugaacccacacuuugcaauaaauauuuuaaaauaugauacaaaguuaaaguuguuaauucugggcaucaacaauguucccuugagagucugaggauccagcugauucuuagugacaaacacugucuuuaacuuaucaucugccuggcgaggacauuacagaugaccuuauguagaacaaucuuuugaaggaaucucuagauaagauugcccuaugaucuucuucuugugauuauaacuuuuugugugaggaagcacauguucaugcauaugauauuaaacuuaucuguaaguuccaagauuugcaagagcuggcuuucaaaaugggagccuuugugcacacgggccucauuugcaguguccuacugaacaacacaugaagacaugcucucuagauuguggagcaguuauaaucacaagauagaaaauacauuugcauuugauaauaaauaaaaucuaggcacccaugaugugugugucugucuguguguauguacaugucugcguguguguguggggggguguggguguguguguguguguauuacuuacacauaucaaauaaaugcaaacagauaaacauguuuuuagaauaaaaauccuuuucauuguacagaauuuuuccuaaaauaucacucuaaccuuagacaauauagucgaagucacaggaaaagauuccgaacauacguguuaagacuauauggcaccuagaggcacacagaaaaaccaauguaggagagccagguuuacaauagauugcacagcccacauuggagggcuuccacaccgcagacccuucaggaauggggcucauuucgucauccucacucagcugugcaaguaguuggaugucugugacacagugagaauauugugaauggaacaaucuuaagcacaggacaguccagggcccacaagagugcucucugaugugugacaaacacccaaaauauauguaguugaaaggaaaagaaguugaaauccugaaaggaaaggcagaaaaggaauaaaguguucuacaagcuggucucuaccagcugggcuaacagagauggcagacaacgggguagcccuccccagcccugccaccggaccuccauggcaauaacagaaagggauuucaaguagauaggaagcaggacagugaaaugaagucaagggaaggaauugcagugcauauaaggauaaaggcaugugcccccaaacuggguaauacaauuugaaaccaguucugguaugacguuuucucaguccuuuauguaggaaagagcuuucaaaguagagauagcacgagacuaacgugaccagcgaugcggauuuuuaaaugguaaaucccuaagauuucugguagaauucuaauggauaggugacagccuugaaggagccugagcccagaggccagcaucuugcagacuguuguuuccacuauucacaaacagguccuccagauuccuaaggaacauagaauauucauuuucagcuaggagauggucguguacuccacucuccacucucggguagugacagccaaauucugcuuugaugaaaugggugaaguugaacguggaauucagaaucacauguuagauuuuguccuccaacaacuccuuuucagaaacaaucauauuagauucacagaaaugagucucagcacuuguaagccuuugacuguuugcaugcuugcauaauuucggucuccuaauuaggaagaacuacacagaauuucaugugugguauuaagaauaugcucaacucucaagacacaguuuagaacugauuacagcaugaucaaauacuaagcaaaugauguguacuuuuaaaauaauauaaagacaaggugucuuccauuuauagcaaugaaauuucccuggucagugccuccacuacugaggucaccugcccuguugucucucaacauucauguaagcccuauugcacaugacccauguaagggaauuugcuauaaaaacaagugagaaauaaaagacuguagucugaaauacauacaauauugcauuaauucuccacaaaauagaacuacacuugcagcuaucaaauaaauuguucauuaaaaacaaaacaaaaaaugaaaaaaauucuuaacuuuucagagacaggagaaaucuuuaagcuacaguccaucaauacaauucaugaagccauuaguuaaaaugcuacucacauuuugaaacauacuaaucugaugaaguuagaaaggaguugcuuaauccccucaaguuaaugcccuaccagagaaugaaugaaccugaguaauagauuuuaugauuuuuccaggaaaaacaggaaaaacucuguugucaguaugauaucacuuuauuuuuuuauuuuacuguguguauguauguguuguguauguauaugaguauucuuuuauauauacauauuauaugcacaugcauauggaugcucauguccacauccaucuuccuuugucauuuacucaccugacguuuugauugauugauuguuugauugacugauugauagguuuaugcguguuuuaccugaauauaugucuguauaccauguacuugccagauccccugaaaguggaguucaagacaauugugaggcuuugugugggugcuggguaucacaucuguguucucuagaagaacagaaagugcucuuaaacaccgagccauaucaaaugcuucugucaaaugcuuuucuaggcugggaauguccaguaagcucuugugaucugucagcacagugcugggauuccagaugcacacagcugugccuggcuaugaugugggugcugggaauaugaacauagguccucuuucccgugcagcaggcacucuagcagcugagccguuuuuugcaacagauuucccuuugagaaauuuaguaucacacagagauguugugugaauuguccuaucaaaguaucgcuccuuuaucaagguugaaacaugcuuuuauuuccauaucaguagauguuuggguauauugacauuccugcucaagugugcucauaauguuuugauuaugaaauuauaguuggcuuauuguugaaguugauaccaugaacucuuauuuccauaucauccuuuguuacugagcucuuaucaaguaguaacgugauagauauuauuaccgaaaaaacagcuuaguccacauuuuuaaaaagaaauccuuucauuuuacacaacuuuuaaguguaauuuugauaaaaaucauuagauuuuauugcaaaaaucuuagcacuaugucugcucagucaaugagaagaauuuugaugaagaauacuuucaaauguucaacacuauaauuggcauuuauagcuggaugcauguauucaucagauaaaagacaauuuuuauguuaaaggauuucauugaaccucaucaugauacauaucucuuaggaaaauucucuucucuagcaaaguucaaaaaauuuugucauguucugauacaugguucucagucaaaagcccacgauaaaaucacuucauuuaaagauguguuuuaucaggauguaacugcagcgcguugaaucuaaugaggggagacuugggaaagaaaaucugaacuaacauagucacucgcuucuagagugaaauuucaaugcuauaaaauuggauuuuuuacagcagaugagagcauccauauaucucagaggugaucuugcagucugcuguuugguaggauacccauggccuuugcagguuuucauuuuaaauccucaccacuguuuauauaaccaagaaucuaagcaguggaucuggauuuauuuagccaagguacaaaagguacaacucacccaucagggcucauuuagccaagacuacuaaaaauauaucucaaccaucugggcucauuuagccaagacuacugaagguacaacucacccaucuaucccuaguauucaucucccuucucaauaugaguuaauaagagcuuaugaaagaaagaaguuuauuauaaaaaauaccaauucaauucauuacuuacaaacuuuaagagguccauagccuuguaugccuuugcaaaguuacccuuccauuucuuccaccauuuaaguugauccaguucaagacuauaagagaggcaaggaacaguuggccaggugcuuccaccagcauuaccacugcgccuguaaaccggaagccccugauccccacugauaaaacguuggcucugagcuuuuugcaaaccaaaaguagaugugggauuuccacacacguggaaagucagaacaauuggcugacuaaaauggcucugaagcuuggcuuggacaugacacaggccugcaggggucuacucauacccugugacaucaggaauugaagauggcccugggagcccuaagucuguuuggaggcauguaaaaugacaguuguguccacauaguuucuuccucuagccagccccuauucuugugauauaaucugaucguuccugggaaauucucaauuggauguauauaaauuauugccuugcuucuccguuguguuuaaaaaucauaauguaacaucuuuucauauaaucugugauaugguagaucaccacugauccugcugacuccugaauaaauuguaugguauugcacuagucuaaauaagccaaaauuauaugagcucugugaaauucuaagagcugcugugguuucaggcuuugccaggaguugaaguccaggaacuaacaccuuugguuuacuuucaggucuuuuccaauggccaccuugccacugaagaauacgaugucccuccucggcuuuccccuccgccuccagucaccacccuucucccaagcauaaagugaguuuccuuggauuuggagaucguguguccauaccuaauauaggaaagaauguuuuucagguucuuaguacagcaacuacaggguaaauagaaggaaaucaguaaagacagaagcgguggaauuggguuuaugacuucaaguaucagaugguaagacuucugcuucugggaguagcuccuacagacuuccuaaacuccugagaagaugaauaacagaacgaaagggcaagaaaacuuagccuaaccuccaucgaagcagagggcagagcagcacagcaagcucucuacuccagccuucuucuuuaugacuuuaucucacuacccaaguucaauaaaguucccccaaguucccugcuuuucaaaacucuucagugcccaagaucugugcauguauccccauggaguuuuuuccuauccaguuaagccuccccuugcuggcucagacucagcuagacuucugagaaugucaguagaucugcauugaguugggaccaguggacauaaagcugggaauuggggccacugcaugcuggacagugagguaauguccagccaaguugccacuccuuccauuuccauuuccuucugagcucucuguagcaguaugagccuacagaaguuuagucagcuagaauucucaucuauuccuagugcuugcacuaugcagcaaccaagccccgccuaucauguuccaccuuuuccucaaguucuaugucucagcguuugcuuuuauaaaaacuaaugugacuuguguucaauaauuaauagugguugacaaagcagagauuggcaguauauauaccuauaaucccagcauugggaagcugagaccaggaggaucaucauuaauuagagucuaccuucagaaggauauaaugagugccagggcagccugcgauccagagugagccucuguaucagaaaacaauagaaaagacugacuugcauuuuucuuguuacaaauuauuguucuugauguaaguaauuauguacucuaauuuuaaaaagauuggaugguuugcaaaucauaaacaagguuuaugcuuucaaauacugccagggaaaauuauuuuaagggguguguuguuguuuuuguuguuuuugauggcuugguuucuaucuacuaagacugccagguuuuucuuuuuucuucucuguuuuuaauuuguuucuuuuucuuucucuuuuuuucucugggaguccuauacaugcucagacagcgcucucucucaggugcaucacuaacuaugcaaaggccuucuuuuauaacgaaaagccuccuuagaacuucuucauuccuuucccuggagguccuugaguuuccauuagauuuauaaaagaaagaaagaaagaaagaaagaaagaaagaaagaaagaaagaaagaaagaaagaaagaaagaaagaaagaaagggaaagaaaaagcuaacucucaaccuuccaggaaucugauaugcucuaaaaguaaucuuuuaacaugugugacaucacaagagaacacugcaccaaacgguguacugcucauugacuaggguuuuugguuuuuuuguuuguuuguuugauugguuuguuuugguuugguuuuugguuuuugguuuuuuguuuuuuuguuuuuuuuuuuuuuuuuuuuuuucguccuuuaaggaaagccauuacaaacugcaucagcaaaguguguuucauagucgggacagaaggagucacugaagaugggcacaauuagauacugcagugccugaaauuaaaccagagugcaauuugagauccuugagggaagaguagagaagcugagcugagacccagcaguuacaaucacgcugucauacagucuaagucugugagagcaaaccugauagugcaggccuugcaaauaaaccuuaaagugugcgcauacaguaagacaucgccgcucuauaaccucuacagucaggguuuuaagaaacaaauuacugagaugguccaaguuccugaucagcucccccagcccucuguuucuuuaauucacagagugaaguaugacuagagaaggggucuugguuuuguuuguuucuauuugguccuuuuauaauuagcaugaaugguaaauuccuagugaagugcacucacugguaaguuuguaauguuuaacucugcaagaaccacuaagaucgggugauauuuucucuccacuuucuaauuuuuuucucaauauuuucuaguuuauacuaaaaaauauuuuaacaagcauuuaacaaguauuuuuaucagcaacuuaguuaauuugcauguuacauauuagccauagcuguaagcauuagauuuguauuguauguuucucuuccccuccccacaacuauaucuguagaaauuaaguaaaguauauaagaaaauauaauaaaagaaaaggaagaaugaauaaaagaaaauauauaaaauaaaauaauccuaacagcagaaauaaauacucaaaauaucaacauccaaauuuuauccuugggucuuuugugaaauugagauuuauuuuaacauuauuuaguucauuuguggagaugacaucacacucuccuuguccuuugauauugucacauccauuuuuuuuucagaauauauauacuguuuuuucugugaaaucaugaaauucugaaguaaaaucugcaguagaguaaaaucauguuggguuccaugucuuacccuagcauuuauuaauugcccuauuuugaagaagguucccucucuggacuuuuggcuucuaucuggcuaauacaugagaggauauguuuaacuuaaauguuaccuaaaaucuuuugagcuucugcucccuaugcagcaauuguuaugaauuauucacuauauggugcuaauuuuauuggaaacuuuggugaccugaaugcucucuacuauagcugguugaccacuuccuauugcagaagccaucaugagaugaacuaucgaccuuacuaacauuacuaauaucauaaugcguauaauacuuucauuauaaucauuauauuguucauauuauuauuauaguaucugauagaauguugguuaugaaauuguacuacuacauaauauccaugcaauuuauuauuaauacagcuccacuuugacccaauggagaggauaguccauguccaaggagcauccaucauaggaggaugacagagcaaacacauaugcucacugacauggcgcuguuagacauucagguccccauugccaucuuagauucuugguccguguucagacaucaaggcaaaggaaaauuacaaaucacugucuaaauuaacuuacaguucuuacaaauguuggaagucacagagcugcacauaagaauaccaggcuagcaauuaucuuuuaguuucaacuccagugauaguaacaguuaggaagauaugaauuuucggcauuugauacuggcccuugaugccuauuuucuugagggcagaggauauccugugagguuuccauucaggccagucuucaucugggugauuaugugacucuuucuacacacuuuauaauuuauuucugaaaauaugguaucauaaagugauagugaaaagaaacagucgcuguuugaauagauacuccauuuucugaauuuuuuaaaaaauagauucuacauaacauuggcacuaucaauauaaagcuuuaaguaaaaacuugaaauguagauauuuauuauaacuuuuuagaagagagaacaaaaaguuccuuguguauuauuuuauuuuauaauuaaauuauaauguauaauauguacuuuacauauauauguaguauuuuauuacauauaugcuuacuaaauuauauccaacuaauuugauuuuuaaguuuaaugagauggaagacuaaacaauugaaauguuuauuguccuuggcacacuauacuaucaaaugaacacauaugauauuauagauaauaagguagugaauccauccaaguaaaacaacacuguagaaagcugaggaauaauuucuuuaugcuuugcuguuuacauggggacaauuguaguuuuggcauauuaaucacaagcugucgaauaccuuggaaccaaagcuacuugguucaugcuuuuccuaacgguccucugucgugggagguggugacguuuguuguuguuguuacacaucucuuaauuaaauaagguacuaaauuugggagguucgcugaaaagaaaauccaauuuuugcccagcucucuaguuuuuguucuguugcugugcucagcugagacuugcggggggccagauggggcaagauccaacucccuuccccuucggaaugggugcucuaguuaaggaaaagaaagugagaagaaagucaguuaaccacuuagcgguaaucuccgguaggaaaaucagacguggggcaggaugacuagugacacacagacugucacucuagaugugguccugaggaaagaccucucugaaaggcgcuuuuaaagcaguaaagcaagggagagagcccagcugugcgugaaaagccugacccuggggcaccggggugcagcuguccuagcugucuccagguuuucagcaaaucugugagaucgcucgcagucaaagcuuaguccaaagcugcaggcugcagcaagcucaccuuuuccugauagugugaaaagcacccucucaaucauuguaauacucaugccaggguuuugggcaaaugacuugugugcugcagacacaagauaaucuugucgaacaucacuguuuguuuugcuggcucuuugggcuuugguuugucugaauuggagauguuuucuguucagguaagaacaguguagcacaugaaacaugaaauaaaacauggcagcuugagcuuuuauuuaauaaaaacauguauaucuuuacuuucugccauuaguugcuugaacagagaucuucugauaugggaagcaaguaaaauggcauauuauuuaaaaugcuuuucuguccaugaaagguucugaaaauuguugcucucucuccuuuuuuaucggcauggugauuuuccuugcuaauacccccucauuauuuuuauuuaaaagcuuguaagugcucaguuacgugcaaaguaggguaauccuugauggccucaaggucuucccuuaaacauguugcaauuguagacaaaaacaguaaaauaacaguauaggaaacacaucaauagaaggacauaugcuaaauacauauaaccgaaaaggucaaagaaaauuacugaauuuguugccaguuucauggggauuuuuauagacacugaaauaugaaggggucugcuuuuuguuuucggagaaaaguuggugugucaaggguugcuccaauuaggaaugaaaaccacuugaagagggugauauuugagguccauuaucaaaguaaaugguaauggcaugugcagucagucugcccugugguuauucugggaguaggcaguucuugggaggaauauguuugugaaccuucagcuuugaaagguggccucagaaaguaucaccgugauggaaauagaccucuuucucaacauggcgaaugugccugcacacucaagccagugagucaccaugaggauaggaaggcucagaugaguuucaaguuaaggggauaaugguuuugcaaccuggaaaaauguaccuccugugcuaugacucaggaacagcagcagaauggaagagguagcaggaauguggagucauauaacaguguaaauguguguaaauggaugcaaauggcuugguaucuuuccuuuggagccagccagauagcuguccuacuuuguuccuccgggacccuggaggaacacaaugaaaauaauaucuuucccuuaagauauaccagugacugacugagucuccaugucccuaaguccaccaucuagauaacauacacacagacagugacucugugucuaguuaugcugacaccuguugacucauaggcuauacaaaaguuuggauacaaugcauagacuuugggucagcuugaucucucugacuuuuuuauuuacaaguucuuuaugauaaaauuuuaauaaauauuaaaacauuaaccuaagagaaaauagugaacuuucuuacaagacuuuauuaaaaugauaaguagaaaauaccaggaugggcuggugagauggcucaguggguaagagcacccgacugcucuuccaaagguccagaguucaaaucccagcaaccacaugguggcucacaaccauccguaacgagaucugacucccucuucuggagugucugaagauggcugcaguguacuuaaauauaaucaauaaauaaaucuuuaaaaaaaauaccaggauguauuuuuuauauuucaauacaaauggcacauagcuuucuuaacuucuaguuauaacucaccaagauccauucaaccuaauaaaaugucuaacuaguagcuucuaaaacugaacccuuaguuuuugauaaaaugauagauaauuauugccuuucauauuuacaucagaugcucucugacuaacaaaagagugagugguauuuagccaggcaagaucuucugucaaugaaggguagcauccagagcuaaccacaacaggugugguuuguuuguuuuuuuuuuuaauuguuuauuucuugcacugacaagaugguuucuugcuacaaggucugaucaccugaguugaaucccugggaacggcaagauaggagagaguaagaacugauugccacaaguuguccuugaccuccauccauaccuuggcaugagcacacacaucccaauacauacuauauguuaugcaaauuaaaaacaaguauucuuccuucagagugaagugcuucuuggaaaucauuaaauuauugaaguaaccuguaagacagauuugaacuuccaccucuugauguaguuauugaauauuaagucaaaggucccuuuugucucugaaguauuuacuuaagugguauguauagagaugguguucacugagacuggaagcagagcaggaugaggaugggaacaugcagggcccacuuccucugccuauagagacguccuggucuuugcagagguuggugagauugaugucugucuccaagaauuuaguguuugcaagaaaauacaguuauuucuauccuaaccauauuaaaacaccaucaagucaucauuuugaaacaucuuuacuuuugucaccuuuaguugcaaggugugucuucuaggauucaacuagagugacuauaacacuauuguuuguuuaugaauuucauagccuguguucugggcuguguagagaccccucugcuacuacaacaaagcuucagguuaccauuaacugacauuuggauccugaaguaucucuuaacaaacagagcuuuaaaaaucaauacugaaaacuucuucaaagacaaacuaaaaguauaagcuuuugaaaacucccaagggaagguuuuccgugaucucugaauacaguugaaacuuuaaauaugagcacacacauacaugcacacacacacacacacacacacacacacacacacacacacacacacacauacaaaacaccucugacauuuuuuucuauuauaacggguguucagccacacugacccaaaagugaaaucauuauagaaaguucuccaaaauccaaagcuuuuuugaggauuacaugagggauacgacugguaaagucugcaacuguuccaaaauuugaggggaaaaaauaaucugaaaaaauguuuuagucccaagaaguucagacagggacacucagcucucggagagaagaauacaaaaugaaaaugaaacuuuguggugagaagaaaugaaaauggaaaaagaaaaaagacaaaaagccacauaggcaucgacugccucacguaccagagggcuccugcucccucugccgaaugugcuggaacauuacacuguuuuguguuuuuuuuuuuuuuuugggggggggggaacauuuuccgugaaguuuauaauaauuaaaguggcuuggauccgaguuuuucuagugucuugcaaacuagcugucuuucuaccuguuggccaaguugcauuuuaacauuuuuuuuuuuggacuguugucuugggcaguagcaaagguuaaauuaaaacccacacaggaaguagaguacuuuucaauuuuauuuuauauauuuucccaaaugaucaaguaaaaugcucaaauccaccacgguaucccgcuaaguguuuuauucguugcaguuagguauuacacuuagguaucaugaguuacaaaaacaauccaucucaaagauuuauuucugucaugaucggcuucuaauuguggacacguuucguucuuaauuguugcagugggaggaacucuagcacuacaguuauaaguugacaagauaguuaaauuucucucauguauggcuuuuuuaaaacuauggguauuagccauagaccaguuugaaccuuuaaagaaccucuuguuuccaguugauuucaguguauccuuaucacuuuugcugauuuccaguacaugggagggagcaauuaacauuuuaauagcuuggacuugaauaauuguacacaucuuauguuaaagcuuuauuuauaaaacccuuucauuuucguaauuuucauuuuuuucuuaguucacccuuaaaaaccacagguaugaauaucuuaucuuaacauuucaaggccuuccauuucuauuggauguaagaacaguuuacaguugaaaacuuccagugacaaagcaguuucuucauuguucuaugucacaucagaccuuccugcucugguauuuaugaugcuuaaaccagauuggauuuucuuuucccucuugguagguguacugguccauuagcaaauugucucucagagaaaacuagagacacgguagaagaugaugacgaugaauacaagauuccuucaucccauccugugucccugaauucacaaccaucucauugccauaaugucaaagcuccuguucgguaagaagaugagcaucucuguaucauccugcaucggcauaagcaucgucaugcugucaaacguggggguuguuucuaugcgguucaauaguaugugauugguuaaaaauccuguuccuugccuagccuguaguuccuauauauuuccuucauugcuuccacauaaaagauuuuguugccuucuuccccacccccacaaaaggccaaauuacaaucuaauaaaaaggagcuauacguuacauauaaugaugauuaauucaugcauuuccccuaagauauuuuaaugaauuucaaaagguccaagcauauauaucaugaagaaauauuagugcuuagaaacuaauauuaagguacuaggucaaccugcuuaagaauuuuucuucauaaugugaaggcuagaauaauuuauauucauuuuccuucuugauauguaauauacuucuacugaaaucauaauacaaugggggggaagccuuaacguuacuucuguuaacuucuuuuuugagcaaauaccuucucuugcaugagcuaagaauacaaagaucacuggguuuuguuguuuuauuuugcuguguuuucuuuuucuuuuuccccucauuauaauaggagcauuauuggucuucaaagugccagucacauugacuuuuauaagaauuauugauaauggcuuacauguuuugaaauauguuugucucuaagcaaaaucauggcuuugcaugcaugaaacuuaauacaguuacaguaacauuuauauaauuugcaucuuacugacaugucaaucuauuagcuuuauuuucugaacuuauuuucuggccugcauucuucuugcauaguauuccuggagcugugcuuggcuccaaguugcucagcucuguucagacacuguuaguggcugagcugccuggggccuccugaugacugacagauaggagacugcaaggccaucagucauccacgccaucuuuacucagugugcugcuuccacuugaggccagcucagucgacuuaaaguauuuuaugaguagaguuuccaucuuuggaguugaaaacgcuucccaggugucucacagagguagagaaagaaauucuuggaaaccaagaguugugccuccaaagggaugcuggugggcggaguuacuacccaggcuaagugaugcacugcagcccacgcuuucccugauuacagcaagaaccagcuaucucuuguuaaucgugcugaugagugcuccugcaaagacgauaacggagaguguuacccugggagagccacgugcccgcugagcuagcugagggaaagucacgcuugcucaucaaguauaaacugugaacaaaucccaguuucuuuggcucuuacuaauuuaguauaguaauuuuuaaaugcuaaaauugaacgagauuuuuuuggguucuuugggauucucauucuucucauggcuggaagacugaaggauaugauuuuaauucaucaaauuuuaauugucaugucacaguagaugauauuuaaguggcuaaccucuuggauacugaaagucaauuugaauuauaaccaucauaaccaaguccccacaguuauagagaaauaauaaauguugcuaauuccuaagcuuaauuguaaugaauacuugaucuaauuuguucuugaaaaccagugaguggaguggcacguugugucaucugcaaaguccccccacccccccuuagaacuuccuuuuccuggaugucacucacucccccuuuggaacagcaagaaaaauaaauugucaguaugugggaagugaaacaguaaaugaaucauucaauucauaucaucauuaugaagacucaauacguaacuguucuuaaaugaaccauaucgugcccguuaaaaagaaauggccaccagagagaauagaaaugaauuucagaugaaucacucucucaauaucuacugaaauaucgacuaucuccuccauuaugaauguaguuucacuuugcucuaagaaaucagacuaauucaaaaggaaaguauaaaacuucacucucucucugaggcucuuuguuagccagccguuacuaagcuaggagcuuaagggcaaguguguucugugccgccucccaugccucaguuucauccagucuugauggcaguaccaaaaucacggcuuuuaaaugagcuacuauuuucccccauauuaaaccaucuuggugaugugcacccaaagcuuuugcugacaucacuucccuaaggugucagagggccagcguuuauuaaacauagugguuagauagguucagaaggaguaggucuuggaguguucccugcagaacuuaaacgaaauuguccaaugcuucauagugguuccucucuuuuaaggcccuuugaauuucaauucaaagaaugcuuaaguugaaccaacaaacacauucaaugccaucaacaaaaauggaggcccuuagaccuuacauaguuuucgguagcguauacuccgucacuucagaacucuggccagguguaacuaaaaucguacucaaauguguuuaggguuucggcugcuuuaguggccguaaauugcagugagagaaagagagagacauguuucccuucagacgaacacgucugauuuuaaaguacaggucaggguagcugcauguuguuacuaguccuuuuucuagagaagauaauuguuuuuguuuuguauucuuauuaccuuaguaggaaugaccguucgcucuauuguccuccccucacgcccgccaugacacuuaaaugauucuugcccucuggucuccacauuaggucuugugauaauggucauuguauauugaauggaacucauggugcgccuucagagaugaagaaaucgaacaucccagauuuaggcaucuauuugaaggguauguauggaguaugcuuuccuuugcaauauacaucuuaguggccucaaccuaaagggagaguucccuuguguuuucauacugagaaugcauuaagguuuuguguuauccucuaggaggugguucugacucagccucugauccaguaccguuaccaccugccaggccuccaccccgggacagcccaaagcacggcucuucagucaacaggacgcccucugacuaugaucugcucaucccuccauuagguugaaacguuaaaagcaguuuaaacaacccugaccugcucuccauaucugcauuauucgaauuaagaguucaauauaaugcagacucuuaguugagaauuggccuaaacuuaguuggguucucugguugaugguggcuccugcauucacaugacaucacucuaacagaugaacuaauugcauaggaaauagcugggaaauuuuaagcgauuuucauagcaucuuucagaguuuuuaagugucugauuuuucugcaauaaggcgcugcuuuuauaaucagagaaaaaguacuuaacuuuguuuuaagcuacauuuccacaaucuuauccuuacauaacuacaaaggagagccuggacgggcgggcgggcgggcuggcugccgccagcagggauuucaucaguucucucaucuagaggcaguucugugucaagacccaagaguguugcucgcucccuuggccucuguccagaggcuuucaagugcgguucuggagcuuuaaaccagggcccuccaaauuuacuaauccuuaguaaacaugacccacgcucugcuucagcaugaaauugcugggcccuaacuuaugagaaaggauauacuucauccuagaaaacacgaacuaguucuguuuaaacuguuuauaagcuuuucugaauugucuguuaggcugcuagaaauacuaagugagcuuuuauauuucucauaugcaccccagaccaguaguuugagcuguccuauuacagugucuuuugcuucugauuuauugaucaaagguuuucguuuuguuuuguucuguuucuccucuugugcuugaauucuacguuccugucuacagucugguuuccuuauuugcuuuuucucuauacuggaucuugaccccucacucaggcccuuacgaucuagaugacaguguuuaauagaguuugcuguagggcugucagggaccuauguguuugcuucuggucuaguugauuuuuuuuucuuguccaauauaauagccauggaugauugaugaccuuucugcuagcuauucccauagaaguuaccuccuaccucuucucuugggccuuccuccagcguggccugcguauugguccuuccuuacuguucucuuggcuaagcacaggcauuaccugucuuuccugcacauguauuuuugaaccucugauguuccacuugauagcagcacuucacuggaugcugcuuguauuuuucuuuucugcucucauaaauucuccuuuaugaggccaauuaaacccuuucaccugucagucuuaaguguuugcgaacagguuuucacuccccuugauaguauuuaagcuccuuaaguuuugaucuucauaucacucaauuccuagcauggugccugauacuuaagggcuggaaaaaagauuugaauuuaauuaugugacagcaagagccugaaugauaacaaaucucuucuaaaucuucaaauacuuaaaauuagaaaaauauuugugaugauuagaucaaauauucugcauauuuuugcaaggcaagcacaaugauaaauucauuuuuauguauuuaugucaaauucauucugcuuaaauacauguguauuuuuauuauuagaaugugaagguguuuacguauagccugucucacugacagcauauuugauguacauacuugcaaauuauaugcaguucauuuuauuuuuuuaaagauucaagguaagaaaaaaucuggucuagcaauaaguugcagggauaaauauauagacauaaagucacacugcaguauucuauaagcauugaauaaaccacauauauauuacauauacacauguggguaacuagcuuuggagccaccuaauggggaucuccauugacguguucuucucuggagaugacaacuaagcaaacaguacacucugcugcacuugugcguuugcucuauauuuuuacaguaaaucaaauguguggugcuauauaacugaauuacaguccaguggaacaaguguuauggagugguuagacacgcucuuugacacuaaauuaccugugcauggugugauuuuucucaggagaggccaugaacucucuuuguugcucagagauuucgguuuggcugguuuuacugaaaauacuuuucaguucagaguucuaguauacuaauaggguaaacgugacaaagggacagugagcugauauguuacuugcaaugcugcuuuuuauagaaagacccaggaaacagaaaaaugguuucacagagggguguuucauuggugugugugugugugugugugugugugugugugugugugugcgcgcgcgcgcgcgcgugcgcauagguacauucgcaugcauguguguguuuauaugcauuuucuauccucacacccacaaagcaacaccauucuguaagucagggaagugcugaauccacccugcaagugaacuuacuugucaggugaagcaguaagggaaaaaucagucauaauuuuugcuuggcacugugguuugauuaaugaaguuccacuguuaauagugcuccuucuugaaaugcaggugaggacgccuuugaugcucucccuccaucccucccuccucccccaccuccugcaagacacagucucaucgaacauucaaaaccuccaggcuccaguagccggccuuccucagggcaggaccuuuuccuucuuccuucagguaggagugagugaaaagccaaagagggggacaggagggggggggggggacggggcuggagagauggcucagugguugagagcacugacugcucucagccagagcuccugaauucaauccccagaaacuacacuguggcucauaaccaucuauaaugagaucuggugcccucuucuggugugcaggcauacaugcaggcagaacacuguauacauaauaaauacaucuaaaaaaaaaaggcaaaagcagcauuuucuuuuagagcaaaguacaucugagaucaugcucucaaauuuauguuauuguuuccugagucucugucacauuagcagaaagauuucuggauagugagagcugugauugccugguuugcuugacaccagaucgauuuaaugaccaaacaucacaaagauggcagagcaauaaggaaucacagugcuugcacaugacccaguaaacaacuccacacccaaguacauaugggcaauaccgauggaauuuaguggguuauuuaauacuguuuaaaaggagagauguaaagucagacuggagauguguuaguggagcagaguugaagguugcuagguuggaauugggguugaguuguauauuguacauuguguacauauauaaaguucugaagcaaaagaaagaucggaaggaccgagggagcaugcucugcauauuauagagagcaagcgaugccuucagaugacagcagaguuccugaaagacauaugacagugugaugggccaauaggagaagcacaaucuuuagguucucaauccccuauuuccagugaaauguuuuucuaauaacggacuucaauauuuuuuuucaaggugugcuuuaauacccugguuuuauucaaagcauaagguuuuauguccuaacaagguagcucuccuaaauguuuguguuaacaauuuuaagcauggagauauauugucuucaacgggaaacaaauacaguuuucuauuagugcacaucuguagaguguggagcagauauaacaaugaagagacuaaaggaaacccucugcacaucuugggcagaauuaucagaaaaaggaaacacagccacacaugacagcaggcuauugcuaucacugucuccagucuccccagucugccuggggagagguguguggucugugugccuugcaaggcuacccuccuggacuagcuuugguaaagcagucuagguagacguggagggacauggcuguaaucccagcagcugcaaguuugaggcacaggacugugaguuugacgucauccugggcuauaccagauuugccucaagaauagaaacaaauguuuuuaauguuuucugcacauuuccacauaagauaaaucaugggaaaucuuuuaaguguucugauuguucauugcuucaccaguaacucauugaaagucuguggagcuguuaauuuccccuccccaucccuaccaccacgaccaauggcucuguuuucauccucucuccuucgcucugcccccacugccccacccccacucugcuuuacacucuucucuuucucaccugguuugauaauguagagacauuggagagaguucaugaaacacaaacucuggucaccuaacaacacaugucacuuugcguuucaaggggcugaauauggaaagaauaauuuccaguugagguuuucaacagcaguugucuugucuaguguuugguucauuauuaacgcauccuuccccccgugcucaugguuugccagggugagaccuaaggccaaguguccuaaggucaucugcugcaagcaagaguuaagacaagcaugcagccacaacucuugggugcugagcuuuuggcagcuucugguuagcauccuccucuagcuuuuguaauguacucucgauuuaauacccgacuggugaagccucuguacagugggcucccuuacaacaaagucaaaauuucuagaagcuaccagaaaauauuuuguuacauuuuacaaaaugugugaccauuuuucuaaagaaauacaguggcacauugcuagugguaauucuucacucuuaagaguaaaacuugaugaaagauauacuuacuaagucacaguccagcucacugcuuuuacaauuguaaaacugaacaaagguagcugcccaacucacacugcagcagcuacgacggaagucucccucaugcccaguguuuuuaauuaauuaguggacucauaaauuauuuugcaguguugagaugaguuccuugaaaaguaugccaacguaagggcagaauagauaucucauaaaaggcuauugcauuuucucagacuauuauauaaaauccccaucucuuucugauagccgucuacgcccugcacagcugagucagggugccagccuuuccacugcuccagaguucagcuuucagacugcagagccgccuuucugcagagaagccucaugaguccagccagcuagcagaaggacagccaugcagagacucagcucuguucauccuuuguguuucccaccuugggcuuucacacaagauuucuuuuggcaaaauuauaauucccacuaacgugcucgagccuuccuuuuggacgagccaaucaaaacuuaacaaaaccggaguccucaacaaaagcuccaugauuucccguccacaaacccaaggcaacugcuggcauaggugccuuuuucucuuuguaacaaaaagagaaaaaggcagucucccugugugugggaagguugaaauaggcauuucuacaguuuugcuuaaggcaaauagggcaugugcuuaagcaacaagagcuaggaaagcacugagucuuagucccacccugcauggagucuuugggaaggacccaggaugcgccccaggcuucgcagcccuaccucaccuuccucucuuucccuguaaccuaggauccccaauauuaacaucucaauucaauuuuaagaucuagugacguuauuaaagguaagcaguacucuugacucugagacaugaauauucaucuguauaaguaaaacucaaaggaaaaggaugcagugggcaucauuuauucaacccuauugagacaucaucaauaacggggcuaaucagagagcucgugccaucugcaagguugacagaggaaucacauaagugaugucaacugcgguguccuucccguguggaggcugccauguucacaugugagaaguucaagggcaagaacugggcucuugaaacucucucuccagcucagcagcagccucuggggauuugcuguaagaagucaggcaggaccugccuaggcuguaaauuagaacgacuacauuucuucuuagcaaauugaacacauuguguguauuacauucucgaaaaaaauuauauuacuguauaauuacacaugggcuguagcauuuucaauuuguguguuuuaaucauaaauauggacauuggccuuacuuaguuuuaaacgaauuuaauucagcaaagcuuuauugauuuucaaauuucccuuaucagaggacagcuaguaauuauagcacucuguaguaauuauucuaugucacgccauccccuuuggaacaguagcuccaauuccauggcucucaacagggagcauccuucucccugucccuuaccaggaacaacuuggucuaaagcgagguagagcaugucaugauggaacagauucuaaguggguuugcugcugauuuaaauaauuuauuguauccagucccuucuuagguaaaaugguuuaaugggaaaacauuuuuaaacugcaauuguuuauuuuauuuaauuuguuuauaauacuaaaacauguccagauuuuaauauucuacguuuucaguuucucuguaaauaauguagaaauguccaguaagccugaguuuucucuaggguauaaugauauagcuaaacuauauauacuuauagcccaucuuucuuuauggaaaguauguguuugcauggauuuauuuuuaguaguuacaauauuuauuaagagcaaguuaauugccaaacaguuugccuguugcuguauuuaaguuaagagauacaguauaauuaaggaaaauucugcccuccaaggaacucagaauaacuucagagauaguaccagcagaagaaaauagaugcagaaaacaugagaguggaggugaaggcuguaaauuauuagcgagccgaagaagucagagauaauguucuucuauucagacaagaguacacacuaaggcuuuaagcccauauacugcuaauuuuaaagcgguuaggccccugugguccuagugacuucugacaacacagacuccugucucuguuuaguuacauuuggugaacuccaucacguauagugaaauaaguuuucagucuacuauucacgcuucacaguuuuacauggcagaguaugaaagaguacauuuuuaauguguauucaaucuuuauuuuuagaaaugcuguauuuuucgcaguugaauuaacuauucagugagacaaccugagaacuuggucuuagcauauuuugggaugucuaauauaguacaguuuuuaaaauaccuuauauuuacugauuuuuguacaggcauaaauucauuuaaaaaucgcaagcuucaggucuguuuacagauucaucuugauguccacuucaggaauccaagugacccaacaguucucucuuaaggcaaaguaggcagcauuuucuucaaguuuuuuccccucaucagcuuucuuucauucauugaaaugcauggguagggauagaaauuugaguuaggaggagguucaguaagugaucugcaaagaugaagaaacaaccauggucuuaguuuuggaaguaaauggaguagcucucgccugaacaagugaaugaguuugaaagcugcacaguccauuuggguauuacugcucaugaaauuaguugaccaguuccucaucaaaaucuacaguccugagaaaggucccagaauucuuucuucagccaaccagcugggaucauugucuuaauuuuuuuaaaaaaugucuuuauuuuucaagaucccuuuuuugacccaacaaguggccaaguuccauugccuccugccaggagagcagcaggagacagcggcaaagccaacagagccucgcaggacuaugaccagcucccuucaucuuccggugaguuggcugagaacaguaacaauauuguccuguguuuuuacagcgccuuuucucuguagccucugccuuuuguuuauugcacuauaccuaagcauucacuuacuguccauguccuuaguauuuggcauguaaagcguacauuaugaaaacaacacucagaaaaauaccugggggaaagaagaagugaggcuuacuauucugagugaacagucaguaaacucacagucuuuauuuugggaugcauucuuucuuuugauuuccuuuucuuauccagauaauauccuugagcaucugcccuuacugguuuuuuguuguuguuguuguuuuuguuuuguuuuauuguuuuuguuuuuuguuguuguuuguuuaauuucucauuaagacugacaacucucuaaaauucauaucaguaacaaaccauguuacuguuaauuguuuacuauggguuuuuuauuguugcuuuuguugcuccuaauguugugguucguugauugauuaguugguuggcugguuugcugguuggcuggcuggcugguuaguuaguugcuguuaggguuuuuuuguuuuuuguuuuuuguuuuuguagugaagugugggccuuuuuuaucugcauauuaaucccuuuccugagaguuccacucucacaacuuacucagcuacuauaaaggccugaagauaguguggcccuaugccuugcucuuguguuuguucuucaggccuuuauccaacuaaccaagcaacaagccacagcaaugccagcacuuggaagcugagcaggaaccuuacaccacguuuagcaacagacugagcuacacaguggcauaggaaagccaagaccaguguggccuauguagggaaaccccaucuccaaacaaacuacucaagugagacacaaaaguauuccuguaucucaguucuccuucuggaugcccaacgcauaaauugauggggaccgaaagaagaggugcuagauguaauaguugcauaaugggacucucugaaucauugagcugcuuugaguauuaucagcacuguacuuuuccauagugcuguguaggagaugcagaauucuccauaaaaccacaaaaguguuaacacuuguauaugaccugggaaagcacagaauaguuuaacccuuucagauuuugguccauguugucugccugaucacauggagccacucagggcuuucagauccgucuguguauagacuguaguuccaaggagacugacaaagcauggaaaucaaggagggaaaauaucugccagccccaugugacauaagaaagcaaagccauuacugaaauauuguugaaguacaccuuuggccaaaacaccacgucugacuugaaauaauauauucagcaccucuaacucuuaaaauaaugguauucauucacaucaugagucgagucaucacuaaucacuguuuucacagguucuucucugugggcugcacaacaugcgaguauuguggggucaauagcaucauucaugugcaggauuucgaguguuauagauugggguugacauuacaauagaaacuucaagagugcuuugacuugcaaacagagaaacacccauauaacgggacuaaacuaggauuuacguaagaaauuagaaaauaauucuaauaaucagagccagcuauagcaucaaguauuucauccuacuuccuaaaccuuuucuaacacuagcaaagcaugggacuggugcccuguguuacacacuagcaaagcauggaccaaugccucugguucugaccuguguuuguuagcaagaaacaugcuagguuuugguugguugguuggguuggguuggguuuuuuugggggggguguuuuuuguuucuuuguuuuuugguuuaguuuguuuuuuuggggggguuguuuuuuuguuuuuuuuguuuguuuuuuguuuuguuuuguuuuacagauacacaucuguacuagccucugaauuaggaguucucauuuuaaaaccugaccuagauacuaugugccuucacagucucuucuugucaaaggcccuacuaaauggccuaacaaggauucuggugugauugugaacucuaaaaccaagaaugucuaucaucuuucagagcuacauaaauaagugauaguagcuuacucuuccaugaacuaugaaaagaacaguucuaaagauucagaaacaguguuaucaauauaaaauuauguuccuuguucaucugucaaaacaucaugugcgcaagugcaucuguauagcugcgaugcacuucaagugcauucauuccucucaaaggaaguauuucauagauuuaaaaaagugaauguugccaucgauauuuuuaccaaaugauugugugauaaaacacauuuauaaaaauaaaaauaaaaauuucacuggcuuauuuuaaaaaucacauacuucuggguuggggcaacuuuccugccaguaaucgacuuacucuuuauacaagcacauuacucacacauagcuugugucacuaauagcuauguguaaguuuuauaaaauuuugaugccacuuuccaccuaauguauauugugcugcaguuugaauuccuugagcauuccauaaugccuguucuuacaugcagcauuacccuugaaggagauuauucauaucauuaguaguuaaaagguacuucaaggacuugaaacaaugcuaagaugucugugacucacaugaaaggauuuuauuucugaauauacugacaaauuaaggagguguuguuauaaggggaaugagcugcagugcuguguccuuuguuuauuauuggcuuaauggaaaauugaagggcuguugaacagauuguuauauggguaauggguuuggaaauuucagcuggaaaucagagcuguaauucacacaagguguagagaacuguuuaaguuauugguagucagugauggguaguuugccauuaacacucgguucggauuccaggaugggaaugucagugucguugaucucuaccaguucagccgguaguugaugccacuugaaaaccuucacacacagcuccaguuuaaaaccucggggcuggagucuuuuuucacaaagaucugaaacagucuugaguucugcauucuguguauucuaagcacaguuaugugaagauuuuucauguguucguguuucacugaaaacuuuaugugaacucacaguguccagacuaauucagcaacacaauguaaauaggcuccaaaauuaauuaacagugcauauauuugaaaacaagauuguaauauauuuuaagauuuuguucauucuuuauucaguuuauuucauauuauuucuucuaauuaucaacuauuacaaaacauaagaaacguaagaaaauuauuggucaaaggguguucaugcuuauuccaagaauuguaugcauuuccuauaucacuguaagucuauauguaacuauauguacauguuauauaauauuuaauuuauuuaacauuuacuauaggauagauaacuauuuuaggaggcuagaaaugagaaucacauauaucauuuaguauacaaaguauauuacacacaauuuuuucuauguagauacauaguugauauuuuacauaauguauauacuguuauauacuuuaaacauaacuauaauauaaaauauaaauaaauguguacagcugcaauaaguuuaauuuauagauuaaagaaaaacagcauguuuuacuaaucugccaaggaucccacaccaagugucagcccaauaaaauauaaguugauuucaacaauuuuuaguaagguguucaaacauuuauucuuuuauuguuaaugaaguuuguguugugauucccacaguagccaaaccaaaaaaccaaguuaggacauaauaaaaaauaacagcuuuguguaacaaugguugcuaaagcauucguggaucaccuuccuaguaaaacagaggaagggccaugaaggacgagcagugaccauagaguaguggaaggcaccggaagcagugaacgccccaggaccucggcagcgccccucccugggucugcuacucucucauaucagacgauccucagcaucucagucuugguucaggagcagcucgcgucgucuguuuagcuguggugcuguggaucgcacgagcgugacauacgcauucagaaacacaauguaguguagacggcagcgguaagaaaggaaaucacuuagagcugugccacgggggugucccauggauucccaguugguuucguuccgugguaagauguagggguuggauuucaauccucuccaugagauacuugauuuccccagcaccauggccgagacaucccuuuccccguugugugacuuuuagugacuguaagaacuggcuggcggcagaugcguagguucugaaucucgguuccaccagccuccgaguccguccuggugccguggcucugugaugcaucuugcagugugguaugggaagccuccagcucucugcugugcguucaguguggccuuggcucuuugagauccccgagcuuucggguggauauugggggaauccacagauggauuugaaucuauagaauaauuuauaaauuacagacauuuuaucaguagucuguugguccauggauauggagaguuuucauuuuuguuuuucaugucaguuucuuugauuauugauuuguaacuuuaacuguagagcuuuuacuucuaggguuagguucaucccugaauguuuuaucuguagcuuuugugaguuuuauaucauugaguuacuacuaauucuuguaugugagcucugcguucugccacaccauugaauuaauacuuacuaaugcuguuuugguggaauccucagguuuuguguacaaaaaucauguacgcacaaaaucagucacacgaaguguccauugaacucccuucuuuauuuguauggcuuuuggguuguuucuuguuaagauguucgguuugaaauguaugguugguucugcacugaguaaccugguggcaaugggcaacugaacucagagaaaauccuugcagcuucucuccauucacauuaaugccaucuagggguuguacuuaauucaugcuguguugaggggcuuaaucauagagaaguguuaagugguaucaagugcuucuuguauaucugcugagaucauauggucauaucguuuccauauuuuauugucaguauacacauauguguauugauuuccauauguugaacuaucuuuuaacucugagaaugcaaccaacuugaauaauagugaauaaacuugaguccuugggaugaaaccagugacuuacuagugaguuugauuccaugaaacuuuguugagaauauuuguauccguguucaucagaaauauuaauggucuauaaguuguuguuguuguuguuugcugcugcugcugcugcuguugcugcuccauacuugucugguuuuggaaguuggauagugcuagcuagguucuuggaaaguuuucacuguugauaaauugcaaaaaauccaaugaaacgaaacuaggcaguuaaacaucacuggugagccuccuggcugugggcucccggugagggacuucauuggugauucaaucccauuaccaccauuguucuucccagauucuguguccucuggauuuuccuguguguuggcauaaguucauaggggucucuauguuuaccuuucucuggcugagaccgcaaggcuuccuuuucccuuucugaccauaccuacuugcuuucccaauuaaccugucuggaagcuuauccugguuaaguuccugaagaacaguuaaugguucgacuaauccuuuccagcacuuauuucugcuuaaauccuuguuguuuccuuccauagacuacauuaggcuuaaguugguuccugguuuucuaaguacuggacaucaccgggauauguauuuacuuaaggguuuugggagucgguuugaguuuugggguuuuauucuuuguuucuucuuguuguugcugcugcugcugcuauugucuuguggguuuuugguugguugguuuugguuuugguuucuuugcuugaugucccuguuucugcacccacuucccgcccacucaugccccgugaagauacucacagccuguguuuauaccuuuggaugccccuuguuacauaucacacguuuucucuauuguguuuccauuuucauuaguguugcgaaauuuuugaaugcucccagcuuucuucaugacccacuuaguuguuaaaaagaaucuucgguuucuaugaauuuuuacaauuuucagaaucuuuuuguugagucauauguuauuccauuuugaucagaaagaauagaggguaccacuucaguuauuuucaauuuguugacuuaacauggacuauucuagagaaaguuucauguuccgaugaaaugucuguccugcagcuguuggauaaagaauauucuguagguguuauuuaaacucauuuaucccuuucagaguuuagcucugguguuugcucauaucuuuaucuggaugaucuugacagaugcaggauauugacaucuugucgccaucacuauauugaaggcugucuggccuuccauauccaaugacuuuguuauauaaaaacaaacaguauucugaugauaaguucauauagauucagucauacugccuuguuaauuggcuucuuuauuuaauaacgugacuuucuuugucuccuuggguuuauuuuuagauguaaauguagcugguccugucugucuuaagcuucuguuuaaaacauccaucauaaaccauccuuuacucucggccugucuguguacuuaauaaugaagugaguuuguguuugcuugacucuggggacugauuuaacuggagagugagagaaggaaugacacacagacauacacacaaaagcuaggaucagguggccugagacucuccauguauuuauagagauuggaaggaggguuuuuaaagacagacagacaaggaagcaggguuauuauauaaaacuguaaaacugaacaaggaguugauguagcuaguguucauaggagcaguuccuguaggggaacaguucucaaacuguuuacaucuggagagagaccgcuauggugaacauuugaugcgcauucugucaacauucacauucagacccaaggaaagcuuuuccaucccugagcaucucuagggcuacuccuguaggacugaguccuuguccucgcuuugcccaaaucaaacaauacacauuuacagagggcuucucuugcucccugcagucuuaggagaccuguuauuggaaauuguuuuacucucgugugugugugugugugugugugugugugugugugugugugucuuagacuuuauccuuuuuugcucguucacugugcuugcuccauuguucuguaguguaucucuucagugagguuuccuauuuuacaugcuuucaugauggugauuacauuucuuucacuucagaacguaggaauucuuauaccuauuuggaagccgucuaugguaauccgacaauuucucacuggcagcugucuuggaaggccuugguucccuggauggauauugucaucauggaaagcauugcuuucuuucaagaaucugaauguaucccuuaaugcuuuccuggccuauaaaaugucugcucaagcauucagugucacucugauacgguuccuuugugugacuuugaucuuuccaguggaagauuuaaaguuguuucuuuguguucuauaguuuggacaguuuaauuguaauaaguuccgugaugaucuuuucuggucauguugauugggaugcugcauuuguccucuacccaaauguuuguaacuguucuaaggucaugaaauccucugcuguuauuccuagguuaucaaugagcuuuuuugccccugaugaaauuuuucucguugccuucgguuauuccaaaacgucaguuugggcuuuuccguuuugguuuuguuuccguguuuguuucucauuuacuagcaugccagagaucuugagugcuuuauguuuguguugggggcacaaacaggaugcuucccaagacacaucugugagcccaugccucugccccucgaugcggugagcugcagaccuuuccauucugaacuccucaugucuaaacugugcuugguucguucuccuuuggagucucacuuuacguuucuuauccuuguugcccacacugacuuccucauuucacucaccuggugcuugcuugcuugcuugcuggcuugcuugcuugcuuuauuuauuuauuuugagcucuaauuuuuuuccuacucauucuuuuuaaauuauuuuguuuugucaagcauuuuaucugugucucuuucuagcuuuuccuagaggcaacaugcuaccuuuuuuuguuucucaaauuuuugugcuccuguuuugaaacuugcaccucuggcuaauuaguuauuccugcuuuuaugugguagucuuauuagagguggggccuuugagauuaccccauccccagugccuuucagcucguguuguauuuauacaggucauaaguauuggagauuuuauggguacagcuuuccuuuuauauauaaaagacacugucucacagcagguguccugguccucucccucuuacaaucuuucuaugcucaucuuccucaauaaauguucccugaaccuuaggcauuuguuugauauauacagcgcugguuuugcaucuagcuggucaccaacucuccuuucuuagauucuuaugcauuugggauuagugaguuugggcacuguauauguauugucaaaaucagguauaccgguucucugugcaucccacaggaacggagacucacuagcccuuugccagguaaggugggaugggcagcagacagugugaggagcucacugcauaaauacuccugaaauugaaacagugguccuugcuguggcuugagguggggguggaaucaacacaggcccuguggguguuaauucuacuuaauuaauuaaguuaauucaguagauguugugcuuuuugugcagcuugaagggacugaguuuggauucccagaaugcguuugaagccagguauauuagaaggcaucuauagucucagccaccuacagugaacugggaguaagaaacagagaaucuccagagucuuguaggccauccagccugacguaugcagcggaacaagagacgcugccugaacaagguggaaagcaaggacugauccacaguugucuuaugaccaucacaugugggucauggcaaguguggacccacucucgcucucacacacaaauauagacacaucuacacguacugcugcccacauauaaaagaaugaauuaccuucaggguccugcaccauaagccagucuccugcugaugcuuuuuuuucccucuguuugcauuuucuuggacaaaaaugccuacaucagaaucuaaaguguuugcuugagcaaaaccacauugaauuugcucaaccuguugacugacagagucagaccaucugcggguuuuguuucccuuuuccuugguauaaaugaagugcagcagauuaacuuggaaaaccagggaggaggaaacccuacacugaauuucguggaguagcuccuccaccagagcaugagcaggacagaggucauuuggggacuauucugcacuuuuaaaauuuugucauugggaugcuuaucccucugguaggaaccucucaacuccauccuucuuccuccuucuucuuucuccuucuccuccuucucuuccuccuccucuucuucuuccuccuucuuccaggagcuacagucagugccacaguugagaaagauauaauaugugacuaauccaaucuugucacuuuuauucugaacuucaacuguuauugcacuaguuuuuuuuguuuuuugguuuguuuguuuguuuguuuuaaagcaacucuuuucuggccuaaaaaguaaaauauggaaucagaaauuaaguauuaguuuucagucaaacuacuacauucucccccuagauccuaauuuuuaaaaugaaauaacauuuuccauucugcaauaaguaacuaacaaauaaaaagaguuggagagaaaaugaacaauaguauuuaacauaaaauaaugacguaacaauauugucuucuauaguguucauuuuuaucucacuguuucacugguaucugucuuugacaaucuccacagaugguucgcaagcaccagcuagaccccccaaaccacgaccccgaaggacugcaccagaaauucaucacagaaagccccaugggcccgaagcggcguuggaaaaugucgaugcaaaaauugcaaaacucaugggagagggguaugccuuugaagaggugaagagagccuuagagauugcccagaauaacguggaaguggccaggagcauacuucgagaauuugccuuccccccuccugucuccccacgucugaaucuauagcagccagaacugcagacaccaaagggcaguuaacaaauauuccaggaguaugagacagaaggacugagagggaaugcaggagccacggugucuuuccguguggcuuccccagaaggcagccuggaguccagcuucucugguuccacagcucucuuaggaugcccacacugaagcuucuguguuugugcuagccauacuuugaaaucaggguugaacugauaaaauaauuuaaagacguuuacucccccuugaacuuugaaucugugaaaugcuuuuccuuguuuacacguuggcagaauugcaguuugucucuguuuuugaucccuguacuguguuccugacaggcccuuugcagaguugcucaggucugcuguaaguuucuccaugccugcccuggugcccacaucagaggcuaaaccaucucuuuguuuugcucucuauccgggccccaccucauguccccagccagguccaauuccauuucucccauucacacggcacgcuagucugaagguccugauuuuucaguguuucaaacuaaugcagaaagaaaaaggaaaauguguguggucuugucuucacuacugagucuuuucuuugggaaccaucacuguugagaggugggggaaaaccugaauguaaaaagcauuuauuugucaauaaacugccuuuuguaagggguuuuuauauacuauaaaagagcuucucuuguuaguuuaaguucugugaccuuuagguucccgaacucucccucucauccacccaggagugucauaaugcuguaaaagugacugcugcagaugcagggaaaacaggcuugcaggagacugcuuguacuccaguaccauaaugagaugcccugauauuaaugccugcaucacuuucaggagagauggaaaaggggaccaccgccuggaaauauguuaauaugccuuuagauaaggucauggacauacaugccuuucccaaguggaauagagcccauuuucuauuuuaugaugucacccuggcuccucacagugugggagcccccuaaggcacugacgacuguuauguaucacugcaacugcaggccuuguaaguugcaaaacucuuaguacccuuucuccacucaugguaggaguccuguuuacucuguggguuuuguuguugacugcucuguguugcccccauccaggcagaugaaacugugguuacuucuaaucuauggauaucuuuugaccaucuguaaugugcguugcacucuugugggcuuugaaagcacaaacucucacacauggacuccaucauauuauuuguguagaugcguuuggugguaaaugucuccagucugauggaugaagcuuccaagauugguguaaggacuuuagaccucuguggcaauuucagguuuuuggguuggguuggguuagguuggguugggguuuuuguuucuuugguuuuuuguuuuuguuuuguuuuguaucccuaauaguggggggaaaagaauaaaaacuaucucugugcaagaaugcuugaaccacauuuugauaguuucuaaacauugauuuuaggcuuguguggauguuucuuaccacucguuacuccacaccuagucucacauacagagaugccucggauaaucacuuauccugacaaaugacaagauaguaaguacaucagacagauccgauggagcugccauuguacaagacucauggacaaagcuguguuuguccaggaagggaacccagcacauucuuuuacaguuuggcuuuuauggaaugagacaggauuugaggacucuuagucugcauauuuuagguuuguuuggauggucuuauguugcuucugcuaccagagguguauuuuuuuuuuuaauguuuucauauccuauaccugggaggagguaugaauacaaguuuuuuuuuauacuuucuacaauuggcuauuuguuguuuucuuaucugcucuuacuuucuguacuuguuuuauaaguucugaugucauacugauacagugcugugucuguugggcuucauguagcuugccagcaaucagcauagccuaauaccuagaguugccccuuuguuguccuuacacuguuaaaacauccuuaaaggaggaggggguagguuuacaagaggaacccugggacccacagcauauucaccuccacucucagaaaguacaagagauuuuccuccagaauuuaaaagcuaaggaugugcugacacaguuuuuuggaaccugaaguuucggcaggguagggaaguguaaauaauuuucuggauuguaccaagaucccuacugcagccacucaguagccacuguugguuuucucaucaaggaaagugaaucuuaggagucauauguaagacaaagcaaagagaaaaugggaaaacucacaaaauuuauuugaaaaaaaaauguugaaauuauuuuucauuuugaaagggacuacuaguuaauaguugcuaacuaacacaauguuccacacuuuguucccucugauccagaaauugaggugcccccccaugcucaagaucugauaauagaauuacccucaauccaauaucuuauauagucugcacaauuaaaacaaaccauggcuaauuguaaccccuaccugggauccaucuccaaugauauuccagucauuguuuuucuagaaauggggaguuauuuuuuuccuuuuccuuuuauccuccccaccccccacccugcaccugacuucuugguaucugauauauaucacagccaaauuuucuggacacaaauacuggcauuuugaugcuuaacuuaucauggucccacaauuccaguagauagcccuuuuccacguucucccucccuacaguacaacagagcccuggcuacaaccuucagaagucuguuugcuaacucaguauuucacacacccaggacacaugcagagcucuucauaaugugaacuuccuaauuguucaguuccagaagcauuuccugcaguuugaacgugacuuugccucucggauuuucaacuugaagccuuaguuugcacugaauugucucaucugguuuuaaaaugucucaaauggacugauuuggaaucaaaaugugguauauuuuaaauauugaugcagguacuuucuguaagccugaaauguugagcuucgaaggagacuuucuggaaaaagacagcaauagaaaguuuucuucucaguuccuauuuuuauuguuuugaaaugcaguuuuuacgacuugucuaauguggcaaaauagcuauguguucaauuaauuuauauuuuauucuuuuuucauuucuggauauguaacaaaccucaaguacuuuaucuguucuuuuaagguauuuuauaaaaugaauguuaacaa

SEQ ID NO: 12230 - RNA, 27024 nt, Mus musculus
cugucgcuaggcucgucgggugcgugcgauuggccagcucugcgcagccugcagcucggcgaggcucggcggacggcggcggagcggacgggguuuggaagccuccucugcgacaccgagugagcccgcagcggccgggucagcugagguggacggccucggcaagcgggguauguccgccggagugaggcgcgcguggcgacucaaggaggaggucgggggaaccgggagggccgcagggcuucuggaaccucccagcgccgggugggaggguggggcuggggaccgugggaaggggcugggagggagggcgcagggcccgggugaggcggacgagcggcccggcaugggggaggggcggcugggagggagggagggagggggaggagagggcgcccggcccggccugaccuggagggcguuuggccccgcugauaccccaaguccuguucccuccggccccagagaguagaggggagccuggggguaccucuuacggaggucgagaaccagggaucgaagaagccuggggcguuugcucggugcuucacccucuagagcaacuuggaagguggagggugaaucauggaagacauagaaagggggcuugagaaagcccaaagcguuugugccugauccccgggaguggcuuggacguuggagcguagaccuggaguuaaucgguagauugaggacacagaaaggagccccauucggucguacacucccgugcuuaguguccucuuggggcccuacccaguuuuacugauuacaguugccaacuuuuguuaaguugccgucucugggcacgguagggagaauuguagauagguaaucucaaagauucuaccaaaguagcuuguuaggcucccuucgcaugugcagaaaguacgccgcagagaagaacuugagcucacauagcuaccagugaaaaugguuacauucuugccauauacacugcgugucauacagauuuugagacccacuuacaguuuuagaauaaucaagguucuuuaaagaaagaaaagaaaagagagaaagaaaaaauagagaagaaaaaggagccaguuggugguggugcacucaggagucagaggcagguggauuucugaguucggggccagccuggucuacagaacagccaaggcuacccagagaaauccugucuuggggaggcggggacaagaaaagaaagaagggaaaaagaaacuuguuuagagggugggcguuuuagaagcuucugaaagagggccucuucucagguuaagcaacaggugccugaggcugagguauccuagugcaggggcuauguccuuggacacaucaguguaucccaguuaccaggaauuucuuggaugaagguuaaguuccagguugagucacuucuggacuuaggaaguaguaagacagcaacgagaugcaucagaaaaugcauagugaucuuaacaguaguucuaggaacucauucauguuaaucucuaccugcuuagagaaaggcaggaccagaguugacagcuguguggacgagguuuucucuugggacaggaaauaacgguggugccugacauugcuacacaaauggacaacuuuuagcuaagacugcagggaggaaacuagaaaugaaacugggccacccaugguagauguuaaggauauguaauguuagcuuuuagguccacuggagcugagugcuucccaguuccaucagagggcauauuaauuaccaaguacauuugugcuggaacuuggucuuacuugggaguguaucuugauaugaggugccccuucuggccagguaaagaagguacugugagaugguucuaugguucaggaacugagaguguucagcuuucuaagcaccgguccuuagucuauauugcugacuuauauggccuauagauagaaggcaguaaaugcagauuuauuguaagaucuucauuccugucagacuaucaaugaaaguaugagauaguuacuaucuuucuaaacuuaauauguuuuagagccugggguagaguagauguuauguaaauguuuucuaaagguggagaacaaauugggccaacaauguaagaguugguucuauagaggugucacgucaucacagccauuagaagucaccugugagacugaucaaacaaaacccaacagugcucuuuacauuaagauaacuguggcauccagauuguggaacauuguuccacuuuguucuucugcuuugaccuuguagugaagggcuguuuucauuugagggauaguuagacgcaaagacuagauagagcguuuaugugaggacuacugggagguuuauauuuaauauucaugauauaagcuaggacucaugaaaaacaauucaagaugaauaguuuggugauuuggugagggauuuuccacauuaaaggggcgggggugaaaauggagguucaguaaguuuuagggaaggagacagaaagcuggcaauagugaaaguucaggaaugaaagcagaguagccugugggagguucaggacagcuuaaauggugcucuuggucauuuacuuggaacagguaaaaagaguaggaacauucugugucuauagauaagcauguuaaggaauuacuuggccuugcagaaaaacaaauauuaacccauuacuugauccuaaauaugcacuuuuauaguaguaauuugaauuacuaaaagucuuaagguucagaauuaggauuauaaauucauaggacaaucauauugaauaaccugaaaugagauaauaauaagaaaaacccaugaggggaaaauucuguagcaagccaguaucaaauagcuacuuuuaccauuuaaaaaaauacauuuuuuuaacgugguaccaaguauuuauggaacccaaagccuuaugcauacuaagcaagcacuguaccacagaucaauguccuuuuuuagagucugguagccuggacugaucgaucgaucaauuauuuauuuauuuauuuaugguuuuccuaggcaggguuucucugugcagcccuggcuguccuggaacucacuuuguagacuaggcuggccuugaacucagaaauccaccugccucuuccucucaagugcugagauuaaaggugugcgccaccacggcccggugccuggacugaucuugaacuuuguaguugaggcuggccugaguuccugauccuguccauccuauacuuaguucucuucuuuuuaaaauaaagaaugcauggcuggggagauagauggccaagcuauuagcagcaguacuacuuuugaagaggacccgaguucaguuuucaaaucagaggucucacaaccacccaugguuccagcuccugaugauccaacucuggccuccuggggcaccugcacacagaaauaaaauaaaucuuaaaaaaauaauaggagaauacagucuaaucauacacacccauuuugauuggagguaauguggguugacagguuaauggaguuguguugcuugaucauggauaguuguucaaaagcccaggagaauacuacucauuugcccuuuuucuuugaguuuccaaaauaggaaauuagaaaaaauacucuugagauuuuauuuaggaaaauauagguucuaauuucauguucauacaugcuuccucucccagguuaacauuagaguugcaaguuaauaauuuuguagccauuguccauuugaauaacuacuauguacaaggcuucuucugcaaucuagaaagauaacaaaagcacagcuuuaaaaagucacauaguguuuagggcuuugaagaaaaauaaagcagggagagaagacagugaugaggugcauuuuaaguuagauuguuagggaaaccucuagaagauacauaauuagcaaucugguuccagugaggggugugaaagacuugaaggcaaaggacagaguaaacacaaagccuucaguugggaggugaucuaaaacugguauagcaggugcgaguaaggcagagaaguagaaaaugccggagguugggucauuuguacguuuuucuaugggaauucauuggaagguucuaagcauaaugacauuagauuuuacuuaagaacaaacgucugguuuguugauucagugaaaguggguggagguaauaagcagaucauuugagacauuuugaaauaaagcagacaaaguagggaauugguuucaauauugguacugaagaugccaaauuggauggauuaccagaacacuuuaaaggugguggugacaccagguuugcugacacuuuagaugugaggugugagaagagggaagcaaggccuucuugaagaguugccacuaacagaugugaaagccuuaggagaggcaacuuugggguagaagucaggaauuuauuuuuagacagaugguauugucagcuaacuaguuaaaauaauauaauacauaaaauagaaauuacauuaguaauaaaacacuucccagaccauuuaugugucaaugagaggcacuauuuuuaaggggcacaauuucuuaacauucuaauaguucugcuuugaucaguuuuuuuccccuagaguuguauauauagagcauccuggacuccacaaugaacggacaguuggaccuaagugggaagcugauuaucaaagcucaacuuggggaagauauccgacgaauucccauucauaaugaagacauuacuuacgaugaauuagugcuaaugaugcagcgaguauucagaggaaagcuucugaguaaugaugaaguuacaauaaaguauaaggaugaagguaagcuuuuaagguauuaaguacuauacauguucuuucacccauucccccaccccccaguagacuaauucuccauuuccccuagccauuuuauuuuaccuacuauuuguauaguucauacaauuccuuuguauguuaaaaauguaauugauuaguagaagggagugucugacauuuucacauguguuuuucaaauacuuuucuucugcucagauuuccacauguauguucagauuugaaagggauucugauacuauauugaauggaaaaggaauuucuuuaccaacugugauguuuguauaugcuuggcccagggagugucauuauuaggagauguggccuuguuggaauaggugugucacugugggcaugggcuuaagacccucacccuagcugccuggaagucagcuccuccugcaccaugccugccuagugcugccauguuccuaccuugaugauaauggaauaaccucugaaccuguaagccagucccaauucuuauaagaauugccuuggucaugguaucuguucacagcagucaaacccuaaggcagaaguugguaccagggacugggguauucuugugauaggccugaccaugcaucuguuuggaaaaauguggauugggggacuuuggauuuggaaagcaguagaaugcuuuaaguggggcuuaaugggccauccugguaggaauauggaagacuuuguugcugagggugauuugaacuguggaagccugguaguagaaguuuuagaggagaauuuuaauacaugaaccagagacuauuuucuugauauuuuggugaagaauguggcugcuuuuugccguuaucugaagaguauacccaaggccaagguagggagauuuauauuaauugcauugacaaaggaagucucaaaaaagcccaagagagacuuuguucucugguuaagucucaugaagagcauuuugaacaagaguagcaagcuuagaaaggaaaaauagaaaacauaugguucagguauuaaagggguaccaagaagugaaaugaagcuaaguacuauuuucaaggguauuaaauugaauuaagggaguagugaucuuggggcaagaucgcacccagauaaguuaagauccaggcaugguagcacaagccuuuaaucccaggagccuaagacaaacagaucucuugaguucaauuccagccuagaacaaagcaaguucuaggugaagagaaacuuaaauccaggcuugguggaccacaccuuuaaucccaauguuuagaagacacacauguagaucucuugaguucauagucaguuuauggagcaaauuccaggacagccaagcuuaggcagugaaggaguuggaaaacaaagcuagugauaauguaauagagcaagggagccauauucuagcuccagcagcagcagaacucggcagcuucagccuuguggcucugagggaggacuuuagaguccagaauagaaggcauuacugggacaauugauucugguuagguagagcuaagaaauuaguggugauuaagaagagaccagcaucacugaggugaaaucuucuggggaguguuuucugagagcacaaagaagcuguguuccagagauagccaagguuguaacuccugcagcagcuguacuugguauuguguaagagucacccgcuuuuugaagcaugaaguggucauggagagcagcuaagcucagcauugugagaggccauggaaggccauugguaaaggugcagccucaguugcaguugauggccuaggacugaaggagucaugaaaaggauuugaggcuuggcaguuggugaagccuaguugccccagaagaauccaguguauuggagaugccaguaccaugggaugcucaccaagagcagcagcagcaguggaguggggucaaccugagcuuagagugcuacagaggacagagcuggagaaccgauaccagcccuuuggaggagcccagaaugucauguguggaucccagacauugaaacaagaaccuguaauacugaaguugccuuggauaccccaugauuuuccauaugccagagccauagaauaccugcugaggaaugcugcuagcagggagugaaaccacccuaggagaaggaaguuuguuguagucaacaaaguuaaaaaaggaguuggagaucugaagaccaccuuugauaucaggcauggagauguaguuuggacuuuguccagcugguuuccugucuugauuuaaggauuacaguuaagugauuggaugaaucgcagaagagaccuugaacuuuggacuguuaacacuguugagagugcuauagacuauguggacuuuggaaguuggacgaaauguauuuugcauuaugguauggguagguauggccuccauagauucacguguuugaacaagcucaugggggcuagggaguggaaugugauguauaugcuuagcucaggagguugcucuauuagguguggccuuguuagaauaggugugucauuguaggcauggacugaagacccucacccuagcugccuggaaaucaguauuauguuagcagccuucagaugaagauguagaacucucagcuccuccuguaucaugccugccuggaugcugccauguuccugccuugaugauaauagaaugaaccucugaaccuguaagccagccccuuauaagaguugccuuggucauguugucuguucacagcaguaaaacccuaagacaccaaccaaauacaggaaagcuggcuuaaacaaaggcagaugucucucuguaucucuuuauucuuuuuuucuucuuccuuuggcagguucuuacuauguaguccaauacugacauggaacuugagguuaacuacaccuggccagaugucuuuauugcaggaguuauugguguucauuauguuaauauacauugucaauuuauaauaugcaaugcucuugggcucauuuguccacaacuauuuuuuauggagauauauuuugcuuaacaaauauuucaccaaacauagaauuacaguugcauuuccugauuuuauuacugacaacugcuuuucucugagaacugacuuuaaaucaugaugguuguuauuauuauagaaaucuuacauucucaguggcucaacaugcaagaaaaucuagcauccuguggcuuacccugagcguuaacauccagcaugcagaugaauacucugaagagauuuuacuuagcuagguuuugagauguuggauaucuguacauauagcauugcucagagccuggucauguggcuucgcugagcugcagauggaaauuguucaucccuuggcaccuauuuuggacaacuuacacuggugaucagcuaaguuggucaucuacugacauguguaaauucuccuuuucuguugacauacgaucugaaauuagccaaacaaauuuuugagagucacuguguucuuccuauuuccuugagcaaucuuaucuguuuauaaauacauaguuuuaacucuauacuguucagcuguaucccuuaguuaagucaauuucuucucuuuucuugaguuuauaacucaauuuuuaauuuuaaaaaauuuuuauuauucuuuaauccuuuuauacaguccagauuucauccccuucccagucugccuuccaaccgauccucauaccauaccuacccuccuccccgcccccacccccguuuccauucuccaggaagauauccccacucacccccaaccccaccugaccucccaauucccuggggccucaagucucuggaggguuagguauaucacugaaacuaggccaggcaguccucugcuguaugugugucuggggccucauaccagcuacuguaugcuuccuggcuguuggcucagugucugagagaucucagggguccagguuaguugagacugcuggucuuccuaugggggccacccuucuccucagcuucuuccagcuuuuucucaauuccaccaccuggguccccggcuucuguccauuguuuggguacuaguaucugcaucuuacucuuucagcugcuuguugggccucucaaagggcagccaugcuaggcuucugucugcaagcacagcauagcaucaguaacaguaucagggcccugaaccuccccuugagcuggauccaauuugggcuugucacuggaccuccuuucucuuccucuucuccauuuuuguucuuacaguucuuucagacaggagcaauucugggucagagcuuuugacugugggauggcaaccucaucccuccacuugaucuucugucucuccauuggaaguagacucuacaaguucucccucccuauuguagagcacuucauccaagucucucccuuugaguccugagagucucucaccucccaggucucugguacauucuagagggucccuccaccuccuaccuccagaaguugucuguuuccauucuuucugauggcccucagggcuucaguccuguuuuuccuccucuccuccaauaccugaucucauucccuuuuuucccuccccucucccacuuaggucccuccuuuccucaccucccccccccacccccccauugcuuucuucucccucccaagugggauugaggcauccucacuuggguccuuccguuuguugaccucuugaauccuguggguuguguccugaguauucuuuguacuucuuuggcuaauauccacuuauuagugaguacauaccaugcauguccuuuugggucuuaguuaccucacucgggaugauuuuuuuuuucuaguuccauccauuugccagcaaaacucaugauuguauuucuuuauauuucguuccucaguccauucauccauccacccacccuucuuuguuucuaauccaucuauccauccauccauuuuuacugggcuggggaccaaaucuucuaggcaggcacuuuaccagagucacaacucaaaauuuuaaaaaucauuuuaacucaagauacucuauucuugccucacacuuauuagcacaucuuaaaacugaccuuaugacuggcauucucuugucucccuuucauguaggggaagugucagcaaucugugaagugucagaaaauaaauacuguugcuuugcaucucacaguagaauucugucauacaaccgucauuuuugaugaguaaaaaaguaaaagacauaguucauuuuucugcaaaaacaaaagagguucuguugggugugguuuguggcucccacuuuaggguaucuuccuuauugaaaucuguccuccauauccaguuaccacauuguauuuucuuccuuucucccucucuccuucccuccuuuucuucucucccuccuuuucuuuuuuaugguauuuuuuaaaaaaacuguuuaauuuguucagauuguuguuucauagucuguuagcagcuacaugagauggcaacuuauauaacuuuccuacggagauacucguucugugucuuaguuaagguuucuauuccugugcagacaccaugaccacagcaacucuuaaaaaggaaaacauuuuaauuggggcuggcuuacaguucagagguuuaguccauuaucaccacagcaggaaauaugcacaugguggcgugcaggcagacauggugcuauaggaggagcugaaaguucuacaucuugauccucaggcagcagaaggagacuguuccauccugggcauagcuugaucauaugagaccucaaagcuugccccaugguagcacacuuccuccaccaaggccacaacuaauagugcuacucccuaugaaccaauuuuucaaacauauguguauggggagugggggagaacauauuuauucacacuaccacauucuguuacugaugugggauucaaguaaagaaacaagauuaagacugacugcagaaaguuucacuauuuuugcaucaguguguuaauuucuauaaaaugucuuuauuagcagaaucccugagaauugagcauuauuaagcauguaugcuauacauauguaugggccugcuuauacaguucuaaaaacaguuacaaaguaccuagcuaugucuggauuuugacauguuuguuuguuuaaaauaauauggcuuaacaagucuuaaaauugguuuaguuagucucaccccguuuugugagacauaguuaacugugucuucugacugguucccucuaccccauaucauuucuuaacuuugugaauguguuuaaaacauucaguuaguauucuaauuacaauauuuuuauucuuaggauccuaagggaccucagucuucaacaugcauuauuuuuauauauauauuuacagaagaacauguauuaacugaaaaaaauuaggguuucauuuucagcauggucagugaucuaaagauuucaccaugguuuauuaaagcagucccauaaucccuuuugcagcucaugcuacuaauuuaugaaacucuucccucaauuuguguuagugcauucuauuaaaaauaaggauuugaacuaugggaauccuuguuuucaugcuugauacauuuauuuaagcauuauacaauggaaagauuuuucagucuaauauaguaauuugugauauuguuacaucucugaguacuaaaaguuaaugcguaugaaacauuuucaagacaggguuucucuguguaacccuaguagaccaggcuaucuucaacucagagagucacuugccucugccucugcuucugcccucugcuggauuaaagccguguaccaccacacccugcuuaacuuuggcuacauuuucucaugaauguaugauaaauauuuauaagauuaguagauaaaguugauuuaguuguucuaaaaaaaucuuucuucgcugauacuuaugggagauucuaauucucuguaauuuuacauuuuuuaugacaguuuauuacugaugggacucugaauuuauuuuucuuuugaauuucagauggagaucuuauaacaauuuuugauaguucugaccuuuccuuugcaauucaguguaguagaauacugaaacugacauuauuuggugaguggcgaacuuuaaaaugaauuuauuuauuuuuggacugaaaugcuauuagauaugaauuuuuuaauaauaaauguguuuuuauuugcuuuggauuuuuccucuuaauggcucagaguuacauaauaguuuaaaauauuugcguucaggugagacuuugaauuacuugggacuuuaugucuuagaaguguaauucaggcagaauuaaagauuauuuugguuuugagaugaguguaacuuaggaaucucuaguaaguguaguauaguuuuaauuuauaaugucagaauuuuggcuuuguuggguuauuuauguuugggaauauuaaugucuuaaguucuauauuuguuuuguuaccccaaauaguaaugccuuguaugucaaauuuagaauggguucaaacuaccuccgaggucucuaagaacuuauaauuaucuuccucuauaguauguuuuguuuguuuguuuguuuguuuuaaggcuuagcauauaaaagcuacuuuggguauuauuuuucagggaguaaaaacuaacaaugaugggucuuggauauuguuccaggguagccaggguuucugugagggagauaaaaaaggaaguagggaauuuagcaucaacuguguaucuuauuugauuuuuguuacuuuuuaaagguauauauuuuaaugcauuuaaauuccaacauuguaaaaauacuacuggagaauagggagaugauggcccaguuggucgguuugcugcaguacauacaaccugaguucugaucugugaacagcugagcauggggauaugucuguaacuccagcucucaguuggugaaaagcugguucagugaaagcccucauuccaagaguaagguuaaaaaagggguagaggaaacacucagcaucagccuugggccuccgugggagcacucaccugcaugcaugcuccacacacauaaacagguuaaaaugcauggaugaaaguaaacuuagugucuguuauuuuaauggcaucauucccuaaguuuaagcaaauuaaugcuuuuuuuuuaguuaauggccagccaagaccccuugaaucaagucaggugaaauaucuucgucgagaacugguagaacuucgaaauaaagugaaucgcuuauuggauagcuuagaaccaccuggagaaccaggaccuuccaccaguauuccugaaaaugguaaacuggauuuauuuuauuuuauugucaugaauucuuuuuuuucauuuuuguggggagaggauuauuugauugcuucuuggagucaggugucauccuuaauaucuuuauucuccuuguuuaugcuuuuguacaugucaacauuccccaacuauuugucaagauuacuguaaacuugcacuacaguacuuuaauugaaucauagagcucugggaggacagggccuggaaucccauuuugaaguacucucuaggacgggggaauaacucagugguagggugcuugccugacauaugcagcacucuguacucaguccccguacugaauaauaaguaaaugugcagauggcugcauaaggagugcuuuugugaugauuucuuuaguuugucucagucuguacaguaggccaguuuucaaacacuuuugauucacggauuguuauuagugugauaauuaaugaaucuuagaaaucgauuuucuguaguaaaaacuauguuucaaauguaaaauacuuuuagauuaguacuauaaguauuauauuaaaguuuauuuuaacacaauuuuuaauaauaugaaacucuuuuugcauuuacuggugacauguaguauuuauaaauaguaaagauaauuuaaggcuuacugacauauuggaagcugauauaguuuaggcaccaaaauguauuuuaaaauauggacagaaauuaaaagcauaugucauagguugaaaguguguguguguguaucuguguguguguguuuaaaaaacaacuauucaacuuuuguuuaauauucuuaacuuucagguaaaaugauuuuguaacuggcugcucauaauuuucaaaugcuuaaaacuauacaaguuuuaaauguuuaaaauacaaacuggcaacuuuuuuaagagucaagcuagcuacauguaagugccaugagaauuucuguggaaaaaugucauguauaacuucuugaaagccuuagacucaaauacucuaguuuuugcuccuacauaguuuaagaaguuggcucuuauuuuuuuuucuuccuccccauucccuccauuccuacgugcuuguuuguguccucaaucucugccuuugaguaucagacucaggguguuacaugugcuacugaguuguagacacuuuuuaaaaauaugguuagguuuuaaauagaacuauuuucuaucauuucuuucaugcccuuuagccauuuggaauuauguugaugauaaaagcuaaauaaauauuuucugaugaauuaguaauuuuagucuuaccucuauuucagauuaugguaaaauuuacugaaauacuuuaugaucuuagacacuuuauaaugaagacuuauuuauauguuacagaugaaagcagcuugcuuauucugaaccuugcccuuguuuguuuuguguccauacuugcauauggguggauguccauacaagggcagcauggagcucagaagacacccuucauucuucaugugccuuccaccuaguguuuaggacagggucucuaaauggccuggaaccuccccaaguagaggcuagucuagcuuuguuucugccuuccaucuugcuauugcuggaacuacaggaugguauuaccuagccagcuuuuuuugugaauucuggagguuuagaaaucagguccucuugaauacaaagcaagucaugaccaugaugucuuuucaagcaauagaacaaguaacuaagacacaaggacacaguacaaaugcaucuuaugaaaguagcccuaacacuaaaaaauccacguuuacuuuaagaauuaccuuaggucagaucaugccuguuuauacuuuguugccuuguauauuauuugaagcaaauucuaaauauauuuuuucuacaaguauuuuaauaacuaauaaguaguacauauuuaaaagaggagcagaauuguguuauuuuacugaugauuaggaauucuggcugccuuggcuuauuaauagaggaauagacaaaacauaagaguugaguuccuaaauuuagacaagauuuauguuguuuuacaaaauaaaacauucauuacuauaacuguuucuugggcauuuuaccuguauuuguaggucauugggguaugggcuggauaaauagcucaguugaugaagcacuugauguagggucuguguuaaguuuccagaacccaugugaaaaaaugucugguaugaugguguguguuuguaauucuagcacuguagagaugggaacagguagugaccuggggcuaucacuggccagccagugguagaccauguagccugcuggguaagcuccaggccuuugagagacccucucagaaagcauacagggcagcuuuugagaaaugucacuggaaauugucuucugaucucuauguacacaggugaacacacgcaaacauaugcacaccugaaugagcuaggguucaugcugugcugaaacaccaucaccaaaagcaacuugaggaaaggguuuauuaaaaggcuuacauauccugaaucauaguccacugauauaauccaaggcaggagcucaaacgaggcaagacucuggaagcaagagcugauguagauggcaaggaggagugcugcucgagguuacugcuuaugguugccuggccugcuuguauuacccaggaccaccagccuaggggugccccacccacacaaaucacuaauuaaagaaagugccuuagaggcuugccuacagccugaucuuaggaaggcaguuucucaauugacuguagcuuguaucaaguuuacagaaaaacuagucagcucaaggcacuauaagaggaacguguaaaauguuuguguuuauuaaggagauuauuaaauaauaauaaugauaauaaugguuuacuuucuccuuuuuuuguuuucuuuugcuuuugagauaguguugcucuauagcucauguuggccuagaacuuuugauccucuuguuguagccuuuuguuugccaggauuauuggcacucaguuuaauccaguaauucuaaaaggggcagugacuguuagagacaauaauuauuuuggaaaacuguucuuuaucuuuuacucauuuucccugaagcaugaacacaguucuauauucacaaaguccugacaguauuuauacacauguauauauauauauauauuuuuaaugugguuuuggguauagauaaaguaaacuugucuauucuuuauuauagauacuguggauggcagggaagagaagccugccgcuucugacucuucugggaaacagucaacucagguuauggcagcaaguaugucagcuuuugauccucugaaaaaccaagaugaaaucaacaaaaacgucaugucagcauuuggauuaacagaugaccagguuucagguaagucgguuccuuuuucccucucaucuuuaucuuucccuuuuuugacuauggugaaauacuaugucuuaaggguucagccaguuauuuuuuuacauauuuaagcuucuauaaaacaagaaaauucaugauuucagcaccccaaaggagauuuguuuggccuuuagcaugcuuuucuaccuuaaaggaaccacuguuuugcuucagguaaauuuuauuaaaagaaguauuuucagauuauuuuuuuuaaagcagaacuuuuauuuuaaaaaaaaaguccagauuuuuuuuuuauuuuguaaauugcauuugauacaucuugcuaucucuucuaaucuuaggaaauuuaaaauuaagcagauuucugauuaauugcuuuuauaugaauaagguuuuagcuguaaagcuuuaaauuuuuugaauugugauuuauucuuuucucuuauuuuugaccuaucauuuugucagcguuguaccuguuuuucuugguggggacggagaggauccuaaucacacacauguuguagagugcuucauguuuuuacuggcugcuuuccaguauuacaauaugugucuuauuuucuuguuucuauccaucuugcagguuuucauuguaaagugagcauuuucauuaguguaucuugcugacuuguaauuuuuuauuuuuauuuuuuuguucuugcgcuuccagcagguucuuagucuguguggacguaaauuaccagagagaguaguagcugguaucugugggcugguuuguuguuguuguuguuguuuuguuguuuuguuuauguuuuuauuuucagcaguagaugcugcaucuuccuccucuuuccuccuuccuuuuuuauuuauuuauguuuuuuuuuuuuuugguucugagaccucuuggauuuauccccauuccauaaacagauaaguggcuaaggauuugguuagaguuuauaauuauucuagugcaaguaacuaggccuucacugacagggagcuucauccuucauuuccagcuccuugucuaaccaugaaauuguuaccaugaugguugucuugaaauucuuaguucacugugucuacagggguaaacucccuuuggaguugagauuugauuuacuaguagcuauuuuaaauaauuguuuucuucuacuuuguucaagcuuuugcuacuuggggaaggguuugccugaaccauuuacuuugccaauuuuagcaguuuaaaauagagaauuuauuugauuuauucauuuugauuuucuuggaaacuuuugugggauuauuuacugaagagaauuauguuagauuuugagaaaauauuugaauauauuaccuuuucauguggauauguuuacuuaguugucuucacauagauaacaaccagaguauauauuuuuuuaauucuaaaggugugauaugguuaaggugggaaauagcuaccacaguaauguagagugaagagaaugaagucuuagaaaaacagaauagacaacaguaauaagcuacauauaagggagaaaagaagagccaagcacugaguauuuuuaggauuaauaguacaguaucuucucuugggaaacugugugcguuaguacaaguaaaguuguaagccagucagucauguauuuuaaccugguggucaacauuccuauuaccauaaccuagcauagcuucucauuaguacuugacuguuaauggacaagccguaagccuaaaaugaugguauaucaacuuugucuugcagugacaaaaugcuugagaaaaaauaacuuaggguaguggucucaaggcugugggguagcucuuuuggagguugcauaucagagauccugcauaucagaaauuuauauuaugauucguaacuagcaagauuacaguuaugagaaugaaauaauucuaugguugagggucaccacagcaugaggaacuuuauuaaagggucucagcauuagggagguugagaaccacugacuuaagguaaauuucaggucaugauccacuggcuccauuagcuugggccugaaacaaggcaaacaccuuaggggcuugaguauguguaagagaaggcuauuuauuuacucugugguggucagaaggcaaauaaacaaggaagugaaaggggcuaccgacaagaugcauucauaaaguacaugcucucaagagcccacuccucuuucuuccucucaccuucugguagcccaccagcuaucaguucauuggugggauagcccaguuacgauguccaagcacucguuucaaacacuucuugucagcuuuaguacuugggcuuuggugaugcuuucgauuuaaaccaugauaaguucugauggcaugccacuggaacaguuagagacugcuuucaaggagagccugcuaauaauagugguugaauuaagcuuucuaagugguaauugccuuuagaagauuuugcuguaagcuuuguuuaacucauaacccuucaaaguaaacuugaggucagaauuggugugcccuuugcauaaguggagaagcuguggcacagaaggauucaguagcaugcccaaagucagcagccacuguuagcucgggcagugcaaucuaauaauuagcuccaggaacucuucacaucacccuucuguguugcuagcguaacuuaaagccguaagccaugugucaucuucagaguccacuuucacaguauuagacguauacagaaaaucuagaaucucuguacuugcuucuauguuuuucuuauccugacagaguuggauugaguauggguguuuagaacuagaguccugggccuaucaggaaagaacaagaguauggccaaaguucucacagucuuaaggaaaaucaaaguggggccucuguagacauuuauacaacguagcaaucaguguggcuuauuuaaaaaguaagccauagauaaauucacuaaggaauaaagcauuuauaauucaaagauuuauuagaauuauaacuagguuuuaaagaaggccauuuaaguaugugacuguugcaguuaaucauagagagugaagaaauuaugauaaaugaaguagaggccaaaaaauaauuagacauccuaugaaacuaugaaguggaucauuuuaacuaaaagagaacaugugagaaguuuggaucucugaacacaaccagggagauuaaauugaguuuacagacauuagagaccugguuaauaaagcagcacugguuuugguugacuguagauaggaguuuugauuuuugaccuggggagguuaggacucaggaauuuagcauuucacacauuuguagggaagcauuucuaauuuugacuuuggauccuaaagacuggagcaaaugucaaaauacggagcacauaagcuuaguguguccucggugacauggcuguuucauagugauuuuauuucgauugucaauaaccugaacuuuaaauugugcuuguuaaggaaagaccuugggaagaguaauuaacugacuuuucacgaccacccaggcccacccagugccccuacagaagaccgcuccggaacaccugacagcauugcuucuuccuccucagcagcacacccagcaguucagccgcagcaaccucccuaugcaggagcucagacacaagcaggucagauugaagguaaaacagcguucagagccguguguggaagggcaugugcacaaguguuuauugaggcaucaguaguccauuuaccuaaguagucucacucuuuacacagauggaaaauagucuaucuuacugacauggugugauuuaguauuguggaaccaaauaauauacugaguauguuucugauuauugaaaagaagaaaaggggaugaaaaauguuuuaaguuaauauaaacacaaagugaaagacuggggagaaauuacuuuauaaucuccauuccaaacacuacauuuuucugucacuuaaaaagaauuuauaucaagaugaugauacauaauuuuagguaaagaauguagauuuggaucaauucauuugagguggguuuuuuuuaucccucuugaaauuaggugucuucaguaaguaauuuaauaucugaguuuugauauuuuuuucacugauuuaaaaaauaauacgaaaauuggacuaaaucaguaguuuuaaaaaauaacucuugccaggcagugguggcacaggccuuuaaucccagcacuugggaggcagaggcagacgcauuucugaguuuggggucagccugaucuacagagaaaccaugucucaaaaaaauccccccaaaaaaacccaaaaaaaaccaaaacccaaacaaacaaaaccaccucauuaauccugaaugaaauugaaagcucaguauuuaaaagggcuauuuggcacagaugacaucagagcgugacuaaagaccacacugaucucuagggcaacccuuaacauggcucccuccacccccaaguuaacugcuuauacauguuaggaccuuuuaaaagaaacaccagauggugcucuaaacagucuguaccaacggguugaucacaaucauaauaaauaaguccacaguaccuaaagcaacauuuacauuaaaacaaaaacaaacuagagcuuuaggcuaaaaugaucugugacuagaaucuucuuguccugugaugacacuugcaugcuugcucagugaauucauaugagucacuggggacuaucagguggcaucuuaucuuaggguauguauucuuguguuaagucuuuucuccaccaacuugagucagucuacuccgcaucaaaaauacaagagccggagcuaaaacaaacuaaaacugaugcagacauugguucaaaugggaggcuaaagcagaauacagaguuuggguggacaaagauuccaauagccaugucaggugaacuaaaagcuauuguagcacugauguacauucuuauuuagaaggagaauuguacaaaauaaggucaguggcaggaaugagagcaaaauuucacuuaucuuuugagagcuuuuuuaaauugcaaaaugaucaaaucuguuaauaauaguuucuauagugaaaauggucuuccaucuguguucuagcaaccgugcaccucuuuccagcagcuucacauuacuacuacugaugcauucucuuugcagugguauuaauuauaugccuuacuacaguuauuucuuauauuuacggauaaucagccaaguaugucuauauaaauauauaagcaucgauuuagaaagagguugguggauuuugcuauuauuauuggauuuuauauauuagaaaugagacagugauuuggaacacuuuaaacaccauacguuaugucccaguuugaacuagcucuaguucaguagcucaguuguauaauauguauaauauauagcuggagauagugauguaggauaagcugcuuuagugaauaucucuugauauauaauauauacauuguagacacugccaguuauuuagauugacuucugauuauauuuugagcaaaguuaucaacaaaguaugacuuaauuguuuaacaucucuuacgaaauuaauaauuugaaauaaaauuaagaauuucaaguuauuaauugaauaccauauuuucccccgaaguauguuuugcuacugauuguaauucaaauaucuucuuugguuggaaggcucaggcaagcauauaccuaagcuuaugugaggccuuagcuuuaauuuugaaaagugaaaaaacgagagaccagccaaucucuguguauaugaguucaacugggucugcucuauaaaguuaguuccaccuagccagggcuucacagugagucucaaaaauaaguaaauaauaaaauaaaaacugucugagaaauguuauucaauaacuuugacccugugugaacaacaucaagcaaugguucucuacuuuccuaaugcugugaccuuuaguacaguuccuuguguuguagugaccccaacuguaauauucuuguugcuucuacuucauaacuauacguuuuacuguuacaaauuguaauguaaguaucuggguuuucugauuaucuuuugggagacacagcccacagcuugaaaaccacugucauagagcauguuuauauaaacugagguggcuccaacaucacuagguuauuacacagugagugaccagguugaaagucauuuuaaaaaaaagaaauacaauguuacucuaaagucagugucucucuuccucuguauaauucgauaguugcuaaaauccaaaugacuuguaaugagaaacgugcuaugaaucgucagagagguauugcuaauuuauaaggacacauguuugucccuuuucucugauuacuuaccugauggcauauagcauggacaauguacuucauagaauuuauaaagugguagccacuggaguuacaucauaaaaacacuugcugccagcuaauaugcuuggcaguuuuaucuguagccgagcaagcaaucaccuuuaaguuauucauucuucucuucauagacauuuaaauaauacaaaaauuauaauuauuauucaaugugcuugcauauuaaauugggagggaauauaaagguacccuaaaaguauuucucugccaaguuauuaagccuuucuccuuugccuguauuuucuuucguaggucagauguaccagcaguaccagcagcaggcuggcuacagugcccagcagccucaggccccuccucagcaguaugguguucaguacucaggugaggagggguugaaagacaguuaacuuuccguucuucuuccugaguacuugaucuguaauguucacacugucggaaguguuacuuaugagggcaagcaguacuuaguuauguuuuaucaaaucagcauuuucuauuuuuagugagcaaauucaacguaauuauagagaugauucuacaguaaucuacaguauaaauuguuuuacuacaaagcuaucucuuacauuaacaaucuaaccucuuaggugacuucaaauugagaaaaaaauuauaagauuuucuucuauuuguaucacucauauuucuagaguacucuuaguauuuguagguauaucaacaauuuccccacacaugcagaagcgaauuuaauaaaaacuaaguuguuuuauuuaaggcuguuuaaaauacucuagaauaccaaaaauaaaacauacaaacaaaauuacaguugaauucaggcaacuaagaguauucaguguuuuaacugugcugacgugaaguggcacaguugaaaacccaggggauuucaacacauagaaaucugcaucgccugaggagguuucuguaggugguccguuccuauacacagaggaguuuguuugaguuuuaccaucucuccacugaagauuaucuauauuuaauaugauaaauuucuuuuguuuuaacugugguuauaauuuagguauuucuucuaguuucaucagagugucucucuaccauguauagucaaagauuaaaauaacuucuauaaauugaauuuuaacaaaauuauauuuugggaguuuuguguuauuaacuaaagaauaggaguauagaucagcaaauugcagauagauagauggcuagcuauagauagacuauagcagauacagcuacaguguaaaucugcuacugccugguuuuguaaaggaagccucacuugcacccuacauguuucucaguugucccuguugcugcugcacuuuggcacugcugagaguagagugaguaguuggaaagugagagaagcaguguagcccacagcaccuaaaauauuuacuaucuggcccuuuaaaugaucuuuuauugguccagacaguugcugauugcuaaccuagacuacaaaauuuugucauuacuaaaguuugguauauuuuuacacaaagaauaauuuuugggguuuuugcuguagagugauuuuauuuuauaguuguuagaucugauugcaaaaaacagaugaauugauuuuaaaggaaaugccauuugaguguguuauucuauuaagcaaaaaaaaaaaaguauaugguacaaauuguauaacauauagacauugcuuggaggugggccuuaggcuuugguauuuuaaaggcaucacagguuacguagccacagugaggaccacugauguuguucuacucuuuuauaaguggcuuuucaagccaugcagauauucagcgaggaggcugaacagaaugguucucuugucuuuauaccguuuuauagucuccaaucuagacuugaguggucaguaucuuaggcuuaguuguagcuauuuauggauuuuaaaaaauaucuauuaccuauuuuguugcaauuuguaauauuuuccaccuaacguuacucauuuuaggaguguuaggaggguguagaaauggagacaaauagaccuaauagagcaguauugcugcuacugaaauggucuuguuagcacguaaaguuuagauuucagguguaggauggaaagauaguuuuauugcuuuccucucaauuggaauagucauuuucaauauaaaaguauucccccaaaacuuaaaguaaaaaguuaacauuugaaaguuuuugucagggcugacaaguuggcucagaaauugcuagcacuugcugucuuccagaguaacugggcucagauuuuagcauccauaaugauggcaguucacagccaucagacauguccaugcccucccucuucugccuuucauggguagcuacacaacacacacacacacaauauuuaaguuuaguauggaagacgggagaaauuaaugacauccaagaucuuauaaauuuauuuuaauucaguauucaggaacuaccaugagugaauuacaacuuaauaccuaagcuuuuucugggaaguuuaagacaggguuuucacagaguaaaauuuagugcuuuucaaauugccucuguauuucugauccugcuaguucuauuuccuugacuucaagagcuauggaaauagauaacuaacuacucugcauggagacuugcugguugguagugacauugaccaaucucucauacuuuugguuugccaguuuucccucugaccuuuuccaguuuuguucauaaagguuucuuucauaaguaaauuuugaacccagguucaaggugaguucagaauauauacucaaauucauucaauccuuuuuuuuuuucuucuaaaugcaggguuguacacauuuuaauaauugucuuauguaucugguauuuaaugcugacaggauuccagucaauggagagguuucauugcaaguagcugcagguguguuucauaguagagauaaaaguuuucagugaagcagauuuuauuuuuuauuauauucuaguaaauaaugaauauagauguugauuaagugggacaauaugauuuguuuuuuguuuuauuaugccaugcuaagucaaaauuugaguuuuaaaggcaaaaguaucagguaccaaauauaaaggauuuaagaacuauaaacauaguagucauuauuccuagauauuauagugaauuaauuuauauaaaacaauguauaugaagaguguuuguagcacuguuucacuuauaaagcacuugucuguaaugggauuucaugugguacuguuaaauaggauuucccuuuaaaccuaauuaaugacuacuuugcuuuuaugauuuucgucuuccuagaaaguguaauuauuucaccuauuugagcauucauucuaggaauuuugugcaaaugggaacuugcucaaggguuauuauuaguuucaaagcaguuguaaugaaaauacaugcuuauagugacuugaauuuuaggcuauagaauuuaaaaagugucuggaaaaauuuuguaacucuuugguuuugagauguuuuaugcuggacucacuacauaauuaugaauauauuuguuaauuuuuuaaucauuuuugguccauagcaauaagacuaagucucuggaaaacuuucaccaaaaaacccaaaacauuuguuauguauuuugcuuuuuucagcuaguuacagccagcagacuggaccccaacaaccucagcaguuccagggauauggccaacaaccaacuucccaggcaccggcuccugccuuuucuggccagccacaacaacugccugcucaaccaccacagcaguaccaggcgagcacuuacccuccacaaacguauacuacccaaccaucucagccugccaacuauacuguucccccuggcucucagccuggaauggcuccaagccaaccuggugcuuaccaaccaagaccagguuuuacgccaucuccugcaaguaccaugaccccuccuucuaguggggcuaacccuuaugcucguaaccguccuccuuuuggucagggguaugcccaaccuggaccugguuaucgauaaggagguucagccacacuaauaauaauggcugauugccucccaaaagacuauacaauacuauuuuguuucaauuuguauuguauugaaguuuaaaaauuuaaaaagcagagcauuuuuuuaugauaucauuguugcuguuaauugaaaauauaauuuaccagaauacagacacaaaaagaccaaaaugaauauuguuuccuccccugcuuaaaauuguagccgcuuccuaguuauuuuggaacacuacucuuacaugcguguaaaaugauuggcuuucuaguuucccagagaauauuaaaaagcuaggcuaagguauagccaucacacuuggcuauuuacuguuaacaugauguacuaaaaauagagcccucugagaagaugacuagacauuauguauaaaauguaacauugauaggcuaauaaaggugauugaauccaac

SEQ ID NO: 12231 - RNA, 224602 nt, Mus musculus
auaggugcuugucaaauuguuuauuugccauucacauggguuugaauauuggaguuacagaaaagaccauaguacaaaggaaagaaaacaucaguagcuuagggcugcccugcccuggcucugcauggcccccaggagaggggucugccucagcgacugugugcagugagcaggugcagugccgugaguaccugcuggccugggcuacugagaaucguucugggacauucucucuuaucuaugugcuuuaagaccugagccugacagugccccuuaggagguguucuuaauguuaguaccaggaaggaaaaggcccgggcacugauuuugggauuccucacgaccacaucuaacacuugccacaugugugggcaguagcuggaggcuggagaacugcauuuucugagguguguuuuuuuuuuuuuuuuuuacccccaauacauguguuuuacugcuauuucaauuuggaaguuuguuuuuuuguuuuuuguuuuccauugaucuuuuuccauccagaguaacagaaauacccaacaguucauuugaagauugauuuuuuuuuuugcacauucauuucuccuagaacauaaggugaacuuaaaaaaaacccauuggaaccaugcuuguuuauuauguuuauaaaagugaguaagaaguagcuugguuuuuuuaaaaucuaaaauaaacaaguuaagagaagcauuuuucuucuacaauauuuagcgaacauaagaaaaaguccuuagaaacacacacaaaaugugaaaaaaguuauuacaggcauuaacaauauuuuauaaugaagcaugaaaucuauuuacauacauaaauacaauugaguuuguggauacaacucuucugaggaaaaaaaagaaaaaacagacaaaugaucagcuuuggcuauaccgaccuggcugaaagagggaaggcauuuccgaccaacagccaaacccaccaaauaaagguguacuguagaguaaacaaaacaguacuuuguucaaauaaggaaaaaauauauucugagauugcugucaaacuauuuauuuucauguaugaaagacccucaacaucucaugccuucuccuacaaagaaaaugagaagaaccaaaaaaaccaaaacaaaacaaaacccaucaaaaccaaaaaaucccuaagaccgaaugucccugggggaaaguuauuucaagaaagaaauuugcaguccucaguugaggccuuucgagagaaacguaugaaagaaaagaggcagaaggagagacaccccuuccggucccagcgugcguuugucugcgcaggacguuugggcagcagcacagcugcucagccaacggguugugauccucaagaguuuuugcugcaguaucuggacagaaagcagacccaaaauggcuggcaacgccucuguucuguuggggaaaaaaacccgugagcaagagaauggcugacucacccuguucuuuaauaaacggagaagaacuggacuuucuguguucuggacacuugguaugggggagaggaugugugugugugugccuuauguguguguguguguguguguguguguguguuugcaggagggaaaagaaaagugagaagggcuauugggaggauauagacggcgagaaaaccagaaggaauggaaaguguguuaaaauuauaaauaggggcuugaauaagcaguaagaauggcuuaucccauuuuucuuucucuggaccaguauucccaacagcuccauuaucucagaauuggcuuaugggucuuccuugaagacagcgaaugaggagaccgcuggaagcacccgaaggcaaugaacacaauuucucagguagagaaauaccugccccguggaaucuaucuccaagacuacaugugccugauggauuuuuuuuucucugagacuaaauacugccuauguugauaaaaguuuaggaagcacuaaauggcucuaacacagugacaagccuucuugaugcauggugcccagggcgaaaauucaaugugugagauuaucugcuccucugagggcuagcguaucuuuagauaucaaaauuaauaugaaaaaauagaaaucucuuuccuucguccuucccuaccguuuucucaggccagauacggcagccuaugguaagaggaacaucuaauguuggagaaacaaacuccuuuugagaaauuaaauuuuuuuuuauuuuucugacaacacagcugucaaaguguucuguggaauaacugaguggagaccggauggaggaggaagguauggcugauaugaagaucuauucugaguuucucugaauccugcuagcgcucuucuccagacaagagcaaccugguaucacagguuaccaaagugcugcugcucuauguaagacaaagaaucaacauauagauauagauauagauaacucaaaaaacaagcuguauuuuuuuuaaauaaguccagccguuuuugcugccugcagccaaagaucuaaucugaaugcuuaaauuuauaaaauaauauuaauaauaauaaaaaaaucaaacacugugcugaaguccugcuuucaaacgcucuucggaguugaccugacaucacuucaacuaauuuaagagguacauuaaaaaacaaaacaacaaaagaaaaauccaaacaaccagaucauuuugagcacauguaugucagaaccagcgguuaggcuucauacguuguagaacaacuggauuuugaccaaguccuccacuguaacaacaguaccauuacauuuacagugacacgaugcacaucugaaccguagccauggcggacugcagagaccaggaucuaucacacugaugcaccccaaaggucaggggcucggccuggugggagaagaugcuggugaaggggcagcuucugaggagcauccugcacaggugggcguggcaucugccucccaugacugauuccacuaagacugggagaaggaaaccggcuccuucagacuuuugggguacacucucuuaaaacucagccuuuaggccucaaagacaccuggucuuaacucuucuauuuggaucuuugggguacagccucaaguuuugguuuucaucaaugaacggguacuauuaauggaaggcaauuuaaaaaucacauucagugguuugggucuauguaaauacuauguaaguaaaccccugaccaacagcuuacuugguugagcucugugauaaagcaugccagaaugaggaggccuuggggcaaguauaucuccaggccaaaaugaaauccucuucagagcaaauccuuggcaccucucugaacccuuucaggacagaguuugccucucuuuuugaagggaaggagccagguaugagacuauuuguugagccuagcagaaaauuuuguacuucugaccuuggagugacccucagugucuacaauccaauuaaaaacauugcugcguuaccuaccaacuuguuugaauaacauaaagggaguuuaauguaaacaauauuucuaguuaaccaagcgaucucuuuuuuuuccagacaucuucaacgcaauaauauuuaacuuuggcuauuauaaagaaaaauguaguacuugauaucuuucuuaauauaaguacauuuaaauaauuaaaaaaguaucaacacauauguaaauguucaaacaucaagauacauaaauaucuagggauuucuuuguggaaauacaguaguuaaaaaaugacccaaagcuguagcugucucuuuaaaaauaaaaacaaaaaccaaacacaaauaaaacccccagcuacaugaaagucuaaaaguuaaauaaaccuuacagagaagggaauuuuauuucuuugaguuggucaaaggaagaaaaaaaagcaagcucaaaucuauacacacuuaaaaauaaaugaccacccagaugcaaacaggcauuuuugcaaucgauaaggugcggaaaagaaaacuccgaaauaagaaauagaugccaaacaggaugggcugcgucuuccccaccccgaaccgaaaacauuccacacucuuuggaauaaacaacgugguuaaaaagugaagucaaggguauaaaaucuuucuuuuauucacagcauugcuaaaucagaagcauucacaguuucccuccgggauucuuccugguggccuccaagggcccuccuggcggggucugugcauggacggcaggcccagucccucgauggcgauggcgcucagcucaguagggccgccacacggccuccuccaggcgcgcggggggcauguuggugggcgaguugcuauggcugcccucggucuccaccacgucgcucuggcuggggaggcugggguugagcagcgcggcgccgguggaugcguuggugcagggcggcaggaugcgcgggggcgaucucucuccgcccaccauggagaacugguaggaaccggccgaggcgccguaguauagaugguaggagggcgagccggucuggaagggcccggccugcgccugugaugagccgggguagggcggcggcagguaggugugguagcgagaggccgagcucauggcugacaugccgaugccgaugcccgacgugacgggcggcgaguaggugaaggcgccuggguagugcaugcgcgggucggagauggacggcagaguagggaacuggcgugggucgccgaaggcggucagguccggagccgcugugggcgggcagaggaagagaaggcaugaguguguggucagggaggcacaggcuuccuagacugccagagugcugcggcucaggacacacaggauugcccagggugccccugcccacgguggguggguggguggggcacagcgagugcuccugcccacggaggggggaucacggagagugccucugacacaaagagugcucccucuccaacacacuggacuugcccagagagugucccugcccauggagagggaccacagagagugcccuugccccgggggcgggggggggggcacagcgagugcuccugcccuaugacaaaggacuaaucagagugcuucugcccauggagggagcgacccagagagugcucccaccccaacacacugacugccaaaagugccccauccauggagggggaaaccggaagugcucccaccuaggacacaggauugcccagacuggcccugcucauggggggggggggcauagagaauaccccugccccaaauacuggacuacccagaguaccccugcccauggaggggggggccacagagagugacccugcccacggggaggggagcacggcaagugcaccugcccuaagacacaggacuacccagagugcuccugcccacggagugggggcacagcaugugauccugcccuaacacacaggacuacccagagugcuucugcccgggggggggggaccacggagagugccucugcccauguagggggcuacacagagagugcuccccccacaacacacugccccugccuguggaaggggggaccgcaaaauugcucccacccaggacacaggacugcucagagugucccagaccaccaagacuguuuccaaccaggucacacaagauugcacagaaugacuaugggugggggauggggguggcacagggagugcuccuacucaggacacagaagagugcccagacuggcccugaccauggaggagggagcacggagagugcacccacccaacagacuggacugcccacagcucccugcccagggaggagggaaccacugagaauauuccugccugagauguacacuuaccuagaagucaacaggacagauaacuacccaagauacugucacuuaagaagaugagauucuaugcagagggcugcugccagggaaugguggguggcggggacuaucuagcaagaagugggcuucccccagcauguuugacaugacagaugucaaacagugugacacagagcaauggcagaugcauugcagggaguggugggcggcauaugguauguauccugacacgccguagcauauguaccauauagguaccugucacacacacuguaguguaaaguuuccaauacacauaaauguuagaucccagguuggcaaacuguagcucauuggcuaagucuggcuggggagaaguuuuauguguucuaggaauuaagaaugaauuuuaccuuuucaaaugguuguaagacuaaaaauaaaaacacacaaaaauuguauuucuacucuguugcgacauagcuucaaccuauagcacaaguuggcaccugugugcacuuucaugggcgcuaaguagcuccuauugcuguugagugaccaggacaacagaguguccaaagcuuaacaacuucucuuugguccuuuacugggggagaaaaaaaagccuauccucuaaugaaagcaucaauacugacugguauauugcuaauauaaucaguacauuggcauaacaauauuaauauaacaauauacaauggcauaacauuaaaauaacugaggucaugcauccacugauauguugauaguagaauauuauauguuaaguauguuauaauaacaauauuaugucauugcacuuaguagucagguuggauaauagaaaacugucauuuuuguagacucugaucccuugaaaguuggcuaauuuccuauuauuaggugcagugcguguugugguagggacgacgugaaugucggugauugacacaucacuugccucugucucugccuucugacuuguucccaucuauaguaaccuuagacauuugacuucaugucucgucuuuaucuaagaccugagucacuguuuucuucuuaaagguaauuuuacuugugauuaugcuugugugguuaugagccugugugugugcagugcccccagaggcuagaagugggugccaacaucccccagagcagugcaugcucuaaaccacugagucauggcuccagcugcugugucacucacuagcuucuaacacaaauggauagcaaaacuuguuuuguccagaaaugacagacuuucuuuacaagauucauuuugaauuuacaguucuacagacugcccuugcuucaccggcucccucugcacuuggcacgugugcaugcugccuuugaggcagaccaggggacaggagggacaggaggguucccuugccaaaagugccacugcuggcaucuuugggcuguauuaugucuagcggguguuuggagacugauaacuguuugguggcaucuuccuucuuuacccacaagaugccucuaguggccucccugccgacccccugcccgcuacuuugacauccaaaagaaucuccagacauugcgaaauaacugagaaugguuaggaagggaugcacauccgcccaccagcugccacagugaguuaggacgguguuucggguagcuugugucugucagucagaggagggcaggcugcgacuauacuguucgcaccagcacggcucagcagcagcaacaacacagggcagaggcacgaacuaaguguucaaaauguuaaauucucaaauucagguacagaguugagccugcuagagagaaacuugaggggaucgaaaagcuuccuuugaaaggaaagcuacccggguggauuaaucuuuuuuuuuuuuuggaaggcaugggcugugaucaacuucuuucuguuccaagccuauuauuucagcacggagagcucgggcuuguguucuuguuucucccucucccccuccacccccucucaauaaucuuuuauugcucuaacacgauuuuacaaaaggaacucuuguguacauuugggcugaaugugagagaaauagacuccucaucagagagguaauuagaguuuauaagcacagcccaagucugcagcaaaucccucuacuaaugaggaaaccaggagucugacuuucaaacaaacacuccuguuaaucuuuucaaagcaagucagacaugugggcaggcaaaggcuguaaaccaacaguggcucugguaggcugcccugguaggcugcccucuagccucuccuccagccagcaggccacaccucauuccucaggguucaucucugcgcccucaccggggaccucuaugagcaaacucugugucacuuguuuugcuuacagagagccaugacaugcuugagaguuaacaggaagcucuacuccauuuuuuuuuuccaguuagauuuauacagucuagggagaagccgaggcaggagggagagcauuaggcacacacacaaucggccuguugucaucugaugcaauacacuggacacaaacaagugacucugcccauuaucccucuugcuucauuuguccugagacaaaaaaggugaauccacuggaaaaaaaugaaggagaggucaccacguuucagagccgugucugaacaugcucugccagucugucccaguucuuacaugguaaugugguaaugguaccacguuaccggaaucccgagugaguccgugauuugucaugggcauaagcgcaggaguaauguuacagucucagcugcugggggcagaguauguggaagaucugagauaguguggcgucuuucuacgagaggucagguucucucucccuccuccccuucuccuuccaucccucccugucucgcuuuguauacgcucuguaauaaaaaagacaugggccuuuuagauauguucaaauucaagugcucuauucgaauacguguucucauuuacagcuauuuuauuuuuaguuaggugcucgcgcgcaugugugugugugugugugugugugugugugugugugugugugugugugcuugcagacacuggaggaaggagagagaugcccucgaguuggaguuaugggcagcugugagcgggcuaauguggggggccugggaagagcaacaaagguuccuaaccacugagcuaccucaccagcuccccguguuuucauuuuuaaauccugucuaaccucuuuccuuacacaucagcagucacacagaauuuauacaucacccaacuacggcuccucuauucuuuuggcuaguccggugcacgccgcccccacccacucaauucaggugacaacugcccccucucccauucauggggagacuuuaaaaguaggaagugugaggauuagaagguucagccacuuucacuggcagugucucucccucuauggugcuaagucucuaccuugacagagcgcagagucuuggcucuaaagcuugauguggaugaaagaggucccaccccaggccccucccacugcccccaaaggauuaaacaaccugagcagauaaugaccgccuuaaaaggcucuccugcgugacucagauuaguaugcgcugucugucgcccagguuggcagcuagacauuaauuaaccaaaagaaaaggaagaggguaaaauaaaggaagaagagaaaugaggaggaaagauaaaccuucacguggcagcuccuuucagacaagguguggagucugucugucugcaagggacagagacagacagggcccgucugcugagaacgcaugugugugugcugagcagcuaggcaggucgggcugggggaggcugaaagcccagaacucgaagcugucacuggugggauuagaaggcacaucagccacagaggggucaaguucggcugacaagcugugggccugacagccucuuccuuucagggacccuaccuacccucucuggcccagguuuaugagaacacauuacaggcuuuugaggccugugcucggggcuugguuucuagagggaguuuugccaaguugaggcucacucuaugccaguuguuugucauucucuggucuucccuacugggcagcagagggucacuuuuggguccuggcgaacucucucucucucucucucucucucucucucucucucuuccccccucucuuuccuguacuauuaaauaaauaccuuuccuucuagcuuguauuguugaaguccggaucauauagccgugaauuagaccugauacuuacuuuacuuugugugacaguggcugcggauagauugugguagugaaugucccuaguccuauguguauauggguggcacucccugcacucaacuaauaaacauacacacacacacacaucccugcacucgacuaauaaacacacacacacacacacacacacacacacacacacacacaaaaccuuaaaggacaugaaguucugagggagacgguauggggaguugaagggaggaagggacguggauacggccaaacggaucaucccuguguacgccauccucagagaguguuaaaagccacucuuacaugugaucaccggucagccggaggagcuggccccaggugcccguuuuggauggugaccaagcuaaaggacuuauguaauaaauuucaaugggcaaguccacacuggggacauuuccaaggaaaacaguauuucagauggaggcuguggccaauggacagaauugucucgggggggggggggggggagucugaaugucgacaggugcugcuggaaucacacuguguccccgaggggacaggcuuuuacacacagccagcugaacaaaugccagcauuucuaugucacccucuuaauucuggagaccgucagcugccagggaggugcuggcacugacggccuccagucaggugaaaaugggagugagcuggcuuuggcauuucaguccagcaccaaggccuaguugaagcuagaaguucucaaugcccccagcugagacaagugacaauguccagcaacauuuucuguggguuuguguuuguaaggggugagugggagcauucugaguguucauugaugaguacccucgagugcagacucaugcgugugcguguguguguuccucagcagccaucuaacuuggcuuuuugaggcagggucucucccaagccugaagcuuucuaauucaacuagucuggauacucacaugucuccauguccuagugaugguacuagcagccugugccacugcacuuugccuuaauaccugguccucauguuugcaagauaagggcuuugcccacugagcugguccccagccuuggagauauuucugauggacagacagggccauuuacuacugacaucuggaggucaagggucaucuaucuauuguuuggcacauaggccaguccccuguucccacaacaaaacaugauacagcccaaaugucaguaugguugcuggggaaaggcggggugaauugagggugauugugagggagcagcugacccgcuggaggagucuuaagcaaucguggcugucuggaaauguagucuuucacaacauuuaaagcagcagccccaacuccucugccugcccccucaucuauucuaaucugccuucaagaguccgaaagcaaagccugccccucccccggcacacaugggagugcauucacgggccucuaaaggacgaagcucucugaaguauuucacaguuugcuucggcuccaauuucaaagccccaaacaguaaguuucuucuuuugccuucaacaaaggaauuuuuuucccccaguaccucugauuucccugcccaggagcgaaggugagugugccaagcccaaagggcucauagguuaaaugacuaauauguaaugagcucguauuaacaacaauuaugcuaaccaugacaccugagcuuucuaccugguuccuagccucagucugaacagcucuuagcugggaauguuuaucuuggggcguauuuguguccuauuccaguauguaccccacugugcuguaugcaggagccauaaaaacuggccacuucuggaaagaauagccucggucuagaauucaguugggauguuaauuucuuggccaaagguacaaaaaucuuuaggccacuuccacuuaucagaauaguaaccauuggccaccaacguuucucaccagauaugagcaaaccccaaaucccaaagggauggacuaaggcauugcugccuccucaucuggcaucucuuagcauguuaagaaagaucagugcucaggcacuggacacgcacagaggcaggaaauuuggucuuugaacccuuuucugguccauuagccaugucccgccuuuccugugucuuucugugucuccccgagucucccgcgguccuccgaauccuccccuccagccccgcugcagguguguuuucacagggcuuacuugagagucgacuggaaaguucugcagagaggcuggucaugccgcuggcacggccgggugaaaugggugucgcuggguggacagaggaagaggugauggaucccagguacugguaggacuggucauaggaccacgguggggauggcuggaucugccuggcaucugcagggagacaaggauguuggucauggaugggguggggcagggguuuuaagacgaaaaguucucaucaugauagcuauuaaccauuauuuaaaugauuauacauguguuuacacagcuuguucacuugugucuaaugagaccacuagagcccaaguauuugaugacucuguuguaugaaggcccauuaaagauacugaaguacaguucauggauuuagggggaguuuuauuugcuaacucuuccuuccaucuaucuaucuaucuaucuaucuaucuaucuaucuaucuaucuaccuaucuauaauauauauagcauauauauacauuuuuuuuuucacacuaauacuguugggaauggacucugguaguacuggaucacucuaagugacacauucaggauaacacauucauccuggccagcaauuacaguuaucaucaccagaaacauuguaucggcucagauggccaccuuguucaggaagcacaaaggauguaagggggucuggagcgugggggacccugaggaaauguccacgggcauguguauguuuucuacuucagcaaaugccauuccucaaaugccauagaaacaauagcgagagcgauaguaaaaagauaacucucccccguacacagagagagagagagagagagagggagagagagagacuagagagagagagacuagagagagagagacuagagagagagagagagauacagacagacagacagugcaaacauggugaacgaccaaaacacaggcacacuaaugaggcugcuucacaacagaccaaaccagguagcauggacucuuggggccagugguguuuuugaagggcaaaacuuugagaauguauuuuauagauugucaccaagaaagagcagggacagagccgggaguugaagcaaaugucucuugugcacuugacuucggggcucaauaagccuuguuccuuucucucacucaguuugguuuuaauguccgggaaaauagaacacaacgauaaccacaaacccgacaauguaaggaccacagaccugcuuguuccugggccaacauuuuaacuuagaaucucccggugaagagaucuccugacauccucccaaugguggagaguuugucugaagggacggcacagacaagggagcuggcacacacuaaacucaucagacaagugcugcgaugcagguggagccuugugcgguuuuacagccgacuguuccugaggcccggagguguguagaaacaacaccguccugcaucccacaucacuguaaggaucuugcuccauugugugugugcggggagcccaaagcucacacucucagauguuuuccacaagacaugccagugcuuucaauauacacacuuagcaaauggacauauacuauucaaauauuuuaaucacuuaaaaagcaaacaaaggagguucuguaauugucaugaaggcccccggggugugaauugcgguauuguaauccaugccuuguuguguagacagccuagcaccccagcccugugucuaaaaccacacuaagcauaaaguguggugccaggguucaugcucugucauguuuuacuguagugaaaaacucaggcuaggccuuucuaaacucguaauuaaaccgugcgaacguugcguaauauuucacagccucgcuucgguggaacggccuuuaugauucaggcucagaaucugcgccuucuucuuuuuuuuuuuuuuaaacacagguuauagauuuggcaucaucuuacuucccaccacaguauugagugggucacugacgccacggcccaucaaccaucauuuccgccagcaccaggaaccuacuuggguccuuugccaggggugggccaguagguggugguggugagccucuucuuguaauuuggguuguuuucagcuuuuuaaugcucuauuaaaaacaaaaacaaaccagaagaggcagggaaauacagugcauucugcguuugugggagagguucuaucguuguuaggaugggaggggagguggggcuaggaacacaggaaaguuagaaucauaacaaccauauuguugauugccuaucagaaaaaggagcucuaggcccaucgguuugcugagagggccaguugcccuagaccaaaccuccauacuucucucucggcagagagaugaucucuaaagccauccaguggcaacaggggaggcuccccguucaaauuaguccaacucaucuuugcuauauguugcuagagucagggaagagucguguaggggaugggaggcgagguguagguacuuaaaaucguaacugugugccuucugggaaaugccacaaggagggauuaaacugggagcuauccagaacaggccacaggcugagagagucaccguuaggcauucggcaaagugcagguguacuagucuugaaggaguugccucugguaagccaauccauccaagugaacaagaguugguuaaacauauaccgugugccaggcacaggaaauguggccagugauaguggugacuaggagccacauggccccugccuuggcucaucagggaaaggcuucuaacuuugugaugcuuggaaagguuccuuccucaugcacaugucagcacacuaagaguugcuucauucauucauucauucauucauucaugcauucauucaugcaugcauucauucacccauucacucauucaaacacuuguauauucauaggcuggggaaauuauuuacuuguucccucauucauguucccacaaauaguuuugcuucacccaggcccuagugguagggauucacuaguaaaugguuuuauggucuuuacuuuguaagacuuacagacacgggaugauguaaagguugaauggaggcuggcugcuaaaucacaugacuaauuuggacuugcaaaugucugcuuccaagguagaggcaagggcagcagugacuuuugugacaugcuuauguucugcagaggggaggagcagggcaggaaagcauuaggauguaagucaaccagauuugggguugacucuugccuccaccauaaauuagcuucaggcaagacuuacauucuucugacuagcaagaguaacaucaagaaacaagcaagcaacaggaaaaagaccugucacaauauguggccaucaaaaaugguuaauuaaucugagugauuuccaugauugcauugcuaaaggaaauucaguccugccaagagacuuaucugguaaggcaacacacacuugaacuggggugggacucagguacuacuggagugcuuggagcugaguaucuugagaagagguaggcucuggggauuagaugcugaaugaguaaggacucuggaauuucgugacacagagaaagcaggaauucgguguuuuaaucaauccaugcuucuguuuuuaaaagcaccagaaaaguugagccuucuguaugcugguuguuuuuguuuucaggacaaaugguuuugaugagauuacaugaccaggccauuacaaauaauagauaagaggggcuccuuuuacaucccugaaccccauucccuuccauuugaaauggaggucaaagauaaggggaaagguagggagacaguacaaagcaccaugacauauuucacucaggaaaagaaugucuuaaagguaccaacaucaaaacaucuuuagaguccaccaugacgcugccaaauaauucauaccagaguggccugcuucuuccuuuuuuagcacuaaaauguaaagaguuuuggaguuaccauucuuguccuaagaacaaggaaaaaaguagaacagaaaaucugugacuuuccuguaucucccacagaauucuagcaggaaagcagggcaccacccaaguccugggaggcaggcaagcauguaaaaccaacccaaggucuguugauuagaaacagaagcucauggaaguacaacauggagaugucacaaguugcuggaggcugaauauagacugauaaugagaauacaagucuggagagcuauaguacuguccaggagaaacauguuuguggcccaggaacucaacugaguucucaugguuucccaucuuaugguagacugccaaccaaagagcuuuaagcauagacuaaagcagaguucaugggaaacucaaagacaacaagggaggaaguaacaaagacacugggggaacuacaugccuuugucaacuauagcuuuguaaucauugaacccaacuggacgaucacagaaaacucacaccaaaggucugaagggaacaaagugaaaccaacccagaguuuuauacccagcaaaacuauucuuccaaugcaaagggaaaagcaguacaucuucugaugaaauggaaaucaaugaucaccaacagacauguuuaaagggccucagacagaaagaaaaugaaauggaccagaaacuuagaucuugggugaaaaggaggucaucccagaagaagugaaucaaauaaaauaaaacccauuuucuauucauaacggaucugaaaguuaacuguuagaagugauaacagccacaauuuguuggacaguuacagcauaaagaucaagaaaauaauuggcaauaaugacagauaagaaagaagugauacaucucagcagaguggcgcuuguccaauacacgagcuugauccucaggacccacauaguggaaggaaaccacuaauucuugugaguuguccuuugaccuccauauguacagcacagcacacacacacacacacacacacacacacacacacacacacacacacagacaggcacauacacauguacacacacagagacagagagagagagauagacagacagacagcacacacacagagacaggcacauacacauacauacauacauacauacauacauacauacauacauacauacacagacauagagacaaacagacauauacauagagagagacagaaucauauacauauauacacaaagagagacagcagacacauacauaaaagagagacagacagacagacauguacacacagagagacagacacauauacacaccauauacacacaugcacacauacacacacacaaagagagagaaacagacacauacacgcacaaacacacauacacacacacagagagaaggggaggggagggagggagggagggaggaggaagaggagagggagaggcacacacauauacacagagagagacacuaaauuuaaaaauguaaacaaaaguuuaaauauaaguaacauauaacaauuaaggaauaacauuauuugauugugggcuuaguuuuuaaacucuacagcaauuauugaagcaauuuuaaaauauuuauuuauuuauuuauuuauuuauuuauuguuuaaugcauaugaguguuguauuacuugcaucauaucuguguaccucaugcuuguagugccuagggagaccuuaaucguguguuggauuucccugggauuggaguuaacagaccgccuuuagccacuagugguuacuaggaaucaaacccagguccacuggaugagcauucagugcuuuaaugucugacccagcucucuagcucccacaaaacuauuuuaaaaaaaaaaucauuuuccuacccgauaggcaauaaacaagcuaaaaugaagucacauaaaauguuucauuccauucagaggaggcaggaaagccgggggugggacuaagaaccaggugcaacaggcauaaaaguuagaccauggcagaucauaauccaacuguaucuauaaaggugaauugucuaaaucuaccacagagguugucagaacaagcuacaaauaaaacuuaacuaccugacgcauacaaauggcucauuuaaauguagauucagauagggcaagcauaaaaggguggagaagcugugcuaacaccaauccaaggaaagcccgaguugcuguaucaaguuuucuacaaagccgauugaagauggagcuuuucagggauaagagauaaguuacguuaugauaguacggaaaaccaaaaauacauuuuccuucacaggugucccgugaacaaagggucucacuaacugcaauacaaggaaaagcagacaaacccauccuuacggcaggagacuuuagcacccucuuccagucaccgauagaccaugcaagcagaaauucagacucggcugaccuggacaguaucaguuugaccuacagaacaccgguaggccgcuccuuucuucugaggcacacagaucacucgcuaaggcagacuacacuugaggccacagaagacugcuuggguuugaaggcauaaucauacaaaguauuuccuuaggccacaaggacuuaaacuaaaaccaaacaacacucuccccucccccgaaaaacaaaacaaaacaacaacaaaaaccaguaacagaaauauuacuuagaaaucuucaaaaauuggagauuaucuggagaugccauagccaccaaauaagagaucugaaaagauaugucgacugucaguuacuuaaugaaaaugaaaacaccaacauuuagggacuggagacgaggcagcuuuggaagggaaauuucugguucugaaaacauauuugaaaggaaagccagaacgccaguaacuaaugcguauggggugaggagggggaaagaaugccccacacccgaggcaaagagaaguagccguaucuaaagugaucaaugaagcucacuccaaucagaagaguaaauaaauguuccuguuucgaaaacucaaagcaucccgauucagccuugugcccucccucccuguccaaggaaaggacacgcggggacaucagccuaguucacuugagccuuugguggcccuggcaccugaccucacagccuggguuuucugggucaggacguuggggcucugcuguagucagggcucuguuccuugaguauuuggcgggcaucucuaaaacaacaagccguucacccucgauccauugaaaauaaacagugggccaugcaaugcagggccacuugcuucuuaacgcgcaaaaucugcucugagaauggauaaacccaaggggccuguucuggguuuuuccuuagaagacucccccucuuucugcaaggcagaaggcagagucauccucagggcgcccucccagugcagcucagucauggguagcugguguaaugcccucucggaugccucagagaacacaacaggaugugagucaggacacagagauguugagucaguuuccagggugaugugucagggcgagccccaggggaggcuugcaccuucucauuugggacccuugugaagaaagacccaggauaccuuguguaggaaagugguggcgcccccagaugcuuggaggaugccccacccccaccccccacucugcaaugucagcuuucacagcccugguguugggcaggugacccaacugaaaggcugcuugccucuggugguuuugagcaguguuuccuuuggcuucugcggugggcaguaaacccacaacagcuccagaagucagaacagacaggagucaccccagagcuccuucccccaacccccacuccccagguagccagcacuggauuagcaucgccuaagcacaccagugagaaccagugauaacaggagucaguucccaccaguucuggauccuggaagaaaagaggguugugaaagagcccugggauuugccaagcauuugucucccacuggcugcagacauuuugguuagucaugugcgucucggcugcggucacuguuccaacgguuacuuugaagggaggcauccagagugagccaggauggagaccugccugguaaggcuguuucaaaggccuucggggucugagggacccauucuaaaugacaucuauagacccaggaggugacaggccaccugagaaagggaagaaggaauuguguggcuucaucuccuguuccgguacccaaauuccucacucaucccggggaggccuccugacuuuguggucaggaugcuacaaaucugaaaugcuuauucccaacaucagggacacuccuaaccccgguggcucgccccagaauccuuuuccucccaaaucucuguuuccucauuuuuuaaaaaugggguugggggguaaccagacucaccugccucccaggugugagaguuaauuaauguuugugguacagcuuugagauccacagaugaaaggcucucuauaaaugcaaagugcuauuccucauuagagcugccagacaguucccaggggaaauagcucagcccucgccacgagggaggccucuccucucagccagaucagucugagacaggucuggaaagggcucuguauuuaggcagaguccucccugugcaaggguucagggauaagucacccgcuucuagaaaacacgcuguuuucauaacaccucucauucuccguuggcaccgucucuccuccagacagaguggccuuuggcguccagacagaacugugcuucugagggcaccaaaggccccgucuggucucugcaguguccuuuccugcagauaacuuauuucgccgaacuuuguuaaagaagccccaccccgacuccucaccgcacugcacgagcugccugcaccucugacguccacuuauguuuucuaggccuguagucaggcucagccaccauguggcaggugccauccuaggagcgccugcugaaucauccucuccuccauugcuuucuccucuauagagucucgaaaggcugaggguaaagaugacuuccuguccccagcccccagugguucuucuccagccucauauucguccuuacuccucccuuaaauaaggugaggagaaauucacugucaggugucagaggccccagguaguuuaguuugggagcuugggcucagcccuuuguauggagggacaagacugucacucauacagaagcuguugacaccuccugugggaagcugcgagugagcgagcgggaggaccucaugccucugggugucuuacagaguggaauguacugacaguagcacacacugcaggcucuauucauguggcucaggucaggggauguuggagauguugguccgggcugccugcagaagguggcuuguucuguccagcuugcucugggcugcugcugggucuucaggggagcaccaacugucuuuugaaaacuggaugcaguaagagcuggcccuugggcggucacauuaagugaacagcugagacuuuaugaggguccuuaacaugccuuagggugaugguaggcaccaagaaaggaguggcuauucuucuuuggaauugcagaggguggugaugauggaucuauuauuaccuguacaaugucaaucagggcccagccuagauugaaguccgaccuaauccaggcucuaucaagccacuagguggcuuuguuuccuuuggggggucaccgcuaccugcgcagcucccagaucucugugccaagggcugucacugagccuacacucgggacccuggugggagagcagaggucaccucuaccccagccccauggccugugcgugcucaaccuuguagucuagcauuguacuacucacuuuguuaaauguuagagcugcuugggaauuucuaagguggcuuaacggacagaacucaggcccuguccccuguguuccucugaccaggguauuaagcagagauuacagcguucauucuuccgcagaguauuaagagaaauucauauucauggggacagaaaagaagauccaaugcaauauccucuagaauauuccccaaaacagaacagaugaugccgguugugcuguggcuuguacuggcuccaggcaucucuaguaucuggguaccgcuccacuguucccuauucccggaccaacagugcucaggcaacaagagagcaagggcaugacucuccagucugagagguugcaauggagacaccaguuugccucuuacuguugaggcaagugggcauacuccccuccugugaggaggggucauugcaucagccugugagguacuguuagggugagauaguaucuuggccugaccauuagcaguucaguuguaguaugaaaaggcaagagagucuccccuugcuacccuuucagggaaugguagugauguccagagugaggacugcuugggcuuguccagcacagacucuuuauccucacugccggugcuccacauagcagagacaccgcaaggcuaccaggaauaggacuugucccagccagccagaguuccagggugcaaaccgugguucccacaaccaugcgugugugguuccgguggcuaagugccagcgcggagacgcagcaugagggagcgucucuucccugaacaccacagcuccagagggaguccguacccgcucugcagaacgcaggcucauggcaggguggcgcugugccugccaggacacagggucugaaagcugaauugcaagccagggauucauuguucuuugucuucugaggugugagucaugucaaaggguuguucuuucuuuaagagccuucauuccacacucucaacucacagaagaacauucugacacaggggaaauagaaaaauuccacagaggugaaaugccuagcccccuuugguaaauguuugcaagagagauccagucagugucugcccccauguucuucuccucgugcguuguguguguguguguguguguguguguguggagggguagguucagaguucuggucuggucuuaaaugucuguucucucuggccugaaccugggacacugcuguguuuuccuuuccuacacaccagacuuguccucuuagaaucaauuccccaaagcaaagcccaagagaagcaccucagagagcuguggggugggggcggggaacucccucucccauccucuagccaggcuaugcacaggucucucucugcaucagaagaaucuaauaaauaagucuaggguuuuccugcuugggggugggggguggucagccuuucaugauuccuggcuguuccuaucuggguuguucuaacacaucuuucacaagaacuguccugucugacuguccaugcaauggacauuaaucauugcacuuccauuugaucuuccauggccuccccacaguacuagaaacaaugguagaucagagaaguguauucucauaggucuuguuguccaccuagaaagauguaacccucacauaccuuaccaucccucugcugaugaccucaagaugacagugggauggguggcuaggaauuaucaugagccauccuauggaccuaccaaacuccagccucuuuuccauagaugugccuuuuggaggcucggugcuuaucacgcgccauaaacacaagguuccuccuccacguggacccagcaaauguucucagacccaacucuguguccgaggcuccuaaauuucucagaugcuugccaucagcaauaggguggggagacggggccaagaaacuuccccgcagcaggggucguguauuucuacucaagcauuggcuuguuuaggguucccugaggucuucacuucacucucaaacacugaggcaccagacaguucucgcuucuauguuuccccgccuguaaucucucauuuucgugggagaaccacaggagggggacucacucacuuacauuugcggccccuuugcacaccccaaguaacugaccuugaucugaacuaauugggauggcaauggauuaauaacacagguuggugagguagagucugccaugcaggggagaccuuugaagauaagagucacgcgugcuuucauaaaguaaucccuggugcucugaacaaaggacacaaacuaauaaaggcagacucauuugggggcacccuccacucacagaggaauuccaccccgugcucugauucagagaggcaaacggaagucugacagaauucuuuuaaacucuaacacagaucucaaaagacacauacccauacagcguagagacucucgguaauaagcaggccucugaugaucuaaagauccauggcuucauuuauugacuagggaaaguaaaugacauuucaaauacaaccuucacacuugaauagaugaggucacccugagaaagaugauacugaacggagcccagcagugggagagcucccuccagagaacgccuuugauuuacaaggucaaggcagccuuucauacagaagcgauagguuuucagugacuuggacgcagauggaagaaaaaaagcuauguacagguugagauugugggacauaccgacacauuugaucacacagugagugggacuggccaguggaggaaggaggugccagagacccagaggccgaagugaucugcagacagacacccaaucaacucaguuuugcacauugacaucuuauacgcauggacuaaacacuucugccuuucccaggcuggucuaaaccaguagggaacucucuucuagaggacuuuuaguaaugucaggaaacaggacuacucuugauuagagucgggagagccagagacauugaguggguagagaccaggggugcugucugguagcuguuaagugcauaagaaguucccguaaaagaaugguucagcucccacagucaagggaaacuaaaaugacaagggaagacugacccagggaacgucacaccgauaggguaguucagccaacuucaacauggaagcagagcaugugacuucuagaggcugcucugauuucgagagauguaaucuagcacgguggccuggguggaagacacaugaacugaggggcugaggugggggcaaccauggcuaggcagcgccuaaggagaaccucgucuccacaucgguguuugcagaaacugcuuucucacagucucagucugacacgcagacuuggcacuggcugaauccagccccgggggagccacagguguaaauggccaauaagcuugccccugaguugaccacuggcuuugcuaccuuggaagggacaggccagcacucgcuucuccugggcuuucugggcaugagucacauguaacuagauaauggugcagauuguugucaacaguucugaggucuuguuccaaagacucauggaaugauggggcaggaagcagccccagaggcuaccugugccagcuccaacucagagaaagcuggagugcaagaugaagggacggucucuguuccucacacagguuggugguaggaugaagguuuacuuccauaaagcaccccuccuccuaccuaaugaucauaccggcaaaaugggaaggcuuaaccuucaaaaacucuaacugcugaggguguuggggcuuugaagaggguagcucuuccuauuuucagaucuggggguauucagagcuccgaggggucccucagaauucugucuuuacauuugugucuccuuucguacccacgccuggaucaaagacaaaaguuggagucuuuuacuauaauaauucacaaauaacucaaaaaccaagggcaggacaggaaaaaaccauuuuaggguggucacagggaggaaccaggcuucauaaaaugaggacggcgacggggagucacacugucacccuuugcaguuccucuaauggcuuuaagcugccaaacacugcacugcacugacuugaaacccuuuuauagagagugccauacuccuucuguucaaaucacuuaaaauaaugaguuagcugcacuuguauuagucugucuuucaaguggauuagauucaugggcuuguuccccuccagacucgcaagcuuuggccuggcugucugaaccuccagauuagacugacgagcgcaggccagacagcaaugaaacgcaauuaccuaggcaaacuuuugaaggauuugagcccuggggcacaggcuguuuaccagagacugaaagcaccguuuguacugagcagggccaguugcuguggucuugggagcuucggauccugccugccacuggacuccaggcaggauuucugggggccgauaacaucagcuucuguccgcacuucagcaccucaggggcuuucugguuuucaacaagaagacgcaagcaccaacaaaagccgauuauaauaucucccuuuguguuacugacuaucucucauugguggggcuccccgcuuucuuuuucgcauguauuguguaccacauugggggaaaaaaauccagcagcaauccuauggucgauuggcucuguaaguugguucuuugaaaaugaacagccuuucuaaaaaacaggaacuuccugucuucuuuaaaaacaaaacaaaacaaaacaaaacaaaacaaaacacagcucauucaaaccacuuuccccuugauuugaacagaagacccucuaagaguaccuagugaagguuccucccaaaggggauuagcgggccagagggccagagggcuuccuguuuggggccacaaucugacacucuuucacacaaaugguggguaaggagacagguggaugagagagagcgucuggcuggcuguccgagcaccauccugugaccagagaaggacaaugagaggaagacaagccugacuuuccugcgugguaggagucauacuagguaaaguccccagaagcuggggacggggcccugaagcccccugacuuggcaguggaucaauuauuuuuaaagaaaagauuucuuguggucagacuagccuugaacuuauauacgugagagcugagaaugaccauaaacuucuaauccuccugccuccaccuccugaaugcuggaauccaggugguacagaugucggugggugccaagugcuggggauagaauuuaggguucacagcccuaggaaagcacucucccagcugagcuccagcccuggccccagggcaaggcuuuauuaaggugaaaagguguguguguggagagagagagagagagagagagagagagagcgcuaaauaaagaguuucgaaggauggauuugaaaaagaaucuagaaaugugggucugagaaggaagcagcagacacacacacaccccugaagggcaggaagcaggaaccuggcugguggaggcaguauugugcugugguaggggcugggaucccuaggaaguuguggguaacuaagacagcuuauuucagggccuaggucucuaauuaagcaugcaaagcagguucaaauauguggaagucugccucaggugaggcugagcugucugcagaggaaggaaggcagggugucaugggaggaguauuuggugugggucuggaaacagcaugguggggaggggcggguauccaaggccacaacauuaugggccauaaugucaagaggcaaagggaccucccagucacugcauuguuuccugccuggaacuuugaaaugggguucacacccaccagugucccacuuugaccuguguuccuaagaucagaagaaaaaaugcuucuacagggacugacugguuucuguaccucguggccuguauuccugaggacccagagaagugaaggaguguucaaggguacuugggacucugcugacccuucugugggucucagagcccagauguguggggaaggccaugcuggagcacauagauucaguccuccgguuagcaggcugcgguuguuaacugggcaggaugacgccucacucaggacagugaaggaaaaggcacuuggccccaccaccucucaaguauaaccagagagcagacauggggagauguuacagugagagggacugucaggcuugucuaggaacugggagaggacucaguuugguccuuguaggaagggacaugugaggauugcugaaauaugggagagugugggaacagggugaggagggaacaggacuagccagagaggaagacagguaagcuaaccucacauccacuugguaccuuccccagacucccugccuccauccugcuccugugauuggcugagagugauuucagagcuuggauggacuagggagccagggagagccuggaacaccacaggaauggaggcauugcucgagaagggaauuugaugggcagcgaaaagagcucugugcgccaagucuuuggccuucaguuggcuugaaaggcauuaauagcuucuucggccgugggcauggccuuugaaggcuacaugaucagaccagguggacgcacagggccuagggggguuuauaauggucaccugaaggcaaaggagccaaggggaagcugcaggauccucacuuacauugccacucaagagucauagcagcagaaggcacacugaggucagaggcgucauuauuccuguacuuuguggccauucugccgugucugaaaagcuguuccuguccacugauauccacauagacacacaagauggccgacgcaagauggcugaugcaagauggcugacgcaagauggccgagcaacaaugacuuaugcuacaagaagaacgugaaguucaaggaacuucaagucuccucaguccucaguugcccaugagcuaacaguguuugccuucccuguagugcucagagaugagcuugguguguaagggagcucuuuguagcucugagaaagauggccacaggcaccuaagcugccagcucacugggagacugcugaguuuucugagucccugaggcaugguggcaacauggugggggguugaggggaagagaagcaccaaggguuccuacauggccuccauaucgugggcucuuacaucacagaaugccugggauaguuugcagaacccuuguuuugagccuccccuauacaauucugugaggaugaguucauggcugaccaaucccccuucagggacaccaacccugaggggagccaaccugggcucuaucuauugcugucagagccuuggggcaaggggcuggcuuugcagaguuuacagguggggcugcccauagccagcucaguagucugccucuccuugugggagaagcaggcuggacuguagcgugaugucugguaccucaccagugagugauucccuuucucaugucagcagaggaaagaaagaacgagaagagacacaaccaugaguugugacggggaugggcucagguuccagaguugagugguggugggcuaaagguuacauucccuuccuuaucccacgucucuacagauggaaauugauuuucuaagagaucucucuccuuaugcugcaagauguucuucauaacagggcugcuguugguuagaaacuauauuuaguuucuaaauauaaauuuauuaaauuggggggggaugggagugggcagggaggaggggacaggaaaggaaaagaauucaagcauuggcugaccuaggacuucccuagucuugccuuggcuucuucaguuuccccuccucccgacuccucccccaaguucugaaggcuggagaugccucuaacaaggcccucauugucccagacaggugugagauuggacuugaucccuggccaacaccuccagcaccagaaccagcccuguaagcugcaaacacgcaccagcccuccaguaaugccucugcagccagccagagacucaacaauuuaaggcuuaacacgcacagcauaaaucaagggaggauggaccagccgaccggcagcuucuugggcaggugccugcagacugucugcagaucagacccugccuguuuggguuauuugagacugagacacacacacacacacacacacacacacacacacacacacacacacacguauaaaauauaaggaugagaaauuggguggagcccugugcacaggcacaccugggucugcccuaucuugucccaacagccccucguucgccuggaugguguuuggaagggacuccucaggaaggcucccugugcuacuuccaaauaccaggaauguguccagcgaccgaaccggagaagacagccaagcacucggcuaacaguguaugccaccuguggcaagucacuuuccccuccaggcugccauugcuccucugggaucuggggagggggggcgggauccuuuacguuuucccagaaugcccuucauugcucuagccuuaucuucuuuagagacuuguguuucucagacaguggaggaggcaagcccagagugcaaguccccugggaguucgggucaugacuugucaagagcacacuccguggguggugaagguggagaugacaagccagccggcagggcuaauuagugaagggagucaaguccccauucucuuuugaaacccaguuaacuauuaaguaaauaucacuuaagagccaggaugcuggaguccucugucucucaguuaaggaagggagccagaagccaccagcuaugcaggauccuguucccugguagcuugggagggggcggggggggggggggaagaaagugguggcuaaucuuacaaauuccaaaacagucucugaucuagccauucaaggcccugacucugaauucauggcaaagacuuggcuguaacaggggcaccucuggcuggauacaggucucggcucaugcaugcagucuucugggaguaaugacauaagucuggcaggaccauucugaacuggucgaggggacugucacucggcaccuccccccugucccagccuagggccugcccggaguggcuguccuucccacagcuguggcugugucaccucccacacuguuuguuguccucuucugggucugacagccugggcugcagccgagagcaggcuuagagugguggauuuggcagagggagguauugacuuaaaaucagucagggagaugagaccucauucaaagaaacccuuuaguagacgguaacauuaaaaacacagaagagucaggccacucauauauggugagucuaauucaagaaagcaacggagagggggagggaccacccccugaacgcugcccagucagggccgcugguuucaggaagugaccuguuagcucacuacagcuguuagcagucugggagugcuugcugugaacugaagaggaugagaaagcguguauggccuuguuuauuuaaaacaaaaaaacaaccccauuuuaaaauauauuauuuuaauuauuccuucuaaaaaaaacguuuuaaaaauaaaauucaacauuaagcgaagaagagaaaagggaccauaagaaacuaaauccugcccucucccagagccaaaaucccauuacagggaaaaggcugaguaaggcuaagccagcgcuggggaaaugagccguuccccauaugaccgacuucaguacaagaggacagccugggagagcucaguuauggagggcgccuggaccuucaggguguuggcuggggugggguggggugguggggcaggggagaggcgcuaggcaaagauguggauagugacuauggauggucccgcuggaguuuacccaaggaccccaaacucaaaucaccaaaacucuaaaggccauugucacagaguggcugugagccucgcaggacaggccucaugucagccggagagccggcagcaagagcuguagcaggaauggcaguuaugguuacacagacggcgggagcagucucgagaacuuuagacacgcugggcgcugugcucugcacaucccaggaucgcaucucagccucagugagggguuucugcaggagugaacaagacacaaccauaccaagacacagcaugcugaccacccaauacuauaaucaugcugacuucgucuucaagaccaucucacgagucaggcauuaugagcgugcccauuuuacagauggcaacaguguggcacagggaccugagugcuuccuuccuucaaggaccuacaacuagaaaguggacaaagucggagucugagccccaaagcauuauagauuggcaugaggccguccuaaugaauuaggcuuuucuagguacccccucuccccaaguuuauccuggagccacucugaugaccaggugugaagaugaguucugugcuggaugaugggagggauggauggauggauggauggauggacagaggauuuguccuuucgccccaacaucuccagguucuggaguccuccucagaggaagccaugacuggccagggagaaagucugacugcaagagcuacccuccguaggcccuccaccgagucuccccucccccaaggcgugaaggacucaaauggggaaaccgggaaaagccacgggagcaugaauagcaaggcuuccuuccccuuccaccugagcuggcuaucuguaauuuuacacaaauucaauuucaaaccccugcuuugucaguuauggaaaaucauauuaaaucagacagauccaugucugggcaguggcuucucucauuuggcaacauaugguggcucuuagccucucuaagcuugaucacacagcaaaaaguaucaccccaccaccaccaccaccaccaccacaaaagucugccaaucagaagcagcaggguggggugggggcucuagggcauggagguugguuucccugaggguguuaggggugacucuaaucccuucaagauacugugcccacaauuacagaauguuuaggaccaagcagugacucacuugccugagagcaaggccuaggaaacuguagagagcagugccaggcagggggagauucagucagugaagcucucuccucacaaauaugaggcccucaguuucaucccaaggacaggguguggcagcauauggcgguuaccucaaggauuacagcaagaugggagauacagacaggcagacuucuggaguuggcuggccuucuagccuaaccacugagcaaagcaaaaggcuaauaagaggcccugucucaagcaaauguggcaguuauuggaggcugacauuugagaccguccucccacaccugaggcuguccuccgacuuucaggaguacaugugugugugugcucacccauaugcaucccccccaccuccccccccccgcccccuggagaaagauguauggggagauggggagugucaggcacuaugaaaaagaaggaguggcccaccugaaccuucuagaggguauuuccucugccugugaccucaccagaccacucgcaaucuguucugucaacaugaacuacgaaggcuuuauauaauugccuuugguaaaugugugaacccaacaauaucauuaugauagucuuucuugccucaacuacucuggugauaaucuggcugcagacacggucacgcuccuacccugaaguuuuaaaauuggguggggggcgacaguaggauuaggucugaagagcucugggcucacucuuaagagugccagugccuuacuggaaaaccaacggaagcgcaucuucaaaagugggcuguucugguuggucugcggagugggcgguuuaccgcaaaauacagaugcuggcgagcugaccuugggagauguaaauaaaccgccgaacgggcaggagggccaagucaagcccuugagccugggcugacuuuuacagauauuuuaauaacccuaucguucuguaauuugccaucugauaugugcagagagaugugcuaauggaaggagaguggccgaggcagcgccgucgucccaggagacaccauaaagccaucguguucauuucccuuguaugagcagcaacucuaaggcgagcaguccucagucucauuaguccucugccccuuuuugucugaagauauucucucaaagccacccgaagcagcccuucaaaguguguggagaggaaauagugaagauuuagcucugagccucagaucugguccuggaacgccucauggggagaggaccugccaugaagcuggagacgguccuaaugggugaaccaucccacccacgagaagacuaguucauagaccuuccuguccuggggaaguucuacuuuaaucuaucaguggugucucuucauuccagagcagcaugguucuagcacauccccugccaaacucccagggcugacucgucaccacggugcccaagccuugaugaguuuaacugugcuacauccuggaaccccaaauucagugacucaacaagugaaacuguguaagaauuaagaugggacaggaaggaaccagggacagacuugguguccucagacggcaucccauaguuguuggaugacauggaaggugucuucccaucugauacagcagagauuccacccacauaauccccucuuagaggaaagggcugcaguuuuguguuuaaaaugaauacccaccugugauaguuuguauaugcuuggcucagagaguggcacuauuagaaaguguggcccugucagaguaggcaugucacugugggcauggguuuaagacccucacucacccuagcuaccuggaagucacuauucugcuagcagcauucagguggcacucucaguucuacucuucauguagaacucucagcuccuccugcaccaugccugucugcacucugccauguucccaccuugaugacaauggauggaaccucugaagcuguaagccagccccaauuaaaugcuguucuuuauaagacuugccuuggucauggugucuguucacagcagcaaaacccuaacuaagacaccagcuuucuaaaaaggauaagguuaugauccauggagaucagaauuugaaccaucagugaugguucaaaucuugcaaauaugucuggaagguucuaagccuugcaugagcccgagggagacacugagcaaugagggaggcccagguucugugaccuuucaaccugagucagaaguaagggucccuucuggccagccucuacuaccaguggcuuagaggcucauucuagcucaggaaacaugguucuguuuguucugaaaaugcuacuuuuaaagugguaagcacugcucaaaggagccaggcucagcuaggacucagccugaagacccuccaucaccugguuacagagaucaacagaacaaggaaacagcacagucccugucccacuucuuucuugcucuguucucaggcaugcacagagaggcacaugacugaucuguguuuguuuucagggugaguucuacucuauuuuucuccuuauuaguuugucauauugacugugccuggguaaccgaaucgcccggcauugacacauaaaauguccugccagaaagggauuaugggaggaaacucuguggagagaugggaggcuugucaguaaacagugcguuugcaggcuuuccgcgaucccuaccuuuaaucuccacaacaauuggcugcucugcggcucugcgaucaauuguuuaauaugaauauagagucuguguggggccaagaagugugguaacagggcagagacucgguacuagguggcuauugucuggaagauaagggacaccaagugccuuaguucaugguccccuagaguuagaaugggguguccuggagccagggggaaacaagacaaaacagagugaugaagccuuugggcugcacuuacaaagcccagcacugggagaaugccuagguggcccuuucagccugacacuauucucucgggccaaacuuuugguaaacuuugauaaagcuucacagcugccguuaaaaauucucucccuccuccagacuugaaaggcaaucugugaucugugaucuguggcuuggcaugaccggggcccaaagcaaaccaugguccuuuuggcaugggaaucugguugacaagacucugugcuaacuaacgccugcugcuugguccuacaaaacaacaacaugccugccucuggccuggcuucaucuggaggucgaauucuugaguaccucccaacuggcuggcuuugggcaucagggcaaguuuuguuucucugcucgcugcugucuauguggccacaggauucuggaggcuccaagccuccuguguucugacauuacacccuagguauugggguaggaagccccccuuucccaccaccauugacccuuuggcuucaucuguaugggugcucuagaaacacucggaaauagcugaucuugcccaggaaaaaaaaagaaacucuauucucugaccuggggaauggaagaaucaggacauggcucuggcaaaugaagggcugagaugcugaagugcagaugacaagacagggucacacaggcaugacaucacauuuaucuggacacuaggucuacucugagggacagaugggaaggggcucguuggacugaccgggauccaccggcuaauguuccgaugacaucaauguaacagguuuuaaucucuggcacugaacgguggcaccagaaaggccagggccauauucugaccauuagauugugacgaggaucucacugacaaagggucuggucucucacacacacagcuaagugaagggccugacgcugucuugaguagccuaggucuagauccaguaacaugagaccuuuaaagaagaagaaggagagauggaacagagaagagcugucagaagagaggggguggggaggaugcagccauggaccaaugagugccuggagcuggcaaggguuagaggaggccagagaguccuucucuuaggccuucaaugggagugccaccucuugucaccuuaauguugggacuuguagccuccaauuuugagagaauaaacucucauuguuuuaagucacuaaaucugugguccguauguugugucagccacaggaaaacuagccaaguugguguugucgacaaggauuauaacagugaccgcucaaaggacauuccgacaagaacaauuaccauucccauuuuguagaugggaagacagaggcuuuaagagguuaaacuucuugcuaaaaaucuuagaguauaugccguagccaguuugggccaguuugugauuguacucuucccgccuuagcagcuaaggacugguuccuuuugaagccucgaaucuuuaacaucaccauucagcaaguacacaaaagaccacugaaaggcccugaggacaagguuuagagucauuagccuuagggagaaguucgaagcgucagaaggacgauuugaucauagagaccaagucccauaguaagugacuuuucccuugucaucagaaaagguauccacgagggacuaacaggauccugagaacaugggcagaccucuuugagcaacagucaugaaccgcuuuggaaaccagguccuauuaaacugugguuuuggguuacaaagguagugucaguuuaagugguaagugauucuuugaagggcugauuaaguguuuggggguaagguuaauacauaauacaccaggguugugacacugaacaguuuuagggcccaaggugcuggcaccugugcccauccuuaagguggcagguuauguuaguaccucacgcucaauagaugaggggcccaaacagggagaacaccaaggccugcuggcgcuuccucccugacacccaucuuucucuucuccugaaugucuaugguacaguucuuuagcccgcacauucauacuuucuuuagacauagaguuuguguugcaccagcuaagaauauauaugcacaugacagggcauccucaguuccugccuagaagcgcuucucuuucuauaaacuuggacuacuccuucugucuucucacuguggggugagaagaggggagcacacaccacguggcaggggcggggcagcacauaccaugugacagaggcguggcaacacauaccacaggacaggggcagggaagcacacaccauguagcaggggcucuguagucugcacucuuuuuuuuucaggguuuucucuuauccacuucuucuuucucccuuccccuccccacugcccuguuuauugugugaacaucugauucuggcguguugugcguguacaacuccgguccugcagcucuucggguuuagugccugccacagacaggaguuauuuugaagggaaaguuacuuagugcuauaagcaagcugcaaggguuaauuuuuaguacuuuacgcugugugcaugaaauggccauuucaaaggaaauggccuaggaaaucaacaggcccaucccacgcuggcuuuaaauauguaugugacuagggguggagacaggcauaugacaaagaaagacagagacaaacacaaaagguagcgcaugcgugcgugcaggcacgcaugcacacacacacacacacacacacacacacaccacagauuggggggugggggggggaggcagaaaugcagagaaaagcaggcagcgaagcugagcagucccaugcuuuaccccagggcggcaagggcucgcaggucccuuucucucccccugcuuaugcuaguuaugcuaugugaguugguggugggcaggacaagccuuuuucacaugcucuuguggccuggcucucuggaugcaggaguuugcuccuuacucuggaagguggaaaugcuuccuucccuucguacauucugaggguggagggaauugcccugacaugguaacccuaccucuaagaaccucacagacaguagcgaauauaacuuuuucaaagggacuuggaaggagccuaagacaauccauuagaaaacuggaaaucugggggccaccugagagcacguggccuuccucggucacguggagcuucagaugggggcaucugcucucaucuaggcugaucucaugguacuugggaagaaggcuuuaguuauaaaaggccacaggagagagacucauaaaugugugugggauuaccccaagaaagaguugcuggaaguccccuuaccccaugaucccccuuagggcaugcucagaauuucaguauucugauuggcuuucuuuucuacccaucuuuaaaaauaaaaugccccgaaacaugacuuagcaagacauccagcacacagucugauguuauuaucaacgucgacagcagcaucaaccuccaauuacaaccaaacacauucaguccacaucuucuacacaaguggcuagcccaacuccucuccaugccugucggcccaguagcacaccagucccugagccaggagcacaaguguguccuuccacaccaccuuccugccugugccuucagagaggucuggauuugacuucauauccaccccguaacaaagcuggaagaaguuggggagacuguguuucugucuagaagucacaccagagauuaccgagcaaaaagaacaguguagaccucgaagucuaagcucagcuucaucacaacgaauccaaggaaaguuaaacuuuacagcaagaggcuuagaguacuuauuuggucugaaggauuucggaaucagcaucuuuacaccuuaucugcaucucccccccucccccaggcagaagucaggacaccuucaugaugguucccagggaaaucagagcccaagaccuaaaaugacccauguguguugcuuggagccauuccuaaaagggaggugugagggaccaggcccggcuaccccagaacucuguaaucugcucuacuccugcuguaaaaggaacggagaaaagcccugaaauuuggcaggacuuaacaaugguguccugacuugcguaaacaggcagccaugacaaaacagcuuucuauuccacucaaagacuugcucaaauaggaagucgaaauuaaccucggcuguuuuaaaguuaaaaccucaacaaacaaaacagugguuugguggcaugguaacugucuucccucuccaucugaaccccagugcagaucacucgaggugucuauuugguaagauaaggaaaugugauauucuauacccaugauccucugcuggcagagccaagggguggcuccagccugcagucuucugcugcuccacagacgcuccccugcagugacugucaccucuaaagcugacaaucauuccugugucucugugguguccaggggacaccgcccuggcuacuucugggauaguuuucuuaaaacugugacugccauuucagagagccacagucccauggugcaucgcuuaaauucccaccuuaaguaggcacgugugcucuacggcuaggaccaggcaguaacugcccgcaacgccaggaacaaugugaagaacuugccuguuacacuaucccuguuaauguuuacauuucaagggugaaaaaaaaucaggaguucacucaaaacuagauuuguauaaaauagcacuuucuuauaagaagagauaccagagaagagccggagaagggagaaggaagaaagaagagaggagagaaacccagaaggugggagagagaacacaagaaagagaaauugguuuuauaugcaguaucuucaaugggguuugaaaccgcgugucugccuggaggccaguaaaucccugcuuaucaaauuuauauacuggagaggaaaaaaaauccacaauauaguccacacaucuucucagaguaccaaccaagccccuaggacacucuaagagcaagugcaguguucuggagagucaccgaugcgcagccaccuguccaugaccaugccucugugcacaggugggugguuccaaaggcccagggcucccuugagcccacccacccucugcaguuucuagggacgagguauguaagacggcaaacugaagcaguccggguucaugaggcaggcagaggcaaccaucugaauuugcuccugcaugguuuggcacuggcuuuaaagacgcuuaccaguuuugguuugacuguaaguaaaagaccagccuccuucucagcucacgggcgcucggggcagccaggagagggcaagagaacagccuuuucuuuggguuuuagacaugggaucccggagaaaacgugugugaacuuaagugagaguaaacagaaggcagagaaauguccuuggauaucuccuucucccacaguccauccaucucaccuaaagugugucauuugccucaauucaccaccgagcugcacugugggaccuuggaaaauuaguguggguauuuugagugauuauucgucacuauuacacacacacacacacacacacacacacacacacacacaaaaacaccuaaggauuuugguguggccuuuuucuaaacauaccuaggaagaaagccuaauuuuugugucuguucauauaaaagagaggcgcugugcugugcuaacacggucucauguaucucugguuggcuucaagcuggcuacguagccauggcuggccuugaacucuugauucugcugucuccauccugcaaguacuaugauaacuugacuguaauaccaugccuggggguauaggcuuucuauauuacauucuggaaaaugugggccuauuugugagcccugcauguguuucuccccagagacagcaaucggcucagauaaaaaccuuaucaaguagaugcccccuuuucuccugugaagcucagaggacacuagucuuugcuuucugugaagggcagagccccacuccugcugcccauccucugccccuuucuuuguaugggcugcucaucccuucauuugaguugcccaggccugcaucucugcaggaguauugcuguaagcaugccauauuaauagcugugucccaccugucccagagaaaacugccuuuugguuauuauaaugguauaucacugaacaaacagauuccgacgucagccguccgacuggggaaaugcagugagcauuaucuaacuuggcacagaggguaugugcaguuauuacaucuuacagcguguuugccacuggugacuggcccacagagugaccagaacucacgcuacugaucugaaaauguucugccugauacagcccacaccacauacauacacacgcaugccucuuucauauuuugaaagaagagauauuaaaugaaaacuuagcauaaaaucuaaaggcaacaagaacuuaaaaaccccuugcuggauuuguauguguauguguguuuauacauguauacacaacacauacauacauacauacauacaugcaagcaacuguguguaucguggcuucaagacuaauggguagauaagaaaacaacauaguagaaaacaagucuuacaaaaaccucucgucagcuucuauacaggaggcuauuuguaucugaaggcucuauagcuaaagauuaaaccgaagguggguugauaauacagcuuuuuaaauguacacauauugaaauguauuuucgucaggauucccuacguaauauaacuuggugauugucaacauagcaugaauagcguguuagaugcuagccgcagaacggauuacagucuccaggaugauguccacaggccuaggcaaguacuaggacauauugaacuccuguggaguuugauaccuggaaccgauaacugcaaggguaccaagagagauacacgcguguagccauguacacauauggcuuccacagccacgauucccucccaugcucagcagccacacuucucagaguagagauacucugcagauggaacagcguucuccucauuaagcucccagcugaugcugcgggguuucaacaguucccuuagagcacccagaaaggccuggcagccccggugcuuucugcgccugggacuccagcaaagacagaggguagugggcuccgugggguacuuacccugcaucugacuuugaggcugaggguuaaaggcaguggagugguucaaggaggcccgaggguugggcgugggggcuggguggugcgggcugacccucauggccgugcgccgcagcugcuccaauucacugagccgcucggaaaaggacaaacucccgggcuuggucugaucaucuaguuucugccgauguccuaguguagggaccgggaggggaagggaggaggaggaggagagggaggcagggaaggagggagggaagagaucagaaaacguguuguggaggggacuuuucuuaucuuuccccucccucucccuucacccccaaggugagcuuguuggacauugccccuugggcuggcugccugugggaaccagggcuauccuucugauagcccgcugagguuccuucagcccacuggucccuggcuguugccucagucugggacucggugcccacagcucuccgcacauccccucgggugggcagacacuagugagcggaacugcugaugguggccccggguaagaagcccguugcuuguuggcugugggccucaggcugggaacagaacuguggcagccaagaaaggugcccucccggggucaagaaugcccugccuuccugaaaaccugagcagcaggucugagaggugccagagugggcccuggaacguagcagcgugucccuucaacaggaaauugggugcagcugcaaacccacagccgaggagugagauuuccuguuacacgcaggcaggcacagggcaucccucucugcccucacacacccaggccccuuccuccuucguacaggcuccucagaagcauccuuacuucccugaagcccacucccugggcggaucccuaggaggaaguaggcagaaaggugcagcgugggucuguuccaauauuucuaguaggccaggcccuugggagcucagagggaguggccagcuggucugcugauuuucccucggaaugaaaagcaaggugggaugcuugcugucguguaagggugguaggugucucuguuaccaggaaacagcaaguaggggcauccacgugggccagucaggagggcugggccucccgcuuuuuuuuuuuuuucccucuccauccccuucaaaguauuaugcagacuagagauuguagaggagcccagccucccacacagucacaguagagauccauuccuccuuuuaagaggccgacuuuguuguuuccuccucguucucaagguuuguuugacuagaaccguugacugagccagggccauucuccugucaaugguuacacagccugagccacaaucauccuccuguacacagccucacaacaagacaggggaagccguuggcuucugcccauagaaaugcuguugcugcuaccccagcccagcccagagcuacacggaggacccuggaccauucuuccagcacaggagugguuacaaggcuaccccgcccaccaccuaguucccgauugcuacaauuauaaaauuaugucguagaaguuguguuaugguuucaaauccccgcggcuugcuauuucuuccugcuacgggccuccuuggcacugccgacacggucucagauuccaggccagaaaaagggcccacuauauugcagcgauuuuuaucacugacaagaccuguuuggcuccaaauggaggaaaaaaaaaagcuuaagcauaauauuuguguaguucacaugcagcgcucgcucuuuccacguaucgccacggcaaaucuggacugucauucagagcucacaacacuggacucaaacacaaacacccugagucacgcaggcucggccggggcgcaugggagaggccucuuguagccggaguauuuaaagcucuauggacaaaagaggccaaguucccgagccacccccuccagccuuuuaccagcagaaguacaaaaacuucuuuuucuagagccuucuaccuugcucagucuuaguauauguaguucggugugcagcccucucuggauccucccucuucuuuucuuugcgaccuaaucaguccccacuccucaucccaccugagaaaccucaggcuuucucacagaaaaacaaucugagcucuaaagccauuuaaagcgugaugcggccccuuuuaagugucugccguggucucucaugccagucaaggaagaggaaggugggaaacaugacgcuggauagcuuguauggucucagaaagaaugugggucagcaagagcuugcagcaggcuuugucugugucgcagccucgcauuccugaggcacccaguggcauuuuggaagaacaccgugaaggacaguguguagccauaggaagggcaugcgugugugugugugugugugugugugugugucugugugugugucugugugugcgcgcgugcgcaugagcccccucacuugugugcaugaucauucuaaagucagagcaucaguuaaugguggugucucuggccagccuuugaagaauggcuaucugaguaucuggcucugugaauuuggggacuugaucacugagaacucaaacaggaauaagcuguuuguggcaaguggacaagccccuauguggccaacacacgugacauauuauuuuuauuucucuucccucguuacucaguuaaaaaaaaaaaaaaaggacuccuaauaugugaucuguuuucguagcagcugacaccugccagaaucguagucauuuacagagauuaacugaugacugccugcucuggcaggaaugccugggccuggcuucucagagcugcuuccuaagccccaugagucuagaaagucccgagcugggucuagugcucuggauuagggaauacuucauuccaugcucucuccgugugcauucugggagucuguaggagagguucugccugagagaaagcuugaaccccacauccacaggguguuagagaguugcaacaccaggacacccagggaacgcagggcaucaucauguucaaggcguggccccaagugcauuuagaaucaagagcaccuaauucucuucugaaaccauugggcuuugugugccaaacagcaauauuuugcauggaacauaggagcuuccgauggaaacucucaggcugggggaaaaugaaugcuuuaugucuuuaguuuccuggaucuguaugcuauuaaaauaucaauuugcccccugaauuuuaaaugcaggaguauggaaagugcccacucugaaaucccugcuucacucuuacugauuacugggcucuggaggguaacagggaauucaacacuggaucaaaccaccggaggacuguaacauagacuaaacacacacauucugguaaccugggcuuucaaguucacugcgaguccaucgugaagguuuccagaguggggcuucaagcugugaccacaagguacugggugcaucuuucugaagcucacacagagcugaaaggaggucccagauauucuauuauuauuuuuacauauuucgagaaaacacugcucagaauguuauuauaaacacacagccuagaaaacaacaaaaaaugggaagagaaagauauaauaaaguaaacucaugcuacucugcccaguggcuccaucccagacaggucucucuauuucccugagguggcugcccaucagagcaccccuaagcguuauuguauuuuaugguagauaauaaggucaguugccaucuucuuucuguuaaaaacagagcagaauagcacgcacaacucacuaccaccucagcugccuuugccagggcaccacuguggucugcggcuguaaaugacugaaauagagcaucugcuucucuaucaaggcaaugagguggaauugccagauuuuccuggaaaccuuugauuagccaaccugucagcuccuauuucugaccgcaguuuucugguuuucuugauagaucacauggcauauacugaaagucuuguccugcugagcagauuggaaaagucuaugcaaaauggcaacacugaaaauauucucucucucucucucucucucucucucucucucucucucucucucuguuuguguguguguaaacugugguucuccuaaaacuaauggugaauuauauaaauuauauauauucaccuuuaaaaugacaucugcauuucagaaaauauccuucagcuaacccaaugguggcuacaugaucuggguauaagaggcucacucuucuuugguuggggcaguuuuaugucuauggaagggcaguguagagaacaccucaccuucuuugugucccagucaguggcuaacugcacugaacucagcucugacccuuccuugaacugucuugcaguaagacaagccuuccaaccagcaaaccggcuaucucccagcuaauuaaauguugagaaauacugucuccuauugcauauuauucacauauuacaaagcacugggcauguagcucagugagaaacugcuuccaaacauucacgaggccccaagucucagugcuagcaucguaaaagggggaagagagagagagagagagagaaauucaguuuagcaaacauuuaaauuaauuaaacuacauuuaaauuaauccacguacuauaccuaaaacaugcaaugauauuauaugauguaugcuaauauauacccuaauacauuuuauauauguauguuuuuacagauugucugauguuaugugaacuuagaugguuucaucucgucucuucauuuccucucgugccaucaugcaaagaaaacaggacacagcuguuacaccgaagaacuagaaaagggccagagaaaucagccauaucuuuuaaaaugacagaugacaagccaaguucagagagguucuaacguuuugcccaucucacgcagccagauggaggaagaauacgggucccaacccacccucagugccccaguccucccauccgacacccagagcacccagaaugaguuguuuugauuuuggugacccccucccugccuaagugaagaaauacagagacacaaccaaauugaguuuagaucacaggucaugcacuccucuuugucccacuucuguccccaguaugacccaugggugaggagggccagaggggcacaguggucugcagcccucugagggaucucuauacccggagcacuuggaaacucuugcuaggaagucuagaguaaagaccuguagaacuucaguuucuaggaagaucugugugcugccgcuauugcuggugccagguauaugugugagaggaggggggaggggcucccccuccuggcccgugaauuucccaugagcaccaugacuucccuucuccuacagacuucugcuuugcagagagcuggagaauaaaauaccacuuacaaucccuaccucaguauaugugggugacugcuugauuucuguauacuaccaagccgguggcauucaagcuucugaucuaaacugccccauauuuguaccuacaacccacgcaugucuuccugaauucuuuccaucuucugaaacucagauuuuuuuuuacauuguaucuuuuggggaacaacaagaagaaaagucuucccacuuaauagacauguguuuguuuguuuguuuguucuaagaagaacauuucuguucauuguugaaugaauuggcacgugcagggcucauauuuacugaagacuggcuguacucuaaguucauggccacuuugugauggccccguucggugugaagacuggcgauccuuuggucuguuuuuaaaccguuguaagguauauacagagaggcucuuccugcugauugucauaucuccugcuguggcuagauggccuuggugacaacagugguucucagcuuuccuaaugcugcggcccuuuaauacagcuccucacguuguggugaaccccaacugcaacauuguuuuucauugcuaccuuuuuacuacuguuaugaaucauaauguaaauauuuuuggagcuagacgguugccagcgggauugcaacccauagguugaguagcauggaguuagagacuccucagaauucuugcgggagaagugggaccugccuuacugucagagggagugugagcacagcagggaccauggugcucauacagagcuuauuguucuauuuaggacauguagcaggucagagcucagagugccccugagggccagggugucaaugcagccucugacuccuccccgcugaggcggcccucacuaggagacaccacuacccaucuggcaccccuuguucuaagucugugcuuccugcagacucuucugugggcuccuuaucugcaagucuggaauuaaaggacuaagguggauuccucccaagggcacccauggcaauuacgucugccgcccgaccgcccgcaucuccucggcuggggcugacuggauggcucuaagcuugcugcuucuuaacaacuucaugggaugccuuggcucaauuuccuuaguguuucuuuuaggcaaauaccuggucuuuagagcuuguccccaaccuaaccauuaagacagucuuuagagcucugacucucucucucucucucucucucucucucucucucucucucucugugugugugugugugugugugugugugugugugugugugugugugugucaggcugccauguaauccaggcucgucuugaaaccacuauguaagaugaccuugaacuccugaucuuucugaguacugcagagacauguaucuacacuauaccaaguuuacacauugcuagggauuaaacuccaggcuuuaugcauucuaagcaugaacucuacccacuggcuucacccucagcaucuggcuuuuuccacagcaccauugugucacuguggugugucugugccugcugaaccuugagucuauggagacaugaauccugcugucuccuuaguaccuaaggcuccgggcacacauccggcuaaggcuaaaugcugacuaaacaaccagcuuuaacccagcaaacagauauucuugaucagcaccauccacccuuccuucccaagacuagaggaaaguagaauuaauucauuuggggcaaaggaauccagaacuaagugugugagcagugugacugcuguguggacauaguaugacugcugugaagauaccugcugaggcaaagucucaggcugggcaguguggcucccugaagaacuguccugucagagucaaaucugucaccaaaccauucuuuucaucaugcggaaaaguaagacaagucccuugugcagagccaagcacagcacacuggcaugagccuugugcagagccaagcacagcacacuggcaugagucagcagccagaguggauucugcuuuucucugaugcacguguguguguucacacacaugcugaugccacacaugcauaugccacaugcuuauaccaugugcauugcaugcaucuacauacacacguaccacauacucacacaugugcaugucuauauauuccuaucaacucauaucuucaccaugcugguauacaguacauacuucuaucauaucauacauauauguaauauauauguaauguguuuauauauacuacacacauguauguagcacaugucuacuacacacauauacacgauagcacauauauauguuauauguacauacaauguguuuauaucacauauacauauaacauguucuauauauguauuauaucuaucacacacacauauaagucacacauauauguaugcauuugucauauauuuguguguguguguaccugugugugauccacccaugcacacauacacauucacauuucucaaucagacacaaacuauuccuugauccacacacggaacaguaaagccagcggaggccaaauccagaccaagccugacagucacagacaacaggcugacaggccccgccucuccugcucccugaggccccaggacuccucucucccucuuugagccccaggauucagggagaaaaaaaaagcagcagucucuaucagucauucuccauucugggccuugagugacagacuucaggugugguggcucccaugggacccugguguccugagaguagagggguuugucucuguggucaucacccucccucaccuccugcuuugucuggugacuaaggagguaauuguagcuuagagcagaagcugucugguuaucuugugcuccugacccgcagugguccuccguggggguggccgccugugggagaacugcagggaacucacacggcaagaccugcuccuuugccagccuguaaucucaacuguuaucuaacucuccugaaagcacggucucaggaccccccucuguaaaguguaauuaaaaaguaagcugauguaacuguucuuauccaucuaccggagcagcucugacacggauagacuucagggaagacagccaugggaggacugcaggacacaggcagaggcaggagagcucucuagucucugaaaugcaccuggacucgggccuucagcagggcaagcccuagguugcacgggccugggaggaaggagaagacacucagaggcccccaccuccaucuccaugcucagcgcugggucugagcaauccugcaucucucacuucuccuaaugagcuguccuucuccuguuccugccaugcuacaugugauuggcaguggugcugaguauguuugcacagaguccagauaaacagaggccucuuggaggaggcugagugaugucccuguaaaaccuggcuggacggaggagugagaaagcgagcgagugagugauugauuggauguccuucucugggguucucggcucgcagcaucaacaacgaucuuucucccuccgugcuuaggaaaaggggguaaagaaaaggcuccaucaaucccuaaaccugaagaggaaaaaaagagccaauuggagcucuaggcuggccucaaggaaaagggaccaaagagacagcacagggcagacgcugagcaccugugaguucacaguuguguuuuagcaaagcacuggcugagugccacacucaagaaaagguuacuuucaaguuguuugggggugacucugucucucagccacuggggugugugacuggggaggaggaggggcggcagcuacaauccaggaauggccgagugagcagaaucuugucuaccagucacaaguacccaucagcaagcagccauguaccugcagagcaccggccuggucacuuacaaagggagaguucuacucauuccaaauucugagcacaccccaccccucacccccauuugccccccuggugaccucaucucaggcaaggaguagggagcaguguggcuaccucccuaucaacccaagacaaccuucugccucugaguccuucccacauuuggcaguggugggccuugucccuggucaccuagggacuguccuaugggaagcuggucaggugagauccaacuccccucucucugcugucuucuauaggaaaaucgcuuuuuccaauggguuuuugagucuuucuuuuuaguguaucuguucagcccagacacugcugucuguuaggauacacuuuggagcccagaaagagaaucccggaacugggcagauugcucuguugucucuuccagccccccgggggggggggcaccccauucccuuccuguucucuucuccgucccccacccccaccucccucgccaacacacacacacacacacacacacacacacacacacacacagagggucaccucugcuuccuccauuuucugugcagcugcagcugagguauaguaaggcuacuguauaggacuuugaaagcagggccgagcagggcuuuccagacuccauacaagccagcuauucucugccuuguuuucuuuggcuucggguuaagcagcaccgaaugagucaaacaguauuaacuuucaauagggaagugguguggucaaccaaagcuguuuguggcuagauuguggagauagguagggcagguaaugaggaaaggcccagcauacgcaagggggggggggcagccucacucagcaacgcucuggcaauuaagucaacagaacucacaccaucuuuuuuuuuccaguuggcugaggaauuaacaccaaggucucuggccggccagcuuugggaaguuggccauuaggcucggacaauugagcacuuuguguguuuacagauuuuuuuccccuuucuucuuuuuuuuuucuaaggcugccaaagucaugggaaauauaguuuugaugauuuccccugcuuaagccacuccacucugcauuuauucccgucccuuugcagcagcuugggcuggaugggucgauccucccucuggcccuacuccaucuugcuccucacuagccccucccccacacccccaguggccaucucuucuccaucccccuuuggacacacuccucagagcaggucaccugcuagaggcuggaagaggaugccuugcaaguucaacugcuccuggaaacauugaaucaagcguugaguucaucagugccuuagcccucacuacacccuccucccaacuuuguagaugacaaaacugaaguuccagcagaagcugagaauugcacagagccagguggcagggccugagggcuuuccauugggcacugcccccugcucaggacucaggagcccugcugagaagaacuccgcccuccagacucagauuucaauguuuuccacuucuuccucucugcacucugcuacuuauuuauuuugagaauggcugaaucacucucagagcagaaaagauucucugauccugcccccagccaguguguuggcagaugcacggacuacccaguggccuccagagccucagcaucaaguagcugaaggguuugaggcaggcacggggcacaggguggaucgguucaccucccagaaacugaaucucaggcacacacagagacacagauacacacacacacacacacacacacacacacacacacacacacuguaacacacacauuuauacacauacucacacauauacaaacaggcacacacacacagacaaacacacaaacagacauaaauaugcauacacagacagacauacacacucacagacauacacaaacacacacacagacauaaauacacauacacagacauauacacucacagauacacacagacauacacaaacagacauauacacucacagauacacacagacauacacaaacacaccacacacacacacacacacaaacagacauaaauacacauacacagacaaacagacauacacacucagacacacacucacagacguacacacacagacauaaauacacauacacagacagacauacacacucacaaacacacacucucacauagacacacacucacagacacacacucacagacacacacucacacacagacacacucauagacauagacacacacacucucuaacacacauucauacacauacaaacaggcacacacagacacacacauagacacacacagacacacauaaacauacacagacacacacauagacacacacagacacacauaaacauacacagacacacauagacaugaauacacauacagagacacagacacagacguacacucucacacugucucucacccauacacccucacagauauacauagacacacagauacuuacauacauacauacauacauacaccacacacacacacacacacacgcacgcacgcacgcacgcacgcacacacacacacacacacacacacacacacacacacacauacaggaaauauagacucagaagcagcaggcuauccuaugguuuugccgccaugagagccguaugcagaagaaaaacuauuugguccuggaaaagaaaaugaauuuaagcaaaacucugaacuguggauaaaggcugcuuccuuuguuuccaagugccuuaaaaaguuucuggagggaggcaaacgaggagggaaaagccucuccaaguccagcuuaacagggguggcuaauuuaaaugcggacuucuccugcauucucaccaaucugacgagacgagacggaaccuaucuuucaggcggagagauaguucugcaguuaagagcacguguugcucuucuagaagaccggaguuugguucccagcaccgacauggcagcucagaaccaacuguaauuccaguuugaggggauggaaggaccucuucuggccuccagggcaccaggcaugcacgugguacacaaacauacaagcaggcaaaacacucaugcacaaaauauaaaacaagcaagucuaacaaaaccaaaauuaucuuuaagagaacaaucauuauuuuccuuaagaucacuaaggaucuugcccaauaccuguaaaacauuagcagucgguuuucagguugcuuuguuugcaaauaucucauucacaucuauuguauuccuauuacuuaguggauaggcuauuucucuuacuuaguugauaagccacacuuugauauauaccacucaaauaagacgaaacccuauacaguagagagacuccccucccaugguacucauagcugacccaguagaauuuucuagaugcuaggagcuuugguaggugacagcaacauggaugcccaauguucugcugggaaacagagcuacauaugacagauaaagccucuaucuggacccaccugccuguucucugaagaggcaggcgcgaugcagguuucacaagguggugccuugguaaggcuuggguuugguuucuggugcuucgggauuuaaagugaccgugaggucaaguugaaagagaaaaggcuccaagugcugaguccuguggaaccaauuugccagguuucccccucaucuuuaaauaacuugguauugguaaauauuuggugaacacuucggcagaauuccaugugauuccuuugguaaauacaagguuggggaugaaggagacugacuugccuguguuccugguuugugcuuuaaauguuacagggugcuaugugcagggcuaugugaagcacccucacauggaagucuccaugcaugguauugcaaucccugugaugaagguuuguuaucagagccaagacagugcggaagcuggagucaggcagcuagccucagagcaauggcgcccaccuggucuaucuuccccuuuggaaggugggcaucuggaaaccccuucuacagagggaaaaacaggcacacagccaguauguaucagaggucugacuccaauucccucucuuacucccugucgaacccucugauucuuuucugaaauuugggacuggggccccaggaacaaggucagaucaggaguaaaaaugucccuccuguacguuugcucguagcauuauaaaaugaguggaccagaaacgccgugaagccaccccacaggcaaguaaggcugagauacucgggucagaauuccaaaagggaccauuaagucauccugaacuuacgaagugacuuauuucaaauguuuacauuuuugccucaaaugacuagaauaugacuuaccagccacggcguacaaaaguaaaaagauccagcaagcaaauaaaaugcccacuguucggcauuucagggcaggcaaguacgcuggacuuuuuuuuuuucaguaacagagaggguuuuagucaauacuugcuuuaauggaaccugggcauauggaauuccuaggagcacaaaauuaaugcaucaccauuaauggacuucacaagggccuggggaguugcagauuaauuccacuguguugcuuuaaggguggcgugggggcgggggguugguggcggugugugugggggaacccacaggaaaaggacuucccuuugggugcuuaaauauuuuuucuaaccuuggcuuucacuauggacagagacugagaaaguuugauacacuugcaaguucucccagggaaaaccuuaagauugaccuugacgaaaacugagccacuaagagggcauuuggcaccuggcuaauagccggugcuuucccgggucugaggacagcagaaacacucacagguagauuggaguuaauuuacccccuuccuaagggcacgaucuaaugcugccagagccccaaggcgggacaccuuacaaaagguuuuccgacgcaagacacgaaaaaaaagaggcagauucaaauuagcuacagugaacuuagacgcagaucuaaaaugaggagcaugaaguuuacuuauaugaucaaagcuuugggggaaaaaaaauccuugugugugugugugugugugugugugugugugugugugugucaguggccggguccuuugagacacuguguaccaggcuuuuccuaauggccuuucccagcacacagcuuuacaggaaaaccuaaacccucgggaaaacucccgaguuccuucaaaacggaaaagggaaagugguuaggccuugaaagaauugaaauugccucggaaagggaaaggggagagguaggcaugguagugugcucugacaacaggggcugucugccacagaccuucagcuagcugggaggucauuuguccccacggaagaugcacaacagcugagucucccagagcaacauccacagguagcaggagagcccccuccucucucucucauacacacaaugggagggagcccuucagaaaccugucuaggcuaggugcuuucugugugugcaccgcguacaggucuugcuagagucuacaggcacccuggagugaugaucccaguacugucugucugucaucuuucaucccuccacaucugcagcugauacaaccggauucaaccaaauccaggcugaaaauacuugaggaagaaaaagugccgcacugagcacacacggacuucccuaacaacacagucucacagguauucauuuauccagccuugucuccaguacuucaguaacccggaggugacugacagucuacaggaagaugcucacaaguuaucuacaaauaaucugccauuugauaucaggggcuuccguguggcagauaucugagguguugguuccuggaacaaauccccuaaggucagcaagggcagauggggggcggggggauucuguucuuuucuagaacaaugugaagacucuccaucagcugucucgugcauacacugaggcccgagugucaggugugagcuucuuuguuaccaggacauaaguuuucuucaaguuguucacaaaguacgacacuuggggacaagucuuuuggaaccgugagggacuuaggaacagugcccagaauauuuuaaggggccauaauaugccagaaaagaaauuuacugggccuaaauaaaaaaaaaucugaaauaaaaaaaaucaaaaugcauaaauguuuaauuacaucucaaaaaaacgcaacauuaaggccacuucaugaauuuuuaaauuuaggaauucacagaucccuuuguuguuucugucaaaaguccuuucucauuucccacaagacuccaagguaaauacaaacaauagccgacgucuucuaaauguauacugugucccagggaagguucccagggaccccaugacacugauauggauggccauugucucuguuggacagagagccagguaucagcaucccaaagcuaagcagggcaagcaugacgugcagcaucccaagcugaguggcagaggcaucagaucagggcuguucggacauuaggcuuguuacuuauagcuagagaaacugaagaugaaguacaaagcccauucaagaacagagagaggguaggggaagggaaaaagaggagagagaaagggagaggggaaggaggagggaggggaagagagagggacagggagagggagaaucugaaaaccacuguggaagcccugguugaggacaugaaggaugaucaccucagcucaggguuguggccuguaaaggggcccuguuugugaagaagcuauaccucuguuuugcugacaagauuuuguuaccccagcucgagugggaacuaauuuagagauuaucucgucucauugccuaguuugacccaagaggaaaccaaggacuaaaaaguacuuaagauaauugcccaaguucacacccacaggcccgauggcgccagggugaaagccuaggucccggaguuaaggauccugaaaucuuuuuacacauuuuaagauuaagaacggaagccucaccagagacaguauuacauuguuggguucuuuucucucuuucugcgcuucguacaaucauuccuaacaaggacaguguaucagcguagaccccaguuucacugggaugguauucuaaguagcaauaugauuuugcagugcucuaacucaaagaaauacauucaaagaaaugguuuagcuuccauucauuauauguuucuucucucuuuuccaggcgccaaacugaggaggugucuugcuuaugccuguauagucuuccugguaccugggaagaaccugcuucaggcagcaagagccaccuaaacuuuaacaacuucugcacagaaggggggcacugacuaaaaacucacugggguaguaucaagguaggcuguuguucauggguaguaucauagugaacuguugcucaugggguagugucaugauggacugcuguucauggguagugucaugauggacugcuggguucauggguagugucaugauagacucuuguucauaggcagugucaugauggacugcuguucauggguagugucaugauagacucuuguucauaggcagugucaugauggacugcuguucauggguagugucaugauagacucuuguucacaggcagugucaugauggacugcuguucauggguagugucaugauagacucuuguucacaggcagugucaugauggacugcuguucauggguagugucaugauagacucuuguucacaggcagugucaugauggacugcuguucauggguagugucaugauagacucuuguucacaggcagugucaugauggacugcuguucauggguagugucaugaaggacugcugcuguucacaaagacagaaguaugaucuuuucucccacauccucaguugccccagagaaacuucuaggccuuagucugaauucagggaaaucuugaugcucacaaaacucuucuaggucuaguguccaauaacuaaaauaauaaacaggaagagauucuaacauuccuuagaaacacuuaggcacaguuauuauuaaugcuuuuaagaacugcuucccuaagucucuagguaguuagagagauuagcagagugggaacuaaaauacuugggugaagccccccagaaucuucugcuuaaccugaaaugccuucagaggggaagagcaggcauacagagcacugcucuugacgcucuaucuuuugcuuuccaucuggguggaaggaaggaaggaaaaacucuccauuuuccuuuaugcaccaugauucugccuugaacugauggacacgucugauaucugaacacuccaaggaccugggagccacguggcacgguucccugugagcaccaugacuagccauggcaaccccaagagcacacacugaguguccaagcuuuaccugggacccuuugcuaaaggggauccccguuuagacaccugcccucagggcugcuccagucggucacugucguacucuucucuuugggaaacauauagguuuuugcauuaucccugguuuacgucccauugccaccauguccucaagcagaccucagugacccucagagccaaucguuagcacacguggcagcaggcagcauugggaacucccugggaagcacguggguaacucaguacacccaccgguaggaagacugacuccagucaaacgucuggggcagcuucaaagcuauaggaaaaccacaugugagucacacccaaguugauaagccuuccuuaucaaagauacagcaucacaaugcagcgaggcccaaauaccuuagugcucagaagcagaccuaggugugcaacaucuggauuccacagcuuucauucuggcugauuagcugggugaccuuggguaggguucuuaauuagcuuuugcuucaacuaccuuaacuguuucucccaagauuuuauaaauuaauaugccugcagcacuuugaaaggugcugggcaaauaaugagugcuauauaaugucagccacuauuauuaguaacucuucuuauccagagaaaagaauaucuugaagaagaucugcacugcuuucaauguuaagaaauaaagccacaaacacccauuucacucuuuucuaacagucucgauuuugaguccauuaucaccgaaugcuuacagaugucuuucaugcauuuugcuuuuucauuagaaauuauucaucaaauauaaagguucuguuuaauauacauacaugcauacauacacauguaagauuuuauuuauuuauuuguguuuguuuguuuguuuguuuauugucugcuaugucccuucaaaaucaaagaagaaaauaaauucaugaggcugggacacaguucagucaguaagguguuuguugcacaaguaugaggaacugaauuuagauccucagcaucccugucuaaaagccggguguggcagcgcauaccuauaacccuagcacuggugaggucaacauacaagaauccuggagacucacuaucagccaaucuagccagaauuucaagcucaguagguuccagguucagugagagacccugacucagacaaacaaaagggcagaaggagagugaaggacgaagacaugugacaucaaccucuagcuuccacgugggaacacacuguaggcacaccugcauaaacaugcgugucccacaucucacacauguguacaugcaugcacacacacauacagaagcacgugcauuuacucccaggaugacuucaacaaaacucucuaaaaagcaguuggcugacaggcccuugaguugauccauucuaaggauacuuucaucuagaaacgaucaguuggugaaugugaugguuuggauauauuuggcccagggaguggcacuauuagaagguguggcccagucagaguaggugugucacuguggguguaggcuuuaagacccuuauccuaccugccuggaagcuaguauucuccuaauaaccuucagaagaagauguagaacucagguccuccugcaccaugucugccuggaugcugccauguuccuggcuugaugauaauggacugccucugaaccuauaagccaguuccaauuaaaugcuguccuaauaagaguugcuuuggucauggugucuguuuguuuuguuuuguucuuuuguuguuuuuuuccagacaggguuucucuguauagcccugacuguccuggaacucacuuuguagaccaggcuggccucgaacucagaaaucugccugccucugccucacaagugcugggauuaaaggcgugcgccaccacacccggcuuggucuuggugucuguucauagcaguaaaagccuaagacaaaaguugguaccagggaaugggguauugcuauaauaggccuuaccauacauacuuuuguuagggaaaaauguagauuuugggacuuuggauuuggaaagcaguggaaugcuuuaacuagggcucaaugggccauccuauuaggaauauggaagacuucauugcugagagugauuugaacugugcagaccuggcucaagaaguuucaguggaaaagaauuucaguacauggccuggaggcuguuuuuaugguauuuugaugaagaauauggguggcuuuagcccuugucagaagagucugccugaggcuaaggagaagagacucagauuaauugcaauggcaaaggaaguccagaaacacccagcagagacuuuguucucugguugagucucaugaagagcauuuuaagcaagcauagcaagcuuagaaaggaaaaauguaaaauauaugguuuaaauaguaaacgggcaccaggaagcagaauggagccaacucccauguucuaggagauaucggauuaagggaguaggacuuuggggcaagauccuacucagcuaaauugagauccaggcauggggcuauccuuggagauaaagccaagaagaucucagaguucaaggccagccugggacagagcaagcucuuggugaugaaaagcuuaaguccagguguggugguauacaccuuuaaucccagcauugauaauguaauagaacaaggaggccauguuccagcaccagcaagcagcagaacucagcaguuugggcucaagcuuuagagucaagaauagaaggggcuacugggaaaauggaugcucgugagcuggagcuacaaaauuagcagugauuaagaagagaccagcaucaccgaggugaaaucuucugagaaguguuuucugagaguacaaagaagcuguguuccagagauagccaagguugugccucaugcugcagugguacuugguaauguguaagagucagccaggugguauugguguugaaggcaugaagggggcaugaagagcagcagagguuuggcacugugagaggccauguuaggccauuggugaaggugcagccucaguugcaguugacagcccaggacugaaagggucaugcaaaggauuugaggcuuggaccuaagcuguaagccagccccuauuaaauguccuuuuggucauggugucuguucacagcaguaaaccccaacuaagacacugagaccugcauccugauggcucugaguuccaaggaacagcucuaucuuguucucgucacugugaaucucagagcuugaacagugauugccaaggacagcuuuaccagagggcagaagcugucgcagacacagccagcauugguuucuugaccuuuuugaauuuuaaugaagucuauuccccaagucacagguaccggacuucccaagacucaucacgaguggguugagagauggaguuuuacauguuucuagaaauaucaaagcaacauaaacccacucuuaaaauucuguuugugaagagaaaauccuuuuauggagcaggggcuggugcuaaggagauugcucagucaguagagugucugccacccagguaugaggacucaugucccuaucccuaccucgaguguaauuggcugggugauuugguaugucugcacuaaccccaguguuggagaauagacacauacagguccuugcagcuuacuggcuaguuagcaucgcucagcagaugagcuacagguucacagagagacccugugucaaagaacaaguagaguugaagacgaugaugguugaugcugaccucugaccccugaccuccacaugaacccauaaacacacacaaacacacacacacuuauacuacacacacacccauauauacccaucacacacauauaccaccauccuuuuaguauaucuucuaccacacuaucuuccaguauguuaacaagucaucaaauggucuacuuacugccugaaaacaaaaaacuuccgguggcacucuuccccucuaaggaacugaauucccccaagcucacagauuucuguauuggcuggagauguagaaggaucccauggacugugugaaaagcaaguuuugacuuacucgggggcagaggguuucugggaccggccaguaaccaucugaacugcaaaaggcuggggagucccuggagcacacaaccuacuacuacauuacagcuucaauccugacaaccaugucagcgucgagguuaccuuguacccuacagggcagccucagagcuggaucccacaugagaaaucaugaaagccaguccacaauuaaacacaaaaauuccaaaggcaggagagagaacucauaggaugugaagugcagacagcaugguauggauggacagauggacagauguguguuccaaagucagacaccaaagucagacagugaaaaacucccccuccacccuguggcuucaucaucuuguuuaaaccuaagguugcuucccuucucuagggcugauuuuccuuuucuuggaaggaucagagagguucuuucucucugagucuuugauuugcuaaagugggagaacugagcgauguugcucaguguggcaaacacuaggguucuugggccagacucauccagaaucuaugauccuuccuuaaugaggggugggacagcgcuccuaaaucuccacggcugugccagucuggccacccugacgggcacacgggguccucacuucucacugcauccaaaaguggugaugggcagagugccaguggaaaugauccgugugcuaugagaaccgguaugagaugugguggcacacgcuguaaccccagcacucagggucuggggaggcaggaguucaaagucagcuuggcuuacauagcaaguuccggccgaccgggacagcauagugagagccugucucucaacucaaagcacaaaaauaaauaaaaaagaauaggacgauaauaguacaauuaaccacuaaugguccacuguucuuacaaguuauaaaauagcagaggcggcaagugcuuuaucugaguacuugaucuauacacaucaggcaagcaggggccccaauaugggggccguuucccuuuccccugccguuugcuuuuucuaaggcucagcuccccccucacuucucuggaauguuccaggaaaaaaaauacacacaaggugaaagccugucucucuuagguguggaagaauaaggaaaauagaaggcuucucauggguccccauuuucagcuguuuccucgugcacagccauuguauaaucuguccuggaggcagcagcugcuuuagagagccacggacaccuaaaggagccauccuaugagcacggucacucucagcaucagucuuccuacaccucgcccccucuccuggcccugugcuaagucaucaccucggcuugcuuccucuccaguccccugcacugggccauggcccucggguguucugucaugacugucuacucugggaaaccagggagugccaagagguuuccugggcugugugaggacugugugcuaccuuggucugcuguucacacucuaaaggaguagggcaugcuauccagcacaagccccagaguucccugaaccugaccacagcuaggaaaucucaaggacguuaacaaggaaaagcucaacagguuuugguagggaauaaaaaugggaacagggugggcagaguggagggagcugcccagcccagggaggggagggaagcacagccagggugaacacucugcccugugguauugcuggugacugcagcuguucucuguguauuacugcuucagggaaaauuggggaaauggaggcagagaggugacugguuccaagggugguccagauaccagaagucaugaccaugauugcaggagacgcugccauagccagagugaccacugaauagccucagagagccaaauucccaagggcuacuaccucagagcccagaugagaugccuguguggacagggcugccuguugagggaacuaccucagcaggcucaauggaaccaccacacugaaacgaggggucgaggcaaggaagcuccacggagauuccugacauucuguaagcgcaugcccugcaccgggcaccuggcuucaucuaguuaaguuucacaaugaggcugucaccuuuacauacauuuucuacaagaaacugggguucugggaggcucugagacuguucuagggccccuguucucaguaccuucauucuuaucaaauaaucucucugcaccauagcuucugggugcaggagggaccccauguuuucgcaucccagccucugaggguaucacuucccaggggccccugacaugguuuggaggugagcugcucuucguuccgggcucaucugccuacagaauuggacuguggcccagcugcagcuccugggccgggguguggcccuguaagagugucacuccuguguuuacuccaagauaguccuuaagucacucugaagacaucuuuccuucagacuaaacaaccccacuccuuuuuaaacacucuccucacaggaguuucgggguauuuuggaggcuaucuuucuauauuuacugguuucccccaguacucuucgcccggcccaggcucuauuuuaaacaauccuagaauaagaucccuucaagggaaaaagagaggaugauuuucacagauuucaucucuggccuuaacaaauuaacacaagcauggaugguaagccaucucuucuuguccaccgugaccuucaggucuucauugucacacccuguacuuggccaauugucuauccacugcuugugucugagcacacugaacauugcuguauaugugggggucuacuccuugccucagaaaacaaaaacaaacccaaaguguucuuaacucaucugaguuggccuaauuucccuuugacguguaagccaaagcuuuagaaagaacccaguucacacaaacaacguuugagaggugagagaguugaccuggaaacuucuccugucuucaggggccugacaucucuucaggaaagaggcugaagccacagauacauugugagaccuggugggucuuuguguacaccagcccagacaguuaccagccccaagggggcucacuuacuucgggguucucgggggccguccacugugauuuugauggcucuaugguagguggcaacuuguggcggauuuguaaagacggugauggucagagugaagcucuugccuguggagacaggaaacagaacagaacauauugagggguggucugagccucucuaccuuaugucagucuaugcuguccagcccucaagcuugaaaggcaacagagcuggggcaggaggacuuguucuccugguacaccuagguuuuguuuccaaucuggaaugcacacaguggguucaccauguaaugcacacaguggguucaccaguuauuucugaucuguaaugcacacagaggguucaccagguggggcauagugcauagucacauagcuauaagucaaucauuaauuaccaauaagauccaggagaucagaauuuacucccauaucaggacuuugggaauugacagcugggacucauaccuaucuacugcuaaccucccucugucuucccugcauauuuguaaaauccaggcaaaagaauaagaaaagacaccgucacacauuucucucuuuacucuguacuuccgaggauuagagaagacugacuuucuggggccagggguaggucagcgguuagggugguggucuagcaagcaugaagcccaaggaucuaugcccuaugccagcauuguauacacugcgugccaggcugcacaccuguaaucccagcacucagguaacggaggcaggaggaucaaaaguucaaagucacccucagcuacucagugagugugagguuagccucggcugcaugagacucugucucaaaacaaaugagcaggccaaccaaaucaacaaacacugaguuucuaagugugaaaacaugcuguuagcauucugucuaaacuccaccccacaguuaccugacaauagccagguaggccugacccacuauaaaagggguugcuuguccccuccucucucucuuguucucaugcucccuugcuucucuuuugcccucuugggcucuucccuuccccccuccuuccccuuucccugcccccucuuuccacguggucauggucagccucuacuucucuacucucucccucucucugcguuucugucucugcuacccucuuaacuccccuucccauggccugaauaaacucuauucuauguuauaccgucauguggcugguacuucagggggaggggaugccucuacccccauaccucaccacaccuccauagaacauauucuuauucucuaucuuuuuauuaacacagcacaugcuaaauuagauguuauucucuguaccuauuagaaauugaugcuugaugcuaaauaguauuuauaaauacccaaugacuagaugcuacgaaagcauggcugggauaggacagagcaagggacauagacaggacagacagagcaggcuucaggggguggauucugguuuaaauuccagaugcuugacagacaagccacuagaucuagacuucucuguguucuuguucaggcucgguguucuugccugaaaauugguauaggcaauuuucccaaauuucuaccuuuugggcccgagagaaagauaaaugagguaaagcauuguaauggugucugcccauggggguccgaaggcucacaugcacgcacgcaccucuccccgucucagagcucuguauggaaugcccguauuuggccgggugcaauauuaagucuucuaccuaaauauuaguuccuuagcuaguacaaucucuccucuuacguaguacacaaugaaacucaagggaaaugggaacaaacuguguccaaaaggcacuggcuacugcaaaacccugcuuacccgccuaaccuccuuagaaaaaccauaccacuuccagcugaaaguggaaggccacugagacauuucccaagaauacaaccuauaaccagagcaagcagcacucccuaucaagaguacaguuucccaaagacccccgagccucugaagucugucugcuagucucugccaaagagaacaauagugucaggcaagguucaggaggaggccucuugugcaucuugagaggcccaguggaccagacaggagugguuucuggagacugggguucuacggcccaagagacuuuguaccugaauccuuccccagcuuccccaggaagaaggcugccaggcucuggcacuugcaucagacaccugcggauacaccaucaggggauauuccauaugguuuucuaccuuagcaucuagcagacuuggagggaugguccacagaggcugagggugggcauguuaagaaugguguucugauguguaaccugaggaaguugcucaucguucucuguagccuuugacuguguaaaggcagugccgagccugcugcuguacgguaagcacccugcacaccucacaaugggucuuccuuucucaccaagcacccaugauggacgggcgagaccuugguaucaucaacauggaauccuagagccaguuuccagaaucuucucccuagaacccgucccucuuucugcagcucaugagcucagcucuuuaaguagugccuccagacucugggacuucuguacucaaccccacuucuccagccacccagauucacucucucaagucuucccaacuucaaggcccagugagucucccacugaccugcuucccaggugaccuuccccgaaggaagagucugcuugugacuaguuccgauuggccccauaaaucacuuuucaccuugauuaauuaggccuucugcuuugacagcauuugugaugguccaagcuuaaucugccugggggugggggugagggugggggcagggcccauuucuccaaagccucgcauuccucagaagugagaaaggagaacaggaagaggcucucaggcaauggaagauuguaaagccaaaggggaaauagguaaaggaccuugaagacaccagugacugauagguacauagcuugguccugagcuggccuugguguguguguguguguguguguguauguguguguguguauguguguguguguauguguguguguacaugcgcgagugugaggagagugaacagacaauaagaucaggugcuucuauauagagcauucgaagaguuggauucucccacauuuuugccaaucugggucccaggucaagaguagcuacuuguggaauagcucacagaucuuuucugauagugucuucugagcccgaggcaguaagaugccuacaugggagcuuguagcucgguaacagcucaagguuggggaguacuguagcaucuaacauucuccaaugcuggcuucagccauggcuugccugaaaugcgucaugaaggucucgaaugaugucuuccaaaccugugacuaucuagcacacugucaccacacacagaaucaugucaucuguugcuuucagccucggaagugcaaagacuucaagaacacugaguucaagcaaucuuggggcugauguaauacagugcuauggcuuaaugcacacagacucagucucuuguucuggaggccacaaggccaagaugaaggugccuguaagacaccuuagguggcaaugggggugguuggcuccuuccuucuccuucuccugacuuccuaagauugucaucaguauugaccuucuggaggcgcuguggucucagugccccaauuacugcuucuaccuuuguaugcugccuccuuauaugcccuugucucugaaucuccccauccuuagaagcugucaugcaugagcuccacaugaaggccaucauaggugagcuccacaugaaggcuaacacauauggucuccacaugaaggucuucaugcauggccuuaaccucacagcaucggcgaauuuucuaaauaagaacauguucagagauccuggguggguggagaccauccaggcacauucuucauccuggcacaaauacagagcauccugggcuuagcauugcaaggguuucucgacucuagaacagcucaauucucaccagggcuccuuucauaacucuacaaugaggaaucucguuuucacaauguagacauguuuagguguaugcagaccuuccaaugcuuccgacacauuccgauggaaguuacuucauuugguugucagagaagacccgugaaaugagcaagauggauuuuuaccaguucuuaaaagaguguaaggcaaagacuuaaacaggugacuuugcauccucaaaaaucacucagcucagguuggcaagauggcucagugggcagagggacuuacugccaaacgggacaacccaaguuucacucuugggauccaaauaguggaaggacagaacugacucacacaaguuauccuugaaccuccauagauaagccacaacacacacacacacaaauacauaauacagacagacagacagacagacauaaaauauuaaccaccucacuuaaccacagagggaaugacccuaaacuuuacacucacaaccuuugugcuuccaccauuggcguauaaauggccaccugugcaaaaucuaaacucaggagccuccacucaccccaucucccacccacugcccaacuaccauccuccaaagugaaaauugccccugugacucuaaugugcaagcuguucuaggcagcugccuacgaacaaguucaggacucagcggcagucucuccuggagcugacuggcgcuuccagaagguguaagacugugagagugucggcuuagccagagacuagcugacuuaggaaagaaauacagcugugacccccaacugguauggccacugcucagcaccaugguuccuaugacuuuauggucauccuuuaaugugucaauacgaggaauuccacuuagugauucccaccagggagggagauuagggagacugcaugucuguaaugggguucaccugggaggagauaaacugguggcaauccccacgaugggcucggguugcagcugacgugugugcauguguguguaugugugugcacaaacacacaugugcaguuuuauguggaggccacaggucagccuuagacaucauuccucaagcucugcccaucuugugauuugagacaggaucucucacuggucuggaacucauggauucagcuaggccacugagcagugagccccagggaugugucugucuccacuuccccagaacugggauuucaaacaugcauuacaaauuuaaaaauuuaaaaccugggcucuagggauagaacucgggaccuccugcuugugcugccaggauucugccaacugagccaccuccccaguccugguaagagcuuugaguacaaggacaucugcuuaugaucuauagaccauggugacuuuuuugucacccugguucuaaccugaccuccauucuuguuuguauuuuuccagcuggguuuaggcccgucccugacaacggcuuccagguagccagaggcacaucucggugcucagaauuacagaagcugcaagcucugcucuccacccacccaggcccgugguugcucagacacagcccugcuuggccagcaccugcagacgugggagcuagggccuccagcgcacauguguuguuagccaaauucccuuauuaaaaugaccuaugggcuugguauuuuaaguacaugggcguggagagugaaacacucucaaguguuuuucuccgccguaacuugcagccgccaggagaggagagacucacaagggaccgaccuagaggaguaccggucagcaaaauaacacucgcuuuccugggaucuucagggucuaaggcagggcagagagacugggcuguccaagacuucauguuuuagucuguugccugaugggagaccccgcuuucccagaaacccuggcuggccaggacauagaucacuuuggugcugaucaggggcauuggcuggaggcagaggcuuuuggugguagaggggcaagcgguaagccacugaugcucugaaucauccagccagugagagggccgacagagagggggaagccucgaaaucuuuauucugcuccugguacugaaggaacccgccgcaucagcuucaguggauggcugugaucccagaggacugauauuugacaggagugacaagagggcugaaggcaagaggaaggagcaucaaaaaagaaagaccaggggaagaagggggaagucuggacucagccaagcauccagagacaaagcuugcucagaacauuccagagcuggaaguacauagggagagggcuaagugugagagcucagcaacccaguauacccguguucgaaucccacucguugccuguacagucauacucaagggcaacuuuguuacugucucacagcccuagcuuucucuucugcaaaauacaaagugguaacagcuuuugugagcugcccaaggacaccugaugggggaggaauuggggaagaggaggaacgcucaacaggugucagaauugcugcucagacugauuucuacuugaacuuggcgguucauggcugcaucaccagcuggccacccuuuaaggcaugacagcgaggggcugauccacuauauaaacaagccaagacagcaacauguggcguccuccucgacgccagucugcccauccaaagggcagaacaaaauacgaacugcuuuauuuaguuggaaagaaggucacggggugagccuuccuggacacuugcuggggcuguggggcaugcuuugcaaggccaggcagucccagggccucaggggaggacucagugguggacacugacagcccuggggucuaauacagaaucagcaggacccugccucucugucuagccugagacacacugcuucccuuugcauguagcaaaugacuaaacugcaggaucaagauacuauaacacuguauauggcuuccccuaggagggcugagggcaggaagcaaaaaguaagcaagaagauagguggcugaagaucacugcuugcccaggcucuaaacaucacuacauuccagcuugaccccugccccgcccuccaagcccguuggccuccagucucuugcugggagcccgcugcccuucuuggccugugggugggcugcucuauccccaccccccaccccccguucucaguggcuccguaacucucauucuccuugguguagguugggacacaugagucaucuucuccuuuuggggacuguuucuggggaugugaaacuugcccuuugucacgaaaaggaagauuacacaugcaaaggaucuucugcccgggggaugugggguagccauuuuccuuaagcaguaccgguaacaucccucucuuugugucucucugagggaaccuucugcacaguugcuacuuuaggcaccccaaagcaaguggaaggaaacuuucuuuuuaaaauguugccuuugaaaaaucaaaacagccaggaagggcugggagggaggucugcucuucacaaacucaggaaauccccgaagauucuccaagguuacaggggaccguagauuaugccauguccaauucuggguacaaguaacucugagcauggaaaugcacgcacccaggccagcgacagggcucagugaguggaggccugcggccaagcccagccaccugaguucagucccuggcaccuauacugaaaaaggggagacugguucccacaaauuguccucugagauccacacauguguacacaugugcaagccuaaccacacacacacacacacacacacacacacacacacacgguuggggacuuuuuuuuuuuccaaggaaaugaaugcucucccccagauuccagggauaacuucuguguuugcaggauauucccagcaugcacuuagcauuuccccccuuauuuucccaccggugcuuccuaacagccggcacuuacacguguguccguuccauuucccuuccucuugcuauuuccaccaugaucuguugacgguagaguugcauaauuuacuuagggacuuauaggcaggacacaacccauuggacuugcacagcuucuguaggcugacugauauucgugcgaagagccccuguguccagcuggccugacccuguccugucuguguccauguaggcagaaugcagaccagagucucugcucuuggccaacguccaagccucaagagccuaacugaaaacuugaagcacagaacucaguucuccauagaaacaaccuuugccugguugugcggagugaccagcaguuugagagugagccauccacuuggagaaugggaaagccaugugugacauucucuggaguucucuggaagugacucaguagagcucaggggcugggcuuggacccuauuugugucuuuuguucuaauguuauuuaaauuaaauagagcagggcgcuuauaccccacuuuaaucccagcacuagggaggcagaggcaagcagaucucugugaguuugaggucagccuggucuacagagugaguuccagggcagccaauguuacacagagaaagcuccaaaaaccaaacccaaacaaaauaaaaaaacaaaaaaccaaaaaaaaaaacccaacaacaacaacaaaaacaaaacaaaaaaaggagggcugaugggcugggagaugcucaguagauaaggugcuugcugcacuagcaugaagaccuguguuuggacgcccagcacuugugucaaaugccagugggcaguaggcaccuauacccuauuccuggggguugauacaaauggauuugggggaggggggcugccaacugaaauggugaacuccagguucagucagagaccuuuccucaaaaaaaaaaaaaaucccaagugaugaaagaguguggacagcagcugcugcuuccacauacacaccugcacacacaugugcacacacacauacaagcuugaaaaagugaaucaacgaguucugccgacuuucagcgauggcugccccugccugggaagcauggcuguacuugaugugcuggguugaaaacaaccuuagggaaaaaaugaacgcaguggguccugucucugucucugaggguccggcccaccaccgcucaaacauacaggacagagauacgcaucugcugugcgacagguaggguaaagucauucugagaugacacaaacuagauacagaagaggagagagaggggauugcacacaaaugcuauaccugugcccauuuuaauaagguaaggagaugucuauagauucugccaucuugggaaacauccuaaaauuggaucagacacuuauaucgcuugcccaccccaccaaagcaccaagagagucccagggacucugcuuucuuucuucacgcugcauguucucuccugucuuacucacuuggaauccuagccccacauuaucucagaugacuagccuguuuuuagcccagacuugcacaagagucucuuuagauuaaggccgcgugcucuucuguccuuccauucagcgacuucuuucguugauagaugcccagauuccccaggcugugcuggucuaucugccuuguguaggggccaugcagggaaaaagccuaagguggcuucccaaggcugccugacuaaucccccgccuguaccuguggccuagagcaucaugcccacagcaaccugggcaggagcagcagggagucuggguaugggugugggcauucaggagggaggggaguguuggggucugcaguuccugcucagcaucuucuugaaccuuugcugcucugaaaggaggcagggcagguggacuggaugcuaauggaagagaggaaagcuggacaccagccugaggugggcgcuaaugcuaaauggggcuauuugcgagcucuccaugcacagaucugaggcugccugagaggagacacuaguaagacuggucucugagcaccccagacccccaaacaaguucccuacucugcacacugcagucuaaguuugugcaccacaccugugugucgauguacgucucugccaaggaucuguuggcugcucgccaggucacuggcaucagaccuagugcccaggauggaugucaaggcccuuaaagcauccucagcccccuguaugccaaggccuccagagcaggccacccucguaucucuugguuccucgacagacaaggcgcgcccccacacccccgccaaaugcacacucuguugccucccauagguuucaagagagacgacgaguugcccggggaaaccaucugcccuucgcuagguuacacacaacuuguauuugcccccguugcaccuguccuuugucacagagacgucuacacagaacagugaaggccugcuucacugucgccccucaugaacccuugaccuugagaacgccucuucagcggacucacgguccucuagugcuagccgacacaauaggugcacagcagaugugcgaugaugaaucaagaaauagaugaacggggacauggcaagcugaggcaggaggaucacugugaauuccaggccagccugggcugaacaguguucacucuguuuccaaaaaagcaaaagagaagaaugaaugagugaaugaaugaaugaaugaaugaaugaaaugcucucccuaaaugccuuuaggagacgggguaagcaaacagacacagggaagggagguagguugcauaugcacaacacacagggcccagacugggcccugaaaaugauuaguuguuuauuacuguuaugcaugcauugauuuaugaguaauugugacgccuccguuuuaucagguccuuagcagaacaaagggauaaaaguccccugucguggaugagaggcaguaggaggggcaccuccuucccuaacuuccugucaucuccucccuucucuuccaacaaucccacccuucaguagaaagagccgccaugccucgucuccuaagucuccucauaaguacaccaucuugcuauuauuauuauuauuauuauuauuauugcuauuauuauuaacaacaacccugugaggccugagugaaaggcaccaccaugcccacuacacaggaggaaaaaccaaggcucacacaucucagggcguccugagcacuucucagccucccucacaccgccuuccaaagacccgccgaaucauucugaagagauacguguuucuguggaauugcgaugaaucagaggaaucagguggcuuuagugugacccggaguccaggaauuuggccagaauagaagucaacggugcagcaagagguggcagcaaaccucagugcacaucaacucucuguguccaccagagaagacccaagugugagcacucccuugaaaauuauuaaaaacaaugagauaagaauagcuucuaguaacacgggguggccuggagcacugccuggaggaccguccagagcccguccacccgggucacacagacauaaaccuccccuaagcuuggguggagacagcaguuaccacucgggaagaaugcgaugcugccgggugccagccugcacagcucugcuacgggacaaagggauuauucugccccauugucgaaacgcacuguuuauugugaaaauacacacgggaauuagaaggggcauguaugauucauaaauauuugcaugcuauuaacgguuggacaaaagaguuggacuggcuaaguugggagaacuucuuuucccaugaaaaacagugcuucauauuacaguccauauuuaauuuccucucucccauugcuaaucuaaaaucucagugcccgcugaauauaacccuuucgggcccucagagcuccaggaggcugguugggcaggaaggguaggcuaggaggcuuucucucucagaaauccacaaggagccacaagaaacaggucuaucagugacccugccaaugucccugucuccucuagggauacugucccugcugagaccugacccagcauggagacuugagccagcuuguucugacccagggaaggcauaaccuaaccaguauccagcguuuaucucugaaaucgauccucaaggcuccuccuucuccucccuugggcaaaagcggcagagagccgacaggcacagagggaaguuguucugaaguucuccacccucaggcgaggaggguugauagagucugcagguauuucagauugucaccaugaggaagguggggguugcugucaaacauucaacaaagcaugacacaagcauucuccaauuuuccccugauggaaaggcauccucaaggaaaugggugcucuuaagugucaaugggagacauccucucugcucucuguuaagaagaugguaaggucuacagccuagagccguuaaacagugcuaagcgccuagaguugaacauuuaagcagggaucuaaggagugagugagugccuaccugccaggcaggaauuguccacugaggguaccacugggcagcucugggggggggggagauaucacgaaagcucauucgucugggcuucuggacacguucuuauucauuuacuauuucuuuuuguuuguuuguuuguuuguuuuuuacacacaguuucuuauacgccaggcuggccuggaacucaacacaaagccaagggugaucuugaacuucugagccuccugucuguuuccucuuugacucagugugaauaccaugaauuaaaauuuucgcggauuuuuuuuuucaaggaaggaaaagaguggaaggaggaggagcaagggagauagauaucuaacaacuucuggaaguguugggucaaguccggcuuucuccaguccuggcacgauuaaaguuuuagaauuguucuuuguugggggugggaggggccauucugcacauaauaggguguuuagcagaucuugggccuuauccacuggauaguagggaccaccccucaggcuccgugggugacaaucaaaaacaucugcagaccucauuaaaugucccuuaggggucaaaacucaucccagcagagacaaacuaagcaagaggcucaucaaaacugaucaaucacugaccuaggaaagaagagggaaggggaccugccucuugggugguuuaaauacaaggaugaaaauggggcccuuacugcaugcagguucugcagacaucguuuaaaaagacaaagagccuuaugaaugauccagacucagauagcuucucauuaauaagaggcagaaacugauagaggcugaauauauuccauacagacaucucaaauagaaauaaaaaugucugugaagacccacagccaauacuguaaucaaacaagaguccuuucuaccuccagacagucccucccuucuugucuuauccacaaagauccgauacggaugcggaugaauuccauacaacuccuuccuuugcauaaagugacuggauuagaggcacacaguucucuagaggacacuggccagcccucccauucucuggaccugagccuccugggaucagguguuggggaggugguaccuuuggguccauguguucaugaagagggucuuaaguuucuaaaagcauggaguacuaugagucagauaauuugccuccaauucacuuccaucuucucugagaggcguggaguuugcguggcuccugaguguuuccuccuuggcuuaggaagccagaggcaacgugcuggggcuccagcacugcagccugagccugucacaggagaccacugggauuucuguacacucguggggacccauguagccuggcucgcuggcuggagagugucugggcauagcaaauagaguucccaaacuggauagacuguccaauauaggcuaauagaggcugggcuguaagcuggaaccccaacgcagugcagaguaaaacuggacgguacuguuagcuccacccuccacacagccccaaacauguguggaugugagauucguugcagagccaggcacggaggacauagagggguugccugaaacgcacuagugcauguuuacaaacacaggcaugaagugaucagcuagauuaccguuacccacccgcucccugauagguggcuggcacgcugggacauuuucacagacagcuugcuuauccauucuuguuaauugcuugacuggggcuucaugugcacuggggcuucaagaacauuuuaguccaagaacucucucaaugaaaguagaggcuccucugccuaacggcccaacagagucuacaaacagcacaccacuccaugagucgguccuauguccauggguccccuggguucaagaaguugcaaucacaaauaucuguggggaaauccauuuguacugaacauauauguggacuucuuuuauuuuuauuuuuuuuauuaucauuuccuaaacaauaccacagcaacuauuaaugugcaagcgauauucuguuagcuagauucauaagcaaucuaggugugauguaaauuauguuagaggguguccugaggguuaguuacuaaggcugugccauuuuguauaaguggcuggagcagcugcagaugucugaauugaauggaggggguuucuggaccgaccuuccauagacaucgagcgugacucugcagucauucuuaaacacccccuacuguucucagcuuguuuuauaaucaacagcagggaggagacacgcaccagacauuacaccaucucucugcuucaacaaguaauuuuucuuuaaaaaaaaaaauccugaaacagaauauauucuucuauaacuagcccuagccuacuuccaguaccaaaaagaaggugaagaagaggaagaggaagaggaagaggaggaggaggaagagaaggaggaagaggaggaagagaaggaagaagaggaggaagagaagggggaggaagagaaggaggaggaggagggagaagaagaagaagaagaagaagaagaagaagaagaagaagaagaagaagaagaagaagaagaagaagaagaagaagaagaagaaagagcgagcuagcagguugauuuguuagaacuauucucacugaguggcuagcuggaucacuguuuaugucuaugaugcugucaaacaggaaauucuaaaagucacucaaccauuauuccucucacagguacuuucugauugauagucuuuaguccugaccaaaaagggcuggcucauaaggaaagccuagcugcuggggaagggauggagggggcuccauaggagggcuggagggcugcuucugccccacaugggaaaaauccugcgcaugcaaauaaccucagcuacaaaaagcuaccugccgccaugccuggcacuuuguaaagcccgcugggguagagcaugacacuacaguuuccaucagggacagcguccagcgggcagcuccuggucccugcugaggcuccggccaccccacgcuuuaagcuggacagggagaagcuugcuugaggaaaguguugcuaacccucuuauuguggaauaaagagaaggggaaaccugauccuuacaggcagauucugagucagugcuguugguucuggggugaagcuuguuggccugcuguggaaaggaaguguuugcuaggaccggccggggcuuguucucugaggggcccaggcuucccuuaguuuuguuggcuuuugcuuaguuuuuauuuuuguuuuguaccauuuuauuuuuguuuguuuguaguuaaauccgaagaaaacagacuuuacuacaugcgcuauuacaaaccgugaaccaaaaaaaacagaaagaaaauggaagaaaaguggacauuggauuuuaacauagcgcacaccuuuuccuucuucuuguucucccuaggagacccaacaaucaguuucuagugcuuacauggacugcucuccgagaaacaucccuagggguggcaguuggauuucuucuuccucuaugaauuugugaucaaauagagaaugauaugaauccugugauaacaucaugagucacuaagaccaacucucccggaaaagccgcacaccaaggcggcccucccuuuuuggagcgccagaacaguuuauccuucccgcaacgcgucuccaccacagccuuccgcucagccgagagagacaacaucccacacuguaccccaaaucacguaaaagcggaauggaaaugcuuaaagaaaccgacacuacacaaauaugaaggagcccagacugugacgggauaaauauuaugucugggggcggggaggggggggaggaagaugggggagugggguggggguggggacaucaacagugagaguccaggaaggaauuucacuucagaaaagcacaaacugggcaaguucugagcugccaggaugucagcguaaacagcagauuccacuaagaaaggagaccuguuccuggcaagcagcagacuacuggucuucuggggaugugcgugcaugucacugcagccaggacugacagucacuagggaagagacugcucugccaaugguggcuucgcucccacacagacgauuacauccagccauaugccuagugguccaccggaugccugcccuggccuuuuaaauugcuauaccuuccuacccucuaccaaccagguccugagucuacagauaucaccgccauccacacaacagagaagcacaggaaaaugucaaccuuguggguccucauguauauuuaucuucugaguaugggcuguguuuaagacuuggcauugaacugacccucagcaguccaagacacguuccagauucgcacguuuuaguaucugcacgucccaggaagauccauaaacaaucccgaaacuaagcugcacuauagaaaucugggcccgugugcauuuuuuuuuuuuuuuuggaccuuaggaaaucuuuggggggauuuucagaauuaucuaugacagcuuccagagauuuaaagaaucaccaacuuggaacaagugagcauuggcucuggucucccuccucacauuugccacacggcuguugucauguuugguaguugcgugaucuguuucccugugacaggcaucguuaaagcuaaguucacugauggaucaagucuucggcagcuggugaaacaccccagcaggaaauggguguuugcagaugucacugccaagguuucuuaaauguuugucaccucacaccccagcucaugggagcaaguuacagaccgagaaaaaggcucagcuaauugaccucccucaugaaagagaucucuuuuugacccugaacucggagaugacugauaaucucaggcccugugacuaaagcaugcauuguucugggcagccuccugagcgcccuccuaaucucuggacuucagagagggucucccaagaucccgucugauuuucaccccacccuaaacucccaaccgggagcagcuaucucuccuuccuuuguagagccccacagauaaucaacaugcagauugggaaucaaagggagaaacauuccuaugaggagauacacccgagcugaucuaaaggagagcaggcggaagccauggucauggaggaagcaggcaggagcuuccucugccuucaccagguuuucacaggggccagcaggcagccagggcuuagaagccagacaggcagguuuucccagucacaggcugaaccugagguuagagcugagcaucagccagcucccagacagauccauuucuuggaacagagaaaaauccuuccuugguuaacuggcaguuucugugagggucacaauccucaaaaucuggcaucugguaacaagaaaggaggguguccauucaugucaucucuacccuuuaucccacacggaguacccaggccccuccgagaagccaucacugacagaaucccaaacugaccuuacggaauguggauguguuggaaggccaggaccuucugggccaguguguggccucugagggcauauuuuuaggcacauuuaaaaaaaugaaaaaugaaauagucgggucuuaagaucguuccauaaagcauaaugcaacuuuuaaaggauaagguucaaccagggagauuagggcuaauugugagaauuagugagagucauuucuucaguuucuaaugggaagcaaaucgcaagagagaaggagagaaagagagugagagaggguggggugggcugggcuggggaauauccagcaggcuuugauggcaugaaaaaucaaaauaaaaucauauuuugugacuacaaagugaaauuaugagauaaaaccauguuuauuacaccgacagcucacuugucuugguauugacaugaaaaauuuaaaccauaaaaacucaagaccaacauuauauauagaaaccauaacugggucaaguggucaauuaguccuccugaguuuuaauuacucguuaccccucaugaagaggagagccugcucaagucaaauauaauccaauuuuuugcaucugauuaauuuuuuucauuccaggguaugggaaaccagccucgccuugggugcugcuguuuuccuggggggggggggcgguuaugcaaacucaagugcacacuggcacgaaucagacagcagagugcaaacacuccacgccuuggggaaacaguccauuguuccucagguaaacaccagcaccucuuagucacccacucaaaacagaaauggccaaagagggauaggcgaccagcacauagcaccaccaagguaggcaggcacgcugcuuucagaaccccacucuugaucaucaucaacuggcugccacggucgucacaaagccaccaugcaacucccuacgggaaaaugucacuggaauaguccauuaaauagucuucgaaacuuccauagccaaacaugacaaaaagacccacuuagacgccuaggaguauggggacauguucucuggcaacccagcuagauccuacgaacuaagcuuauugcuaggcaggugggcgugggccuggcuguuggggucuuccuuucuucuuggcuucccacccgcucggccagcgacucaucugaaaccucccugauauuuucuaaacacaugccucugaaccguaaugcgaauuccauuugcugaaaggcagacuuucaauauuccaaguggauccacuuaagggcgcaggcucucccaggccuucgauaaguggguagacucuucuuucaaucacccuauuauuagcacaguagcgcgaacacauauuuucaauaacauuauauguucucuacauuuuuuucuccagcugugacaucauucugaaaaugcccugggcaucugggggcagggguaggggagcaaacacagaaguccaggcucacacucucaacucucuccucuuucccacuaugaacacggaauuuccacuguucugaacgccuucagaaucaguaguaacaaucccuuugcuugacauuucuugucuguugccagucuaccugcuuuguuuugcuugcuuggugcuggggaucaaacuaaaggccuuucacacggaaggcucuaccacugagcgauggacacgacuagccccucccugugucuuccccucucugagaacugaucguaugacuuagauauaugucauuccgcuuugauuaagcuagagauaucauuuacggcuaagaucguucaauucuacauuacaaaggugaggguuuaagcgaagaccuugcuccuagacucucacacggccugcugauguuuguaaaaugugccguagcuccuugaaaugaagagagaacacauaccucggaagauaacuggaaagcagacaagccuacagugagagcagguccucuuucuacuccaauaguuuaauaacugguuaaaggugaggcauaauaacugcauguccagcugggcuaaggaaauaauuuggucucucacaugagcaguaucuaaauguuaagugagccuggcuucucccaccaaaccauacacaaagaaugcauagugaaggucacacugcucucagauguaccaguaagaguccauuuuuuuuaauccuaggaauauaagcuuacuuaaaacuauaucaauaaggguucccccaaaauuauugaugugaccaacugaaacccugucgcauguucgagggagcguaaguaccauaugauaaaggcucauggcuuugauuaucccauagugaccacccauuauacaaucucaguccucauucuggggugguucgcucacuuaucucaguuuaggaaaacgguggaauguuuuauugaacuucacaauucacgcaucacacacugugcguuccaaguccaucacacgcugugcguuccaagucaguuguaagccaauuuagucaucaaaacgugauaauauccaguuguuagguaucaaauaaacauuaccuuaaauaaauaucauuaugcugcaucaauaauaagaaacggcuacuauuuggaaaacccggguucgaauuucacacccauccgugacagauacgcaccucuaccgcuccgcccgacaaaccugaggucguugaaucucgcuaccugguucuucauggccgcgguagcauuucucaguucugccgaguaguuuucaucguugccugccaugacggugaccagagugccauccgggacgucccccagugccaccaccuagacgucaaccaagggacaaaugcagacaucagugcugucacaggcaccuggcugugucauuugucuggcaauugcgcugauguuaaacuuaaugcuuaauggugacacuuucuaguuuauagaagagccguccgucaucauuugaucaucgugacagaaacagcuugcugugaguccugcgaugcagagacagguguggauuuucaaauaaggaagacacagagauuaaaggagaaaagccacagaaggucacaggacacagugggaacaagacaagcggggacaggaauucugaaaagcuacuacuguuucucauugguacaguuaucucuuaagaccucauauucgaaagacagaaagucuuguguuuguagauuugugaucuaauccacuucaaaaaaagauuuaucuuggcauuuugaauuaaguguaugugggugggcauuuucuugagagcaggccaugaaggccagaggagcaaauuacccugggacuggaguuguaggcagaugugagccaccugacauagguucuaggaaucagacccauucucuguaucaugaaucauguugguaaccacugagccaucucucuggccccaccuuuuacuugcuuggccccuucuuggugcaccuaaggaaaccuggaugaaaguauuuaaauuuaguucugcucuaaauuuguuacugguuguuguuguuguuguuugaggcagggucucagauagcccaggcuggcccccgccucacuguaucuugaacccuugagugaucuugaacccccgaucuuccucucuucucugcuagugcugggguuagaggugugugugccacccagugugcagcuuccaaggaugacccggaaauacuuaaacugucugucugcagcuaaucucuggcaccucuuccugccgcucuuggacacucaccagcagcaaacucuugcacccaaggagaaaaacuagacacgggccacuucuuuauuauuaauuacaagcgggaugaccucagugacuacgggugcuccaguguggucauucuccucaaaucaaagguagaaccagacugcugucuggcaucuguaugaacuguguucugggggauuccguuacugccacugaaaagguaagggcuuaguauauuuggaaagacaacuuguagaugagcuuacuuuauauccagaaaaccaaaaaaaguaguaauuucagauuaaaacacucugaagccuugaaagugcuucacaaaacauuacccacugcuuggcugcucuuugguccuuuugguuuuguuuuagagagcuaugguuucacgauggagccuagaauggccuugaacucccaguccucuuagccuucgaggucaggauuuacaggugugcaccaccaagccugccguucuuugacuucagcuaaaguuuccaguuuugacuugauaucgguuauguuugccuuguuccauauucaaagcgaccacaggauuucaaaucgccaugccccgagaguucaguuuguuccaaccauuccagacacaugcugucagucuucggugagaugucuguuauuuaucucaguuguguggucauccucgggcagguuuucccgggauggcagcagaaacaucucuucuucuacugccacuuuguuuuucucaguuuuuguacacuggcugcuucacaaucuaucagagggauauuucucauucuguaugaaauaaccccgccgcagaucugcuaaucugguaucaaggucuggucucucugcucgccauucuuacugggugcuuagucaugucuccuucccgcuguucgauguccugcagauggcuaucugggcgauuuuauucauuguggcugcucuaucuccugcguucuaaagaaccuaugucaggaaauugccccagcuacccugagaaauggacagaggggaccccuaggacaucacuaggacacucugcucucuaggacuggguauguaucuugcuaucucuuuaauuuuuaucuguuuucacucacuugcuuugugaaacaaggacccugcggccccuugccucugcuuuuaacccuuucaugucaacuguuggacguguuuucuacaaaggagauuuuaaaaacgcuuauucuccaagcaauauguaauuagauguuucuaucccaccacaaauguuugaugccuuuaauuaggagugguaauaagacaacucuuuuguuucaaagaacaucauugaaauaaauuccccugcucgguuaauugaucauuauuaucuuuucuuucuauuccuacaaaauguuacuccuguaaauucuguuuucugucuauuuuuccccccaucucucucaucaauguuuucauuucccucugcacaguuugcucacaaggaugagauacccucugugaaaaugcuucacuuccuugccuucaucucccuguggagaccuaggccuuuccaguucaucucaacacccacugggcuccgagggcacugaaucgacauccgggcuuccagucugaaugccugacuguuggggcccauaucuccuaagaggccaaaaugaauaaauccuguuccagagcgcccaaaggcacgccaagucaugaauucccacugugccccaccgugccucaguuuaccaugguuguuccagggaucccucauuaccaagaggucaaacccaugaggcccccucgucuacagcacaagaggaccaugguggccaagaaaagcuuguugauguuggaauucaaaagucuaaaaauuaggaguuuaaauugcaucacccccauuucuaaaggaagcaggaagggggcauccaguggcucgguuacuacuucuugggcuuuuugauuuaucuccaaagaguuuugauggagaagggaaggagacaaaauuaaauccagggacauuuaacucuguacuuaaaacaaugacaagcacaccuaggcuagguuacuagcacuguuguuguuuuauuuaaagcuaagaugucuuccaauuugauauagauuuuugucacugagagaugauauagaaauaaugaaaagaaaucaaacuucaaacagaaauacaaagcagugucugcaguaaaaagcuauaaacaauagguaaggcaagagaaacauuuacauuuaguacagaccaaacagacaagaagggacuugcuggcccaagauagcucauauuuuguugaacuucucuguucuucaaguaucaggaaguugggccaaaugucagcugucuucucugcucugaggacuucccagcacuguucuuggcuagccuauucuuaguuugaaacuggcauuuuccaacaauuuuacagguugaaauuaaagcaacaacuuaguuacugcaaauucucuaaucuuccagaguuucaaagaggcuguggaauggaacguagaauuuaucugagaugacauuuaacacauagcuagggaucauggucuuccggccagaauuuuauuuauuuauuuauuuauuuauuuauuuauuggaaagcauauuccaucagcacccauggucuuugaacuucccugauaaagguauguuuauauuuuugugcucugguguaccaggggcuaaacaaauucuuuuauuacaguauuauaaaaucuacugcaagucaccuagacaacuuuguagacgguaucugcaaauauuguguaguauggagcagauuucccaguuucucggcagugaaauuaaguguuucuucuaugcugagauaaacagucuauagguggaaagagggguggaggaugggaggacuaauuagcauaauuuuaaucaauuuucaagggacuucaugauuguaagucuccugauaauucugaagauuaaagcggaggacuuaacaagauuccggaagguuccgggagaugcucuucuacaagugaucugaacagggcuucacaucauccgauuuuuaucugggggugguggcggcagcagggaauaggauaaguccugcaggguuaaccccuaaagagauuccggaaucuuaauucacauguaaauguaaagacuguugguagaaacugcuucuguguguuugguaggagcuggcacacagaggggccagggcccauagaaaauacagcaaggaagauggucuguuuccaaguccagcuuccucuuaaacccagccuuuaaaucuccuuucccuccgcaaauucuaucuacugacuggugagcuccuugaagcagccgucccucugugggacagcauagguggugacagauauuaauccagaggucugauuuuucaacuucccuguccaccgugaccuuugucauggcuccuggcugucacucagggaaacacacugaggucuuuccaaaaucauuuguaaaggggaaucucuacggcagugauuauuuuuguuaaaaggaaaaaauuauuuuucguggcuuguaaaggcaauguguaaggucuuuaauucuuuugaaaagaaaaauaaacauuuccaugugguagcucaagacgggaccacgucaacuccugaagaccauuuuaaaaaucaguuauuuagugucuugauaaacugggauucccugguagacuaagacgaagaagaacaaccacaaccacaacaauaacaacaacaacaaccacagcaacaaagcucagaaaagacccaauuucuucccucaaggaagccacagucccuuuagcuaggcuggcagggagaucuaccuuaacuggcccuuuccuugacuacaauaaguuugauuucucucuguucucugaaagugaccuuagggcugagcccagauaggucccucucaggguaaacagaagacaacaccagcuaaauuuguuuuucuaaaggaauugggacggauuccccaauacuuggaagggaaggaaaacccgagugccuggcuccccuucagacucucaaccccaccucuaccccuuuaaaaaguugcuuucacaacagugguaaagguggcaauucuacagacagagucagcagcaaauucuacuucuaugauuuuuuuuuuuaauguggauggucuuuuuagcaugaaaaggggaaccggacagcacuugucaaaaagugagcgcuauucauuguaauuagaucaagauccagcugaggccuggaacuacgaaaagcuuaaauuaaauuaaucucccuccuaaaugagacaauuauucagcuaaauugaaaaaaagaaaaaagaaaaaggagagcagcuucccuuuucagcucgggucccgccuucuuagccuuuuaaaaacacaacuugacagagucuuuuugcucucagcuguaccuuuuaaaacccaccucaggagaagaccaaagaagagaaucuaaauuccuccagcucccugccagaguuguagggugguucuuucuuucuucuucuucuucuuauucuuuuuuuuuuuaaaccgcccgagguuguuuauauauagcuucugaaagccaaguuuuagacgcaacacaaagcuagggcaagaucagggugaaaagcgaccugaccaacgugagcugcccaccugaaguugccgggucuacaaggccccuugcucaaacagaaaagcugcuggauuggaccuuuuugggugucgguagacaccuugucaccuuucuugccuggggcuuaauuuaggugagccagcgauaauauucuggagguuccagaaaaagcaacaggauucaauacuugcggcuucuggcaggagcaggcuacaggcucggaaaaacuccggacuuuggcaaacuuaaccaacuacuccuugccgcggacuuuggacacgcugaaucuuauagcgcgauuuaaaaaaaaaaaaaaaaaaaaaaggcggcggggcgugugugugugugugugugugugugugugugugugugugugugugugugugaucccuggcuguuucccuugguuuauuuauuuauuuuuuucuucugaccugaagguacuaaagcaucucuuauuuuauuuccugaugcuuucauuugagagauacaaaacggucuggguguucauccagagguucggggaaccuuaaggaagauggacuggcccgauccaagguucuaacuuuuucuauuucguagcaaagauaaggaaggcccuugguaggcgcucugaaauuauccugauuuuuuuuuaaaaaaacucccucuuggauaccucugaggcugacccucccgagggucgccacgguaacgcagcauccccccccccaucccaaacucagugagaaggaccagagacuucuacuacaggcagcacccuucucuagaagccgccuuagccucugcccccuaggcucacucuggccaucggcugaccuccaccugcuccucccgccacccucuucaggcaggaguaccuugaaagcgaugggcagggucuuguugcagcgccagugaguggguagcacggagcagaggaaguuggggcugucggugcgcacuagcucgccaggguggucagcuaguaccuccaccaugcugcggucgccgcuccucagcuugcuggccagggcggcgccgccauccggggcgcccagcggcagcgccucgcucaucuugccggggcucagcgcgguggaaggcggcgugaagcggcggcucgugcuggcaucuacggggauacgcaucacaacaagccgauugaguaaggacccugaaaacagcuccuacuagacggcgacaggggcucggaucuucugcaagcugcucccgggagaccaacauacaaguucagaagccuuuauuacuaccggaggguuguggggguaggagacuaaauuaccaucagucccggacugagaucuaguuacacggaucggccucacacccaagcaggguuagcaacuggccgcuuagugcguuaaaaagugggcaaccagaauucaaagucaaaugcccaacagagccucgcuuugagaguugaaguucagucuuuggcuauuacaaacggucccggaggcaaaauucccauacgcguccuaaaauauuuaugcgcagaacaacaacaacaaccaaaaaaugaccagcaaaaacuagauuuggaaguuccagcaguuaguugccugucaguuuguuuuucuuucuugcgggucaguuuuguuuagagucucaacaaaauacaaaacuuaggagugucuuccauacagagcgccccucuuaccaugaaaaacucacuucguuucucaaaagcaagagccguaacuuuaaaagauugugcuacuaauguaugugcucguauauauaaauauauacauaugaucuacuucauaaaauauuuacaauacaaucuguagagaauuuaaacacaacagaaauccauuaauguuugcugcaguuuuuuuuuuuuuaaguagccuugaaaaucagcuucaguaguuggaaggcugggauaggaucacuugucauuacucaauaaauucuggccaaauaaauggucagugcuuuacaaagaucuguagcuaaucuuaaaaaaaaaaaagucaaacucgaugacacucaggguagagcuucccacagcugaggacucugguuugggaacgcugguuaaguuuguggcugauccugugguuuggugggaguugagccgcaguugggucacacacacaggcagacucgcacucuucggaagucagccacugucuacauugguugagugagucagcccagagucuggcaagaugaucuuccuccaacgucgcccggcgguggcugguuuucugcuggggcgcacaaauacccacgagcgagcaccguguaaccgcagcagguggagcgggccugggaggaggcaccguagaccaguaggcucgaguuacacacgcucacucccacgcacccugccacgcacacgcaacuucaccgcucgccuggaacuccggaacacuuucucccgcaguugucaaaagaaacaaucggagaaaaguucacagccuagaaguugaaacauccaaagccuagaagccgguucauucaaaaguaagaaagggaaaauaaaaauaaaaauuaaaaaaaaaaaaaaaggaaaggaaaggaaaacaagaagguccaacgcagaucuagaaagagccgcaaagggugacuuucuugcgucucggggagcucaggauggaagugccagccgcggggccgggcagcguggugcccuggcuggguccggccgcggggcgcccguccugcccgcgcccgcuggcucuaugaaugagagugccuggaaaugaacgugcuuuuacuguaagcccgacccgaggaauuccauucccucagcucguuugcauagaggagaccgacggccaaucacaggccuuuccgguaucagccugggcgcggccggcugccgcgcuccuggaauuggcccgcgcgcccccgcgcgcuacuguacgcugcccggcccgggacucgguggcagccccuaccguccccagcucccgcacccacgccgaccccgcacccacaggcacacgcugccauguuugcccgaagccaggcccagguucagaucccacgccaggcagccacgcgcggugcugcacucgcccuggguggguuugccgggcgcagcggcgccacugguggccucgguccuggagaccccgaaacaggaaucgagagaccggucgggcuuggggaccgagggcugcguccggagaagcccugggccuggagaucagcgggagggagacgcccugugcucccuggacacaaagcugccaccgcgaggcuucagggaccugggcuggcauccgggaauggucccuaggcagccuugcacugcaguccaugagccaaggcuugggguccugggaggacagggugggauucggccgcaagaggguuggagggcugauggccgagugggggaagcucugagcgccucccugggccagacuagcagcugaggagaaguggcaccgagucauuuaaacaaggccagccacugcuccaccgcagaaguuuuggguuuuaagcauccucuccuucgcagaguugcuuuauuuagugucuuuucucugcggcugggcugcggcuugauuacgcagcgcgccgcguucugagugugcgcagcggcuggagaggagauaguuuucuaaccaaggccucaaagaacucuagacuacaaaaaaaguugaaagcaugggggacucaggccaccccgaacucaugagcucgaauccacccuccagcuccggcgggaguccggagcucuccuucaggcaacgaacccacuccgcuuaagcaauguaggggcaccucccccaccuuguucguccccgcggcgccgagggcauuuucgccgaagagcuuuaagggucuccuuccugcuuggcucgcugccggcuacuguccccagccggagcagcuggccugugcuccggggucccuuacuucucuugggccuugcuuccuccggaacuucuuacuacccacuccauggagcccgcuacuguccacauauugaccgaaccccuccacuuucaucugugcucgggucccuggcugguccccgcgugugucuuccuuccacacgcaucugcgcagccuggguuccguggaagaggaagaagcuguggaggucccggcacggaggccuugucugaaguuugggguggcuucucuugccccaggcggguaggagcuggcggcauggaggaucaggcaggccuuucacggucaugucggggcucagaccggacgccagggggcagcagcggcccucguuaggcguccugggaagcggagcagggcacugggcacgccccgacggcgcgaggaucagucucaccuggagguccuuagggucgaucuugugaguuuggggacagacauuaggaaguggccaccagaacccaccugagcgcccccgucucucagaccggugguagccgguccagcuugcaugggaaucccccggcuggugggucucuacugucgugauccacccaaauuagggucucaucucuucucaaagccucuuugccugggcuccgccuuaugcuaguucaggaccaugaguuccucagguguccagcgauugucagcgaaggcucaacuucuccagccuucuguauuuucccgagugggcccgacuuuccuccuucagcacaaagaucgugacagcagggcaaagcucagugcuccccuggcguuuggggggauccggagcuuugggaagacauuuuuuccuccuugcuuuucuuuuaaaacgaaucuuaaagaagucccaauucaggggucgaaucccgcugccugcgcuccccugccagggccacagcuuccaagugcagccagguucuggugugccguauuuacuggagaguucauggccaguggaagcgagacucccucaaauagcuagcuagacuccccucaaaugcauuuuuugagcagccgacuucagaucuagugcuccuggagccacagccaagcacauccacacagaccaaccgagacagggcaucaucagaacaguguggcagagacaacgcucgaccuugacuccaggggaaagggugucucuccggcccuucaaaagauuaaaggaaucgcguuggggucaaaccucaaacugcgcauggaguuuaggguugucugucuggcagaagccuaggaaagacaguuacaugaacacaggcaccaaguuuggcuuucaagguucgcaccuugagcgcugcucagcugaguuacugcuaguaacucaguuaguucgaagcucgaucaggauaaagcaacgaaaaacugcaaaaauccggccucgggcaucccuggaccuguguggguugucacugagccacuugacacgcacuugaaaaacacagacaaacaaaaucaucgccccgucuuugcugcaaaauagcaaucagcaagcgcgcagcugggacucuaccgaggggcaccaugaacgcgcaguccuugcggcuuuggacagaguucaugcaaguccugcagcgggagagggaaaugaggaauuccuucccacccagagugcgcauuucacugucaaugcacacuuucucucgcuugccucaccaagagcuaaaggaaagguuuacaacuuucacuuccaggcuucccccagagugacacuaaaauuuacaugauuaaaaaaaaaaaaggaaaaaaacugcgagggaaagauuuguuuaagcugcuacugugugacagucugacaaauuuguugcuggggaaguuuaaaagugagcacaacaggauuuggacuuucuaccaugaauuuuaaaaguaguguuugguucagugagaggcaggcaaccauuucaauggagggcggagcgguuuuauugacuuauucuucuacauccuuacgugacuggcuaacuguaaguggucucagaaaacugaaaguuuugugugcuuauucuaugaaaucaucuccaaaauauauaauaguucucuuaaaucaaaauuacccuuccaauauaauacucuaucuaaaucagauucuaagcauguaauaguuuuaaaguuauuuccuccuccuccuucuccucccccuccuccucccccucccccuccuccucugaguguacuguaguuuuagaccaacuccuugcaguugguccuuucacaggcacugagcuaucccagugagcaguaaccacuacauaagcgagcagcuguccacgcugucuggcucucgacauuggaacuuacauuuuucucucaggugaagaaccugcacgauuaugucacuuuucacauuuguuuacuauuguuuaggaccaaacuccucaauucuugcaccguauccuuccucucugaauauuucuaugcugugcuggggggacacucaauucuagcuucauaccuuucccccccaaccccuguauaacuuacaaggagcaaauugaaaauauuucucccuuucccacaaaauucguggugcuuaguaaacauuuuguccucauaaaauuuugcgucaccguugcucugacaaguguaauaaacucugucauaguugacggaagccaagccacauuuuuuucagagagucacacagucauuuaauaacagcagaaugugugaauggugaacgccauagagcugaagguaucauuuaagauuucauugggguauuuuaugugguaugacagcuacaauauggauugcuccuuuuaaguauauuugaaucagcaaaaaagcuuuaauuauuuggcaaaaugauaucauaaaguauauauagaaacacaucaauagacaaccauacauauauguguauaugaauauauacuucauuaaaauauaaauuggacucuaacacaccaugagccucucuaggauucacuuuauguaugcacuccaaaauaauagaaaauaaaaauaagcccgugaauaaacagaaagcuaaaauuuucauaauaauuccauuacuugccagcuuaaaaaaaaaaaaaaaacagauucucuacugaauucuuuuacuuuuccuauuucaucacuugccaucuuuuugagcacugggaguuuuauaucaccguccaaauaaauccaucaucauuggcacaaaauuaaaauagucaaucaccacguaaguggacugugaucugucuagagcgcggcuuugugcgcuuccugucugugcuggauucagaauucggaaucuccgugucucaggagcucugagcugcaugcacaaacacaugaauuagcugcaugcaugaacacaugugaaguauuuacuaaagcucuggggaugacucagaacuccaguugagauuaaaaccaaaucccagcuuaauacaaaaugguuuuaaaaucaguaacauggcagaggcuaagcacaaggagaaaaaaaaaucugaauaucauuccaacaauuuauuuccuuaaagccaguguuuauccaaauaaacaauucagaauacauuuucuaaaagagauuaccuggugcuucuguguuccaauugcuuuccucuagugguagaucauuucagaaacaccucccccuugguugguucccuccucccuccccucccucucccuuccucuuuucagcuaggaaagcaguuuguuuacauugacaccacucguucuugaaaugucacagccuuaaauauuguuggaaaucaucagcauaugcuaagaucccaggaagacacuuuccucccagcagucugcugcuucuaagguacagggaagcccacaccaaaacugugcucauucccuugaguauuuacagauaaugugaguuagaaauuacccuuccuuagcuuuguacacugacaguggucagcacccagugacaguaagggcacauggucggucucaaugccuuaggauuuggguagucacauuccauagcaggacaagacggcuuaucaacgauguugugaagaagaagaagaagaagaagaagaagaagaagaagaagaagaagaagaagaagaagaagaagaagaagaagaagaaaaagaagaagaagaagaagaagaagaagaagaagaagaaggaagaagaggaggaggaagaggaggagaagggaaaggaagaggaggaaugggaagaggaagaggacgaagaacaggaagaggaagacgaacugaaagagaaagaggaggaagaggaggaggaggaagacuaagagaaagaagaaggaagaggaggaggaggagaaggagaaggagaaggagaaggagaaggagaaggagaaggagaaggagaaggagaagaagaagaagaagaggaagaggaagaggaagaggaagaggaagaggaagaagaagaagaagaagaagaggaagaagaagagagcuaauuacuucagauuuccagacgcuguuuaaauaggcaggaggucaagguuugcagcuccacagucauauauuuuuugcaaaagcaaaaaagagcaaauaaaauaggaaaggcuuccacagggcugccuucuaaugacagacugagggacuuaaauguguggccuccaaggaacaaccuuaaaauaauuuuuaaaagaucuugguuuacaagggcauaaaaaagcuccauaaaguuuccuuuuuuugaacacaguagggacagaacgauuugcacuaauuauuaagguaagaugagguaagaaauaacaaauggacucagaaguuaaggcaagcuugguucuaacuggugagcauuggaccuaacagacugacccaguaggacugacuaggacagguaaauuuauuccagagaccugguagagccaacccccuggacauucucucuugagacccagagacaccucuccaucucaggcugagugguuggaaaagcagacuggagcgcagaucucuauguauacacuuaauacuucgacaauucuuagagaaaagccaacguggcaaaagcgacugugcuuggagaggacuguguguuacugugaagaacuuucugcgcuugggugacaucagcuugaggacacagggaaacuggcugaacucagugaacagacacuuauagauaaaggcaaaccuguggaauuaugaagggauuuccaccuccaggagcuggggaagaugccacccuggggcuuggagagagacgagaggcuacauacucauuaauggaagcuagauaggacaugaucucccuuccuugcccacuguaugccaucauagaaccagcagugauugaauugucucccugcuuaauccugggaauccuauagucacucccauuuuauaggccaggagccuccccuuuagggagcuuaggaaacuugccuguggacacacaugaacgcacauguacacaugcagauuuagugugcacacacaggcacaaguaugcacagacaugcacauucacccccacaccacacauacccaugcagaugugaguacacacacauacacacacacacacacacacacacacacaggcacaugaacacacacauguacacaugcacaggugcacacacaggcacugguacacacagacacacaggcacaugaacacacacacauguacacaugcacacgugcacacacaggcacugguauacacacucacacacauacacaagcccaugcacagccacaggcauggaccaacuauguuucuucuuagguacaauugacagcuuugagaaaaauuuaacuguuaguauguccucuuuccccucuuuccuccucauuucuuguaauuccagcacuugggaggcagaggcaggcagauuucugaguucgaggccagccuggucuacagagugaguuccaggacagccagggcuaugcagagauauuuugucaaaaaaaaaaaucucaaaaauucuucaugugggaaucucagauauguagaauuucuauccuguaguuauuucuugucaccgagaguguuuggacaggcaaucgcuauuugguugagagauuuuaaaaucuauaauaggcuuuuagucuuuucugaccuuuagucuuuccaaaugguaacuccuagauucucugagagcaugaaauauuugauuuucuuucucccagccuuccuagaaugguccuuaugugucaggguucuaggcuuauuggugacagaggacaaauaacagacagcaaaugggguaucauggcuacuggcaagcaugugugcaugguccagagaacaagagggaagggacaagggaggacggggcagcagcaccuggggaugcuuagaagagguuuuggugcuaacacaggugauguguccuugacuuagaagaugaauagagcuucuaccuucugaaucccagagaaggggcuagagaggcugaggugagcuggacaaaggugcuccagggaggaggaucguagagagcaaagcuaggcacuuguaauucaggucacugugccauugccaguagagacugaguuggaggguggggugugguaucucacauaagcugagaggacugaaccucaauaugaagacaauggguuccacuacauccaaggauacagccuagccgaguggguaauuuagaaauuuaguccaccaaaaguguauaggugacuggaggggagagagagagagagagagagagagagagagagagagagagagagagagagagagagagagagagagaacacuugagaauuguguccugcaugucaagcuggcuuugccgcugccgcuuucauuguaguuacaccaagucucugaauucgaacccauggacuuacuugugucucccuuccuuuuguugcuaaguccucugaguaguuuuuuuuuagcauugguuguuaugauuucucuccucuucccaugcccaucccaauugcucccacuccagggcuaauucucugaccucuugucagauuucuuacgaauauacccugacaagggauucccacagcuuuucuacaccaguccuucuagcaggcuucugcuaaccuugcaucucuacauacccagaacccagggccagcucuucagcucugugcugcaggacuauggagcacccucccuguucugauugcggagggaugugucagcuuucuugcucagguuagauucccucucauggauuauccuaauacuucaucauggucuccaugucucccagaugaccuuugaacuauacuuggugucucagcauuggaaugauggagggugagguugguaagaggccaccuuccccuggcuucagguuucuauguagaacaacauuccucaguaugcaauccuuggccccuuuccacacccccauuuauccucaaccaggagagauucaauuacucugccagcaacuuaggaagcagaagcaagaauaugaggaagaauccuaaaauagacucuuaagauuguccauucuaaacagaacagugagggagaggaacccauaugagcugguuguagaacaguuaacagacggagggcuuuuuacaguaguuaagguugcuauucaguuggacuccagucagcaagcagaguugauccuaguugcuacaauguagccaaaggagacgguuaaaaaugguaaguuuuucugccuggggcuggaaugaagccagcuguugcucgagcugaagaagacagaagucgguguauaagagagagagagagagagagagagagagagagagagagagguccuaauucucugacccucucccuggcagucagccagcaaggaagcagggccugucuuucuugagguuuauggaacugcauuccaccagcuaccugugugaccuuggaggaacauugcccccuaaagacucaaguuaagagcuuagcuuggccaaccucuugauggagaauccagggagacuagugggcgugcugacugugagcuaauaacuggguguucguuaaacugagguguuuaaacuuguggucugauagcaguggagaacuagcacacugaccuucaguuuuccugauaggcucaggagacacugcuugugcuugggugaguaugggcgccagcacucggaagccacauaccaagccacauuuuccaaaaguucugacugugguaagcuugcuauucugauucgccaugcuuugucuagcauaccgguuguucugggccacuagggagcagaagucuuuuuauugaguccccacagagacacuauauaauaucuuauucccuucugagucauugcacccccccauacccuugugcaugcugcgcacaugacuccuggauguuugcacaccuuguccaugaggcuguguaacucauauuucauuuuuuuuggcaccacuguguaaaacaaaugugaugggaagccucagggcuuuuauuaagcagaggcucugacuuagcaggucuggggagagacccaggacuucguuuccaacaagcuuccaaugaugucaugguggcugcugguccaagaugcacaccuauaguugacaaggucccuggaagcucuugggucuccaaccaaaacuguguccagcauaaccuuuuagacagaugacagaagggcuuuucauagauaacauuauaaaauaugaauccauagcaagucaucacagacagggcucuuuaaacugucaucaaugggcugaauauuuggugucuguuuggaaagcccucugucagagaccuaauccuccgugggaugguaaagcucauggggccuuuggaaggagacuagauaaagaccagagaauggaggugggacuaguauccuuauauggcuuucucuugcuggguguggugguguacaccuuuaaucucagcacugagaaggcagaagccgaggccaaccuggucuacauguccuagguuuaucuaggacugcacagugagacucuuaucuccaacagggucagauucuccacuucccuuucuccucccucccucccucccuucuucccucccucccucccucccucccucccucccucccucccuccauuuccccucuccucucuccucauuccuuuagacauucuuuagggucucacauguggccucacagucacuggauacaugcuccagagggaaacuagaauauacacguaaacagccuuuucccuccccauuuggacuuccagaagauguggccaggacacagccaaucaccuggggcacagagccuggcaggcaugugcaaucaugugcaucauacuagccauauauaaaacaacugggaagcaccucuccuucugcagaaacaacgcagcacaugcgaucuagacuuucccaauacccaguguuuucuacuuuugcaagcaagcagauggcauccaugaaguaauccauuaguuaauuaggauucauucauuuauguucugugugggcaugcaugcugcuugcagcuuguguggaggaggucagagaacaacuccugggacuugcuucugcuucuucccuuccacugcauggggccugggcucacauucaagucaucaggcuuuggcagcaagcaccuuuauuugccgagccaucuugccagcccaaaaguaacuuccauaaugguuuauuuaaccaugauccaaacccauugucaauacaaaauuagauauuuucuaucucuuuuuuaaaaucguauuuucaaaagucuaugcguguucugugccuacaguaugucuuguucugguuugucuggcuguugguguucaguagcugcuugggaccagugacaacuguauuaguuggagcaagacuggaguggcuauucaacaagcaaucaaagcugaccagcuuugacacuuuucuccugcagccccagggggcuguuucuucccugcuguaggugaggcaggucucuucccugacuuagguuuuuucccucugagcauacaguuuauuguuugagacacuccuacacuguagcccuggcuagccccgcccucgugcccccguggcuccuggaggucguucugcucuugccuccugaguggugaacuucgagucguuuucacagcaucacaugguugaguggcagaacccaugugcagggcuccagcgacugcugcaggaggcuggcuccuaugcucagcaugcuccugcaucuugcagcccaggugagcccugagcuaaucuccugcauucuacacugccucuucacacccaccagcugugauggcucagccugugagacaacuuuggcuccuucacagucugaagcaacaucacagaaaggauuaagcucguucucuaugagauuuguggacuaauuguuauuauuauuauuauuuuaaauagcuuauacaauagcuuauauguaugaguguuuugccuacauguaugccugugcaccauaugcacgcagugcucacagaagccagaggagggcgcugaaucccccaggacuggaauuaugaaugguugagagcugccaugaguguacuagaaaccaaaccuggcuccucugcgagagcagccagugcucugaccacagagcugucucuccagugcccaugggcugcacugauaaacaccggcuaggacuggauguucuguuccucauaggccacagguuuuaaauugcuggugcucucucucaaguaggaauuccuacaguguguuuaucuggaaauacagcauaaagggguuuuucaaacugccucuuuguuagccaaaccagccgccauccaucccucugcaacucaguacaguaguuugguaauguguggugaaagccugguuguaggagaguuagggggacagcaagauaggagcgggagggggaggggacggaggagagaggggaggggagagggugggggggggagggaaagggguaggaggaaggagacggaaaaggggagggaaagggaaaaaggaaggggaaggguauggaaggggguggggaagggggaaggggaaaaggaaggaggaggggaagggggaaggggaaaaggaaggaggaagggggauagggagggggagggagaaggagagggaaguaucaugacaggaggauuuuaauuuaauucuuauuuuauguguauguggguacgucugugugggggcaugcacacacaucuggaaugcagcaccuccagauguuagaagagguuaccagguccccuggaacuggagucacaggugguggugagcugccggacaugggugcugggaugagugcguucagucccuggcaggagcagccaacagcacuaaucacugggccaucucucccaucugaaguagccucgaaagccauaucuaucauguuugcuugugggacuagagacuugccauacuccacagacuuuaacuucaugucuaugaaacaaaaaaccguagcugaagaagucagccauggugguagugagaauucucacgucuaauuccuaugcguuuccacuuaaaaugccauaaaaucacugaagucuguacagacccgguuacauacuuucauaucggaucaggaacguauacuuaagguucaggaaauggucgcacuucgguggaucacacauccugccccaaagcuagugaacauuucugaggucaguucuucuaaaacucaacccguccgucucucuaucaagcaaugguuaagucagaauuaagcuuuaaaaauaaaauaaaauaaaauaaaauaaaauaaaauaaaauaaaauaaaauaaaauaaagauuguuucagguuugccuagaaccgugcugcccucugaaucucccuuguaaaacacaaagcagaauuuuauuuacuaccuuccccugagagcacacagcaggaauucucuggagcuuagcuucuuggaggggaagggagugagucagggagagaggcauuucugagagcagauauuaucuaguguucagcuuacagucacaggcagagugaaagccauccucagaaguggguucaaagugauuaaaaauggucaagaccaaaaauaacacuugaagaauuuugcacucuuuuucuuuuucuuucagggugguaggcuuuaaagaaaaauagccacagccaagcaacagauguuugcccacacauaaccacaaaugaccucaaacugaauucaagcucacuucuagugugaucauuggccaagcagacacagacauuuuacugcuggcccaugguucccacuuucuccuaauauuucucuaaucacuuuaacaauuuaaaugcccaugaagaugucuguucugaggguaacuuuucacaugaagaugucugcucugaggcacaggaagaugucugcucugaggguagcuuuucacaugcacagucgguuaacauggcccuuucgaguaaguugcaagagagauuugaagcaagagugucguaaaaauguggacuuuuaaguuuuuaguuguaaucuuuuagaucuacguagcucuguaaucaagucaagcccuugauuuaagaacaucccauaugucaggggaaaauauuguggaugacgucagcauguucugguugugugcugggaagggucucaugacgucagcguguucugguugugugcugggaagggucucaggcagcucacacaggacaagcacuuacuuugcagcuagggacaaauuuggaguccugaucuucuugccucugguucccaagucagaaaauguauaguguguaaaaggguaacagucuuguuuagccaagccccucuuugaacagaagccacccaaguccccucagaagccaagaaaaggaccuuucuagcacaggcugagauauggaagagaacuggcuucccuauuagcugaaugacaguugacacagacaggaggugagagggcagggggauggggugggggauagaauagagggugggggagggggugggaggggcgcauggggggcagauuccuccccucacuaccccagcccacaggaggauucugcuuucuuccuuuugccucaggcauauccaggauggcaauuuucaucccuugguugaagugauacaccccuuucuuccgucuugcccaaacagcagaaaaggaguagucuccagguuaaacccaaacuuccauaauucauauuuuuuucugaccagaugcccacuggucugguugaccacacccucccuaaaguuugucuguagcaaagacugaggcucaaagauaaggaaacaaaacagcacccaugcuccucaggauguuacccaccuccauugucuuuacguagaaguguucacagcugggcagcaccccccacucagggaaugccaacgcaggggagcucuggccacacagggagacaccaucuuacuccaccaccaccaccaccaccacuaacagcaaagggguuuuucagaugcaagcuaggacauuguacaacaacagcaacaaagagcacauggacuccccaugguauagagaaugcaggaggagaccaggggcccuuuuccugguuuucaccuucuguaguagcggaucaaggggaaccaagagcauuggaagaugucuagaaagugcugggucaccugaaccucaucaaggaaauuuuuccccccugcagaaguuaaaaauaaaacuucuauaacaaaaacauccucuucuuauugauuuuuaagauuuuuggaacauugagguccuaaguaccugcaacuuaagugacuuugcugcagcagcucaagagcaaagccccucgcuucacuccagggauguuuguuguguuaugaauaaauaaauaaguaaauaagaaauggucuucugcacccuccuaaaaccucaagucccuccugcauggaugcuuagauacucaaacguaaccaugguucuugucuguguuuuugaagauuaauacauaaguacgcacagcauugccuuaggaggccaaagaaguaauuuaucuuuccugucacaaagagcccagugagcagggcagcaggcucuauugccccuggaucgcuaaugcuggggugugauagguugggguucaugaagaaaaagaugggaccucugaucuuaaccuugggggagccaucgagugccucguguauauaaagacagaaaagucaugggaucucagaaauaaaagccuuguuuaugucgaugggguuuugucagccaagccaaucugcacgaccagacaccaguggucugcagaaucuucggagcuauucugagcgucacagccaugacuaaggcgucuugucgcacuaucuuauuuaaucuaaagucaauaaguuaggaccauccuccuaggccaaaagaggugaaaggacuugccuaaagccagagaagagcaaugcucaucucucauguguacacgaguguuuucaugugugugugcauauguguguguguaagccaaagauagccccagaacucacucccuugaugcuuuccuuauugcuaucaagccaguguuucugacuggccuggaacucacagugagccccaagaucuucauguucccaccuccccagaccaaaacgcucuccugugucucauggcccuggggcugaacucaggcucucugugaauggagcagaugaucuuccaauugugggcauuuugaccguuuuuguuuuuguuuuuguuuuuuguuuuuuguuuuuuuuuucgagacaggguuucucuguauaucccuggcuguccuggaacucacucuguagaccaagcuggccucgaacucagaaauccuccugccucugccucccaagugcugggauuaaaggugugugccaccaccgcccggggcauuuugaaaacaacauuguucgccucccuaauuccagaaguuucuuagagaugccuuuuuggaaggacugcuuggcuugcuggggacauccucccaccaggcacagcgggcagauggaugugccaacagaccuguucuagcuguacgucuaaggaaaugagcuguuuuaacaacacagaacccagcgagcuggauagguaguucaaugacuuuuccagaaugguacuuaaggagcagagcccaucuccacuuggguuggagcccauggccuuaugguuuaaauauaaaacgcauuauagcucuuuauuuagagagccauaugccauuuuuagggagcagccucgguucucucucugacuucggugguggacagugcagauaggugucucagcgcugucauuaguauccauuauuuauuagguuuugaugguggauuagaaaccagcugggaggguuaugcgccccuucagugaaaaccuccucacuaaggucaggacuuccaaguguaaccuuuggaggcucaggagagggcaagggauccagcauaguucaggccuccaaaguucagggucagggagaagagggagacuucaaaauuuaaaaacagccucagguuuucugccacagggcagacuccauugguaaagaagaagcgaaggauagacaaaacaccaggcaauggucuaaugccacccagggagcaacgcuugcuuucccaaagaucaaaccauggcaaaggccuucuggcugcuggcuacaaagacgucugaaaccuucugacccagagggaaguccgucugagaacacagucugucacaugaguuccauggcuaaguguggucacacugcgugugacugcagacucccuuccuucucugugucccucuuuccuccauugccaagucugaaaccaugcugcucucaacacaguacaaagaagaccagacugaguuggaacugcuggagcagcuugagaugcaggaguacccugagaugcaggagcacucugagaugcuggagcacucugagaugcaggagcacucugagaugcuggagcacucugagaugcaggagcacucugagaugcaggaauacucugagaugcaggaguacccugagaugcaggagcacucugagaugcuggagcacucugagaugcuggagcacucugagaugcuggagcacucugagaugcuggagcacucugagaugcuggagcacucugagaugcaggaauacucugagaugcaggaguacccugagaugcaggagcacucugagaugcuggagcacucugagaugcuggagcacucugagaugcuggagcacucugagaugcaggagcacucugagaugcaggagcacucugagaugcuggagcacucugagaugcuggagcacucugagaugcuggagcacucugagaugcuggagcauucugagaugcaggaauacucugagaugcuggaguucccugagauacuggaguacucugagauguaggagcacucugagaugcuggagaacucugagaugcuggagaacucugagaugcuggagcacuccgagaugcuggagcuggucacucacaaaaggacaauucugaaguaagugagagaacaggguugcuccaguggcuaccuuucugugguagaugcugcuaagcauuuuccuccagacagacacguacuauaauuuguguacuuuucagagagcaagugggcuccuagaaacaagcugacuucucucagcuugcccaucucgcaggccugggacccucccucugagaaggcugucucacccuccgcucuagcccugugccucuuccauuggccauuuuguaacuucccuaaaaucaggagggucuugugaaauuuucucuagaagaaauuuagaaauuacuccuggaaagcuccagugggucucuucucuuucaaaguccuuucccgagagcaauccacaaguuuaaauccaguucccaaaagucccaggaaccgacaaccugaucucuggaaaaacacaaaugaagauuucucuggaauucucaagcuaugguacagugagauggaaaggggcuggcauuaacagucucucaggaucuaacugaguuuuuuuuuuuccuugauuuuuuuauuucuugauuuuuuuuucuuauuucuugacuuuaauaguuaaaagcaaaaaaggaagacuuacucaacgaggccacguuggacugaggaacaaagaggccaucuuccuggacaaaauguccaacuucagggacauuuauuuuuuaaguagcaggguggaaggggggauuuuuuuucuuuaaugaccuaagcugaaacaaaggcgacaacaacaacaacaacaacaacaacaacgacacccgaaauaucuuugucuuuccucaggagaagugucuuaggacagaguggcugcuacagcggagguguugcucaauguuguguuacaacacuauuccaacugucgcuggggcggggauggcagucuugcaucaacccccugcaagguguuuccugggcuuugcagacagcagugggggaggugcugcuccucuugugaaggcagauaaugccucccgcucccucagcuaucuucuggggcucgcccuggagauaacagcuucacugccugagggagccccacgcucccaauuuguagaucuauauugaugaagcuuuuuguguuuaucagacacaguuuuaucauuccucuccaaaugcccccagucacacucagccuuugaacuuuggcgaauuuaucaaaugggagcaaugauugaggagauguaaaggcuuaucuggaauucuaaagaaagaggaaccgagccacggaucucucugcuagagcaggucuuuuggguguguguguuugugugcaugggcuuguguuugugcgugcuuguguguguacguguacacacaugagcacaggcauguguguuugcacaugcacacgggcacaugaaaacagaggaagauguuucuuaucuggggcaguagauugcucuauguagacaucuuaugcauuuuguuuuccuggacaccuugccuuggaucuuucucaaggccccagagcaggugguugagcucagccugacucgcagugugcacagaaugacaggcccugcauaagacccacuuugaccucauuuagaucaggacucucugaaaccaaguaucagcccuugaaugggauucaugcuggcuuguguuacuuguaucuucuuaacaggcaaacagcacgaggcuuuugaaagguuccagacaccuuuagaaucuuguuccuucguuuuuuuugucuuguuccuucuuuuuuugucuacuuuucucccccucucucucaucucucuuugucucuguuucuuucugucucuccgucucucucucauucuuuuaucaaauucuacucugcaaaucaauauagaaaggcggggagguggggacagaugaagaggaugaggccccucccuaugcuggcacagaggccccugcgaugcucccaauaucagagagagguaugggaggaaggaggagagagaaggggaaaagaggggaaggaaggagaugagagggagggggaaggagagggaggggagggaagaagaagaaagggaaagcucuaguuacagaccuggagggaauuucagaagggagucccugccccagaguccccguucuuccuuggguuuguccuccaaucucuuguccuccaaucucucagcaggcuguccuucugagagguacgauuacucaccauuggcagcuauggaaaaggcagccugauaaugagacugagaugaggccuuucaucaaaugaucucugccauuauguccccccccccccgcuuuccucuucuccuuauucccccuccuccucaucacacacacacacacacacacacacacacacagaggcacacacacaugcacagaggaugagagagagagaaagaagagaggggagagguggagggggaggaggagaagagggagagggagagggaggaggagggggagggggagagggaggaugagggggaggaggaggaggagggggagggggaggggaagagggagggggagggggaggggaagagggagaggcuguugcaacacuguacagucugggcacugccuguuggguggccacuguccucaaucccuggccagaccuguccagggugucuugccaccacacuacacccuggcugacugcuaugguucacacugauguuuaaaguagagacagcaugauuuuucaguacaaggucugucgcaagggcacaagaagucuuuaauaaaaacucuuuggggacaguagggacugucaguaagggaucagguagauuaugucuagauccaagcuuaugagcucccgugguggagcggggccuguguauacugaguggcuaacguuguuguuuacaauaacacccacaugcaguugcuggacgguguaagaagcagggguauuaacaagagucccugcagugucuaucgcuggagaauguagacuagaccucugacaguucuaggaauccugcauccaugagacauagagaaggagccaugcuguaccuggcaagacuggaccuguguguggagagaggaauggccugccacuggcucaguguugggggcucugguugggaggaaggagguacagcucuucccagcagcuccaugggacuacugucuccauuaucucauucuggagcggcugccugaucacccgacagcuucugcuccagccucccugcagucaaagagucagaguaaaggaaaucggacccggucucuccuccagacagaguguuccggggcucagagaaucccaggcccugugggaaguuagcccagccacugcauggccuaaauaccacugcucagcuuaccgcgccacguugcuuauucugcccccagauacugaaaucuccuccuuccuuggaaccuuuuagcaucucucccugagccagggacacaucccucaaccucccaguuguuaucuagggaaguaagagcugaagcaaucucccuucuuaugccugguaucaagucguucacuggacucuuuccuaccaucucguuaugaguccuugucugaugcagaccucagacugaagggauggcuaucucuagguguuuagucguuaaaggaaaccaaaucaaaaaccaaaccuagucucugucugucucgaugcuaacuccacucucaguguaggacaacagacccacacgggacucucccugugucccgucucccucgggaccuccagggcuuuggagguuaggaggucagcaaucugaggaacuccugagaccacauugguguuuugggcacagugguaaccacaaguggccagugguagccuccucaucacaccccugcccugcguauaggaacucaugggcuuucucuuugguaaacauuucuggcaaaacaaaaagcgcaggcacagagugaggauggcaucucacuacugcgcucugcuugucucuggggcucgcggagagaguucgguagagauggcuucucuguauuugaggaagcuguguuauaagcaagaacccuggcuguccuggaacucacuucguagaccaggcuagccuugaacuccgaaauccaccugccucugcuucccaagugcugggauuaaaggugugcgcuaucacugccuggcuuugaagcaagucuugaaacuccaggucaaacuucuuucuguacauauagaacaugcguguagugacuggagcaaagcuaaguaguccacguugauacaaaccagguugugagggcgguacuuccuuucuaccaucgggguuucaucccggguccucucuaucacuggcucugacagaguaaaacucacuucccacagggcucuguaaucauguaagagugaccacggagcucacugcaacacugggaaggcucuggacacuguccacugagaugucacccuccugaccaauccugggaccugggugggcuuguccuugaaccacauggucacugaugcuucaugcucacaccacagcagugagucuuaccaggacacuucacugaguagaguacugcccugaaaaggaacagaccugcagggcucugaggcaggcuacucaaucacaaaggaaagaaagcauuguugggggagcagauugccuggugaugagcugggauccuugcaauccaagaugggagaagccuagcuggggacaacgcugagcagagcugaccccaucccugcuuccaucagacacuugauuccuaaggccugucaccucucuguuacuacuacugcuauuauuauuguuauuauuauuauuacucuguuugucauuugacuuuauacuauuuuccauggggacccaugagagcaugggcauuuuuuaguacccucuaacaucagcuuucaauuggggggcaggcauggggacccuuuacauugcauucuuuaauaauucaaguggcagcauuguagggcuucucuuaacugcuucuuaaaaguaauuaauugauuuucugacauaucaguuaacaauguauuacucugacacaaaguuguguuucagcucuuguuuggaacagagugcuguauggauucaauucggcucagaauuuagcucgggagaaacuaaaaauaugccucuauaaaaagaaacccccuuuacauggaguguugucuaaaaaucuaacccauauguucuuuccggggcucucaauggggugacguaugggcucaaauuuuuguggcuguucaggcuuggaacauucaagaagcauggaauaacccacuguuacccaauauacucuguggucuagagggggaaaaaucacccaggcugugcagaggacaacgggaggcuccccaucuaaacacggcuugcuaagguucuguccugggugugagugucuaccagcagccagguucuuuguguagcugagauuguaaguuccacucacugcaggccugugguggggauccagccacagggaggaggauucccuuccauuauguagaugcucugcauggcaacucucagaccaguauuguaacuggcuuacccugggucgugugguguggaaugugggcagcaagcaugaucucuuggccucuacagagacgccugagacaaacuucugcaccgcgggagguagcacucccuccugggagucaccacauuuacuucaauacacagaagcucucaauagauccauuuugguagcgugauauuucuucaccacuguggacguaugucacugaggcccuggcaugacucuaggcacucugcacuuggugugugcugaagaggggugaaggguagagcgcacaggagacccaguucccgccucauccugccuuccagugauagggccugguguguaggcucaugccuucaugauuuacagguccaucacugguucagcuucguuugagacaggggagugaccucgacacgaggcaguugaugcuucuccauucacaauccucgcuucccagcaggcaaugcaguugugauccuggcuuucugacuugugugugucucacuucuccaugacugugucugaacugauccuuuacucaggaaggcagcccuucaucaaagucuuucaagcauuagcaccgccaaagagaucuggccuaaagccaggaaacaaacccuugggagggggaccccagagugaguggauggaggucuugcucccucugugugucucgcgggcuggccauuuagucugcuucuuuaguugcagaaugaggacagcgguugcuaauuuaccauacuacugugaugaccgaauggcacaaaccccgugaggaagcuuuuacagcgcugagcggcagcugcucaauuaagggaaugcgagcuacuguaguuuucucucgcuaaaguacagggacgaugagaaaaauugaugaaaaauauuacaacguguucauaauagguugguuugccuuucaguauuugagagcauuuuaaguucugaggcuuauaaggaagggaccuuaguggaaagagcaauggacagaaggggagaaagaagugacuucagggaggcauagggaauggcagacaggcagagacaggcucgaagcagggacccacuaacgacagauguuccuugccuuuccuuggaugaucacaccuuuuuuaugccuugccuacucaaaaucuaugugggcagcgaagacuccugccccucaaggauggcuguugugaugacccucaagggaggagagcauuggaaagacaaucagagaaacacaugugaauauagacuagcauuacuugcuauuaaugucugaauauuucgauccugucucuugcuauguuuguacuuccuuggucaaauggacagugucaccagacuggagaaaugaauaaaagacaucaauauuguugcuagugacucauuccagacuuuucucuggauauaaauacuuguggauuccacuuuucuaggcuaguguuaaaaaaguuaacaucacaaaagucuguaaaaauaaauaaauaaguaaauaaggaaagaaagagggagagagagagagagagagagagagagagagagagagaaagaaagaaagaaagaaagaaagaaagaaagagagagagaaaagaagaaagaaugaauccuuggauagcugaaguguggaaugucaacaacuucuuuauuuuuggaaauaaaagcuuuuauccugaaacauggguugucuuuacuccucaaaagcauggugauaguacagauucugagaguuauuccagaaugagagaggauuuucuuuucguuuucuuuuuuaguagggguguggggaagagacaugaauuauuuaccauggcucuagagucgggagagagcuuuaggauuuugcucaagucucagauugauuuucugacacaccaagugaaaugaaacuggagagcuuggugccacaucagacacccgauccgcagcaaacugcagagucgcugcucagcgacggugcgcuugugugucugggauaggacaggaguugaucccugcuacuuugcaauuaacacacucaauaaagcauuugaagaaauuagacugcgaacuguacacucaauuaacacagagcaaguauuccucacgcgauaagucccguccugugcauuuugggggauggcagggguagaauuugauugaacgaccccacccuuuaacagcuguauaguccaguguggggauggcagauugggcuacaaaagauucaaugaaugugaucguaagguuacaagagccugggaugggagaguaaugggucccaucaggaagggcuggggaagcuuagaggaggaaaggauggguggauugagucuggaagaaguguaggguuuggauauuauaaagggaaaggcagacaaguuauaugguaauggaagccaaggaagagggcgaauguagaaugucacugaguagcucacuugggagcccgcugcagcacacacuugcuugaggugcgugcagagggugggcuggaggacugcagcauuuugaaguugucagagccugagugagucuuuuuugugucuccucucacugaaaacucaucacaaccauugaagaaaggaccauggaaggucucacgucacacagauauacagugccagauagcaagacucaaagccucccagucauuauagcagcagagccaagccauagacucugucggagcaaucuggaugcugugagccauggcguucccaguuuuggcaugcuagaagcacuauaacucaaccucuguaacuaagggguuugguggcccuuuuccuaaaggcaaguggccaucauucaaggguuuugacugaaagaucaugugagcaguuaugccugagacugcagugaaaaggguaugugaacagacacugagccaaccagguuuggagacaucugaguaagggacuauggggagaaaauugaccccagagcuaugaaccuggacacagggaaggggccaugauguaggugaagacacccugguguuucggcugggggcggggggcagagacagaaagcccacauuagaaaucgugcaagcuuuuaguugaguuauuggaauuggaauuuugcgugaguacccuacauccugguuccuaaggcauggccacacuugaucauuagcccauaaaagugauguuggacagaguugggauucuaaguggagucagggaugaugcuccuguugagggaaagaagugacaaagugacauugccuugcgauuucucuccacucucaggcaggaaaacugagaauggcgggaggcacauuagcuagcgugccuggauuccccagucuucauaugacugcugcaaggggacuuugguggcuacccaagacaagccuaucauugucccuggaacuuggagucauuuuguaagguggcucaccccgaccucggaugcaucaacagaaguauaaggcuuuaacauuggcuucuacucaagcugugagccuaggugaacaucagacugguuggagacaucccccacacccaugguguucuuggcaugggaaggcaagggcacaaugacccuugccucaccuuaaaaacauuuugaggacaugaccugacauauccucgcaagugaccucugaccuuuguaccuaaauuacccaucuggugccagccuugccaaguucacacugacugugagggaaagcaaaguguauguggaagggucugugcuugacuggucauugaaaaagcauuuucaucuccaucuccaucaagauugccuuagugcucuugauuuuacucucuguugagaugcaucgacuuuuuacuuaugggggcucuacgguagaucuuuuacaaacuucuaagaccacauuaaauaagacgcagacaauauggacauuaaacugagguagaauagaaugcuucgcacgugccagacacuauuguaauacaucaugucuuuguugagcaacacaaaucccuuucauugucuguugcugugagcuaguucuugcuauuaugcacuuuuaguagaugaagaaacugaggcacacagacauucacaaggucgccuaaugucauagcacauaacaaauggagccaggaguagaacccaguuccugaaugugugcucuugucuguauccuccauaccaaaaccucucagucuuuggcaagggacuucaagcucagucuguggcaagugcugaugguggagagaaggggacggugggagaaaguaucuaaucuagugacaagugaaaaccaagguaagaaacucguuaugauuacauuuauagaugagccaggcugcuguggaauaaaggacccagcuggcuuuugggucuucuugaccuguggauauaugauuauuuauagauucucuccucucugcucaccaggugccacuggccuaucuuuugcuucaguguguugggugggcucuacucccuucuuagaggccugguucucuaccaaacaucuggcucauuucccccagagccucccucuucagagagaggugaugacugaccaaauuaguauggagauaaaaauacuuccuucuucaacugagugaucuccgcauagaccggaaacagaaucagaucuaggaagugacaaguauuuuugguaacugauguuugauaguugagcauauuacauucagguuuaugcugguuuuagaaaauacuagaaaacgauaauuucagaugaacccaucuuaggucucagucaacuugagaaggaagcaugcacacuuuauaguaguucauuauauuugugcagcacacuaguaaguaaauagaaaagguuuauguuugaucguuuguucauucauucgcucauucauucauucauucauucauucacucacucguuuaauggccaaucacugaucagggacucuuagaaaucccacauuugguucucugaugagcauacugaacaaaacagcaaagccuucuggaaguccacauucagugaucagacugagaaaucagaaugaauucaagcccauguuugauguccagaugcuacaaaaauaauuauuaucaaaggagaaaauguuuucccucuucaacaucuugauucguacugacuuucccuccaguguuggggauucuccaggauuuucuuuaaagcuguuuuuuuuauauuuuagcaaguaaguaacuguuacagccuuacucccaaccccucuaauaaauauuuaucuugauguuuucucauuauaacccaaaccuuuccaaagaccccaggcugucuuccaccugaugguaaaucgugggcaagucucuaggaacaaggauuacucuguuuuguuccuggaugaugagaugaaacaagaagaaaugcccgaggcucucggcaccacccgggagaagcagauuccaaccagacacaccaagaugcuugccaacuucugaccacauugaacagccaggaaaacaaaacccuuucugagcaggucccucuuuguaccucauaugucaguggaggcacugccuuccugggaacaccuggcuguguccuuugggugacuuuugggagaaagccuucacacuuggcauuguuauggcucuuucggcuucuaauccgaaacuuacagcgaaacucgcgggcucugaggcccccgaagccccucuguuccucuguacacaguguguucauacacguaccacaaagcccuuuugugugaauagcaagaccucuacuaacauuacuccuccccacaucucuuugauaaugguaaaccauacccaacauagcauuuucuaucguaaucauugucaacuguauggucccaugagguagguuacauacaugcacgcugcucugugacugucaccuaccauccccagaacauucuuauuuuaacugaaaugguauuucauaguuuaacaacucagaauuucucccucuugccaaucuaccuacuccaugucuccguggcuucaccagcuuucuguaccuucaugaaggggaauuguauagcgucuuucuucuuccuuuuuauuaaagacugguuucuucuggguccaaccaugcuguggacuaucuccuuucagguaugugugcaugugcacaagugugccuaugauggugugugugcaugacuguguguauguguguauaugugcacaugugcaggagagagaauauacaugugcccguguuugaauguguaagucagaagugaacuucuuaugucgucuccuggagcugucuaucuuuuuuuuuuuuuuuuaaauucuauuuuauagaagaagugagucccagagaggauauacaauguguuauuuauguuucacauagcugguaauuggauggguggggauggguaugugacagcccucagguucagauggucauuauccacaugccaauguccuguuuauaugccaccccuuauauucugcuuccucuccuuaacgugauacauugagggccuugguuauccuucuuuuuaaaaaaguaauguguuuacuuuuauuuugugugcauugguguuuugccuagauguaugucuguguaagagugucaggucuuggagcuauagacagaugugaacugccaugugguugucaggaauugaacaaggguccucuggaagaacacccagugcucuuaaccuaugagccaucucuccagcuccuugucucuccuucugaaaggacaguguggcccuggcuguuaggacagguggcugaguagcuccacccggaaggaaaagacuagacuaucaggcacuguggacuguugauucucuuucaucuuguauaacaguagagaugcaauaucuauauuuaaguugcauucuguaagaggcaggccgccauuguccguuagcuuugugguuuucauuucuuuccaguucacacuugaacuugugaagaaaucacaaaggcgacgagcgaagccgagcugggcucugcuugcuccugaugacaguuauguacauuuuaaggucggugaugucauaaaaaugggaggcacauuuccagagucggaacuugaucucaaguaaaacucuaauuauaguugccacuggggcaaaaaaaaaaaaaaaaaaaaaaaagauccaggcccccaaaccccaaacccuagcuuuuaauuucgugaaguugagacaucccacggaaaagcaaaauacuccagugugaaacucaacugaagacuggcucccaagcccauuggguggucuccucucugcauccagugaacaauucuuuuacucauugcucaaaagggaggucacagccauucuuccucaugucgccccacuggauuuugucuuuuuuaugggcccauacuccucaucccuuccccauuggcagugugucuggaacuucucauauccccugcgucuggccuuggccaucucaucuucaauaccccuguucagccaugccucuccgguuuaagucugaaugugauuuucugagugggacuuucuguagucuauccccucauuuccuuuucuuuaggauucaaguaaaguaaauuucacugguuccacagagacuaggugcuaagaacuaggcucugugcuauuuguugagacgacagaaaggguacagucucuguccugagccuuucagguuaacagucacacaaggguacuggcagcagccacucgaauaggacugacucucuugggagguucaagauuccuggacuucaggaugucaggguuaggcaggcagaagugugauuugauucugaucuguggugguggcgagaagagaggagccauugcagaguaagagacgugugcacgaauguggacaaaugacagacgacaugugagaccccuugaguuucaguggcucugaauacuucgggaacaugagguaagacagugagcuaaggacccaaagaagaaguccccugcuuacgagacuuaagcaucccagcugucccucuuccucagggguuccuccccucucugccucacuuagcuaaugcuaucuagaccaagaaaccuaaauggcaaguauuggucuuaguucugcagcagagaauuccaaugucaagggugugggacagugaaagguagcuuggaucccgguugagcuaaggcuugaggacccggagacccugaagagacaguaggugcugugccuguucucgcacaccaggcccgucacuagacacagucucccauagauuuacggccaucagucacauaagggcaacaccccaagccccuccacagguagaggacaugccuguggucacaaaggcucaagacagauuuuaacgagguaccuuaaggccuggagggcuuagccaauaagcuuuccuuccuagauacuccucucugaaaaagguauuuaaucucaggccacccugagaaguggggcaaaaccauuuacacauccaguuuuccaucaugacauuccaucaauaaaugucguaaaaccauggacugcaucuuuucauugguauccucaguggggagccauggagaaggacuuugccuauagaacugcagucuaaucucccauagaaggccucucuaugcuuccagccaugaccaagccaaguucaagcccaccgcugucaagcaagaacuccucaccgugggaccagcuggaguuuccccuuucuccccacccauggcuagauccagccugcagacccccacuuaguucucagcuguuccauggcuucuagcagcaccuggauguccaagagccugagaaccagacagcccaggccuccuggcaggcccgggaccccugcgccagcuccggcugucuggccccucagacugcccuucccaacuccagagccgugucccagugcuucaucacagccuaacacccacccagugauggcaugggguaaaccuggucaaacuuccugcauccugccucccugagcagccgagucauguggaggaacagagccacaaaggugccaucagauuugauucuguuuccugguugucacuuggagaccuugccauugucuccucguaggauggagagagaagcaagcuauagugccucuguuugaagggugcuuauccccacaguaacccuuggcuucucaagaguugugucuucuuauaugucauuaauauuuaagccuccaaugcuucaacguauggauggaggugcuggagagucaucuaagcuccauaguuuccaugaaugcuuugugcuuccaagucaucuccuucuccuagaaaaaccacgagcauuuccauaccacugauaguuugggucauguaucugaagacugagcgcacacagaccucuuauucucuaaugggauggaacaagcuuauuuugacuuccgaaguguugcagaccgaaucguguucccucugcccccuccccacgccaagcucaacugaacucccaguuuucaggagugguauagguaguugcuuuuggaaguaaaaucuuuaccacuauaaucaaguuaggauuagugugaccccugguccagcgugccugguaccuuuauguauuguguggcuguuuccuccaaguugaagcauuccuuuguggugagagggggaaggcucagcguauucaugaaacaagacucuugagucaccagcaaggagaggagggacugaucagaggcauagacaccuacaagcugcauagaagacucaagugguucaacuuucauacauggucccccaugcuaccauaagcuuugcugagauaaagccaccugugggauaccuccuuauguaagugaccucucccccacgccuccauuagcauccccaucaaacacauuaguccagcaaacucaguucaagacgcaauccuuucuuugggccacuguugcucuaucuggggugaauagacauagucuucccagaaaagguaaagagagacauuauagacagaacagagcaucgugggaagacaaagacacagaaggagaaugcccugcgagucagcagcagagacuagaaaugaugcauucccaagucaagagaugagaaguggcaaggauaauucuccaguggaguguggccugucacgcaugaucaggcacagagacaacaauguucugccguuuugaucugguuacuaugcagaacuuucuuaacaauagcuugagaaaaauccaagauaucagacuacuguugguuguccguuccuuagaggcacaaaguagaagggauauuuuagcauuaugagagcacagcucagaaaggugccuaagaauguugaauuggcacaguguguguaugugugugugcacauauacaugaaggaggcuugugccuauggagucaccagcguggaaucagcgguguuugcuaagcagcagggccacagggcacccuucuugccaucucuuugggcaguggggacacuauaguucuccagcauuuaaaguggucucucuguggccauuagaaucaaaacuacgggcagaacauacgugagcuguuaacagaagcuguccccagagugucauauuuuggagaauuuugaccaacuuuuugcuuaaguuagaaaggaacauguauucuuugauggcaagaagcaaaaagugccuacuguggauaggcagccuguauuuacuauugauuaagccugucagcaguuugauccccagcaaacacaagcuggaguucucuaaagcucucuggggccucucauaaaggcaggcuuuuaagccaauguuuugaauagaucagguuaagguauguuaauauaaugcaugggcaaugggguugaagacaggauuuuguucuccucgaaagaaaaugagaugggugcauucuucauacagagcuguuagcugagacugcuggccagacagguaagacgggcgcuuccaaaagacaucagcaccucgcucagaccaucaaaaccauugcaccgagaagcaggaaggcagccguggugggaagcagcaagggguggccuggaagccuagagugguuccucucucugcacuugucuuccccagagucccaagucuuucccuuuggcuaaagugcugucauugggucagcugcugaaaugagucauuuagugagagaaaaagcgugaauucaagcauuucagaggccuugacuguucuauaagaaugagagaaaauucacaaacgaaagugggccaauuaaagaaccagcguuugccaguauaggucugggaagccgucagaccugugaagcccccacugaagaacugaaugaccgacagguagggacccagucuccuuccuuaucaugguccuuacaacagagaacucacaggcuaccaggccauguguggauucuuugacaccaucaggcaaccuguuguuuguauauuagagagaauuagugucucuucuuaauaugaaaucuguuuucaagccaugauguuuucccuuggacagaagggauguguguguguguguguguguguguguguguguguguguguguguguguugauggugguggcaggcaaggaccccaggcuaaagauggauucucucuuguucugugguuugggugggugcagagcaaggaagagcucuuugcuccaguggccuuuucuuuuuuuuuuaaacuacaggugacacacacacacacacacacacacacacauauauauauucaaagccugaauucauaaaguuuucuuggcuugugucgucuaucauuuacuugacauugacggucauauucaaaagcauaauaucacacaagggguauuuuuagaugauaguaaguguugcuaagaauagaugaaauacaguaccuaucacagacagguccuucaucaugcuuucugagaagcaugcuucagagauaaaacuguaugcugcaugaaggguuuucagggacucagaucgcuguguugaugaguggagcagucaccugguccugacaaugccuuuccuggaacaaacgauugcucaggacaaagacaugaugguugauacugacugucaacuugacaagaucuagaguuccucuggagaugagcuuucgguagauuuacaaagaauuguauugguuaaguuaacuaaagugggaggacccauccuagaagugggugacaccguugccugggcuugugucuguacugaacucagggaagaaagcuagcuaagcgugggaauucagaucccugugcuuccucacugaacgcgguguggccagcuagcugccccagggaagcuucuacagcugacguuuucugcuggaugacggacuguaccccaaaauguaauuuucuaccuuaaguugcuuuugucugguuauuuuaucacagccauaggaagaguuaugcagacaaauaaccugaagugucccuuaaaaugauuaugucuaagauauuucuggggacagaaauuauuccuuaguacuaaaaugaauucuucagaaaaugagugaaguagcauugagaaccaggcagugauucuguguuaacacagcucucucgucauguggauugaacuauauguaaaucuacugcauaauacauaaaguuacuuccucaguugcaauaaacaccaggucacucaacugcagcaugaaaauagugacugacacaaucaauuacagagagucaggauuucccaucauuuagacauuucuauuuuaucgacugagucuagcguucuggauuuuuagcguggcuucaauaaaugcuaaauaacaacacugccaauaaaaauuaaguaaaaugcacuugcucuccuucuuuuaacuugcugcuagucucugaaaggauaaaguuaaauuaaauuaauuuauuuaaaauguuuggucacugcccaauucuggacaaaugaauccaauguucaugucagagcccuagggggagauggcccuacuuauuuucccauggugacuacauccauuuuauggccaagucacuugaggggacaggcagaacuuugauaaguucuaggcaucaaaaagaaucccagaaucuuguauuuauuucucuagaucucuuugggguuucauguaaacaaucugucuuuagaacucucugucuucucccaugaguccuugaaugcauuggaagcaucgagcuauguccuucauuccagauguagaucagccuggagaaauuugcuaccccaaaagcaaaaggugagaaacaggcuuccccuuaaacauaguaaggggcagagcucagagcugcacgucagcauuccaucuguucuguguuuguuuagggguuucuuugcccauagcaacccuucaggaacacucaaagcugggggcagugccauaccugggaacagacuaccccagacguuuagacucauguugaacuuauagaagaggaugucuccaggaacauuuuggggguaucgagcacagaaccuaagagaaagggagagcucugggagaagggcagccccccugcuccuugugcaggagccagggagucucaaguucuuagcauuuaaugggcuuugccauagacuuucauggugcucaaggaaugcagaucaaugcuuccagagaaauacauuuuuguugaacacugugagcacuaguggacagaacggcacaggauuugauaauguaccagggaguaaacaauauugagccuuauccucaggaugagggagaugagucaccaguuaaaaugguucacuuaggagucuccggcagaagaucugaguuuggucauuagcguccccauccagcagcucacaccacuccacacuccugcuccuggggagccaacgccucugccuccguaugcaccagccuucauuugcacacauuccuugcccuaucuacauacauauaauuaaaaauaaaaaauagcauagaauacaucuguaaaaauguauucuaugccaagaaccaacaucuccucaagaaaauucuauuuuaauguucuuuacugaagucucuucaguugccauuuucccaggccuucauuaaacacacacacacacacacacacacacacacacacacacacacacacacccuuguugggcauucuucagagcucugagagaauaauauauaauucaauaauucaauaauauaauaauuauauaauucaaauauauaauucauguauauauuugaauugucacucugagaagcucugaaacuucauuguuaaccauuuucaaaggcaccaaaauaagcacaagacacaguucuuugguguuuaaagauagacuauacauccuuuaagaauaauaaucaauauaaucgguuauaugaccuaacugcuugguguguugagcuuugagaagaaaagaccacaaccuaaccauuuuaaaaaguauuuguguaauccccugacugaguucaucuaucucuugauuuugaggacagcacugcucugcaucucagaccuccccccccaaccccccaucauuuccuggcugaauccguaaggcacgagcaggcacugcacuuccaggaaagcuggguagaacuggugagcagccccuucgcugucaucugcuugacacucagacuggagucagauguguuuuguacaguagggggaugaucuccuccaccucugaguuguccugugugguucuuggugcccaggaccccgugaauacacagcaggaaguuuacgguauuccaucgcugucaucuucacccacaugugcugagaggugacucaucgauuuaagauugcucuaauaucguuauuuuucuaagugucuggaaggcagugucuaggauuauugaggaguguuuacauuugaagaugaguuagucaacaaaucuaccccucacaacucaauagcaacaguaaacagacagucucaacccaaguuagaugcugcccccauuucucuugacgagaugccuagagauaggacagacaaugacauucaccuggagucagaccucugagugauuggcacugucuugggagaaggcuccgagaccagaaaggagaguccugguuaauuauuaaugucugcaguagacauaaggggaagauguggcuggaucuacaaaucuucaaacaccuaaacgugcagaagagacagugggagguaagaagcacgagauaggcaagcucacguugaagagagagguuggaaaguuuuucuugaauucuuuaagcaguggaacauucuggaugagauguaaacaugccauucccggcagcagauuuaacccuggaggaaaccagcuggccugguguguaaggaaagcuggcauaagaacugcuuuccuguguucgcuauauagugaguuucaagaagaaaaauacuuuaagacauaugcucuucuuucaaggaggagcaaucuucuugggaaacaugucuugcuucucaccuuugguuuggcuggacacacagcucacagauaugacuuucuaauauaauggacuaauucaugcaucucugccuacaugccagaacacacgaaagacuucccacauaugaagugaggaacuagaaacacgugugcucccucggcaagaugcagaagagcuguucuuaccuaguggcugucugggaguguugaacagcagccugcagguauagguugcccuacugagugaauuuguaauccaugacaaacagcagaugggagaauccagaaacucacccuuuucuaagacacacuggauuugcauagcuuuuuagaauaugucuugagaugucaacuggguuuacuauagguccugaccauaaaucaugacuagcucagccacgaccaucuuaaagggucuuccucuuccuuuuucccuugagauuauuuauccuaugguccaauccaauacagcauuagcaugggaucugugaauauaaguucugcucuauagucauccgucuuaggccaagauccauuugugaacauuuugcuagacucuaagauccuggagggcagagaaugggcucugcuuaucccucuguugauaacaucucuaucuuuacuucauauuugcugaauaaaguguccaguugaccagcagaggaugguuagccaaggggaucagagucucucagcuaagcuuagcuuugagguuuaugcugugcacagccuggacccaaaugcuggcccagccugcaugguucauacuauugacacaaacgaugcuccagccugcauggucuuggcagugccuggugaacugagaguucuaagcucacagguuuuagguggcagacaagccacaucagagaaacagacauugaaggcacggggucaucuugugacccuggucccacagcggugacaguaauggauuccuagggucaaagcucugaugggcuuugacugucuuggaaggaaggaggcucugugggugucagagaagagaauggagucaggucugagagggcacagaaggcugaauaggagccucacagugggagacuuucugccacccaccaggaaacgucaggcaggcacacccuucaugcccccuccucuucauuuuguuggacuucuucauacucauucuuucuauuuuuccauucauucuacuuuuuccauucacucccgcuccaguauuccucccaauucccauucugucuucauucuaaauuugcagguuaaaaacaugaccucgggagccugagauggcugucuccugagagacucugccagagccuacucaauacagaggcagaugcucgcagcuaaccauuggacugagcacagggaccccaguggaggaguuagaagaagggcugaaggagcugaagggguuugcaaccccauaagaggaacaacaauaucaaccaaccaauccccccccccccccagagcucccagggaguaaaccaccaaacaaggaguacacauggagggacccaugacuucaguugcauauguagcagaggauagccuuguugggcaucaaugggaggagaggcccuugguucugugaaggcuugaugccccagcauaggggaaugccaggguggggagagaggaguagguggguggguaggggagcacccucauagaaucaggaggagggaagauaggauagggggcuucugggggguacuagaaaggggagaacauuugaaauguaaaaaaagaaucaaauuagaaaaaucaaauuagaaaaaaaauacaugaccucuuuuacacuuaauaaaucccgaacccaaugacaguuuuaaaaagaaugaaguuaauaaagaggauuagagaggauaccaaagugugcuccucuaauggaagucgcgcgcugccguaugcuagcugagucugcugaaagugccccuggagauggugaacagaacccagccaugggagccgcagcuggcggcuggccuuuccgggcaagguuuucuacuacagagcuuugguagcuccuaacugggcugggguaggacaaaaaccuggauuuaaaauuuacuacugggagcgaagggauggcucagcuugagaaggcccugccuugcaagcaucacaaccaggacaugguguguagaucuguaaucguaguucaggggagccagaggcaggcuguucucuguggcuuagaggcuggcuagccuagcauaaugggucaguaagggacugucucagaaaacaagcuggauggugccugaggaaugagaccugauauaguccuuagucucuguacucauggaggacauacaugcauguguauacuugcacauauaauacacacaagacacagacacagucagacagacagacagacacacacagacacacacacacgaacacacacacacacacacacacacacacacacacgaacacacacacacacacacauucuugcaucugguauuuaauuauuacauaguuugaacacuuggcuucuuaguuucuucucaguacugcugguaucugaggcuagacaacucuuuggcagggaaaacuuggcuguguacugucuacaguccaacacccuugacuucuaccaacuagaagccaguacgauccccuguucugaugccacaugcaaaacugucuccagauguugccaaacguccuccuccuagauggggaccguggaacaggguguucccaggggagccagugucccauccauguguuaaugcuuccgaugagacucagagguuaaggaugauggaugcucccacaaacaucaauguucuugguagcagcaggucaacaugacagucuuugcuaaccuucaagcgcacagcuuuucggcuccaaccacacgaagagaauaacauggcgggcaagggcugggaaaccacccuuuccugucuuccgagucaugauacauaugugaguagcaguguaaacugauuuacgaccugaucgcuauuuguccacauacaucaaauaaaauuugagccucgaagccacaggcugccacgaucauccccccacgcccacgcccugcuccugugagacagccauccagaacucugccucuccgcugccuuuuaaacaauggccuucugucauuuccagaaaauguuuuaaauuaguauaaaacuuggcuaaauuuagcuuuuauagaagaaagaauaaaacauaauuaacuguuuaaagaagcaaacagaaaccacaugaaggcaucagacucgcuggcgaggaaucuaacaguagugccugguagcaaacccaucuccugggcaacagauguucucacauuuaaauggaaacagggucggcuuucccucccguggaaggcguuugugcugagaggcuguggacucuacagaggaggugagcuguccagguguggugugccagugcuccagugggagggagacagaacugucgggacccuggacuggucgaaaugucucaacgucacaagagauauugucagagcaaaugcguugaggguaugugaugcuugcuaaugucugacaggugggcaggagagucagcacuggauucuaaagcccucagaugucucagauuuuagcggagcauagaauaucuucagaauuuucauagaagugcuugucaguuuagaaguuccaccuucauccaggcuauuuaugguguuuuauuggggagaagggggcagaagguaaauuugauuuaaaggcugaaguggauucucuguuucuucuucuucuuuccuuaaaaaaaaaauccugccuggagcagagacaaaggguccuauugugcccugaccuaggcgugcggugucucagacagaggccuagcccaaggcgcaccgcaucacacacacauggacccaaucuuugucaccuaauaaagacucauugaaucaaagggcagguuaucauuuauucuguaggcugacuaaugcaccauucuuccuuucaagcagucuuuucugaagacucaaacaauuaggcuuuauuauuguugcuguugcuguuacuguaauauuuuaaaaacacaaauggaccugguaaugugccauuguaacaggguggcuguaggcaaaaaaaaaaaaaaaaaaaaaaaaaaaaaaaaaaaacccaaaccaaaccaaaauaaaaaaaaaaaaaacacaauaaucuauuguugugcugaaauucucuguaaaugguggucccugggaugucucugaaaacccagcaguaacuuaauccauucauuucucuuuuguucuccagugucaauguuccgagcccugggcacaccugagagagcuuaccucuccgcagucacuuuagacuucagaucaaccuaucucauggaaagaaucguuuuccucaguuuaacaaaucugaaaaaugggcucuguguggauuaauuuuuuuucuuaguguccaguuugaccacuggcugcugagaaggcccgagaacaaacagaaaggagagucaugagcuacucccugggugcgggaaggagaaaagguccugauaacucggccacccccuuccaucucucucuuauuuuucuguagaaaauaccagcuggggguuuuacuuccuuucacaagaguugcacccaguuuggcucacggacgcugccacagucucagagaaauuaggggucagacuaagcgccuccuucuuuccaugccuuucccaaacaucucagcucugcagucaugagcugcugaggccucacacccugcaggcagcccgcauuucagcucuacaaggcucugcuccagagacucacagucucuaaagucacgguuuugaugagcaggaucaauuaguaagccaugagucagaggcgguauucacgcugaaaagcucgucacgccaggacagaugagaccgcacgugugacuuuauucugaaauagucucccaccaacuguguuucugagggaauaaaccuuggucccuuucucaucucuaucaaaacagaaaagucggcaaguccucucucagaacuuaauauuuaucucaacuauuccuguuucuaauuuagggcuaaauuaguucucauuagaaggagaaguuggaaucaguuucuucccucuugagccugaguucuccuagccugacaucuugcugaggcuccagcgagaccggcuuuguuuaucuccucucaauuuugucucugcuccgaauucacucuccuugucuuugauucuuggaaaugaaugcuuuccuauacgcgggcauccuucugaccugccaaauaccacaucugucaaaugcugaauagaccuuguuuaaacaagaggguggaaacucagcccuucauuaaaaucucuaaagcaaaugcuacccucuuuccucucaacacauuuuuuuuuuuggugugugcauucgauauuagcauuuaauaauaaugucucacuacgucuuggcccaaagugccaaauggaaaggcuuccugaugacaacccuuaaagagacagccagaugaucgccccaggaagcauggugccgguuucacugcuuaucuggccaaacaacgagaccaaaagaagcuguacauacccuccuggccagaguaauucugaguucuuuuugucuagauucgauuccucugaaaacacauuccauacucugaaugcugucuucaccaaaggucuacagguggacuguuugaguagaucagaacuaacucaugaucauuugaugcuucagauaaauauguaaauggugaccuauagugagaacccuaauggaccuuaugcauuucuauaagaucaucacccaaaggaaucacucauuaaauaagguaacucaucauuuagcugcggucaaugaauacacuucccuucucuccaagcuacggaguagacaaagcaucugaugacccgacuuuauccuccugccucaguuuccuucuugcaugcucacucauggcuuuaucuacggccgaauuggacaccgaauggccucuguuggugaagaucauccugccugcugugacacauguggcaaggguacccccuuucauagcaggaaacguguaagagaggaugugccccaccaaacugaaguacagcugccgugcuggagucgaaagacauagaaggcuccuguccccaugucaggcaccucaaaccgacagcagcugggccccagaguucagccuugugcaccaaggaguugagcuuuauaacaaaggcaccaaggauucucugggccauaagaggggcuggcuggcaggguuuaucaucugcucagcagugucucagaacacaucugcaagaacaacagccuuuggaagcagagcuacacaucacagggaugcuagacccgaaacaaauucuacacggguguuuuuugaaaauucuggaacauuucaaguucuaugaucuuuggaucacucuguuuccagguuuuguuucuauuguuuuuuuuuuuuaaagucuucuucccagagaagugcuuucagacuaggccagcaguugugcaacuuaaccgagcuaugccucucucuuuaauauuugcuuuuguuuugaguuuaaagagaaaucagcagcaaugagagagcaaugcuucaacuucauuauguuuucuggauucuuuacagugucaaaaaauaguguuagcaucuuucagcauacaguuaaugccaagugcucuugcuuugcgcguccaggggaugggcacgggcuguggagcuguggaaggaugcccgaagguggcuauugagaaccuuguggaaugggagcugucaguagaacagagaaccauuaaugauuuaugaggcaaguuaauaaugccagcuucuauagaaggacaagcccagaauucuuggaccaucaguaaaggauugccuguggucuaccaaguggcaagcauucauuaguucuuuagugucccaguuaaaugaguuuuacauucgucaucaacaucuagaauuucucaaaccaagucauaaacgcacaggaagaguaaaauaguacaagaggaauaauuaugaugauuuuaaaaguugauuuucuuugacaggacaauguccauauucuuguaugucuaaggacaauaaauucaggcaugugguaaccuuaagauagggauuauaauuauaaacagcuugcaccaaauucuugaacgggucucuacauccuaaaucaguggagagaagacaccaggucuuuuuguccuaggagugugaaacuugcuagcauuucagggaucucacugugagcucauuuaccaagccuugggcuuuucuucucccgcaaacaggaacaugaaggucuaccucggauuuucauaaggaggcagaggaauuuucuggcccuuuaaggaguguugauuaguaggcgucucuuccaccaggcucauaacccuuuaauuuguguuucugguuuguccaagagagauuugcccuuuucaacuuaaaaugaaauaaaugcaguccacauuugccuccaugagagcgaugaccugauacuauuaaaauaccaucugagagaacuggaaauacuggauccuuccaccacgugaggauuaugggcaucacugcacccaagaggcaggaacggcccuccuucaagucucugaguucugguuaucaugcuuucucuagccucggucaucugaugaacguagcaacaagcaaaguuuccuuccagaaacuucacccagucaggacagaugcuaucccauguugcccgaagucauggcagugccuuggucucagacaagaauggcagaggcucagugauggacucguaagcucaugggagaacuagaucuacccaugagauauuggucuaacucgauguggugggaaaaccaagugaggauuagaguccauucagguguguucagugucuugcugugcuaggaugcuacacugaggaccaacaaggcugggggugccgcucccuguguggagcucuagauuaacacauagaggaggucccgugcuuuagccccagcaucucacaagccagaggugaccaucccuauaagccuuguuaagacauuaagcucuacuauauagcaaguucaaggauagcuugagauagaugaaguccuucuucaacacacacacacacacacacacacacacacacacacacacaccugaaaaagcaaaacuaaacccuaagccccaaagaacccccuuuauuguuuuaagcaaguuuacaguuuuaugguaagccauacucauagccaucuuaggcuacaugcagcccuauguuguagguugaacacucuuggugcugucugcuccuucugccucagagacuuggggcagucuccuuuuugcuccugaguucccacaccugccuucuaucuccaaccaccacaucugucuugggcuagccauccugaagccuauguaaggacgucugggaacuaacuaugugucuaccagccuugggcuuucagucagcagugcuaggcaguucaccaucucugcccccaccuccucucuuuccuaagguaagaggacuaagcgaaaguagacacgguugaaagugaaaggcaagccugaggcugaccugggucacaccuguggagggagaucucugcagcuggagacaacaucaaagacaccagccccaagugcgacuuuuccuucuuccagaagguucaggcccucugcccagcagugcaccucuuuacagugcaccucacaacaugacacagaacaaaaccaacuagcugacaccuaagacuaucugcccacucccccacaggguuuaaccucucugagcauacugcaagccugacagugggacacacuugcaugagguucgaggacgaauacuugccuugugauccccaaugccgccugccagccagucuuucaaaauccuugcuuucucuguaugcaaacucuuagcaaagagcccucuugcaugccagagcauaugcucggcaagagauguuagucucuguuugcccacauucuuuaucgaggucauuuugccaaagccagauaacugaagacgaacguguggaaucuaacuucuuaguaguacuugaggcuaaaaauaguucgauuguuugauguuuagcuauagauggugagucucuuucuuucuuuuuuuauaaagucuggaggauuauuuaaugagagacacguguggcaagucacagcaugcaagcuuucuucaucucagcaaugcagaaaaauuccucagacucuggguuugccuuuggagggcauucuaaaccaugcaaaauauggcgugaguucucaaggaggaggaggggguggagggggagggaagacgaggggaaggaggaggaagaagaugggggaugagggggauggggagugaggaagaggaggacacagcugcggcuacaaacuagaugagacucucuugccaccuccauccaaucaugaaagaaucugagagauucaaaugcuggagauguuccgguacugggaugcucagaaaccauuguccagaccccuacccuggcugaggcgaaccucucuacuuauaggaacagagugugagaauagacuccggcauauguacacuuguuagcucuggugauuccccauauauuauuuauauucgguuuucuaaggcaucacacugugucucucuggucuucugcuaauaugcucacacauuaacaagugaccuauccaaaucugcccacucaugacucagucuagggcugugcacauguaguuguacacauacguccacuuaauugguccaugguucggguuucauagucacuggacaaucacuugccagcugcuucaaggagcucacaccuuccuccacuccacuccaaguucaggaccagguguccauuauggcuaagagcuagucuggauugggcuuaauugacagcuccauuagucugaugaacacaaauggcaucaaacaccaggaucggacacaaauugaagaugagagcuccuuugcauccacuugggaaggcaaacagggauuuuuaagacagacuagugaggacaauuagcaggauuaaugggcuccccaguagggagaugacaccagaugcucucugcugcacaguucugugcgcauuccauagcaagucccacuggcuucagagccagcccacugcauucaguaauggugcaaccuuguaucucuaaaccaguaggccuguaugugggcugaaaccuugggucaggucaaaguaaguuuggucccuugccucccguagcagacauccccagugacuguaagcucagaaguucuguggagucauuagcaugacuucccugccuauugagcagccugagagugauucuggcuuuucacacaugucccucucucugccugcaccagcacacugcauaucuccaaguaacuggaauauauagagagagcauaaauggaagauguccacagggaaagaucaaucaugucaccaagauccauuucugaagaaaacaaccgcaaauguuuuagcgaauauaaacgaaucucacccuggucguuccacuguucuggguuuuaugacuauguuuuuuucacacuguguggaaaaauacaaagaagugcccaggaacuaaaaacagaaauggaucuguuuuaaggaguguuucccccuugauuucuuugcuguauuuaccagauguugccuauccagauguaccccagccagccuccaacaagaaccacaccguggaccugaggucuguuccagcacaugagaacuggagccaggauucuuaaagcuuaagaaagaaagaaggaaagaaggaaagaaagaaaggaagaaagaaaggaagaaagaaggaaaaggaaagaaagaaaaagaaagaucuuuacaaucuucuugcuuuaguauauuacaugaauuuccaguuuuccaguuguuacuccaaagaaagacagaaagacagugugugugugugugugugugugugugugugugugugugucuaacucaccacaagccauuuauuuaagacauaagagagauguuucagaaagucuguggcccuggcuugaggagaccagauggcuguccacaugacuuauaucaacauuucucacuucaugaagauuagggcuuuacaaaaguguguuuuaggggaucuuagagcuauauugugccuaaguaaaaguugugugucuuaccuggauccugacaaaagggucuuauagacaugggagagggggagaacaggaaucuugucaaaucugcugucuaaauuugacugaauuacauaguucccacuuuguacucuuuuggcagugacaguugugcggguagcuaugggagaaauuugccccaaugaagcauuugcuagaugucaccuugugucuuccucaauuuuauguguuaauggugugcgugugcgugcgugcgugucugucugucugugauuguguguacaaguacaucuggccauuuauacagccagagguugaccucauguguccuccucggguucuucccagcuuauucuuuggagauagggucucuucuugacccuagaguucagcaguucccuuagacuggguggcuagcgagcugcagagaucuguccggcgaugccuucccugccaccauuacaaacaaugcucaauaucaugccugcuuugguagggaugccagggauccgaacucacgucuucacacugcguccucaccccagccauaccaacagcuuucuuagucuuugagcuucucacccuuacugaacaaucaugcagaaauauugcugaacugugcaagaaccagggcagacuggauuuagagagcgugaccuucugagaaguagguagagagagagcacgcucauuuucccaacugguuaacaucugugugccucagcaugccagcccaggaaguguguggcuagauacuguauuacuuuaucagccugcuggggugcuucuuccagcacacagacuguggcaggccuggcucuuacauuccaaaggaaaucuccaaggcuggggacauggcucuguggcagaaugcucaacuagugcauguagaauccuugguucaauuccuaguauuggagcaaugaaaaugucugguuucauaagaagcugucaucucauucuggguccgaaagccuaugcuagagacugugaccaguacagcuggagacagcugaagaugcaugggcugcgucuggaguucacaccccaucaaaaucaucuugggaugcagguggugaugaaguaaagagaaacauuucauuuucaguuaccaaugagcauuugaaaauaaauucgcaacuccgguacauucuuuggugauauucagcaaucaguaaucuaaauucaaaauacuucaaguugaaagaauauugccuauuaguaacguacagaaugcuguaacuuaguggcauggcucaugucggugaauugcuucucccggugaugagggugacuguggacugagcucccaucugccacccagggucaugaaagaauacuguaugaaaugcccucggccauggaaaagacugacauugaaagcauuuucuaccggauguuuuugcacacuaucuaaagaggaaucaggguuguguuacgacugacgggugcaucucuuuuuccuacacucuucccugcauugucuuuugacaccugauguugaugagugcaacuaagucaucgugcugagugaagacuuggcaauggggaucuuaucaagacaggcaauuugucaaaauguuauuugucgaguuuccucugugucagagugcgguaggagaucuuuauauucuauacagugaguagacuaugaucccaugugacauuucagguggacuggaauaguccgauuacguaaaacacggucaggggcaucccagaauuguucuugucaguaaugaaacaauuccaucaucucccacacaugugcugauaugcucaggucauuacccgguuauggaagcaucuuaucaacuucacuauuuccuuccaugagaguguguguucuccugucccaccucuuggccucaugugcuuaccacagugcccccaccuuucaccacaaaguucucacuuuguggcccagggcccuacucuugccucccacuguucuccugaaaugucuucucaaaugucuccacaguuaacucuggcugagucacuuuuucccauccagacaucuuggucuuggucuacuucaugugguaggaccugagguuucacccccugucugaggaugcuuuccaccucuguucuuuccuccaaagauaacugucuucauuguguuugucuguuuaauuauuugcuuggugcaaccaucuguuucagaccuuugcauuuuuugggcuucaguuauuggaucuaugaagugacugucauuguccuucauaccuagcuuguccuuggacuccagcucacugccucccuuggcuagccgaacucucacuucuugauuauguuuggcucucaaagguaaugguucucagccugccuaaggcucucuuauauuuaauacaucucuuuaauaccauucuucauguugagguggcccaacauacugaguuauuuuuguugcuacuucauaacuguaauuuuauacuguuauaaguuguaauguaaauaucugauauucagggguugugacucauagguugagaaccaguagguucacugcucaaaggguagaaggguuucagaggggcaggguggaaaaauaggaggaauuggcaauaaaaugccccuaaauuaucaauauacauauguacacaugcaugcauguaauugucaaaugaugaugaugugaguaaaagaaggucauuucccaauaagggcuuggaccccuuuccucaagacuuucucacuuuguuucucugcccuuggaccugaccccucuucuuuaugucaguaaguguccuggucucuuuuuccuggacaaccuuuggacuugucugccaccuccucccuuuagcccuggguaguugccucugugacugggccugacucccuaagucccuucccgugccccaaguccuccuggguaaucuucuugaaacuggcaucacugugauauuucuuuccucccaaauacugcauuguguucugaugcccaaccucaugccuuuaggaauuccuucugcuuuuccuaauacuuauaaccaccguccuucaagcuucauggcuguggugccuggguucagaucacacaugucacuucccucucugccugcucugucuccuuccagcugcauuggcaucuuccuucacccuccuugccucuggucccccuuuaaucccuguucugucaucagccuuacuugguguccucuuuucaucgcugcuuggaaaaccucacaaaguucuugcucuucuuucccuuggucugacaggugccuuacaggauauaaagaugagcagcaucuccuaccaacacagugacgugugguugacaacucaacggaggacaaagcuuuugaguagggagcuaugcuuaccauagcucugcaagcuuaagagccccugagucagggggauggcuggcauugcccagcaggacuggcaucauggggaaucugaacaauggccauugcugucuuuggacucugccgcucauugcaaaggcucaggugagugcuguaccgacagagacugucuacaucucagcuucagagugcaagcgaguccuuccuccucagccaugcgccaccuaccuguccugcccgggucuguacucacagaccucucaccuuggccaaacuagcacauccucuaaagacaaccauuugacucgcuucuucccucuucugacugccugugacaucacaucugugucuuaguuggccuugaauguucuuccuuguuuuauauacgcuaucucaccaaaugaccugccagaagcuucauucugcguuagcauucgaugcagccucugacccuuuugcuccuacaagucuguugcaugcaugcucuuuacuccuaaccaggauuuaacuaaaaauuauuaauuaauuaauugaacuaguaaucauuaacuuauuuguugcuucugccuuauucucuaaagcaacuaaacagcaggcggacagagcuggaaggcagggaggaggggguguaagaugccucaaugcagucccugagggagagugugcuaaaugacacccagaaguucuugguaaacaaccaacauggauguggcuguuggguuaaauaugcccacuaguuccuuugggagaacuggaguguuggggggcggguucuccgaugacaguuuaaaaccaguagccuaugccuuguugauuaaguagcuccaaguguugaacugugaagugacuuuuuaaagaaaacaaaauugaucacuagaagaaagaaagaaagaaagaaagaaagaaagaaagaaagaaagggaaaagaaaggaaaggaaaggaaaacaauuacccauccuaagagcugagagauagcuuuuagugguggggaaauauuuuacaugguuagguuaauuguuggggcuguggacugguuuggguaacaguuuuaaaaugucauuaugucucucuaguuggccauuugcuuggcaauaaagagcaauaccaaagaaggugaccgacccuccagcucuggagaugcccccacuauagcucagccauaccaacgaggaaaggccagaacagcccccuggggcccuggcagagugcaaagugaacccccccauccucucuccuccccaccuacauuuagcucaccaauaccaaauauuuucagucaucucucuauuggccagcaaagaacuaggcccugagggcacagagaugaguaguaucccaggcuccugguccaggguuccauaguguuuccaagacauaguggggugucccucugaugugggugggaauggccauggccucuugugcuuagagcugcugaaaccccguugaacuaacauucagggaucaaaggauuuuauucuaggauagggaccuuaaaaaucuucuagcaagcaaaaugaaaugauugucacgggucuuuauaaaugcucagagcuaaacaaacauaauuauugugguucuaggcuucucagauugcauagcagacagauuaauacaaaauuaaaugauugucuugcauuuuauagcuguauguugcaaagguugcuuaacacggauaacccauauuuaacuuuuuuguuuaguauucauaauuaguauuuuaucuuucuaauuauaugauaaauaauagauacaaauuaugaaaccgcaucaaggaaauauuggaauuuuuuuucuugugcaucuaagguauaauuaacaagcauaguauguaaccaaaaauuacuuucaaucucuuauaagaaaguacuucaguggcaauugauuauuuauacaaauaugggaugauuugguggcauuuuagagaauaucugugguaggcaguugucccucaagacccccacccuaguccccagugucugccucagagccaguauccaaaguggacuagagaugacaccaaagucuuagugauuccucaagaacgaaauucaagcucugaaaguuggucaguuucauguauucaggccucgguugaaaagcucucuuuggcucagguaggaggggagcugaggaggagacggcuccuguggguggaucucuucugagcuuucaucuaggguaggaggcauuugcuggcugauccauuguaauagcgguucucaacuuccgggagcugagacccuuuauuacaguuccucauguuguggugauccccaaucauaaauuguuuuguugcaacuucauaacuguaauuuuucuacuguuauaaaucacaguguaaaugacugguaugugggaucauugacgcccaugaaagggucacaugaccccucuccacaaagggguugccaaacacauuacaagguguuauaaggaccaugguggauccaacucuuaaugcagauggcagaagggcaggaagacagaugagcugaagagagagaccccccgcccuacagucugaugaaagccauuacccagcugaccacaagcuccugcuccuuccaggcugaagcgcagaaguguucuauguggccauccagcccuguauucccacuguggugacacuagcucuugcauuucagaugucacagcugcaaaguggaggcagccuagggcccauagucacugccugggggcaggggugcucuggcggaaggcuugcccucaaaauaugggucuuugugugagagaaaagcaaguuuuagcuguauaaacuuaccaaaacccggggauuacuguagggcaaucggacauuagacacugauucugagagugcucuccagcaggaaacguuuguauuauccuucguaaaguaagaggcauagcucugugauuaggagucugggauuugcuguugguaugaugucagccucaguuugaucucugagugugucuagacaaguuuccuaaccaaucagagcccaguuucuagcuaucugaugggaauuucuguuuuaccucuuugacaggacaaugguuuuggaaauguggcuguacagaccccucguguuagaaaugaccccuguacugcugaagucuguuaaacgcaugacacugaguguccugccagaagacccugaacacagguauuuacgaaaugggcaaggcaacauaaguuuguaucaaugaauggauaaaugagcaaauugauuguguauauaugcaugugggaguauguggccauguguguguguguguguguguguguguguguguguguuucucucucucuugcgcucucucucucucucucucuuucucucucucucucucucuuucucacacacacacacauacacacacacacacacacacacacacacguauguguacaugugaagaccagaggucaaccccaggggucgguccuccagaguuauuuaccuuaucuuaugaagagaaggucuuccuguggucuggagcucucugauuaggcuaggcuagcaggcccuugaucccugaagaccuguuucugccuccacagcccugggacugcagcauacacuacgccaccagcuuuguauguaggcgcuggccauccaacacagguccuaaugcuccggugacaggcacuuuccugucugcguugugcccccaucuacagcucugagcuuuuuaacaaguuccaccggcgacccccaugcucacaaagguuucugagagagcaauucuauagggcagaggggcuucuaugagacacuaugugugggguaucagaguucuugaucaaucaaugggaggcauuauuuuugauuccagaagauggagugauguaaauguucguuuacucagaaaaguucggcaagugcaugaaaggugaaaacaagggguguccuuauuuucuuuagaacuuaagggagacaagaacaacuccaaaggaggcuugggguccauugcuaugacaucuugagaauucacugacaaaaugaccuggagacagacaaaggagagggucccuuucccaguagcaaaaccccccaagacucaggggcuucaggaagguggauuuucaugcagcuaaugaacgagucaagguguggcuggaggcgagcauggugccuggagcccugcuggaaguuauuggcagcuauauugcuuaucccuguagcgguuaggaaaugaaauaccucagucuaaucaaguaauugcauuaaggagcuacaggggaccugcagcuacuuuucuggaacagacaggcagucaacuguacuacaaccagguuaacugucaggaggaguuugacucaaaucucuuuuuaguucagcuaacauacuccgcgccacccccacagauguaagcaaaagauagaaaaaaaaaagggcaacuaacagccaaaacaaaacagcaugcugguaauaugugguucauauuuccagagcaaaauucagcagaauucauauuuauuguuuugagcaggggguuggagggugggauguggguuugggcaaugguaggcccuaaaauaaguauugguucuugggaugagcaggcucuucaggggcgcaggcaggcagcugcguggccacuuugcucagcagggagagggccacgcacguacuucuccacuccaagcugauggacagucauaguuaaggugaugauaauuauccaggagauugagaaugaaaaucugaggcguugucauuuaaaggaugagccagaggaaaauagugacuccaaaggauaggaccaucagaaaaacagccaguuuguguuagagcuuuucuugugauguuuccaguguugugggucuuucagggguaaucugaaaaucuucacacccauccagaaagauacagccacaaaguaggcagaguuaccgggcccucuuugucuacacaguguuagagucuccgccaggucucucggcuaccaaaugucucagcgagugcugcuuucaccccucaccucaguugugagaaccuugcucucuuggaugaggacaaauggccuccucccucaauggcagcggcucuccuagagacccugagcauguugcugaagcuuugccaucgcuccccuuccucccaggcucguauacacagcacugcucaggaccguguauuacuguaccguguaucccaguccucaaagcuuacaaaaucacuucuauuugugagguaaccuugcucuuucccgcucagccuugaauuugcccaccaggcuuucugugaagaauaaacuuaaaaauaaacuauuuccauguggcuggacccugggaucccaaacacaggccguaccaucaggacaggcaucauacuguucucguuugaaggcuggcguuuuaugaaaggugacaagagacagcagcugccucccagccucugagcuuggugucaugcugccuguccuguccuguccugaccugcggccugcaucacuucagucccuugcagcaugcaaauggggagagaagcgcugaccuaacgagucuucgggagauauucgcugacugcuuugaagaugaaaagcauuauggggcauuaaguacaauaauuauuaguauaaaaccucacacaccuccuuggaaaacuaaggacaaaugggcaggcaauauaaaaugccuguaacaggaggcgaggagcuaggguggcuugugaaaugugaggacguagcaucaucauuaggaagagcccgggaacucagagaccuuggacugaaggaagagaacagugaagaaggcuucccaggagaccugcauuccucaaccccagugggauucuggguaguggauccuggaggguguccucuuuucuaaaagcaauacagccagagcauugacccauggguguuauggacggagaagcccauucagaguuuguuugggauccuuuaucaccucgccuuuccucuaucacaguaacaggaugguagugugcuaacuagugaccauugggccacacauauguucuugacaacaucauagccauugacuccuuuacccggauccuagaaugaagcuugcuuaccuucucuggccauuuaaagguguuugcaaacccaagcucucugauccugauaaucucuaaucuucuccugguauccugaggucauuaaguuugugcugcagcuggcuauugacuugugcaaagugguugacuuugauggucucaccccagagaugcugggccaggugucucugucaguaucagaacuuuccccacguaugagcagaaauggggccucauugcagccugguccccaagccuucccugaacuuucgcuccuaucagcugggagcggaucaggauagucaaagccuguacucugauaugauugaggaguccugggggcuggacacaggggaugcaauaccacuugucuaugaauuucuuugguaaaucaauuugugguguuuaaguagcuggaguguagcugugguggacaggguugaucuaagguuaaauucaauggcauuuugagaccuuccuuggucuuuaguagcaauggaaacccucuugcauuugaccacaacccugcaagucgacuggcuuaguucuugggcaacuguguuggauuuugaccccuagaauaaauuacagggauauccaugaucacaugagcugacauagcauuuaauguguucauaaacccugcggagaguaugggaggaagcaugucaugaacuagggucuagucagugucuugggguuggaaaucaugaaaacagaaaaugaagggacuugaccugcaaaggaguccucccauucaggaaaaaugucaccaacuaacucccucaaggcuuuaguuggugacuguuaagauaaaguaucagcuagcucacgugugugaauguggcguggaggccagaggucuacauugagugucuucugcagucuuucucugccuuguaguuugaggcgagaucucccauugaaccuagaaguggcugccaaucaagccccagcaauuguccuuucuuuggacucuuacccugaaguugcaggcacauucugaugugcuuggacguuuuaaaugugggucacaggaggucaacacagacccacagcuugcacuuuguaccuggaaccaucucucuagaccccagcaagcuuuugaaccaaggauauucauaaaauccccaagugucuuggcuuggagcuugagagcagauaaauuauggucaugcgcagacuggguucauuuuccacagacuuugaagucuagugagauucauucauggaacuccagucccugggauguugugaggacccuaugacucucacuaacugccacacugacaggugugacuucaggacaaguggggacaguccccaagggugaugcaucugaccuggacucagccuguuauucuaguuucuaaagucaggauugacaucagucaggguggauaggugauaugccuuccuaagugagccuucugugagaaguggggggacccugccugccaggucuuagggugaccucuucuccgggugaauuauguuucugagcuauacugcucugccucucuccauuugugcucuuccgaauuucaaaguuccuuuaauggaaauucuauuuguguuucuaaauuuauagauuuuuuuugaugucuuguaaguucacugcacuuuguguuuugcuuccucuaaaccuuuuagaaaacacagucuguguuuagccaaaggcaagaggagaccaagcucccuuugcaacuuaggaguuugcugaggauuccgauggacugucuguuuggacaaaacaaaauggagucucugcuauuaauuccacggcucacuuacugcuucccauaggucugaaagccuauucugucaggcagucaguaggacaaugagauagagauuuggaaucacaaggucucuugauacugacauugcuguuguguggguguccccacccccuuuucacgucacugcccacacccauaacgacacaccuauuccaacaaggccacaccuucuaacagugccacccccugggcugaacauauacaaaccaucacaauaccuuucugagggaaggaacacuuuaacugaaaaggagcugaagggaugaauuucaucacacacauacacacacacacacacacacacacacucauacacacacacacacacacacuacacacacuauacacacacacaccacacacacuacacacacaccacacacacacaccacacacacuacacacacacacacaauacauacucauacuacacauacucauacacacacacacuacacacacucauacacacacacacuauacacacauguauacacacacuauacacacacacuauacacauacuacacacacacaccacacacacacuacacacacacacacacacacacuacacacacacacacacacacacacacacacacacuauacauauucauacuacacauacucauacacacacacuacacacacacacugcacacacucauacacacacacuacacacacucacacacacacacuacacacacacaacacacacacaguauacacacagauguacacacacacuauacacacacacuacacauacucauacacacacacuauacacacacacuacacauacucacacacacacacuacacacacacacacacacacacacuauacauauucauacuacacauacucauacacacacacuacacacacacacugcacacacucauacacacacacuacacacacucacacacacacacuacacacacacaacacacacacaguauacacacagauguacacacacacuauacacacacacuacacauacucauacacacacacuauacacacacacuacacauacucauacacacacacuacacacacuacacacacacuacacacauacuacacacacacacacacuacagacacauacacacaggaagguaaggacaaaauguggguggcaaggguucuucuacucucaucugcaagaaaagaaacuuagaaaaaaguaaaggaugcauugcgauguuuguuuaaagaacaguaugcucuugcuuacuugcaguggagaccccguugccuuuccaggauuucuggugggcauacucaccaguuauggggcucaucagaugagaaucagagauacagagaauguaccacaggcaugcauacaugcaugcacagaaaugggcagggaaaugcugugugcgacucugugcaucacggccacuuccagauccuucucacucuggaccugguuccacggcuucacgggaaagcucgugaggucuugaauugggugggauggggcuuccauaccauggugaacagcugggaaaacucacacugauagcucccaguccuaucccugcucccacagggauggcuagggacuagccauaucccaugugggccaccauggagcugucccugcagugucacccugauguccucaucagaacaacauccugccgaaacacuugccuucuuccaucucaucugcccauuagcauaaaugucagagcuccguuucaucaaugcgaaaacaaaggcuuagaggcucauuugcccaauuucaccacagguaagaggaagagugaggacccgacucacgucaccgacaucuaaauauaguuccuugguuaugguggcagagaaauaacaauaaugccuaaagacaguagauaauaauagaugauaauggaugcuuuacuaaaugcccugcaccauuuuuaguagaguuaaugaucaguuugcuucacucucacagucuuaugagacagguacauuuguuacccacaggaaacaauuggggaaaucacgucccuaaaguuaaguggcuucccagaagccauauagcccgggaagggagaaggagacauuuuggucuaacuucacagcuguccagagcaugaucggucuuccaggugcagugacauaugaaugacacccccaucguggguaucccugcaaggcuccacagucacuacauuaaagacaauuucucagacgaguucuccaugugcuccaaccuaagaaaccuuagggacagagcuggucacagguccccaggaagagaacuucuccuaggcaugccugaggugccccagagccauuucugaucuuuuaaagaugacaaagguguuguagccccacaggggugaaaagcagcaguuaacuugggauggugagguauggugaaaugcuaauggcuaauggcuagaugacgcauggaugcgaguccugggagccucugagaugcccuagcaggcuccucugccaugccuguaaguagaggacugacagaccuaugcuagacucuacauggggcaaugaccacuuguuucccaaggcaguuuccaucaaugggaccacucagucagucacuucagagggacaucuuuucugugacagaugaagacuuguuuugagggcacuugaaugcagguguugaggggaacucacacagaggcaccagauguuucccugcccccuuuccucuucgcuccagcacugggccuaugugcacaacaaugacagacauuuggggcugcuccagcuccuucccagacucauacccuguguccagcuuccuguaaccuucccgagcuuuagcgcucaggacacaggaugaagacucucuagacucuaggacaacguacaaguuugcucuccuugaacaggacccaggagacagaacugauuuggccucagaauuccuucaaagccacacaugucaaccuaggcuacuucaggccagcaaagcacuaugggaaaaagugaaaggugugcugugaaauuucagaagugaagguugugcuugaugagauucuuugacguagcgucuacugaguccaaauguggacagggcucucuaagacucagugacuugggaagccacugguaugggagacugaccaguuaaguuugcugucauucuuaagacccacuguuuauaccuaccgaggcaacugccucucucuaccuuauugacucaaguggcuucuucauugucuugucaauucaagaccaugacuucccaggacauuuuuuuuauccugaguccagaugccaauauugacaauggaguccacaugaggagugaauuagugugccucguuccuagccacucucuugccaaggaccagaggcuucuggaacauucuaacacugcugugggaagagucagcaaagcaucuaucccagugagcaaguggcucagccgugugagcaguaggaggcagggacuucccuuuaugaucaggauaugguugccaacagggaguuuuguuucuugugagacacaguuugcccagacaaggugagggccaggugucuguagucuuuggaagccauguuugaguuugcacaagaugccugccauuuagcaaucacacagacaauucugaaacaggacuuggagcaaugaaguccagggggggaaacacugucucccuacuuagaaacugugagcagagaggcccaagucagacuuuucaaaacccaggcccuucugugagccgaggaaauacaguuuucacuuaucuuuggagccuuugaaguacaaaccugccucagcuuaauagcacaagccagagagaggaagguggauuccuuuugaauuaaacagacccaaguccaaaaaggcaaaaguacuauuucuaaacaaguagacaucggggccauugcucacaaacauccuugacaugacugcucauaggacagacaccuaugucacuauaacaggaaaugggcaggagaggcaguugaugguuuuccagucucuccucuauuggacucucagagcaucuuaucaggagaugaaaugugugaauuugcucgcuugcauguguagagagagagggcgagggugagggagagagagagagagagagagagagagagagagagagagagagagagaggagagaggagauaggagagaggagagaagagaggagagagacagagacagagaggaagggagagaggaggaggagagagagacagaaagagcagagagagggagagagaggaaagaaagaaggagagagagcagaaaaggaggguuagagauaggagaggagaggagaggagaggagaggagaggagaggagaggagaggaaacgaaaaagucuuugcugugcaguuucuucuccugccugacccaauuaucagauucugcauuuaaguuugagacagaagaucaaacagcaagaggcacuuuguacuucugccaggagaccauaugauaucucucagcgacucuccugcaugccaggaauacggaaccaugccucucagcugggccugcuuaugguucaauguguaaaaaaaaagggggggggagggagaggcgggggcaggggagaagaagagaaagaaggaaagaaaaggaaaagagcaaaacaugugacugcccucauggaucguggccaggaguuuuagcaguuuaucaguuacagaaaaaaaggcaaaaggcccaaucuaauuauaacucgccacaaauaagucagaagccgagugaggaccgagggaaggagcgagccugugucgggcuuacgcuguaaaacugaucacgucgagggaugaucauggcagacagauuguguuacaagguauggaucggaucuguucuggcaacgucuauggccgugugaccaugagugggaggggcuggaugcugaagcugggcuucuuucuuccccgguuuaugguuuaucuccugaggggauugcuguaagggcacacuacgcuauggaguggugugugcgagugaugugguggggugggguuucuugccuucaugaagacuuuacaucccaaugaaaagaggugccuugggaaagucacuuccuggacucagagacucaggggauccugaccuacacggcaaggcugucagcauaugggacaugaguugcagcacacugucaccccuucgugaacgacagcagaaucggguuguaccucaaagcacuuaccuuucccaauacaccugauccccuugaggcuuguuaaaauugagccccaccuuuuugggaacccagaugugaccagucaugcuuugucuggccacugguggugaaguggucucaggcagaccccauaacuccuguccuccaaggcccggcucaguuccuggucacuuucuucauccgcauuccugcaucagccagcgguccugcucugcgcuccaugacggucagugcauggaccuuguucuuugugucugugugcucagacaguccuccuacugauggaagagcccauuuuccuaacuauuauggacccauagcuggcccauagaaaacaaaucccgcgcuugugaacguuuggccagucugaacagagguggucuuugcaucauuauuguaaguucucuguguguucagauuauuucaaaauguaaagagaaagccagagauggaaaggcuuagauaauucugggucuugguaucagaucagugacagacuggcuuuugguaaauagagguguguguguagguguguguaucauauacaugcauauauaucaucuauguuaucauauacacauauauuuaugugccuacucaaucacuucaaucuuauaaaauuacauaaauaucauuuaucacaauuguauacaugaggacauaggaucuaagagauuaauuaaaauagaagucucgggccagugagauguuucaguggguaaaggccccugccaccaagcucaauuaaccugagucugauugaucccugggccccacauggagagagaaacaacucaaguugcccucuuaccuccuuaugcacaccaugguguauguaccccugccacauacacauaaauaaagaagugucaaaaaaaaguaugaauguaaaaacaaaaguaugugcgugggugcccuguguugaacugacgcacaguggggauggacucaguaacacaguguggagcugugaagacagacucugcucuucccagcaaaggaugucuauccaaauacacggugguugccaaucaaagccuagccuugagagaggcaccauggaacuuggcauuccuuaacuuccucuaauugagucugaauaauaaaugagcaaugagaggcugagaucuggaagucuguuaacuccagaauacuuguaaucauaacaaaguugguuuuuaaaauuuagcuuaagauggugcuggagagauggcucagggguuaagaguauuuauugaucaugugaucauugauuuaguuccaaggagaucugaccuccucuucuggcuucugcaggcccugcuugcccaugaugcacagacauacaugcaggcaaaacacacauuuacauaaaaauaaaucuuuaaaaaaguauuuuaaggaaguauaucaucuuauuauauuauaucuagugauaauguauuaucacuagguauaauaguaacuauuauaguuaguuacuauucuguugguuugaagagacaucacgaccaauacugcuuauggaaggaaauauuuaauucgggccuugcuuacaguuacagagggugagucuaugggcaucauggcagggagcaugguggcaggcaagcacggaccuggagcaguaguuaggagcuuaaacauacagguccacagguagcaagaaggggguugggaggguaagccugcuguggacuuuugaaaccucaaagcucaaccuguccccccaugcccagugacauacuuucuccaacaaggcuacacuuucuuauauuuuccaaaugguccaccaaacugggagccacgcauucaaacauacaagucuaugggagccucccacauagucauucaaaccuucacauuuaucauuuggccacuuugauggcacauuauuacccuuuuuacucaucaucuaccuaucauguauccagcaucuacccaaccccgacuccauucacaucccaccuauccuuccauggcccuucauguguaccucacguccugugcucaaacacagucuuuguugagggggaggugaguguuuugucuuggcugaguugaggaagaagcuggguauaucagaaguuagagcucagucagcaagagagcaggagacaugaagauaagagccggcggcagggcagggaggugcaccucuucccugaggcccccgauugcugcaaucaaaccucaagcaccacguauuuuacagaacaagcauaacgacauguugugugguucaccagugcuuuaugaaggguuucuguggcugcccagaugaggcagccacugagccgacgggcucucuugaaagagccacuucugggacaucauuaaugacccauugcgugcugguaggaucacuuacagaccuuaaucuccuaacuauggcuuagaauacuuuccccuaaacucauuagcagucuaucauugagcaucaugugacacuuuuacgucucgcugcuuggcucuuucugugcuucauucacguuaguaauacccagauuaguucauuuucaccaguaaaaauggaaaugucacugucuauugcuuggacuuucagauauucauaacauacugaauuagagagcccaguguuaauuucucucucucuuucuuucucucucucucucucucucucucucucucucucucucucucucuguguguguguguguguguguguguauagggagauguacauuugguuuugggcuccacaucaauacucuagaacaaaagaucucccaauuccaucauaauuaaauaaguagaaguucuuacuuggcucugugccaagacgccucugcaugcgagaucaauucuauuuacuggccccauuugacccuuuuuauucucuacauaaagacaguugucacacgcaaagagaaaacaaaugaaacaccccaaagcaaacacauguuccuaaaacgaguuggaaaucuaagucuuguuuguuccuuggugacauaaacuguguggccucuuaccaaggacacuggcuauugagaagacuuccacagugagucuauggugaaacuauaacauuucccccgaucaaucuuguguagagccgguguuuaugcaucugccuuauuuauuauagacuauagacuucaauggcgaguaaagacaugaguuuguacuuaaagggaaaaguggucugggauuuuguauugaucaguucugcagaaugaugagaguucaccuugcugcugguggagcucagacugugcagccacccuucaccaaccuucccaagcugucucaugucgccucaaagauuaaacccguggguugaggagccuggggcuaccuuugacccacuucacuuucagcgauuuucugggucuugccauuaaauacgacuuuacgguagugaucagucagcucucaccuccugaguucuucccuuagacucacugacuuaaaucucugaaagaucgucaaaccuuguauuuuucaugcgagucucccaaaccaguauagcccagacugaguccugacgcggacagauuugcuagcuugcuggaugucagccccuuguaagucuuucuuccuagguucuuugguguggaucugugcagagggagggcacagaugugggaggcuuccguccuugucccccaguguccugauagacguucucacuguggcacccgugaccucagagugcacaggugggugcagguuuugucugugggugaaaaagauggacaaauugccagauguccgccuuuacaagcuccuugaccucacauacucucuccaggaacuggauccaguagagucauauguggagaauauuugugucuggauuuuuacaucaccacaaggcugagcuauuuuuaauaagccguucguuuccccuagaagcuuucaauguaaucaaugccuuguggcagucucaacacauccuuucucauguuucugcacaccagagcauccccagugaagggugggagagauggcucggucaauaaacugcuugcugugaaagucugaagacuugaguuugaccagcagaacccacaaaacgucaagcgugcugguccacacgugaucccagcacuggggaaguggagccaugcagaucuagggcuugcugaccaucccaccuagccuacuuaguucuaugucccagagagagagacucugucucaaaacacaagaugcgguaucucugaaagagugacaccaagaguugaccucugaccuccugggcaccugugugaacacccaccccucucugcacacacuccucccauggagggaaaacugguguugugucaguccacguuugugggggcuccuaaaguuuguccaucuucacuauuucagggauacugaagacuuggggucucagccuggauuauucucagaaugacugcagauuucuucucugcuuccuucugcaugcggaacuuuuagaacaagcucauuuucauuuuguugucguugcccuuggaaacauccaugagcaaggagaugaacuaauuccugaugcuucuucuuuccaugcuugauguuucccagucguguaaaucauugcagaaacgaagcuacucaagcccugggucuucacaggcagacucagaagcacccccucaaugcuggcugacccgaggugccaacgaagcccaguccauauuagcucaagcugugcccaagcucugccaagggagcacuucugaaacuggggcagacuuugcaugaaaccucauuuucaaacugaaaccaugaagaaggaaaaaaaaaaggugguucagugugguuuuuuuacucaaaaccaggugaaccuuugugguucagccaaguuuugacuugaagacagagagggcucgccguguguggcugggucucguuucagcuuucauguuccauuugguucuauuucccagaccugaaaucuuggggucaaaggaggguagaacaugaauaagaugagguuggcaugaaauggggugcagaugacagcaaccucagcuuucuagggccuuacgcguuucugucugccuccucuucucucaggacuccuuggaaagaucuuucaaacagucagacuuuuaaaauuauuauuaaaggaagagagcuauugacaccauacaaaaauagcuaaggugauuggccucucguuuaugcuaaugaauccauuaauaaaucuguuuuuguagcucaguuguugaaagcauggagggaaacauuuuaaagcaaaggguggugacaucacacaugcccgaauuuccgugcuuuaagugucugcccugcagcacguacaugaacuugccacauucuuagaaugaaucuugagaguuuacagacaaggaagcuaagcucuuagaaauuggauggcuugcccacacacuaagagagaaagcaugcagguauaguacaggcuaaugccccuuaccugagauacuuggaagcaaaagugcuuuggauucuuuauaucuagaagauuuguguauauauaaugaaguaucuaggacugacuuaagacccaaaucuaagcacgaauuuuacuuauuucuccuuguauacacaggcugauaguaauuucauuuuugucuuaguaucauuucuacugcuauggaaaauacccugaccaaagguggcuuugaggagaaaaggguuuccucagcuuacagcuccaaguuacaguaggccauuuugagaaaguccaagguaggaacccaagcagcuagucacaccacacccacagccaggagaaaagagagaacauaugcauccuugguguuugcagucacccagcaucuuacgcagugcagaacccccuaccuagggaauggugccgcccagagggguugacauuaguuaccacucgagacaguucccacagacaugcucagaggccaaccugaucuagacagucccucaaucgaggcucuccucucaggugauucuagguggugggaagcugacaaauccuaaacacuacaaugugauauuuuccagacacaugcauuucaacucaguaaauguuuggcguuuucacguaagacagggcaggucuaugauauuggauugggaguauuucagauuuucagacuguugacauucuaccuacaccaaauagauuaccaaccaguugaucaaugguaggggaaaauuccucuagauuuugacuucauuccuucuauuugccaaauuucuguccuacagaaacuuuuuaacuugucaagcauacuacaagauacacuuaaagccauaacaucuggguaaggguugccgaguacccugggaucuccuacagguagcucuauggggaaagggaugguggggagagaagaggggagagggagagagggaaaagaggagcaggggaggaggggagagaaaggaucauuuccguuuuugaaggcaggaggguagagaugucagagacugaaacgucuuuguaaggcaguagcauuuggggcucugaagaagacggaagcauccuggaguucaggaagaggaaagagagucuuggaagagacacaggcugggaagaacagggaugugagaggcacuggaguggaguguuuauagugaagaauugcagaaaguaaaucuuggaagagaauuugggccuaaaucacaagggauuuacuaaguauuccaaaagcauaaauacccauguuuucuauuaauaugcauuuuaguguucaaaaugaaguaaaauauuggaaaaguuucaggauccaccuacuguugaauccccuacucuucccaaagaucaaucauucauuauucccaggaauggagauuugauugacaugaggcugauagacaggaguguuguuauuucucaauaaccuaaaguuggaggccuauuuauuggaaaagcugcugauuuuguaugcuaagaagcauccucugaaacccaucucuaaagggucaucuuugaucuggagcugagaauauaaguucugagccaguugccaaucuggucaauuuagucaagucauugacuccaauccauuagccaaaguucuaaucggaugguucauugugcccaaguuauugcuggcugcuucgcugggaagaauggcugagaugcaaccccuaaauggacuuugagccaccauuacaacacaagcauuugagagcugggguaguuagauauuuguuguggguuugagcagacauaacuucacucuaggcuaagacacugcaaucaaugaagaugcaggaaaacacacuaguacuaccagacuguaaaccuguaacugcauagccuagauucggugucugucugaauaauauucucaccuggcccaaaguuauggaagacacgcugccaggcccucauuuacucuaaaguuuuguugugagcccacaaggcaacaccgaaaauacccagcgucuuccuggucuagggaaugccucacgccagaugcguccucugugaaaacauucucaauaagcagggacuuacuguggaugagggcucugcucugcuggguuuccacagaauuccacagucagccacccaugugggcagaggaguggggguguuaugguacuuaaaagcagcagaaauggacaugucucccuuuugacugacugccuguaaguacagaacagaaacccaguucuuaauuuauacuuuugcuauuaucuauacuuuuuuucaggagggaaaaagauacugucagacuuaaggauuuuucuuuuuaaacucgagcgagcaacaagaugccugggcaagcauuaguaauuugaaagaagacugguuuaugauugcuuuguguuuugucugcucagaugucuguguauaacuuuuguagagugcccauugagguccagaaggagucacaucccuuggaaauggguuuacagacaguugggagcaaccguguggguucugggaaucaaaccugguccucuggaaaagcauccagugcuccuaaccacugagccaucucuccauccccugagcauuauuuuguuuugcuuugucucgucaugugucugccacacuuucaugcuuuucacgauuguuuuucccaguccgaaagcaacaguuauuuuuuucccugaucuuugcugcucacuugugagccagauccaggcaacaaaaucccagcauuuaugaacagccauagaauagcuuaaacggauagacggaaaauucugccagcucugauaaaccaugagcugccuauuauuuaagucuccgucuucuugaggacucauuuuucguguccagagacauguucuccugagccacccggaugaaacauuuaaaaagagagaaaaauguuucagugaccucagagucucccuugccagaauuuucagacagaacgggacuuuggucugugccgagccaggcaggcuccuuguauuccaggagacagauuaccauucuuuguauugacgagggucagauuuucguccuugugggcugagcuuccaguucugagaucuucagcuacgcauggauaacuggagcugcugaggagucaggaccauugcuaauauucugggaugucucccgugacccuacagccucagagaugacagaagaauccagaaucucugcuucgagacacgcuuuaagcguuauuuauccacuggggaauccucuugagccuuuccuguaagucguugucuuacugguuaauauuuuuucccccuguuuguuuguuugcauagguugauaauccagaggcuagugccaagcauucugcauaauuacaauucucaacuaccuuuauugagaaaagucugcacuguguucagccaagugauuuauuggggaaugacacagguacauuuguggcuuagaggugaugauuuauuuucagacagaccuggacaaauagaugcuaauaucaaaccaccagaccagcauccagucugccuggagggggauauuucuccuuguuuggcugccguccuugauuguauuuuaccuaucuguacccugauauuuugauuaccuucccugaagauauauagaguaacagaucucuuaauaacagggauauguucugaaauaugugcuguuagggaaaucucauucuugagcgagugucauaggguguaguuguacaaggcaagacagauuuggcauugcugggcaguacacaaccucaagagaccaccauuauacacaugagaucuacuguuuacugaaacauggcuagcuaucacgcaauccaccaucaucugguaaucuauucagcaucgacaucuggcuucagcucccaucuguucugaaguucauuugaucauggucugaugauguguuuuuagagacaugaaaaauguagguugugaaaaggugggcugaauugcuauuugcaguccuuucuccucuugcuccccaaacaauagaauagagagaguacaaagggcagaacugagagagagagagagagagaaagagagagagagagagaggagagagagagagagagagcgcuagucacaccuacuagagcucuguggacaggcucccuuguccugagcacaggucugccccugacagcaccuggccuagaguucuacuuacgcuaugauaggauuacaauaccggcuuaacaaguugucagaugcauugacucagugcacaugaagcauuagcacacacacacacugcgauguaugaacagcaucuacggcccagagcaucacccugaccuuagcaucucuacugaggagugcuuuggaccuuucuggauaucacucuuuuucugugaucugaagguuaagugcugaaaccacuuauuaauauuauuuugcuuuuagauaagaacucacgaggcucccuagggaaagccacacaaaggaagagaccaaaauauaugaaaauaucuaugcaagcccgugggaaaggccaggcuagugcagcagcuaauccuggagcugguuuguccggagccauauacagacuguaaagacacgagggcgagguaguugguaccuauaauaacugacgcacugaaacaagacucgggucuaaaaagccauuucaaaucgaguuuggcugggcagugguggcgcacgccuuuaaucccagcacuugggaagcagaggcaggcggauuucugaguucaaggccagccuggucuacggagugaguuccaggacagccaaggcuauacagagaaacccugucucgaaaaaccaaaaauaaauaaauaaauaaauaaacaaauaaauaaauaaauaaaagauugaguuuggcccauggucuuucacuguccuacuucgcgucuuccugccuuaugggaagguucaucaucaaugagaugauauuaugggugauguggugguuaucuguauugucuacuugacgguauuuagagucaccauggagaaguaagcuaugugugcacugucuuuugucucucucggcguuuggacuguggacaugaugaaaccaaccauccuuagcuccagccaucauggcuuucugacuugauagauugcaccuucaaacugugagccaaaauaaacgcucccucgacuugcuccugucagaucuuccacaucaacuagaaaagucacuagcauggccacugaagaaagccuagaagggaagacuuggcugggcagauguuacuaagcugagauuuucccguggagcccucucuguuauccugagagaaacauuuucccuguuacugauggaaaguuaacucucccucaaagaagaccuccuuuccagaaacaccaaacaagaaaaaaguaucagaccuugcgauuuugugucaaccaggagccuuuuccaaagauucgaauggaauaauuuguuuuucaugguuuauagguagcagauaaaacuuacauggaaaagcgggcaggcagaaguggaaaaugagaagcagaaccuggaaucgucagcuuaaaaagcaauuuguuucauuucagcugagcccaggaauaacuugagguuaacaaguaaauauuucuacuggaaagaucggcuacaauuaggucaccaacucagaaaagacguaggcggaaauuuaagcuccaacucuaucauuaaaaagguaccccgucagcagaacugucagcugugaugacgaagcuaaaauaucaaaggagaacacaaggaggcuuuggaagggcccaccccuuccucagaucaacagccacccagcuuccaaaaauggagaaggggcugaaauaacacgucgggggacuugguuugaacuccuugccuuccauaccagucuaaaaugagaaaaauagcugcuuccuuuggaguuccaagugcugccaaaggcugcaaaggcgacgcuuuuaauuuuggcaguggcaaaaugcuauuuuuuagauacugagagauguuaauuuuauuuugcuaucauacugaggaaugaggauccgggaggcaggggucuagagguacuuccccaaauccuuguuauaugagaaugagaaccucaggccaauccccugcacccaaguuaaguaugaugcaaaucaccucaagccacgugugaugguggacacaugagauccacguggaaagccacgugugaugguggacauaugagauccacaugaaaagccacaugugaugguggacacaugagauccacguggaaagccacgugugaugguggacacaugagauccacguggaaagccacgugugaugguggacacaugagauccacguggaaagccacaugugaugguggacacaugagauccacguggaaagccacaugugaugguggacacaugagauccacguggaaagccacgugugaugguggacacaugagauccacguggaaagccacaugugaugguggauacuugagauccuaauuaugggcagguagagacagaaagagugaacaucaagccccaggccucuuugagaaauccaguuucaacaacacacuugcaagcacacacacacacacacacacacacacacacacacacuacauggcucucaagggaugcauguaggcaguaguguaaaggcugaagaccuguuugagaaguagagugcggacagucagugcuuuaacagauggggacucagccaagaacagguuucuuuacucuuggauguuuaucagagagucugaaaagacgcuguuauuaauuugauguguauuuuucauguuacuugaggauuuacuaaugaccagauuuugcuaagauuuaggucuaccuaagcuauggaauuuuggagaacacuaauuuuuuguuuugcucaucacugaacucuuuuuuuguuuuguuuuguuuuguuuuguuuuguuuuuguuuuuguuuuuguuuuuguuuuugcuuuugcuuuuguuuuuguuuuuguuuuuguuuuucaagacaggguuucucugugugguccuggcuguccuggaacucacucuguagaccaggcuggccucgaacucagaaauccaccugccucuguuucccaagugcugggauuaaaggcgugugcuggccaauucauguauccacuugguuuaauuguucauauauccaaacaauccugucaaugggcuuuuccccucuuuuccaaaucuuucaccacaggagccuggcuugaguuacacgaugagucuauuucuuugggacuguaaacuuucugagacgugggcuuuugguggguguagucucaaagucaugagcauaguuagguccucuauccagucucuauucuucaaauggggaugauacugggucagacuuccuaaaggguggguccuaccauagcugcccaaccaccaugccccuggaaagggagguggagcucccaggagaggugguuugggccaugcugagcagaggaagguagucacaggaggagaggcacugcuucauccucugguccuucugcuugguucccuucgucagauggaugaacgcacagcuggugcccuaacuccaaguuucuacaucuuuucucuucuagcaaaaaauuuaccuucaucaauuucuuauucccuguuccaugaugaaauauugucgggccuagucuuaugcagguagcacauuugccgcuaacucauagugcaugaucuauaccuuuucccacaugacauaaacagugucuucugcuacauacuagacacagcuuucuaggaauggaccauuaaauacaaccuccuucuaucacaugcucacccaagcaaagaaggugccuguuacaggaggauagcucuuacuggauuccucaggucagucaggauuuaauuauaaagucagaagaugugugugugugugugugugugugugugugugugugaguguguguguguguguguguguguguguguguguguguugcuugccugugcauguguaucauguggagagggugaacagguauuaucaacccuuagaauugcacagucagccauauagcuuauccgugggagagaccccacugccuugguuccaacugugaugucuggauaggaaagaugguugagauaaaccaaccuuucagaggaagggauaggagaagggagacaauuaagauggagaccugaaggaacagcagaggcagaaaggagguguuugcagaccagagcaaugccuagcugguagagaaaauccaggagagggaaggaaaggaaggagaggaggcguguggagcacaccaguuugcagcacccauucugagugcaaguuugagcacccauugaucauucaagaagguaaagaagucugaggggagauggauggaguuaguuaauaggaacgauccauagaaaggccccucgccuuuucacagcccagccaccauggcucacagcagauucauggagcagggagcugugguuggguugauggggaaaguuuuguccuguggccaaggccagggucuaggagcaucauggcugaacaaagaggaucauaggugucgucauggagaccggcagugagccugcaaggauggcgaaugcagucaucaggaaugaggaagaaggcaggaguguguguguguguguguguguguguguguguguguguguguguguguagaggaacauuccagaacaugaucucguggagauaguacugcaucugcucugaaagcaguuagccugugaugaaggaagacauuccgaggacagccacucccucacccacccaccccuauccugcccugguuuuaaauguuggaaggaggcaggagggucucaguguccuauggggcuccugaguucauccucaguggggugguuguccuuccucacggggggggggggggaggggggucaucucgcucccguguuauaggauugcagucauuuugcccuaucuagcauuucauucuacagcauggccucaggugugauauguucuacaaguguccguuggucucuguuagggaagucuuuggauccaucccuuaagcucuuagaaccuaguccucuccuccaggugcaccggguuaacucccaccgcucucuccuucaagucccaucaugccucuugucacuuaucaaaggcaggcacagccucaucaagaaaggggaaagaucaagauuuggcaccaaguaucaccacguagccuguaagagguuccaaaaucgagacuggcaacuguuagugccaaaagacggauucaggagagcccaugggugaugcagcaagagaguugcggcucuugucaucucuccaguaaagagaguugggguccuugcuugucaucuccccaauagucaggucuucccagggcucuuggcuuaagacuccuuuuagaauaagcucucuauggauguggugacccuggcagcagucgcagggaauuggguugaugcuaaagucagugaccaauaucuuuuucaaaaaggagauccacaggaguucaagggaaggcauaccaugaagacagaagcaaggaccacaagcaugcaggcagcuagaaucuaaaugagaugcaccaguggcugucuggacccccagaccugggaagcagcagggggaguuguucucuacuggagaagaauggcagucuaugauaccuugaccuggagcuuccacacccaagaacugugagggaacaaauuucuguuauuuucacacacccuauuguggugaucuguuacagccauggaggaccuggccacccaguuuuucccuaccuagccaguaagccccacccaguggaccacacuguccuugaagccagucccagugcaacuagcaugauuuaaaggccugggaagccucacccacgaggcuucaugcccagguaaguguguuucccgggcccacccucgucauuacugacuuccaucuguguuccuuugaacuucaaucaauggcugaacccagaaggcuguuuugacugcuggcuucuaaacuccccacugugugguuuuuugggucagacagucaggcuuacuucugugaaucaucacccaaagauucaauuagcucuggcuucauccaccuuguggccgggccuucggggacagacagagcgagaagagaaucauuugggcaauggcugaggaaagccaggcaugccaggggcucaaggugcugacacaggcagggagcagggagauuaguguugggacagcagggaagaaugaagucacuggggcucagggucuggcacagggacagcugcugauuccugacaguaauucagggcgagagaaagugaagaggcuuugcugugugacagaggggagacagaggccagagucaaccggaggugagacacguguuagcaacauagugcuuucaccaagacagagaccgaauuccaggcccaagucuguugggauagaaauggcuggaacacuuccuuugaagucugacaucauuaacaaaaauucacauaaaaccaaaaaggaagaagaaagggagggagggggagaaggaggacaggagggagacugaguuuaucuuaacaaaggcaguaacaaagaaugaacagagagcugcuuaagauuuucggcauagaagggaauuccguuaaacccaucacaaagaaaaggucaaacaaacaaguaacaaaugaacaagguuucuuggcggggccuggaaggugcugugcuguggaugggcuugguccaugaggcagagccccaaggagcaccacuagauucagggguggcccugaagucacagaccaggguuuggauuccguugagaugggaugagaugauuuuugcuggccccuucuucugcucuggcaggaguuucccagugugcuccaggaacuacuggucaugacuugacuggaauucucuaaggaggagcaguggagcacaggcaagcaaaggagaucccugacugaggcuggacuccugcugguccagguccacucugcugagcacugugauaucaccuacugcuuuuagagucuuccugaaccugucuuugggacuucuccuuuccuccccagcuacuaaacuccuucugccuaggccccuggguccuacugaugagugaccaccugcaccaagagacugugaccuguuguuugugauuucuacagaggacaaauuuccuacuucucccugggcuguagagcuaagaaauggagauucaacacccugugauuugcuuuggacagauuucucccacaccugccaugccaucucaugccuuugacacucugcaugugacagucccuugaauaugcaguugggugugucaagggaugcuucauucucaucuaguagcugaccacaggcaggacaccuucaagacccugugaaaagagcuggagcaccugucuucccuagcucaaagaggauaauaucaauagauuuuauucagaacagcgagaagaaccaguuuggcgcacucagagccccugcggugaccuucauuguucuacaucccauuugggauaaccucuuaguucauacuaaggugugagagacugauaguuucacuaauucugguauagguggcagcuccagcaaaucagggcaaaagccaagaacccaggugauggucuagugcugggcaguucaucucaauuucuggcaucucaauuucucaaacaaaacaacaacaacaacaacaacaacaacaacaacaacaaagaacacaugagucccauaggagucccuggagucugcugugguucuagacacgaaggauagguuaggcagaaagccugauugcaggacacaccccauguagguaacauacuacagagggccacgugccagucaacagauauguuacaauuucagauaguaacagggcaauaaaauaaguccacuuuccaaaagaugagaaaaaauuaaacaagacagagcucacacguugagugaccuaggccacgugauggucacaugcucaggcaugcccucuuggaagucuugguucacacuucagucaguggucagaauguccagcuggggucacagggcaggccaacuuguggccagaggggccuuuacaaguuugguuucuccaccucaaguccagcaauaaaacggaugacgcugcaggcagccugcuuugaccuuggcaggagggaacacagucuccuggugcccagcuucuaugggaguuggcagccagguccaguguuccccgaaaggaccauguuuucuuuucccugccuggaagagcuuuggggccugagggaagugucggguuggugggagaggugcucguugcuuccuugccugugugcgauucuaaggugcaucuuuggggaggagacaugugggcuugacaagccuccagaggaacccgaacccaggcgaacuucccaaauugaaccuuggugucuuggugguugugacucagagacacgguaguauuaaaugcaugcaaagggacuuaggggcaaggaaagaugauggagacacaggccauauuaaagacagauaauaaaagucgugguuucgaaagaauaauuuuggggugauugggaagucuaaaggcaaacaaagcugcccugaggguuaccugucccucagugacuuuucauuggaguugccuucucagaguuaucugagagaggacaggagcccaggggagauggccuucugugcuagcuucagggucucucucucucucucucucucucucucucucucucucucucucucucucucucugucuuucugucugucugucuuuccuucccuccuucucucucuuucaacugaaguaaaggcccagggauaaauaaaguuuaugcccaaauuucuuccuugucagccccugggauucugggauuuuuguuuuccugaauauuuuuuguuuguuuguuuguuuuuguuuuuuauuagguauuuauuucauuuacauuuccaaugcuaucccaaaagucccccugcccacucccccacccacccacuuccacuucuuggcccuggcauuccccuauacugaggcagauaaaguuugcaagaccaaugggcaucucuuuccauugauggcggacuaggccaucuucugauacauaugcagcuagagacacgggcucuggggggggggguacuggguaguucauauuguuguuccaccuauaggguugcagaucccuuuagcuccuuggguacuuucucuagcuccuccauugggggcccugugauccauccaauagcugacugugagcauccacuucuguguuugcuaggccccagcauagucucacaagagacagcucuaucuggguccuuucagcaaaaucuugcuaguguauuccuaggcaaauggauggaccuggagggcaucauccugagugagguaacccaaucacaaaagaauucacacaauauguacucacugauaaguggauauuagcccagaaacuuagaauacccaagauauaagauacaauuugcuaaacacaugaaacucaagaagaacgaagaccaaaguguggacacuuugccccuucuuagaauugggaacaaaacaccuauggaaggaguuacagagacacaguuuggagcugagacgaaaggauggaccaucuagagacugccauauccugaauauuucuaaacaaugauuuuuuuuuccccuaugcuuuggagccaggcaagugauuugggggaaagccauagcuucuggagugguuagccacagacugcuccccauagcucuguuaguacacaaacagggcuacuuccucggaaggggggagauagcagaguucaugaucacagggauguaagagaccccagggauccaaugaggcagggaacucauuuugacagcuguggggcugauccaggguuccagaacauuuaaggaagggagcugcuuuccuuacaguggcaauucaacguuuaaaaccagaauaaaaugauugaaggaauguuauaagcuugccaaaaaggguaaagcauuuacguagauugucacaucccuuauagaaaugagugauuuuuuuucuacuaauaaagacuuggaugcgguugcuuucgcaccaggaacugccucugacacccugugcaugccgagcgaguguucuaccacuacacucugcacauccuucucacagccucauuagccgauagcugcaagccaccucagccaccucaggaaaacuggaauaauuuccagccuggauauggcuggccaccucugcucucguccacccugagcucucagccaguucuggggcccugacugcucuccugccugggauggugacuuguccccagccuugcccaugaacagguugcaggaagcacaggacacaagagucagcucugggcugguaccagguggccuggggacuggaaaggaaguuugaccucaugugguucacagcagguucugggagagcugugugaggaugggugaggaguggggaguggcuggcucccgagcauggcuggggaccgcaacuucccagggacccacacacacugggcuccacccuucccagcagacuuguagcucauccagcugugaccacaaaggguggaaccgaauggccugggaaccaacuucguauugguuuugguaaauucaaaugauagacugaguaacgcauuggcaucuucagaugaaguuauauuacagagcugggaauagaguucugugguaaaaggcuugcccggcacccaugagguccuggguucaauuccaacacuacucagacacagacagacagacagagagacagauagacagagacagauaugccuguauuacucuuacacaguaaauacauuugcaagagugcaugugugugugugugugugugcgcgcacacacacacacacacacacacacacacacaccaguaguaaucacagcucucuuugaggaagugagccugucucacugaaagacugguacuaguuacuuucuuggcuauaauuugagauuuaaauguuguaauuuucuuguucccugcuaucauucuguuuauaggacaggccguugggagcuaaugguuuuuuuuccccuccacucuguucuuucugugcccucuguccgucucuuggaauguacacgauggggcaaaaggacccauauccugugccuccccucccccugccgcccugaagauaccauacccucagccaggcagcguucucuugcagaaguuugaacacagggaauuguguuagagaaacauaucuguuugaugcuuuuguguccuguccacagggauguaagaucaugcaaugucaggccaggaggaguggaccuauuaaugugugcuuguugcugggcaggaauugucccagguagugccaucuuugagcuccucccagugucagguucccuugaagcaggucugaucucugagucagucccucagccuagcuguggggcucagacaggagucaguguccaggggggagaggcagggauccgguggagggaacagacagagacgccuguguugggaugcagaagaggcaaugggaaaaaaggaaggcuaccucugcggggaccuggggugugucuucaucuuguccaggguuuaagaccgcagacgucccuauugcagugccugcagcagcacaugucuggcccuuggugacucuuucucaagcacuguggacauguuuaugaaguagaccacgagcucccggggucccauggggaaggugaagaggagggcaggaucuuuggccuaaaaacagacuucccggcacaguguugacacuucucaaauaacagcuagcucaaaaagaaaaccccaaaaccagaaaaccaagcucuuccccucucugcgcugucugaauggacuccaccucacuguagaguguuccuugacacagucugaggggguggggugggguauugaaaaaucugggcacagaaacugugaccaacaaaugaugcaggaacccugguguuuuuggcuuggcucccuaagcuuaucacuuuuccuuacgcagggaagccaggagguuaaaaagaagacccagggcugcagggacagaucucucaggcaguaaagagcuugcugcagaagcaagaggauugaauuaaacccaugcaaaacagcuuggauugcaaauaauuacuugguaaucucgggccugggguggggaccagggagcagagacagauggaucccugagauuugccugcggccaaacggaggagcuccaggcuggugagaacucugucucaaaagacaaaguggacagccacugagcaaccuccuccagcccucaccucuggcacccccugugcaugugggccuguaggaacaugcacacgugcacgcacaugcaugcaguacaaaaguugaaaagacauaugugcacacacaagcacacaaauaaccugccuaauuauuuaaaacaaaaccaaaccaaaaugcauguauguaagagaucaggucuuaagcaacaggauauagauacagauaccaucauauuuuuuuuucaaaauauagaaauauugccacauuuuccaugagguuaacuuuugaggcgaaaggguaauuuugaaccuaugguuucuuuaaaaaaaaaucucuuagccaaagcagaaacaguuucuugggagaggaaaaugacugaguugucauauccauagcggggugggggacauuguccagguucucccauugcuuccuaaugucacaggcugagccuugguuacacauucauaacaccauauaaaugugaacaaaaucuugcaaggaagagccaaauggccgaugauagacgcgcacuggcaccaaggucauccaccucagccugagaggccauauuuaaauuuaagcugggagucaguucuucccuucacaaucucaaaaaugucgucuucucgccuccgugagaugggggagugaaggcuuugagugggccucuuccugcagugugucuggccuuggguucuuagagucagcuaacaucaaaggaagcagaagaaauggugugaggaccacagauaacuggggcaaggggauugcuaaaauuaggggugagguagccugggcucuggcaaggacuguguggaccuucuccagaggauaaacucuuacuuacauucuaaccuucaaagagaaaggcuuacuccacaggccugagugucuuccagacugcauagaucuguggccucggguccuuccuaacaauucuccaugcugauauucaaauccauugcuuugugcugcggggcccuguguaaucccgaaguugacagacaugucucuuuccugcagauggucuaagauggcuuccauaaucagacacaucccacacgcuccucucccccccuccccccauuccuccugcucaggguccuuuacagaguccucucugcauuugggguacaucugguguggggguuuuugcaagcugggguagcaaagucagggccagccccaccccaugugugggcugagggaguggucaccugggacccugugcagugucucacuuucucccucucucucucacgaugcacguguuucccuagcuacuguaucuaaaugucuacccuucaggauuuaugcuuugaggauagcuaucacaucucggcugggcccaucaggaaagggcugaacuuuuuuucugugaauaucuuggcuucccuaauuuccuuccucuucaaagaauuuacggacaccagaaaguuugagaaaggaugaagagaagccaauuugacucaaguggggaccacagagaucaaccuuauuucccuaagaaagcccuugugggccuccucagaaagccgccaugucuagagagcaugacaggacagucggagauaagaggagcugucccuguggaucuuggcucccucccaccuuuccccugccacacucaucuuccuccuuuugggagaucuuuuuuaggcuuugagcaccagaugccucaaauuuggagagugagggagagccagagagccucauccacuuagucagcucugguugucuucuguccuaaacaaaccacaaacugccucaccccaacacauacacgguaagcacagccccagaguggaugucccugucccacccuggccuauccaccauaagcacugccccuaaguggaugucccagaauagaaccccuugccucaaagaggccagccuccaaagcucucuuucacuaagcagaggggugcaugguaaguggguaaguuacaggucagcauaggggucccagaauucaggccugagggcgaacagggcacagcugggcagagagggccuuuaucuccugccaguuggacccagagaugguuuuggaggcuggagugcucuguguguuccuggcagauguuucccaagcuacucugguggcuguggcuccgggccuggcccagaauaacacauuguuagcauauguuaacagucugccuuuucuccaaagaucacauaaugcuuuccacuuagugucugucucgcaaguguuacuaucuguuuuauggucaacaaaaccgagauacagugagguuggggagcacccacaucugagugggaauggguugggggguuugacccuggagaccugugcuuccugagucucagcuguuauucaccaagugcccuccucgacgguuccuuccagaaugcucucucugacugacugaucucaagaucugguaggaguuaaaaggaacacauauguucugaucuccucaaucucucucucucucucucucucucucucucucucucucucucucacacacacacacacacacacacacacacacacacacacacacacacacacacugcaguguuuagcauguggugacagaugaaagaggagggacucuguuucgguacaggguuuugugaccacacaugguuucuuuccuucgccccagaggaagcacaugaaaucaagacugagcucgaggguugcccaccucccuccccucccuccucucccuccccucccuucccucccuucccucccuucccuccuguucuuccuccaucugaagcccuacucuuucuguccccugaacuuucuuaguaacuggucacugauaccauuccacagaaagaggaaccaccaggcugaagugaaguggaaauuuccagaagacuucaguggcucugaacaaggacagcgccaugcugcuggggcaggagaggcuugcagggaggcugcugauuuagggugugcugacucccucguaggcagagggcuccauaacugucacucaaacgaaagcaagagauuuccuggguggagacaccuaagaggagcuagaaauguagaaagccaaguccuuaggaaaauaacuacagagcaaaaguugccaggacugaagauuacaaagcacagccuggaaauuaaagaccuaaaugaauggaaagacaaaaccacugagagacugugcuccaugccauugagagacuguccuccaugccauugagagacugugcuccaugccauugagagacugugcuccaugacuuugagagacugugcuccaugccauugagagacugugcuccaugccauugagagacugugcuccaugacuuugagagacugugcuccaugacauugagagacugugcuccaugccaucgagagacugugcuccaugacauugagagacugugauccaugcuuuugagagacugugauccaugccauugagaggacaaucaagcaaucuacagauugaauguaguacuuacugaaaucccaauggaaucucucuuucucucucucacucucuccaugaguguguguguguguguguguguguguguauguauaugugugcacacauauaugugcagauguguguggagguaggagguggggaaacauaccucagauaguguuugauagugcucuguugugguuguuuuucuuuuuccuagacagggucucucacggccuggaccuuacugaguaggugaggcuggcucacuugauguauuucucaccauugaggaucgccaucuuuggucacugccacauuaccaggacagaacacauaauaagcacauagacaauccucaagauaacaacuuacuaaaugcacacggaggagauaaauauaucugcaccuugcccuuuugcaauaaagcaagcgaauacgaggggaauuuuguagugcccuggggagcacagccgugcuggacggugaauugucaccacacacgugaagaagcagugcugauuucuuuugcuuccuccaucugagaagcaaguuuguuccucugggcugucuccagauccucacauccaaggcuuggcucucuggaucacaauccaugugaaaucacuuccccaucugagaaagucaucaggggaucuuaauccaucuuaaucaucaauggcaaaggggcccugagaguggagaugcaguuaugacugugugggaugccagcacuuggcuucaucugggugagagcgagucuccauagcaaggagccgacagcuggcgggaacauugcagagcugucugcaagugacugagcuggguaggccggaaugggagccucccgcagggagacacuuaggacuuguagacgcgacuacguccaaacaaauguucaauuucaugcuuaacugaugaucuccacuuugaugacgagugaccaagaggaaagcugucuguuaaaaggugacucacccgccucucguuuuaaaucaaucuugggaacaugguccugaauuacaucacugaccuccugaagacgggaagucucugagagaaaauaucccagaaccacagauucugugugagggucgauaccuugugagggagccucuucguucccagggauggcuguuaccgaaggacaggaggacugagcugucccugagaccagcaagaagaauuuccuacccuggugaugaacaggcugacagugacagugacugucacuaagugccuaaccugagcacgugugaaacaucuucaaaguaauaacagaacuaagggguggcuuaugcuuugcaagcacaaggacuugaguucaaaagaugcccugucucagaaaacaaacagguauagaaagccccaggacaugccuuuuguaugcacccauaagcuguggagguucaugucguugcauaaaucuggaauccuggcaugugggagguugagucaugaggauuguggaucugggggcagccugggcuacuuaauguucggccagccuaggcaagcuagcaagauucugucucaaaacaacaaacagacaaaaaaaaaaaaaaaaacaggccagcaaacuaaaagagucuacaugaagacuauagauagaugauagguagauagauagauagauagauagauagauagauaggaacgugagacauagguuucucuguaagcaccuuggcacagcacuagcagugaagucuuuagucuuauagcacauuucaaaagccccagaaugaaaucagcucccaucuaugagaauuuuaagagaaggcaaggcugaaucucaaaguucacgcucacaaauuccgucuucaucucuucauucuuugcugauagacuaucucacucuccuggguggaucagcgauuuggugaacuaaacacacaaccccuucccaucccccuaccccuacuuccagcccauccuauggccucuguaugggcagauuuccuucuguaaugagaccauggcucugcagagaggaaacagugaauguucaagggcagaauggagacaggcucccacuucuggcaucuuggggaggugacuguccuaggcuuccgguggacauuccacccuggaggacaccaaaccuccaagaacacagcagcagugcccuggcuuuaaguucuugccaugucacugucacugucacggagcaacguuucucugacucucuccaaggccccaaggucaguuucauuuuuugugccucaguguuucaugacuaacucagccacaucacuccccuuucugcaucacaaaccucaaagguugcugcccuacuggguaaagaacagaaaagaucuacauguuucuugaaggaucuaugcuuuguugggguuggauuuuguucuuagcaagcauuuuaauccuagucgauggagugauggaggaaagggagagauggagacagaguuaaguauguagauggaugaacggacagugaaugaacagauagauggguaggugggugaguagauggauagauagacaggcagacauaaacagacagauauauagguuucauuuuuacccccacagcccauaugcuaccuaaagaccuauaaacaacauuagaauucuauaaacccauuuuaugucccaggauaaucaugcuuuuacuucuagagcaccauguuuaacacagcagucuuggguuagauggcucauaacuccugagcuugcugcccuauuggguagagaacagaaugacaucuaccugugaugucauuauccuaaaacauugcaugugaaguauuuugcaauacauauauucuccauccaucuauuuuuaagccuaggaauuaccuguuuuucaauuguaauauauaugacuuagaagagucucugaggucccauccuugucaccaucucuguaagggacaucugaucucucucagcuccacuucagcucuuaugagaacccagccucuggugggagagccugcuggggaguguggggcgauugguugggcuuagugccugcguugcuguaaauacugaacagggaggaggagaaagugggcuugugaucacagaugggcgcucucaucccucgcauaccuuugagacagcuugugucucucaucaauuccugggacuguggccacacacuguuagguuauuucccacugugcuuugcagguuugucacaugaucucgacacauuuguacuuccuuuucggcuggaaugugacagccaucucccuagcuauccuggcuucccuaauuggggaugauggagguuggauuuuaccggauaacauggccccaucugagcagaaucccucagaggccucaccuccuuguuggcagacucaccccaucuuaaguagaccucugagaugaggggacagagagaccuaucuacuguuaccagcagguccuucagugcuaaagagcuaaacugcagcucaauggccagggguuguauuuuaugaucauuaggugguugucuuagagaaaaggauaugggcaaggaggcaggacaugcacacauugaugaccaaaggugaagaaguugaauggucucaguguauggauagaaauauuacuuugcuucugcaaaagccccaaguagaaaguuuaccuaaaugucccuuucagaaaauacaaaaagaaggauguucuaucugguugaauaaacguagauucuccucuccauccacccaccuucugaggcacccuuucucaagcagccacagaagaaaccuucucaugugguccagaggugaggaacauggaggguuugagaccugguccaaagagcgacucagguaaguuaggugaguccucugauccuaugaauauaauagugccaguauuuuggcuauagaauaugaagugcugggcacaguacuacuucuggaggagauaaaauuacaucucucuuaggaagucaugcaaaaccguaccugagaagaucuacugauccaaugggggaaacacagaaagacaacacaacagaacgcagaggcccacugguaacggagagaccggcaauuggcuuuggaacggcuggucauccguguguugaauuacaggcaauuaucagugggcucccuguuggccguaauguagagccaugugucaaagggaaaucugaucucuaaggagggaagccccacagcaucuuuuaauccugugccaacucugcuggguccaaaccuuuccacggugcauuuuuauucuugaaauccaucuaauaauuauugguaaaaguugcggugagguuaagcaucucuaccagaucaucugguuuucagaagcuccaacuggggucaugaaaauaggcaacuuugaagacugaaauaaauucugcuuuacgccuuccauacugucuagcagucuauccuccagacaccuguaugucguucaccgggauggucuuuguuaaauucuuguguguguguguguguguuuuggggcuuaugugcauaugugugcaguaggguguguacgaauggaggccaguaucuuccuuagccccucuccaccugguucuuugagacggagucucuuacugaaccugaagaucauugcuucagcucaacaagcugagcacuaagcacccagcagccuccuguccuugcucuccaguucuaggaguacacgucuuguugcauccaacuuuucgugugacuacuggggaugugaacucagaucuuccugcugggcagcaagccaucuaccuauaacacugagccaucuccacagccccaccaaaaugauuaagguauucuggaaccuugaagcuucauucaucagagaacaacaggcagcuucaugcauuuuggccaugcauuacacuuccuuauacucccuaguacuuggaguuuaucagaauccugagcauacaucacugaaagaagagacuuccaggcaucacaaauggcgugcaaagcuaggcccgcuggaaagcaaucaguaccucucccacauguauucuggcccagucggagccauccuuguccaccucuguccccagguccccauuauagccaacacgugugcuucaaucuggaagaacugagguuaguagguacagaccauugaagcucauugcuaagugacggcuccuucuagcuuccuguucuccaggucaguuuaggauauucacacuaaguaaacugugggccuuccggcuuuagauuucugaacuuugguuuccacaagugcaaaaggugggcuuggcuacauccaggcuuaaguaugcuaucagcuuacgcugcgugcaucaacuaugcaaaccgcacucuaccuaaauaccccagauaaggccuguccucagcagaacugcucagggaaagcccaaauguugguugcugcuagguggggcucugacuguaaagcacacauaagccacauuauacauucuaguuucaaggagguauuucccacauuagagcuccucuaucagcaaagaauuaacuccauaaacccuagaauuaaaauuaaaagauacccucaauaccacagauaaugacaaucgggaccuggaauguaauauuuuacuagcuucuucucauuuuuguuuuugagacaggaucucauguagcugggggccagccugcaacuccccgaucuuucugccuuuuccucucaaaugcugggauugcaggcaugugccaccgggcuugguaaguguuaggccacuuaccguuguucaucuuaaauaagcaggcauccccaugacugggacucacaggcuuugacaccccccuccccauuuucccagcccuaauaauguaaaaguugaugagaaugcuccugucugcuuggguuuuauauuuucuuccuauccuuaucuucuggaccacgacuugguauguuauaauuaauagaauauuguuaaugugagccagcgggugaagacuaccgccagucagcuacucugucuccaugaaggcacuagcccacugauucugaauguguccuguggaagaaauugucaucagccacuggcaggaauuaaagaaacaccccaugucucggucuaucucucagucucaggcccagggcauaccugacuccugagcccugaugucuguccuacagaaggggaaucuggagcuccggcucuaggcacugggguaagagccgagaugauaucaagucccugccuauucucugucugaugaugaauaugcaaacacauucagauaaggcaggucacaguaggggaagccaacacaguaaagacgaccuggacuagcacguccguggccacaggcauaagcguaauagcugauaaaaagauaggaaucaaaacaggccugggagucaucaucaaaugccaugugcgggggcugggggggucaucaucugaggcaggagagcagcuauggcuccaagcaggaagauagccuuuauaauuaccgcuuguguuguaaggcacagugggauucuggacacccgucuccccuagccagcuuugcuccugaccuuuuagugggcaaugcugcuguaauuucucaguucaaaugaagucuauagagagccacagagaggauguggaccccaaagcuggcuuaacggcccuugggaggcagcuggcuuguaacgugaucaggggcccugcuucuucuuugugugcugggcucuggcccuaagaaccgguuauuggaugucucuuggcaggugcuaugggauuaaggagguggcuggccagaggcaaacuuugaauuaggguaguuuaguaaaaaaguaggugccuaaaguaaauacgaucuuuagcuuaaucccccauagcuaacguuugguucaaauuuaauagcaagguuugaaagguugguuggcauguguaucugucauuugucuguaugucuuugcgcugcacaccaggaguuauauuuuuaacucagcgaugaagucuauauuuaccaggccuagcaauccucaaauaccaagugcguuauuuuuccuucuuuuggagacacaacaagguagaauacuaaaauguugggcaauuuauuucuuaaaucacguuuuuccuucaguugcuagggauggacccagcgagcucucacacacaguguccaguaaguguucuuccuuugaggacucagagccuccauguuauuucuuauaaacuuugagggcacuuacguucuaaggugagccccgaauuuaugcugugaacucauggucuuccugccucaucuccaaacagcugcagugacaggacuucaccaucagcaaagcuucuaaagucacucuuagagaauguugcaaggucuguaauuuccacucauacaauucugagccaugauaaaggacacacacacacacacacacacacacacacacacacacacacacacauuauguaaugaccaucacacauuccaguugcuucagguuccugaaucacugaagaaagaccgaccucagagcugggaauguuagcugcacugguauagugccugcccaccguguauaagacccucggauggauuccaaguaucauggaaaggguagaguacaucucuaaucccagaacuuaggagcuauguguuuaaaggucacccugggcuauauaggguuugaggccagccugggcuacauggauggcaccuuccuguuuuccuggcaucgacucccuugccacaccuacucaucaagccagcaagaacugcucaucacugugcuucucacacauaggaugugugugcacgcccaccuugugucuguagcuaccauccccacacuuauguuacccaagagagguguaaccuaugaggggaguuuuggaaagcaacaguacgcacuaacugaucaacagagacaaaagaggguccccaguauggcgacucuuuguaugguaaaugguaagaucccaaauuugaaguuucaaggccaauuuugcaacuuuggacaaccauucagccuuaaagaggcgugucugccucccgaggggccacagcaacaguggcagcugcuacgauguagcagacaaaguacacacccugaaacguguuuguuuacuauguuucucucuuugccucucucccucagcccuucucucuuuuccugaguguguauguguguguuugcuuguugguguguauguauaugcaugcagaaggucaacuagauaucgauuuucaggagacagucaccuuuuucuuuugagccaugaaucugggucucacugaacauguuggguuggcugacccaagcguucccagggaucugccugacucauccuuccuagacuuggauuacaagaaggaucuacaugccuggcucuuugacauagggcuugaaaggauuuuuuguauggcuagugcgggaacuuucccagucaagcugucucccuagccuugagaugcuaaagcauuaguagaaaggaagguaucaaugauuucuuacuggucacgauuuuaagaccagaaauucauuuugguauuuggagacucucuggacacuuuuggggaaucccuuugacucuauuuuuucaccauaggcuugggccaggccaucccucugaagacauggaagccugucuccuccuuuuaauucuguguauuccuuguggcccauucuccaucacuguggcuuacuccuguaucucucuuuuagccauauggcaaugcuucaguaagagcuggauuccccaaccuugcuucuuaacagcuucuccaaaggugacugaaugacaaaaguguugcuguauggcuuacggucccaggcugaggacaggggcaggggcuacugagcuccacacagguuaaguaaaggagugaaaauggaggcguauagagaagugccugacucugaggcugugaggacagggguggggcugagcccgugacaccuucccacccagacccacagacgugggugaggcuucucagcuagcucugugaguggaaagccuggacuuugcucguugaccccaaccauccacuuggacuaucaugguuugcucaucauugcccagggagagguuagagacagcagcaaucccagagcacggagaagcgggggcaguagaaucucauuaggcagaggugcaauuugaguauuucgugaaguuuccaaaaaugucaguuuugcaagauguguguuuaaacacucgcuugcaaaauuccuggaaauuagcaaucaacacucauaagaguggauaagcaagaaccauuggcagccauguuguggcugcagggggaggaggcaggucuucagggaacucagcuucaugguguggggaaugacugccaaugacaugugacccugucccuccuacacagagccaccuccacccagcugcuuuaaauugacccaagaauccaguggcagucccauccaguggaggccugaacuuuugcuuucuguacuuguaguggaugcaaaucagaaguaauagggucaaggaaaccgcggggaaacugaggcucgggagucagcaugauccacaaggaggacuacugggaugcaggacacagugagacugaagacagcaucuguaccuaccagaaauuuuagguugucacagacuuauuuauuuuuuaaagcuaggguuucauguagcucaggcuauccuagaacuuggguuguagcccagggugaccuugaauuccugacacuacagaugugugcuaucacauucuggguguguggugcuggggauggaacccagggcuucauaccugccacgcaagcacuuuauccaaugaguuacauuaccaguccagauuacauuuuuuuaaaaaaaaacaaaagcauuaaauuuaaaauaauucguaaaauacaggcauguauaugaaguuauugugcauuuacacuuuauuauauuacaugguuuacauauuauauaaccugcuuuuauacacuuuuuuuuuacuauauacuacauuuauaccaaguguguguguguguguguguguguguguguguguguguguguauuaaauaaauauaaauucacaagcaaauuuagcuugggcuggcucaagaguggaaggguccacuucucacccuucuuuacaauacauauucuugaguuuauuuaaguuuuggccagggaauugugaacagauucuguucuugcagggaacagcacacggucccuucaauacucucuccuuuugccugcagaguagagaugcugugucagggacagcagcagccaucuugacagaagugcuauaagacagucaugacagaaggcaggcugucaagguagaagaaaccugcuucucuguuauaguaaagacgccauaccaucucuacacaaaagagaaacacaccucacaccucuggccuugcucaagcccuaacagcuugucuaccgacuuaaacgcuggagugugccugugauaacaguauacucugggcguucuccaaagucuccaugugauauuaauucacuuucugcauccagaccccuuuaaugucucaggccauuaauucuagugcuauagugaggagccuguccucaaaacagggcauugcagagcucccagcuccucuguggucucucuucccgccaucucaguuaacugaagcuaacugcaaccugaacacauuaaauggaaaauuccucaaauuaaaauaagaucuaaacuuugcacagcucuaaauggccugaaucagcagaugcagcccccaccugggccaucagucaucuuuguccagaguauccacgaguugugugcuacccucccgucucagucaucagauaaacguuagugacacuccaguguucauguucauuaaaguaagcuuuauuuuacuuaacauugacccaaagcaugaguguggggaugucugauagugagaaacaucauggagaagccagcaggagcugacagaucucuaccaagaagggggaaaaaugaaugcugagguugcuaacauuuucaguaagaucugcccuaucaugauccaugccaggcuuccugucaccugcauagacuguggcaguuauggccuggugaguggcaauuaguagguuaaggcugucaggaggaagaaucugacccucuauugguuucagggaaucaugggagucuuugagagcaucccucagaagagaagagauccuuacggcuaugccaggcugcauucuuucuuuucuguucuguuuguucuguuuguucuguuuguucuguuuguucuguuuucuguucuguuugcuaggcacaacccagagugaagcuaauccuuugagugcacacauacucuaccacagucugacaagaccaccuucaccccagucacuuuguaacuccacacucuccucccaugaugcagaagcacccauauuaacuaggaguucauagcauggaccauauucugugcaaugucuaucgugcucagaggaggagugaccgggcugagcuuuaggaacagucagaagccacagaggacaagugucuuuggaggcuagcagguggaaccuaaaagaagaaagggaauuuucucuccuuucaucaguucaguaccucaaaaaguuaccucagaugagcagaccccagagucuuuacacuaaugacaccuucugaauggugucuuguccgaagaagauguuggaggguacaguuagaaguguggaaacucugacauauaucuuuauaaucagucucucagccuacacacugucauauguuuaugacaacauuucacaggaaggaagcccacuugacuucuuucacgaaaaugguuaaaacaguaaugagauaguuugggucacucccugacaaccccuuccuuagcguucuuacaacugggcuccguguuaccugaagcauccaagcauccuucaggaugucccacgucuuacacucaucucacgagacagcuggguuuccccaguggacuccaucucaugugacaacagagcugagacacacucucuccaccccuaagacacggacauucuuuggccugaauccuugcuccuucaggauugucaaguuaagcuguuuauuaccagugucugugcuagcaacuguacagagaugccuggguauccuggcuaggugcagauaucucagcagaaguuagaugaggagagccacuccagagugaggccguggggagaaacacaccaaaggacagacauguacagaggagagccaugcacagcgccagccacucaggggacuugcucagcagaauugagguccauuuuaaagaccuuccuggaggaggggaugggaaaaucacagggcuuuucuagaagcccuuaagaauaggcuggauuccuccccccaaccacgauuucuguacuuuuauuuuauguguaugaaugagugccagcauaugugucugugcaccuugugagagcagugcaucaagaggccaguagagggcguuggugcccugauaugaauugcaggcgguugugcgcugcugggugagugcggggagcuguaagagcagcacacacuuaaccacugggccgucucuccaaccaccuuguuaauuuuguuuuuguuauuaaucuuuaguuagcauaaaaauagcagguuucacgaugacauuucuauguauauaaacacacauguauauguauauguguauauguguaugugugcauguauauguauauaguauuuugcucauauuuaucucuagcacucuccaaauccccuuaccucacugcccucccucuggucccccuucuguuguaagaacauauuuaucuggcuuuuuauucaucagauacacacagacagugaugaaggguauugguggucuuuuccccguguucucuagaauagcaaaggugaacuugaaacucuaacuuaggugucaggauccagaaggcccucggcgauaaaggggaugccaucauguguugcucaguggccccuucuuggaugauuuaacaucagcucuuagaugccauuugcugugacauaagauguccacuuaagugguugugugugugcauauguguguguauauaugugugugugugugugcacaugugugugcauguguguguauguuuguguccacuuuguaguccaccacagccucagagucauugcaauuccccugccucagcuuccucaaagccgggauuauagguuguaaccaccacacugacugucacuacuuugagaaguagguccuauggagccaagaaggcagcuuuccuguugauucucaauaccacucucugcuucggagggucaagcuguuugguucccagugaguuuguggucauaccagcgguuacccacugacuucucaucugccuagcuuaucugauaacaggcaaauggggaagagcuuuuaauacccccugaaaggggaaggaagaugggcacgcaguuauucacaucguggaaccaggccagggcacaugacuccaagaaggaaaacuaucuccaugcuggacucugguguccccuuugcuuuugaaucugguauuucagcucucugugcccaucuuucugugugucucugucugacugugugccucugucugugucugucugucucucuguccgucucugccugucucugucuuccuccgugucucugucucuuucuccuucucugccucccucccucucuccucuauuaaaaccaggucacaauagcccaugacgcagaaagacaagaacucuagguuccaaaugugucauuuucaagacaguuuaguucaagaccagggucugcaagccuugccauucccccgacucccguagcgccccccccccccaggugucagcaacccaucaggcgucaggguucccugcuacccucugaucagcucugcacugcacuaaggaguuuuuuauggaaagcaauggucccaguggcugaaggguccagcaaguggcugguagagccagcaaggagcgauggagggauggugugaggaggagacaggaagggaggcggugacacaggccuucacagggccgcugcagcuaggaacugcugcaaaagcaagcugcccacguuaucaguggcgcgcaggccugcgguuuucucgcucuugcaacccggcuucaacugccgguuuauuuuucgacaaacaggaugccuccaucugaggcugucagcaucccaggcucuuugagaagaaaagagguagugagggccccacccuagagcccagccgggaggggugggugagagguccuguuucuagaugcuucccagagaagugagaaccuagcaggugcaguggccaggguucaggagcgugucaggaaggguggggguggaacuuacaccucccacccccaccagacuuaaauggacuccccaccucugcaugggucccaaggcuaagaguuccaacuauaaggggauggacagcuugggcauggagaagcuugcuucugaaugccugugcagaacacuugagagccaccaagugcugauccucugguccacagaccaaccaguccuaagaugggaagugcuagggcuguuagcaugaaaaugcuuaaggaugcacaaggauauaguggaugggagagugugugugugaauuuauucccugguuuuaugagagcuacuuuguuaaugggaaauggaguuucuuuauguucuagaaggaacgggaguuugaagcagggaagggauuugaaaaucucagcuagagagaugacucagcugugaagagugcuuaguguucuuccagaggaccagaguucucuucccagcauccaccucagguagccaagacugccucuaacuccagcuccagaguaauuagguacuucuggccucugaggguaucugcagucacauaaagacacgagaguacaugugcccucacacaggcacguacacgcacacagacauagaaacacacacauauauacacagaaacacacauacacaugaagcacacacacacacacacacacauacguucaugcacacaccacacauacagacacacaggaguacagauaucuacauucaugcacacacacauccacaaacacacacacacacacacacacacacacacacacacacacacacacacacacacacacacaauaauaaaaucuuuuuaaaaauccuagcugggaacgccuucagaaacgggagaacccagaucagucuuucauccaaaagaugguaggaucugacagaaaauacuccgagcugugcagccgagccagaacccuguuugucccgggaagcagacgugucuuccaugcggaucuucacagacauaguuuuacagaaacuggguuguaguuaauggcucagaauuuagauuccaaauuuuagaucccaaagcuuaacuuguucucaaauuaagccuagcacuguggccugaacuuuaaaaaaaaugaauacccugaauuucauauaauuagcaguguccuauguggagaacugaggaagccgacuaggaaauccacuguguuuggacugcucaccagcgagaagacacaaaaacuaccagaugcuccguguacgccugaaguuacaucaagauuccauuuugacaucaccacaaacagucagggcuuccuguuacagacugucauucaaagaccuuggaagcuacaaggacuauuaagguacugaguuucgggcucccccagacuugggguuucucaggugagcuguagaaauuuguacugucaagccaaggacucggcgguaugaaaaguucaagcaacuuuacuguggccuucugagcacaggcaagguugccccuggccuggucugaugccuuucuugcauugcugauguccugcugaguuaauuuuuuuuauuuacagaguguuuugggccuaacuuugccucucuaccuagauggcaaguucuggaaggcaguuauagguaguuucaugcuggcauggcaggucauuuuguagcagagagucacaugcguggaccaccccagcagaucuacggaugcucuugacugcuaagugagcuaacagucuuaccuacguggcuuugguuucagaagaagcugagaagaaaaaugagguagcgaguggggaacauuucauaggaaccugguuaugugguuagugggagugggggaggagaaugggggaagggacugggggaggggaguguggaucugcucagcugucagcuguguggauuacagagagaauggcuuccaauguuuuacaacauauucuagcuucaacucaccaccuccauagaucaaaugguggguguuugcucuacacucucacccucccaugguggauggccuggguggccucuuccacagucuucuucucuuguugcucuucuuggcuucccccguuuucugcuugacuggugggcauuccaaacccucacuuccaagcucgucagaggggcuuuuagucucuuacauguagcuaggcagaauaaaggcaugcuuauauaugacugaaucagaguaagcuacuuuagggaaagcaauagaaauaccccacuuaaucccaacauggcgagcuuaauuggccguguggucuugggcuccauucuuaaccuuccaugguuuuggcuugucaucugaacucugaggcacaguguguucauuuugcauaucagcuugaccacacuggcucaugacucuuuggguaggugcaugagagauaccugaugagccuuggagaaagccagugugcccagucuuuccaugcagguuacuucuuuaaggaaaacuuccaggugucccuggcccuuccuucuuuuggguccacuguccuugggucuuuaguuuccccccugaagggaaucuuuugguuucuguaggaaucccauucuuuuggaaugcaagacuauucccauuugucaucuggucauccacaaccccucccugacucugcagcguggacccccucccuucccuuuaucuugucccuccagccuuugaucucagucucuaaaggcuuucugcuggacugccucaucuuauaucucuugcuucucugauccuugaagucccuaugagagccugcaguccuugugcuuaggguggcaguucucuucuuugcaggacacagggaguacgauccccucagaaugcugaggucugccuuccacagacaacaggcccccaaagggcugagcaucucagcugucaucauuucugagaccuuucaaguucuguaguugcauuuuuuuuuuuuuuuacagggaauugggcuguggucuuaagauguacccaguugcuuucucaauucugguaguggugguagguguguguguguguguguguguguguguguguguguguguguguguguguuauacuuucuaggaaauggaauuggaggaguauaaaggauaaaaucuuuccccuguuauccuggugauuguaugagguuggauuucucuuccuuguccuccuuugggcgugaacguuucuuguuuggaguuuucccaugaacugaauguguguuguggcaucuuuagacgucaccuacucauuuguugcuaauaucuucccucuccucucucucucucacuugaguugugacagccacagacaacuccagacauugauaagucacccuucuguccucacauggcauccucccccuuguuauaaaccagagguguaugacacucuccuguuguagaacaaauuugacaaggaaccuuccucugaaaagccauuguauaugaccuaagaagcgagaaagaagcggaaugagcaggccugcuagaaagagugaaaaauuacggaacgauuaaccagccacagaugaacuguagguacaagcauccaaaaccacuccacgcagcagaagccuguuguuuuugguuuggaugaagacucaucauaggagacccuaaaggccugauggccaacgggaaaauggacaaucgggacuguagcaaauuggaaagucuuuccaguaacuaagcaauuagcaggguaagaagguguccugaugauccaggggacauacggacauauuugaaaucauaucucugcuaaggguuucaucuucugcauacacacagaacccaacaacuugacagcaagacaagaaauaaccagaucaaaaugugggcaggggacuuggaaaaauuauuuccccaagacauaugaaaugacccaggaguguauuuaaauuugaccaacaccucuaacugucagggaaauacagaguaaagccuccaucacaggccaccucggaucuuuaggacagaugacauuaaacauuccagagacuccauagcuguggaaaugugggggucugaggagauauaaagaaauggacccacugugugcugcugguaugaauacaaaccaauauagccacuauggaauaaaguuugaaaguccauuaacagcuaaaaaucaaacuaguguaucacccuaucugaugguuaguguugucaacugacaagcuccaguguuauccaggaguaauuuguuccugucaagggguuucuagguuggguuaacugaggugagaagcccugccuugacuuugagcaguagcaucacgaguuaguguucuggacuuagcaaaaggagccagugaagcuaagcaccagcauuugccucucucugcuuccugagcagaugcagagggagccacugccuagagcucuggguaccaugccuuccccauugugaaggacugaaccuucaaacuguaagcuaaauacacccguccuuccucaggcugcuccugugagacacuccauugcagaaaugagaaaaguaaccaauacacccagcacacacacagacacacagacacacacacacacacacacacacacacacacacaccccacggauacacaggcacacacauccagacacacaggcacacacagagacacacagacacacacacagauauacaggcacacacacaggcacacaggcacacacagacacauacccugacucacagacacacauacagagauacagagacacagacacacacacacccaaacacacacacacagacacacacacccagacacacacacccagacacacagagacacacacacacucagauacacaggcacacacagaaacauacccagacucacagacacacacacagagauacagagacacagauacacauacccaaacacacacccagucacacagagagacacacacacacacucagauacacagauacacauacaccuagacacacacacacacacagagauacacaggcacacacacacacacagacacacaggcacacaagcacacacagaaacauacacagacucacagacacacacacagagauacagagacacagacacacacacccaaacacacacccaaauacacacacacacacacacacacacacacacgagagacacacauacucagauacacauacaccuagacacacagacacagacacacacacacacacacacacacacacacacacacagacacacacacacacacagacacacauacagacacauauacagagacacauauacagagacacauacacagagacacacacacccagagacacacacacacagacacacacacacagacacacacucacccagacacacagauacacacaaacacacacauacauacauucacacauacauagacauacagagacacacauacacacccagacacauagagacacacacacccaaacacacacacagagacacacacccagacacccagacacacaaagagacacagaacacguacauacacagauauacugacccacaagcacacaugcccacacacacacacacacacacacacaugcagacauacccauguacccacacucagcacccagacacacagacacagacauacacacauagacacaggcacagagaaacauguauggacacaugcacacagauaccgcacaauaaauuuaauguaaaaauauuccuuugacuguuaaaaaggacaguauuaaauacuaucuugggguaaaacaagaagaugccugucuacacauauguagucccuucaaaaaauguccuuuggagcugauaacagagcacacguguccccaggccugggggaaauggacuaauucuuagggcucguccugugacuuuacuguucuaguuaaucuucuaguugcugugacaaacacuggacagaagcaucuuaaggaaggaaggaaacauuuauuuagcucagucuguggguaccgugaaacucguccaggaaggccuggcagcaggagcccgaggcagcugugcccacuguguccacagucaggaagcagagggacaugggugacgggcucagcucacuuuuuccuuuugucaagacuuggcccacucucaucagaacaugcugccuacaagcagagugggcccucucucuuuaacauguuuauuccgcaaacacccucauagaccuauccagaggugcauuucuauggugcguccucuuucccuuaaguugacaaugaggacgaaccaucagcgacaccgacccugaauauaggccaauuaauccauaacagagaguggcugugcuccccagaaagccaugacucgggcugcuuagucugacacucucuucaagacaaaaguugaaccagucuccacuccaauagcugaauuaugugucuuuccuuuguugauuacaggaguuaagagcagaggcaaaaggcgucagggaggaaucaugccaacgguuaguaccuuccugcugcuaaugguguggugugugugugugagguauggugugugugugugggggugugguguggugugugugucuugugauugugugucuuguuagugugugccuugugagugugugugugggggaugugguaugugugugugucguuugugucuugugagugugggggggggaugugguaugugugugugucguuugugucuugugagugugugugugggggauaugguaugugugugugucguuugugucuugugaguguguguguguggggggggaugugguaugugugugugucguuugugucuugugagugugugugugugggggggugugguaugugugugugugucguuugugucuugugaguguguguguacacgugugcauguacgcagcacgcacacgugcacauguccaagaucacugugaccucuaugacuguuuagagucaaaccugccacucacacagaaguagcugguguguuaacucuguccugauuuucaguucagagucugccauuauggguugcuggaagacuccccaggcaaguccuaaguucugacugaagguaacagcagacaccacuaugaggaaaagggaaggcagaugagaagcaggggcaccuggcuggucuggcucuggaguguacacagacgugcagaaagaucauaaggagggcuagcggggcuucgaagugccuuccgagagccuuggguuuugauuucccagucuaucaucauagccuugcgcaggcaaagcagggcccuggccuucuccaacggagcuuuauuauuuuauuacuguuuuuuauuacgggauaauaauuagcuugagcaccuuuuaauuucuucccaucaagauguuugcacagcaacaauuagaggcuggcagcgcccagcaucuacagagagagucucucagagccagccgcuggagcuggcagggggacucaucgcuaagguauccucccuugggggccagccgagaccggaagggaauuggcgagaauauaguaaucccuggcacggacaucaggcaagagaggagccucugaaacaaguguggcucaaagggagaaagcacaccauaccggcaaaccucaggacucagugggaccaaggccccacagcgggaucgcaggaugggccgccagacuuucgaggugauaaauguuucuagagaaagcucuaccaugcccaagcccuccucccucgggaagcauaucaaugcuugcugugugacuggcaggcgaugacaggaagguccuguucgcaggcccacuugcugucacagcugagucaacugcuucuggcuagagucuuuauuucaaccacagaaauaaugaaaugaaggguuugguauaggcucugugcaaacccuggucagggucagaggucacagccaggaccaugugggugcuggcucccagaggcuccuauauuuuugaaggacauccuggugaugggacauccuguggacuaauucucuucacucucuaggucucagggccuauguaagcauggggucaggaaagaaucucagacaaguuagagcugccuuccaggucaaggucagacaaacgcaggguuugaugugaacaacuuccacaaacuccucuuuaagauuuucaugggauguucucaggacaaagacacaagacauaacaugaaauuaucccuauuagauaccucuuuggucacaaagauguccaaaaugucaccuccuucuaugucugagggaucuaaagacugauaaaagccacggauuacuguggaacacugagcgggguugacuguccccagcaugcugagagggccagguuggacguucaggcuggggugcuacuggcuuggggaagcauaggcccccugugggagccuaggggaagacaaagucucccucaaagggcagcugugguggggaagagccugaauguguggacaguaagacaggaagcacggccugcccuggagagaacuuaggccacugacugcaucuagggacaccagagcaguccaagacagggaacagugcccucucagagcugacccuacuguccucaggauaugggagccauggcaagcuuuuggcuccaaaaggcuugacuuccuugagagucauagagacaaucuuuuguacuguuuugguuugguuuugguuuuggagaccaguuucucauguagcccacgcuggccugaggcuucugaucuuccugcauccaccuccugaguaccacgacuauagguauauaccaccaagcccaguuuugacagugcuggaaauccagcccagggcuuugugcaugcuaggcaagcaucuuaucaaagcagugacauccccagccccacauugacguccuuaaaacccacauguaaccucugcagcuagacacugggcucuguaucccagugagugcuucuguuugaauugggccagcauugucccugcagccugaccccagguaauuuccuuugcuucugcauguuauguagaaggguuauugugagaacacagcucauggggcccugugaggaauucaaugcugcaaguguacuugucucacaccuaguaggugcucaaggagugucgcccuaagcuuaguuuaaauggauuuaaguuaacccucagccuggggcacucacuuuaccaaagacugagacgaaugggcuguuuucuccuucucaggugcacgguuccaggaaacaccacaaagccaccuuuugaagguaacagaggcggcuccccugccucagauccacggcagucuuuacaauugcuuguuacuuacuucuugacauucucuggguaucucccgucuuguguguuucaucuccagacuuuugauaggucugcauggguugggucauuuccuuacuuuacaaaugggacuccaaaagguuaaaacauggcuccaguuggcuuugguaguagauccuagugauuggguaggaaccaauggcugggugcaaagccuuccccaagagggugggaaccaagggcugggugcaaggccuuccccaagaguguaggaaccaagggcugggugcaaggccuuccccaagagggugggaaccaauggauaggugcaaggccuuucccaagaggauaggagccaauggcugggugcaaggccuccccaaggccccugucugcccaggucucuguguguuagucucccucugaggauggcccauugaagagggucuaaugguccagaauacuugaguccucuuggaucccugcuggaaugauuggaaugguacugugagugaaaaaauggaaguucugaaggagaggcagagguuugugaggauucucugauucagggauguccuuagaaggacgggaaaguacaucccgacuugcguuugaagcuuugcaauuucauucgagcugugcuuuacaaugcauauucuacaaaggucucaacaguggugugggcgugucacauauaaauaaagaccuaugcgaagauuguggaccugcuuagcaguuugccaggguugguagcaacaucaagagccugagguggcugguacuccugcugcccauggagaaagcuuccucuaagucagugugucccgagagugcugguggguucccugaggcauguccauuuugagugcuggcccgugugcaugugacagugguaugagaggagagcuucaauucucccaagaggagagaagguauuuuuggccucaugagucaggaacccagagcuuuguucagaguaggaacuguagucuuguuucaaaauuucuaugccagcuucuccugcuuuucaacaacacccccucccccauccggaggcuaccccauucucuacagccaugaccauguuccgagagcugcuuuaaauuucaccauagacacccauucaaaccaagcuacuuaagagcacuguugcccaaggaacagauggauguauccucggugcuggguuuacgggagauggagucuccaugggacccauguucuuaucaugagccuaaggaaugugccaauggcucaggggccuuacauguuguuugcuuagucuauguauucacauagaugcuuggccugcaacgggcucuggggugugaccaaggcagaggauuacugaugucugcuaacucuuuagaggcucgaacuguagcugucacacagauauagugucaacaaagcucugggagacagaggguaagacucagauaagaccucugauaagccaaucucccaaagcgcugacacagcuuccccaaaucacucuauccagggucuggggacaaagcucaaaaaguaaaguauuugcuuuauaagcaugaaaacuugagaccaauccccagaccacauauaaaaagccaggcaccaugguaacaugagcuugugagccuagagucucuguggaaggggacucacuggccggccagccuuaccuacuuggcucucuccaggcaguguaucugaggaagcacagcuguuauuguccucugaccucugcagacaugcaucacacaugugcaugcacacuguccuggcacacauauaaagacaccacacacauagugaaaugauuccagauaagguuucugcccaaacauucugaucucucuuucuagcuauuuaagaaaaauacauaguuauagcuuuauaacauagcaacaagugucaaaugaaaccgcagagccauugugagguuacacacauaaaaaauuauacauugguuuuacacacacacacacacacacacacacacacacacacacacucacacacacacacacacacacacacacacacacacacacacacacacacaaaacuauacaugaagcauacauauaucuauaaaguaucaccauguggaauaguaucccaucucaugguucaaugucuuuggucauuuggacuuuagacagauuccucuaacucugugccccaguuauuuguuuugacaaugggaagcagaugaaaggcaaaaacuuuugaaaagaaaaaaaugguagugugguugacugagcacugagcauggccuccuucacugcucugcggaaacccggugcgugagaguccuaacugguuagcacgaccgcugacuuccuuuauuccuuaggaagcugagggcagguagcaaugaauacacaguucauucacugaccuuuacaaaacugcaaauggccuuucuggccauaccugccaacagccacacugugaggagagagaagggagcugaugcucaaggcugugaccauguuccuuuucuccgaguuccuccaguccuuguauggguuugggguuucagccuuuauaaaugguauuuucucaaggugagucagaggggacucggcugugacagugagcaggugagauagaccuguuuagauguggcucacagagggugugcaaagugcagacagacugugggggaagcuagccucagcggcuggugcuaaagcugcucccagaaaccauggcggcagagccaaggccuuugguacauuuggaggcuguagucgaggaaaggaccagggacagcuagcuauguuuugaauuuuuuacaggaaaaagcaagugcucauccacugaucaaugacaugccuguuugguaugcuuauaagaaacuuagcuauggggaagguggccuugacaguucauacacauacagacaugcaagggugcaauacacacauacauaugaaagacacauacacacacaugaacauacacacauacaaacacacacauaugaauacacaaacacauacucuuucuuucuuucuuucuuucuuucuuucuuucuuucuuucuuucuuucuuucuuucuuucuuucuuucuuccuuccuuccuuccuuccuuccuuccuuucucccucccucccucccucccucccucccucccucccucccucccucucucucucucuuucucucuuucuuuuuuucaguauuggugacuuaauccaaagucucacacauaccagggccacucuugauuagcaagcagaucucuuauucuucuuuuauuuuguauuuuaagaugagaucucacuaaauuacccagcuggcccuaaacuugcaauccuccugccucagcucccaaguggcugagagacaaggccuaagccacuagguggggccugauuuccuuugcucuuuaccacguacucuucucugcauguugagcauaacagcaauugcuagaguuuucuuugggcucuccuaaggaagcccuucuuugucauguuuucagaagaauacuguccuugcaugaccaugauaaacuugcaaggaaggaggaaacgcugccuccuggagcagcuuccuggggaguuugguuuguugagcagucuuauuucauuuuccauucaaagaagucccuuccaaagaguccuccugugagagcugcucagcccugccugugcagaugcugugcacacugugagaggugcucaccccuaccuuccugugcacacaguuucccugucugacacacacauagaggcuugauuuagaaccaccagaauguggcuucacauuuggaccaguggauguaagucuuuagacuagucaacccaagaaagaaacucagaacucuauuuuugugacuguuucuauuggaguuggggggagggggagauacaaugucugggagaauaauugguuuaaaagaagccugugcaaaaauagguaccuaaggggucggaaaugggaggguaugccauacacagcgucaacaguuaucaaaaugagcacccaucuugcugcaacgugaaaugagagguguguauuauuuccucucucaaaggaaaccagaauaaggacuuucuuucuuuccuuucuuuuuucuuuaaaugaggcauugacucucucagcagagagagauuugcauccagacuccggaagccgucagggccaguaauuaccaagcaaaaccaaccucccccucacugccauaugagguaugggugaaaaccauccuagaaagagagccacuccaugguuauuaucuguuaguuuuuauuucuauguaaaauaaaaucaucuuuaaguaaauugaugguaagucauuugaaacuaaguuucacuugauuaagggauaggcugggguaugaauaagggccagaguguguacaaggcccuggguucugucacccgugucacaggggaacaugaagaaaauucaaagggaaaaggaaggaagggggagauggagggggagauaagagauggaaauaauucuauaaugauucuauggaaaauuauuuuauaagaagcaaaauaaaucuauugaagacacacauuagccccugaccaaugguaguaguucuaaugggaaucuuuucaucggaucgcuagaaaauuggggauuaaguaugauuuugaacuucgacauuguaaauugucacaccuuguuucccauugaaucggcucccuccccucccagugacugccuugucuuagugaaucaaagguaaacagccauuccagccuccaucugccacuucugaggagagccacagagaaaguuggagauucugugagaacacagcuaccucuugaugucccguagaggaagggguccaaguguccccaccccuauagaggacaaagucuuucuuacaaugucauaauauuugcauagaaccuauguccauccuucuagacaugcgaauucaccucucaaugacuuucauaucuaacgcuauguaaaggccaugcaaacgaggcuguaccauacugcuuagggaaaacagauaagaaaaaaaaaucaagugugauauucaauucggauguaauuuuucccucaguauuuuccccuucuguugcuaguugaagccacagauggggaacccugggauacagacagccaaucguacucgcagagcauagucagcuuagaaaacaaagauacaagacaggaagguagggucugccccggagcucagccacuggguguugaaccauccucacauuccugccuucugcaucccauguuucucuuccuuugcuagauguuuauuauguugccaaacugccugcuaaauaguuacauuucucagcagcucucggagccgggcaggcagcuucuuuuguaacagggagcaguuaaggcauugacuccuaacuucagaaagcacugagaguaagugagagaugaauguucaucccuagaagggacauuuuuuuaaaaucagcuuccuuccccaucaccauggccccaccaagacuuggggaagacaggggaagaagcagaaagaaccuacgagccaaauaauggagaggagugccaugaaauguugguugugguuguugucuggacggagcaugcguggcacaugguuucuugcuugccugcacaagauccaccuaagauccagcucguuaaacuuccagcacaaacugggagggcuaaggagguuuaauccuagcugaacaauuauuugggguugauggguagugagggagcacuguucuuuguggguguggucauuguuaguugcucaagcuccccuaugcauauggucaagacaaagaggacucaguggguagugguuagaaacgaaaauaagggcucuccagugauggcucagugguuaagaauucucagugcccuuguccaggauuugggcucaguuuccaguacccacauaguagguauaacugucuguaacucuagcucaagcuccagggacugcacacacacucagacacuuaaauaugcacaauaaaucaaucgauuagucaaacagucaauaaacagaagaagagggcaggaaguuggaaggagguaugauguuccagggcagauauggguggaaccggaaggggaaacagggaguggauuugaguauauuucaugguagagguguaugaaauucucaacaaauaaauugaaauauauaccaaaaauauaaaugaagcuucccuuucugaacaacaagaccaguccauaugacgcagaggccugccaacacuuuacugccuacacagggccucaggugcucagccaucuuggaccuggcacagccuggugggacacaaaacagggaugucuuaugucccuugugcaccagucugggcugcuggcuccauauacagaccagccuugugugcacgagcugcuguggucagcuucuccucuaugugcagccagcacguguucacugaggaauccaagcaaaagugugguucuccucuuguaauaaaacauaucacugccggcacccuugggcacgguguucaucuccgugcugugcccccuuggcaccggucaguguuaucagggcugcagagaggaagauggagaaaagugagggcagaggagaugacaucgggaagcugagauagcccaagaggacacagcagcacugccugagcuugucugauguggauagugauaggugguucagacccaaccccauuuaaugugagauauccuuggguuccaucauaacacuuccugaugguggccauugucuccaaagaccucaaagaaaacacacauuccccuuucccuucccucccuuucccuccccuccccugcuuuucuuuccuuuucuucccuuuucuucuuuccugagacagggucucuguaucccaggauagccucagacuccauguaccuaaguauaucuugaacucguguuuacaaauauuaggaaaacaggaugugcccaccuuccccaguuucuguagugcuagaaacggagcccagggcucggugcauggcaggcaagagcucuucaaacugcgcuacaucaccggccuggaaacacuccuuuucugcgucuugagaggugccaugguuauauuuuugcaggguuaauaaugucacaaaagaccuaacaucuugucuaaguuugaggcuucuuauaggcagaaaaagcacgauguuugguggcucaugaugagaaaggacaguggggaccaggggaugggagcugugggaaagcugugggguuaauacuauguuuguacacuaaaggacguucaguccauuucuguagcacgcugggcgagagaaaaaaaugcuucagugucugaaaauaucuccugcacaugaaaugguacaaaacuuuucauaccaacguaaaacauuaaaacaacaacaaaccuugcucacauugcuaagcugucauguguuuuaugguuucuaagggguucaaagacuucacacaggaacuuggucauugggcagcuagcucuucuagaauguuccuaaccccuuuugcagaacucggaguagacagagcuucacuauugacucaucuaggucacugggaaguuaccugagaaacgccugaacuuccugugugggccuccccgccuggccccaaccacacaagaacccaggagccuuuaucucugagcuuugacaaagacuugucaaugacaaauaucauggagaagaagaggacuggcugucagaguccuggagacccugcacgugguucaacagacaaaauggcuuucuuuagaagagccuucuagauccuaaggcugcacccagauucucaaaaaaagugccucugcuuucccuguguccugagccaaggcucagccuggccgggucuguagaaauugcaucaauguucagcgggcucugagaugccucuccccuccuguggucacugacaagcaggaagggugggagcugauuagcucucugccuccugugucucuguguacagagucuuccuuagcucuaugcugagcccucuguuggaccacucuccccuccgcuaucuucccuacuucuagaaauucugccacuuccuccagggagccuuccuggaucccuccaucauauugugagagacuucuucccugaguggcuagcacaggucagccaacucagcggcugcugucuuagguaaccagaucuuugcuagcuaacugcuguuaacgcugcugguguauagaggagcugaacucauccaugggccauucaguacuuuaaccguuuguauggcaagauaacaagacagagguuuagucaggcaugguggugugugccuuuuauucuuuuaaaaaauauuuuaauacuucucugagaaugaaauaaaaccuauuuugaucauauucacucaauucuccaccuuaacuguuuccagaucaaccagcauacacuuuaacccagcucagcgguccucgcccuuccuaacacugcgacccuuuaacacggcuccucaugcugugcugaccccaaccauaaaaucauuuucauugcuacuucacaacugugaucuuucuacugugaugaauccuaguguaaguaucuguguuuuccgauggucuuaggcgacccuguagaagguucauuagagaacugccgguuuaaucccaguucucagagguaaaggaagauagaucccugggagucccaggccagccuggucuacacagcaaguuccagugacggagugagagcccaucucaagucucaagucucaagcaaacaaguaaaaccaaccgaagcaccuucuaaaaaaccaacgguaccacucgcuaagcaaacaaggggaacaagaaaacugaaacuucugggauccugggcuucgacugaagggaggaaaggagagagccauccuguggagcuaccugagugcacucagggugcaaaucucccaucgcugccucugcuaacagcagcccugcuaaagggcagacaccugacuucucuuugcaagccugugugugcagcagccagcccuguugugucccagccgcagccagcuucagucagcccuguuuccaucccagcagcagccaccagcccugcugugucccagucccagccagccuugcucugcugccucccagcaaagggccacauuuuucuugagcucaucuuaggucucuuuccagaacacagagggauuucguugcuucuaacugcuccgagaggcccucugaugauccuugcuuauccacucaucuauccacuguccucuccucuuugugcaugcccauguuuaugacaaugugucugugcacaccuugugucugugugugaguguguacauaggcauuccuguggaagacacaggcaacugcgaggacuuauccuccugucucaccuccuaucacaacaggaacacagagauugcacgugugagcaucuggcuuuuuauguaugaucuggggauucaaacucagcuccuuaugcuuaugacaagugugucacacagaaagccgucccgucccuccaguuccacccaccacuuccuguccaaugugucacacagaaagucgucccuccaauuccaccaaccacuuccuguccuguauuuaauaugugaacugcugcaggguccuccuacccccugucacucagccaagguuggcaagauguccuugggguccgacugaggcacagggcaauccugcuagagggagcaggguggagcugguggcuucuucaggcuuuucugaaguuugaccuucuugggcuuccguuaggucacugucaacugugacucaguguacagaaagaguauggggcgagagcugugaagacgagccuagaucauuuuuuuaaaaaaaaaaaaacccuuuuaaaaaauaguuucauaaugcauagguagccucagaugugaaacuucaucucacagggauggcagggucugagucccaaauauccagagauccaucuguccacuugcuucaugcuggucuccuuaaggaccaaaggaggcagguuugccaagacagcaugucaggggcugcauuauucccagacacaaguccacacauucagguuuuaauggcaaguuccucauaaugugacuguccuggauauggaacauucuagaagcaaucaggaaguacgagagugugcuaugcccugucugaugaccuucuacgaggaggugaggagcuggcuuugggaaaucucuccagcgauucuaagacucgguaauuuuaagaggcugggcaggaagaauguuuugauucaaggcuauccugggcuacacagugagugcuagaucagccugggcuaaauauugaaccauugagagagggagagagagagagagagauagacagagacacacagagagagacagaggcagacagagacagagacaagcagacagagaggagagaaagagaaacaugagcccaaagagucaacacuaagugaaugagacagaucucucucucauacacacacaauuacaacaacaaaguguugauauuuugaccucaaacuucuggccuccagaccaugaggaaacauauuucugcuuuuuaagccaccauguuugugguauuuuguuacaguagccugcucacucacuaacagguuuugcaugguggacaaagccacacauagcuccaucuagggcuggcugucaccuaagucuucaguggugugagaggaagugucuucaugcuuguaaacaguuguaaacuguguuuacaggagaacacagcuggccucgguucuuugauucccgucgaacagcucuggcggaugacucgaggcacagagccacacugcugagauuucuaccugugguucuaggaacucagaggcaucucaggcacuccggcuuugccuagaccacuaagccacuucuaagagcaagguugccugaagcguuuugaaaaaaaaaaaggagaaaaaaguauagcagcucccucccaaccccuccccaaugcgucagucaucuuuuuuaugcaguucauugcaccuucugcggggaccaaguugggguucugcaagaguuucaugucgccaaccacaugcgauaguuccugggagucucagucgagucuuaucgucuugcuuaggcagacuaagugggaaccugguguggggcgauagagggggaaaggagcucccugugguagaccacauucuuuuugcgugccagugucucagaugcuggcccgacucucacgagaaagggaacaauggcuugcuugguuccccaucucuguuuucucccguuuccacagugguaucaggcugaaagugaguuacagguuuccuccugcgaggauugcugggacugauaaaguaccaucccaggaggaaaacaagaugcugugagccugugagcugcucacaguggcugcucaggagggagcacaggccauaaauuacaggcagaagcagccaccagugaggagcccuaggaguggcaggcugugguguggggggccaggagacugcagaccagugaaggggguggggucuggagcuggguccaagugagaagaaaaagaagcaaaguuuugccucugugcuggcuagcaugaguggccuggauagccaaugugggccauuuaaacccuuguguugacagguccuuaggauggaauaauauuaacaagggagcugccaagagcucccuuagguccuagagccgagccuccgaguuauuuaucagccuguggauucugacaaccccuuucccuccaucgguuccaauuuucucagaggaggaagugaggccuuuucagaugaaccaugcuaauuaaacaaaacaaaacaaaacaaaacacccaaccccuguguauguaugugauauaugcaugcuaugugcaugugugcauaaucaugugggggagugugaacucaugcaugucacagcguuugugugugugugcgcgcgugcgagugcgcgugcgugcguguguguguguguguguguguguguguguguguguguguaagccagaggguaaccuuacaaguugguccucaccucccaccuuguuugaggcagggucucuuuguuguugggugcuacccacguacuccagacuagcugaccuaugguccucuagggagucccugucucuaacuccugucuccccacaggaaugccaggguuacagauggaacacagcacugcaccuggcuuuuaugaagguucuagggauucgaacuuagaucuccaugcuugcauuguaagcauucacucuucuccccauccguuucuggguuuugauaagaccaaggcagcccgcugaaugugacagacucuggcucccuagccagugcuggcacugcaggcgcugcaggcagaaggcuuguucccuguuaccacaucccuaacugucuuucuguugaacucauacaggaauugccaggagggcagcacaggcugcagccagccuacugcccaggggaauauucagaguucucugcuucugucuuccugaggucaccuaauaggaaacugcaagcguucggagcaugcauugagaggagaguaagccaggaauuuucauucaaagauggcuuccuuagcuuguuggcugccgggaggaaacacagccagugagcagcugguggcuucucaccaggggccccuggggcugcugucucugccuaacucucugcaggacacuggaugauacaugacucagaccuguccccaugagucaaccucacucagaccucacucagauuucucugucaccagcaagggagugcuuggaagcccuuaauuuaaagcuugaaauugguuaaugacuuacuuuuuuuccucuucucuuuaaauccugaugcaccccccccaaaccuacaaacacaugugccaccacacacacacacacacacacacacacaccacauauauaccacauacacauagacacauaccacaucucauucacacacacacacacaccacacacacauauauacauaccauaccacacacacacauauacacaccacaccacacacacauacacacaucccccacacauguaccacacacacauaggcauacacacacaccacacacacacauauaccacauacacauagacacauaccacaucccacacauacacacacacacaccacacauauacauaccacuccaugcacacacauacacacacacacacauacacacauaccacacacacacauacauaccacacacacacacacauauauaccacacacacauacauacacacaccacauauauacauacacacacacacacacacacacaccuuccuccaguuuucacguuucagcauagaugaaccaucacaaccucaauagccuuuguugugacaaagucgccagcaagcccucgaauuccccuacucauuuggcuguaugaauaaauaaugauucacagauacuggcugggugugcacauaauuuguauccagaaaacaaaugauuucuuccccaucccaucccacuccauuuuagcucugccagagcaucauaccacaagcuacacguccugauacacggccacgucuuugugagcucuuuaugccacuguuuuucuuuacuuaagcucaguccucauccugaaagacccaccaagcccacaugggcacuauggcugaacuccagcauuguaaguuccauaaggccgcuguaaaaaaugcaggaagguucagggaccuacguggugccaacccauaagucuguaaucuaguaauuucugcugugacagugcguggacuuaggaaauggcuucauaguucuuucugagagagacuguguaccacaacuugcuggcuuucugucuugagcaaugccggcugccucuuucaauugaggcugaaagaaaaaccacagcacaacacagcaucuucugauggcuuuucccagaacgagucugcccaaauccugcccucuguggacuugccacuuuggcccugaaaucuccgcacugauccaagguauaccugugagcugccucucggagaccacucugcuggcaccggcucuuccggccagcuaaguacugagccugcuaaacccaggggcaagccaaacucagaaccagggccagacagcuugcugccaucagaguaagugcaagcgaaucauucagagcaaggcacagccagauaaaacccaaagaguguccuccgcgccagccuucuaaucucugggacuuuaacugagagcggcucagagcacuugacacaacuuucacccagcgaccaaauauuucaacagccuaagcauuuauuaaaacauccccgcagcacggcgucugacaaauaauaaucucguggucucagagucaacagccucuguuugaauuccuccccccacaagcaggcagggacuucaggcaggcaccggaggguccacgggcugccaucuuagucugcgcaaagcugagcaaaaucagauauaaaaaagaccagcguacucaccucucaugaagcacuguggauaugaaggaaaugacucaaaaaugcugucugaagccaucguuuccuuucgaaaacgcaccucuccugaaggcgggggauucuauaauuucuuucaccuucagagcaaaaaccaagaaaugucacuuacucugaccucaccucccaccauggcuccccacgucucuuucuacccccaacccuaacacuucugguacuccauggguccuauggggugggggugggggaaagaauuauugcagaaacaaauauucaaauuguuaaagauuaaaaaaaggaaaaaaaaaagacgaaagcaccgccuaugcuguggguugaacugcucaccgcucugcgaaagccugugguuugcauucagugugauucguccugccugcugaccacugugcugggcuuacacuucugacacugccaggcuacccaacuugugguucugugguuguuuaugagguccaaagaa

SEQ ID NO: 12232 - RNA, 27066 nt, Mus musculus
agauugucacacacaugcaccugguuacaucccuggcaaaggcagguaagcucuaccucccucuaugaaacucccuaucuucuaaugcagcuccucuggcaacuagccucccuccuuaagggcuuuccacacacuccucaggaacacagacuuaagugaggcggaggagggccuugaaaguuaucaaacagugucucuuuccacccgucaggauggcuguuacauacacacacacacacacacacacacacacacacacacacacacucacacacucacacacucacacacacacucacacacacacacacucacacacacacacacacucacacacacacacacacucacacacacacacgaugucuguuacacaaacacacacucacacauauacacacacacucauacacauacacacauacauacacacauacucacacauacauacauacauacauacacacacucaggcacacauaaauacacacauacacacucaggcauacacauaaacacaugcacacaaacgcaugcacacacacagacacacacauaaauacauacacacacacuauauauauauauauauauauauauauauauaugcauguguguguguguaugcaaguauuggugaggacauaagacauccagauuuugugaguggaacaaaauggggaaagcuacuggaggccuauagggaggaggcuccagguagggaccucccuccccaaaaccucuauauaaguaguuuagauaauuauugcucaccauuacagacagagcuagagaaguuaccaacagcugagguggcucucuccuuuggucacuuuuucugugucuggaguggcaggagggggaagggcguuccccacugagucucuucuugacccucuacccacaugcuagccaugggcuucugaccuuggcacagcuguccaggcagucuucauuuugcucaaguacucuguucauaaggagcagggacacagaaaacaucuuuagcacgggggugucaauggcaagacggaggccagugcaccaugcaggggaccagggguggcagggccgcugacucacucugcuucacggaggcagcagccacgucuugguggagcuaaaucugccgcacgcuuuuagcucaugcaguuguuggcaaccuaacucaacagccuggguuauuuuuugccuccuggagauuggugagccagcuaacguuccuuuaauaagugcuccuucuacagaaguugguggccauuugaguugccugcggaucccucggcacuuguaaaguucaggaccaaaaauacaugcagagugccuucuggguuucuuuuggugaugucuagcagguauugauuccauaggcucuggaaaaucaugagggaagagagagauuucugggcuugaucagcaaacaugucuccucuaauucuauaaugcagagcucugagaaaagauggcagccuaacuaucaugagcuuguugcucugacaaaagcaucuugcaagagaagugguuuaucuuggcuuauaguuuggggauacaguguaucauggugggacaggacugugaggaggccggacaugaagcacuggcugccaggaagcaaagaaagaugaacccugggggcucagcucucauuucuguuucgauguagcccaggaucccagcauaugggauaggacuaccuacauuuagacuggguauucccaccucaaguaaccuaaucuacaaaagucccagcaugcucagaggccuugucucuuuacugacucuauguccaugaaaucgacaauauuaaccguggcagcaaucaaugaaauauucucaaacagcuaagagagaauucuuguuuccagcaugaagauacaucugaggugauauacauaauguguuaaagugucacuauacucuacauguguaugauuguuuguauauacuugguccagaguaggugugucacuguggguguagaccucauccuagcugcuuggaaaccagucuucuagcagccuucagaugaagauguagaacucucagcuccuccugccccaugccuacuuggaugcugccauguucccaccuugaugauaauggacugaaccucugaaccuguaagccagcuccaauuaaauguuguccuuaugagagcugccuuggucauggugucuguucacagcaguaaaacccuaagacagaaguugguaucaggagugcauucuguuauaugucaccuaaaaguaaagauacuuuauaaaauauauccuccaacaauucaggaucuauucccagaagaaugaaucgacagaaagugauuuuuuuucccacgcaagauugaaaaggggagagauuuagacacauguuauaacauagauggaacuagaagacaccaugguaaguggaaaaagccagucucaaaaggaaaagcauugucuauaagauaucaugacagaauaaacaauggaaaggaggggauuauccacuugggccuggugccaggguuucagucagccuauagucuuuugcuauguugcuuuggggccacgauaaggcagaacagaugucugcuuugugauagacaaggagcagggagagaaggcugaagaggaaagggcaggaggagggauccagcgccaguacccuaccuccuucaaccaagccaaccuucuaaugcuuccaucccuuuccaauaaugcccucaaaugcgaccccaucaauggauuaaucuuuucaagaaaucagaagcugcaggaucccaaaacuggcaaccaagcccugguaccugagccugggugggagagcguacuuccauaucaugucuccuuucacuuacaggugguuccugagcagugagagcuacagagagaaagaaggaugauggcugggaggagggccuggagcaugaagaacauuguguauauauauauauauauauauguguguguguguguguguguguguauauguauauauguauauacacacacacacauauauauauacacacauauacauauauauauguauaugugugugugaguguguauuuuuuuuuaagauuuucuuauuuauuauauguaaguacaccauagcugucuucagacacuuuuuucuucuuucuccagcccuauucacucuggcccaaagauuuauuuauuuauuauauguaaguacacuguagcugucuucagacaccccagaagagggcaucagaucucauuaugggugguugugagccaccaugugguuauaggauuugaacucaggaccuuuggaagagaagucagugcucuccagccugagaacauaguauuuuaaugagcagagcagagcuuccauuugggaagaugagaagguucaggagacgggauggcagcgauggcugcacaguuacgugaucguacuuaguggagcugaggaaugcuuagagcuccaguuuccugagcuggguaagaaaacagaucuuaaugccuuuccaacgugcccagcagggaaguuacaauucagcucuguaacuuggguacuauaugguuugaauuucuguguguuccccaaccccuaaaacugcauuagagucucaacugcgggcucauuuggaaacuaggccauugcagucaauaugggucauacuggaauagagugaacugguauugauuuaaucuagccugauugguauccugauacaaauauggaauuguaagggcaaggccaugggacaacagaggcagagaaaugcuguaguguuaagcaaaggaugccacagcuugauacccaccacugggagcucaagagaggcaaggcugguuuguacccagccucagauggagccuggccaagcuggcaucugaauuugcacucuuggcuucugacacugugagagaauacauucuguuuuaggcugcccagcuuguggguuauaggagccacagccaaugggcacagugaguuuucagaaugccugcuuaccagcacacccuccccuugugucagggacauacacacacagaagccaaucugaugcaacucacagcagggucuuuauucuauuugagcuagcuuggguccccccaacacaccaccaucaugcaggaugguuuugguggugguggagcccuaaaugucuaucagggcaagguuuuauaauaagcagcaagcagggaauaugugugcaagcaucuaauuggaaagcugcuguggccuuuaauauaacuggcuggugcugggaguccuaacauaaacuuaacuucggcuccccucugcauugguggucguuagacaaggggugggcuuguaaccgggggugcagguuuguugggggaauaaccuggagacacuggucuuguugaggguguaaccuggagacuggagcuaggcucaaguuuuguuggggggcaacuuggaaauuagugcuagauaccagccuguuagccuacuugaguucaaacuuaggucagguuuucuaaaauggagucugaauuuaagcuaauuuaaagcuuuggcgggggcuggagagauggcucagcaguuaagaccacugacugcucuucugaagguccugaguucaauucccagcaaccaugugauggcucacaaccaucuguacagcuacaguguacucauauacauaaaauaaauaaauaaaucuuaaaaaaaaaaaagcuuuggcaucucacccucagugcucauccugcuuucucuguaguccgccagucaggcugauuuuaucaagucccccuuucuacagauggcauuauaaaaaccaugaaccgaguuauugaagaguaauggaacgucaaauccaagguccaugugucucacugcagggcagcacauacuggggugggggcccuaugaugugggugugucauugucccuaucucagagaugaagcugaggcuuccaagguaagcgacuuguuucaaguugacagugauggaacugaauagggacucugaccgacugaugucacugucacauucagucucacggcuucgaauuuucuucucugucuguuucuacccaccccacugggaagcugcuugcaccugcuugccgaguuuugcugaaggaacaggacggagguuacaagcugacuagagauggaggcguuccugaacaucccuccgagaagguugggguauaaagagaauaaacgaagcuguguccacagugugggcuggaauuccugccgucugguaacagcagguaguucaaucuuacugacucuguuagcuagagagaaacccuggucugguuucagauauggucucuagcaagggagcccccagggaguguaugccuccuccagggaagcaaugggugagauagaaggauuucucagggagacugugccaagggggccacggaaguucugagcaguugguccgcuucccagguagacuguuccucuucuagaacuuucacuucaaguuacucccccugccauccuggcgauucagaacuauuuaggagaugugcauguagauccuaugaauauugacaagauccuggguugggcuggguuuuguuugcaccaacaguuuucugacugugaucuuggcuuggagagguucaugagaagccaaguacauuucccagaauucaugagauuuugucuuuuguggaaaccuucuucucugccaucuuuuccuuugcccaacacuuagaacuccagcccaccaccugcccugcaagccccucccacaucuguaccugccugucucagggcccagagaacauugaggcuugcuccucuaacaggaaccuagccugggcuaacugauguguaggggcagccaaccacuaagagguauuaaugggaagcccugaagcucccuaucuccuauuggccaugagcacaguucccuccuccagcguguucucauaagaauguuugugagcagggcuugucacccugguaggucaaaaugaagaaaaagcaaacaggaaagagacacagagaccacacccacuaugugguucaagucaaagacauuaacacuagcacaaugcucuucuccccuaaaugguggcugaagucggaacaaaguuaagaaggucaacuuuaugcauuuauuggguuucgcuuguacuguccuggcaggacaucuauuuuuauuuugucuucuccaacuuggaaacuaagcauaagcuaauuggguggcuguucaguagcuacaguggcaggaaaguuaagcucugaccgucuggcuguugaugagggcccagaauuggaacauugacuugcccauggcgaaccccacaaaguguaugaaguucggguuuuguacugauuaaucuuagaccaacacagcaacauuauuugcauuuuuaccuuggcagucugucaccaaaauuguuuaggaagugcacauuggugcaguaaggcauucucuuccauaaggaacuugacaagauagacuagggaugcugaggguauuguagccuuaccauuuacagggcuggauggucugcauucuaugacuuuaucacaagggagugaccauuauuaaccagagggcucugggucacucaucacaacaaggaagcagacacuugucagaccaucagcuggcugccauacuauguccuuacggggacaaucaacacaguuucuuucccaaaugacuuucggucuagaccagagaaauuaaauuaacacccaagaaaucagucuaaggugggagagauaaauagcucugaaguaaauugcccacacuccacauaauaaccaagaggaggcauacauuuguaauuccaucacuggguucuaggacguggaaacaggaagagcccaggggcucaaacacuagccagucuaguugaaauacaugauucaaagccguugucucauaaacuaaggcuuuuguggauggccucagacccagaaguauauggacaaaacgaauugaaguugguggauuaugaaaugaaaaaaaaauaaaggagggcauaaaggagaauagcagaucugggaggaauuaaugggaugggucaggguaagugagaacaaaugcuuugugugaaagaauuaaugaaaaaauaauaauaaagguagaguguaauaaagacauucaaaguuggucucuggaguccacauggcauggacaggcaagcaugccuguauacacaccugcucacaugcaaacacacauacacauacccgcucacaugcacacauacacacauaccuguucauaugcacacacacacacacaccugcucacaugcacacacaucuacucacauaccuacacacacauauacaaccauuauaaaacaaccaauauuuuaaaauugcgauaugaauuagaaacacaauuuaaaauuaagcuaauuuggggccgucuuauuuaggauuuuacugcugugaacugacaccauaaccaaggcaacucuuauaaggacaacauuuaauuggagcuggcuuacagguucagagguucagcccauuaucaucaaggcaggaacaugguggcauccaggcaggcuugguacaggaguugcugagaguucuacaucuucaucugaaggcugcuaggagaagacuggcuuccaggaagcuagggugaggguuauaaaucccacaccuacagugacacacccacuccaacaaggccacaucuacuccaacagggucacaccuucuaauagugccacucucuggaaugagcauauacaaaccauaacaggggauuuuaccaauucuaaauuaaugaggcaaaauuguugcuucaagguguuauuuuuuauaugaaaaccagacacacaacaaguagacauguggaauuuaauacaugcuaucacagaguuuggagaacccuccuggaaggauucaggcaguacucuugaaguucuuuuucuuuuuuuuuuuuuuuuuuuuuuuuuuuuuuuuuuguguaagaacacuaagcaagcugcucucauuuggaggugacucuuuuuucagcaucguugaagauauuacaagugaaaaaacccaccauuuuccacaaaacagucaugggcagaaaagaaaaaggagaacaacuuuaaugguauccaggguugaccucugacuaaauuauuucaggcaaccaaaucguguauuuacaaagcagaucaaaugugugcucucaggaucucuagcaguuaaccccugaggugguuaauacugucagcuugacggggucuagaaucaccauggagacauaggaguuucuaaacucgguaaaccgaggcaggaagacucacccuaggguuuuagaccucguggaaagggaaggugaauauacacauucaucucucucugcauccugauaguggaugccacgucauguggccugccaccccucacuccagcugcuagagcaaaccccuccuuccuuaaguuaucuuucucagggauuuccucaucacagcaagggggaaagcaacagauccaggccuacuaccuaguuuaucacaaguccuguauccauguggcaaaacugggugucgcucugaagguccagagucuccaugcaaagccaguggguguugugggaaguagugcccaugacccaaggacacagcuuccagcaguuuaugccuuuucucuuuguacagcugaugaauaucugcaagggaaaauuuagaaguuauauuucuaugaaacaaugcugaccaaguaugcagggcugaauccagggaaauauuuagaacagccacuggcguggacagacucugugcccccagacaauacuccaaaaauacucuuucucacaacuggacguuuuuuuucuugauguuuggauaagcacaugaucaaaaucuaggcaagcggcaaggagggcaaagugcaugcguccagucaggcaccugcagaggacaaggagaggaauguuuauucccauuucagagcucaccuguccgaguuugcuuucucucgcugugauacaaauacugaccaaaagcagcaguggggaggguuuauuucugcuuacgaauccccaucaugguccaucauggagagaggccuggacaggaccucaagucaggaaccuggagcaggcugugaagcagaccagacaggcacgcugcuuacuggcuuggucccuggaacaugcucagcuugcuuucuuauauuaccuggcaccaccugcccagggguggcauugccuaucauggcccucuggaucaaccauuaaucaaaacaaugccccacagacuugcugauuggacaaucugauggaggcauuuuccuuuuuaauguuuuaaaaaaaucuuuuauguuucuugguguuuugccugcauguauguuugugugagggugucaagccccccucaggacaggaauuacagauaguugagagcugccaugugggugcugggaauagaacuuagguccucuggaagagcagccagugcucuugauugcugagccaucucuccagccccaguggagggauuuucuuaugagguucccacuuucugaaugacuuuagcuugugucagguugacaaaaacuaaccugcauacugcucaacacugugucuguggauggucaccuuauuaggacccagggaaggguguucuugcuuacgaggaaguuuuauuauuugguaucuguagaagcaacaucucugcucgcuuuccagcacugauaauuuuauuuuuuaacguuugucaagacaguacaggaaaguggcaaauguauuuugguguuuauuuuacauguuuuuauugguagucugaauguguuuuuuuuuauuuuuuguuuuuuuguuuuuaauuaguuggcuggagauugucauagauuaagcauguuaauccuugcugaccuagauacccccuaguggaaauauaagggaacagcaaacuaacuuuggaaaguucaugagcuuccggugguuaaaguaucagaaugcggcuggggagauggcuuggcuguuuagagcccuggcuggcugcuucugcagagaaucaggcuugauuccuagcauaaacguggaaguucauaaccauuucuaacuccaauuccaggggaccugaugcccucuucuggcuuucaaaggcaccaggcauguacacgguaugcagucacaugcaggcaaaauauccacacacaucaaaucaaauuaaauaaaaagaaaguaucauggugcuaugaugcuguaggcugacaugaagucuuccacuuacaauuaaggucuugguuugguuugguuugguuugguuugguuugguuugguuugguuugguuuggaggaagucuugcucugcagccuauguuagguccaaauuccugcuuauuuagcuucagcucucugagcauaauuaauuucuuagccuauccuuucccaccaaagauuucuaucagguaacaugagcuacuuaaaaauguuuugaguguaguaggacaguggagagcagaagaaaacggaagugaguggggaaacagccugucacuuuaacaugugacuugaaguuauuaaauaaacaugaaauuuauuucucuuggaguuugcaaggaaggcauuucaguuugccauuccacguggguuccagcacagacuuggacuuagugccuucaguucaguagcaagucaccuucuuagacguugaaggaggaacaugugaccuuuaaaaugacaggcucagcuguaagaguucuuugaacuaagaaacauuuguauagaggcaaagcuuacucucuuaguuguucccuuuggccuagcuugauaagugcacauacccaugcaggcugugucccacccuagaugugggacacauugucuucccaagccaguuugacaugaccagugaguaauaaucagauuucuaucacuauaugauagaauguuuuauauuagauggcuaucuaugcugcugcauguaucuggcagucugugcuuuuuauuucagaauaguuuuauauuguaugaaaauauaucaauuuguugauccagcuuauuuuugaugggcaucuuaacuguuuucagauucugaaguuuuaaaaaggauuuauuuauuuauuuuaugaacauguauacacugcagcucucuucagacauaucagaagagggcaucauaucccauuacagaugguugugagccaccaugugguugcugggaauugaacucaggaccucuggaagagcagucagugcucuuaaccgcugagccaucccucuagcccccagauucugauuuuuuuuuauaaauaagaugguuaugaauagucucacaugaggauuuuggugaauauacauuuucucuuuucuuuuuaaagaggagcaucgagugcucucaaccucugagccauuucuccaacccuagauuuuacuuucucauggauaaacaccuaacagugagagucugguucauaagcagccgcguguguuugcuuuuuaaugaaauuccugcccagcuuugccaacugguucugcauucccaccagagcugcuaaaguucugauugucccucuucaccaguguuuggucuggauucuuugguuugcaagcuuuuguacccacauuuuagcagguaugagacaguaucucuuuuagggguaauuuacauuccucugaugauuaauguuuugagcaccuguucaugagcuuacuagccauuuguuuaacuacuuucauaaaauauuuguucaauggggcuggagauaugcuucagcugcuaagaccacgcacuacuuuccugaggaccuagguucgguaacucuggccucugcagguaucagguacauguauggugcacagacaucccugcaggcaaaaugcccaugcacauaaaaauaaaguuuaaacauuuaaguguuuugccuacauguauuucugugcaccaaauuuaugcaguaccagaagaggaggccagaagagggcauuggaucccuuaagacuagagucaacagauacuggugaguugcugugugagugcuggaaaucaaaucagguccuugggaaaagcaguuccuaaccaccgaacugucucuccacccccaaaauaaauauucuuuuuuuuuuaagauuuauuuauuuauuuaauauauacgaguacacugaauuuuauguacguguacacacagaugguugugauccuucaugugguuuuugggaauugaguuuaggaccuuugcucgcuucaggucaacuccgcucacucuggucaaccccgcuugcucaguuccugcuugcucuggcccaaagguuuauuuauuauuauaaauaaguauacuguuguguacaccggggaauucuccaggcccuuagcauaaacgcugucuucgcuuaggacuaccacccauucugugucacuugguguccuuauagcucaggaaaggcucuucuacugggugggcaaaaaccuccuuccagacagaggaugucaggggguucuuggggcugggccacguucaggcugcagcugugacauccuugcuacagcuaucuuccuaaaccaguuuuuuuuuuuauccucuucucauaucuagaaaucuuccaucucauagaguguucucaccagaccucaccaugugggccugucuagguggaaggccaagcacaugcaugagggaggugggacaguucucuuuuaaacuccaugucuaagaaaugugcucugaaaaaaaugaaaauccuugcuugggacagacagauccagccaaucccuguacaggguuaggaaagaagauugcccugggcuggcgggaucaaaugggccugggagaguuucauuuucaggguuuuaucuuuggcuuucaucuggucacugagaucugaagacuguugcaggauuagagggcagagggugggaaaguccugcccugagagccugucaaucaggaagauggggggcugguucuguucugagagccuguuagucacaacagagagauccagaaccgcuuagccaauuugacucuagucagguuuggaagauaggauuucuagcaucccugaggucaauucuguuccaaaugguggagcaggacagugcacacugggcugucugucagcauguucuguggcucugacccgucuuccuuuugucucucuaguuaccagcucuuccaguucucuggauucucaaagucagaagggagcccucagcuuuggggaagcgcuugaggcuaucuuccugugaucgacaaucaacaucuaggacugggcagagcuugguuccaggugaggauacauaugaggguacggcugaagugcacugcuucccuaggucagcgagagucaaguccccccccccccccgccccgccccacccccggcccccacccagguacuaagaggcuuuggaacguaagacauggggcuuaaguuagaaggaggggauuccaacucagggagcaggggucgauccacuucuggguuuugccgcucugccacauacggacuccaccacuaugaaucuaccaucuggcuaccuggguuaccgugugugauagucaauguuaauuguuaacaugacucaccuaggaggcaagccucuuggcauaccucagggauuaucucuuagggugacugacugaguuuggaagccucugggcagcggccuucauaccaugggucaggguuccggacugaaugcgaaaaaggaagccggcugagcggcagcguucauugcucuccaccuccugacuguugauggaaugugaccagcugccccaagcuccuguccucuuaccuuccccaccacgacggaucagacccuugaacugugagccaaaauccuuccuuaagcuacuuuuguauuaucuuuucuucucccuugcuucucugagcccuucaaggccuuuuuucaucuuucuguuguuugacaggaggaacgggcauguuuaaggaacucuggaagguaugacuuaucucucgggagugaagucuagaacuucuauggaaggaaaguugggggccacagacuucucuuccccgggguugguuggcccuguuccugcucuuucaauaccuccuuccccucaaaucuucccaccucugaagaaaaugauuccuugcaacgacaaaccaagcacagaaauagccauccuauuuguggcuucaaugcaggcagcuuuauuuuuacaguaaguugcuguauuuucucuaagcauaaauaauuaucuaccacaaaugaaacuccagccccaucugugauaguuccuguuuuguugguggugccaauuagucacaaaacacuuggcaccuucucccacccacucacucugugggaggagagcgaucccuagcagaaguccccuucccuggagaccagcugaccucuuagcuuccugggagcucugcucugcauucaccuggugacuaguaacaacuuccagauugggcgacugguccuuggccagaguggccaggcaucucuguugugauaagagaugggaaaaguaaauuggugagcuccucuguucuguugacuuaaacaaggaagguggagccuucucucuaguuggucacucugcucaggauuccacuacccgccuggggacaacuguuccccaaauccggacugucucagcucuaagaagcugcaaauguggauugaggagcagagaagauccuucuguuccuuccuuccuuccuuccuuccuuccuuccuuccuuccuuccuuccuuccuuccuuccuccccuucgccccucccgcaugccaugccaggggaaccucuuggccagccccuuucuuggcucucauuggauccuacuggcucuucucaugaaucccuccccacgguguguccuuccuuuucuaccuugcaguuuguccuuaguggcguuucccgucucucucucugauuuugcuccugaaacuucuccaggaggcaggccuuucccucuguugggacauggaaaucagguaacgggagaguguuuuugacaucuggccagagcucacugguucuguugacuuauccucugucugucugcgccugcugcuggaaccagcugugcucugaaggucuuugggguaaaccucuguccugugguccccaccccuucaccccuggccccagggagaacugagaauggggcuuccugcaagacaauugcucuccugcccuucagaccugcucuggaaagaguuugaguggacaccugcuuuccaauggcuuggaaccaccuuucuuccccuuugaucugacugguuccagggucauugcugcuuugacgcugugguaaccagaggaagcccucugaaaagaagagguguggagcaaggguggcucuucacugugggcguggcuaccugugguccuucacugugggcguggcuaccugugguccaucacugugggcguggcuacuugagauccaggugaucuagaauucucuugcuugguuuuauuuuggguucuuggaaaaaaagugggcagaggucaggggaaaagagguuuaauguguuucugaguuccugugugagaaccuguaccuagcacaauuccugggaaggaauuugccuguguacugccacagggcagacaaaccuccucuaccacagaccucucuacuuuggcuucccuuucucuccauuaccucagcccaacuuucugcacuaaacuguucgugauauacuccaaggacuuguaagagggaaugcauccugaauuauuuauccaugugccuuccucuaugcagaguuagacauacaugucccuuuuuuguuuguuuguuuuuuguuuuguuuuguuuguuguugauguuguuuguuuguuuguuuuuagagacaggguuucucuguauagcccugguuguccuggaacucacuuuguagaccaggcuggcuucgaacucagaaauccgccugccucugccucccuagugcugggauuaaaggugugugccaccauguucggcuaugugucccuuuuaauacucauacuuuucugagguaauauuaaaaauccauuuuauagugaagaacacugagucuucaagagcucagugcaggucaugugaucauuucugagcucagcuaggaauaggaauggguccuauguauucugcccucuaagacagcauaaugucucaggagcaccguucuccuuaacccaggcuggcccuugucuuugagggugacgagccacuuugugcucuccacagcccauucccacuguggcucagggcacagauuuucacuugugugucagcggaugaugccaucugaaguucugcuucugcugauaagcgugggaccaucugccuagugcagcucaaauauuucagcagugggagagcaguucugacuucagagacucgucugcagcaauccugggagaugcugggaccggggaccuggcaggcuggccggguacggaugccacaggauucaaaggagccauucccuugcugucaccucugacccuucucgagcaaaggacaccagggaguccacgcuccagcguguggaguuguucagaugcucuuaacaagcacaguaagaucucucccguucugagagcugucacccaggcagcgauuucuaugccgauugcuuuuuguggagucauauuugcugucaguguguguuggcaaaaacuucugucucccacugccuucauuuggggaaauuugcuuuucugcugggggggggggggaaauguucccagauacuguuuuccaacuuuuggguugaaacuucugccauagcuuugucgucgucuugacucaugacugggaagguauggaagaaucagaggacugauucacagauuggaugguggauguagaugcuuucaaggucacaucaggaguaagagaggaacugggcuauaacaguacccgauuccugcuugacagagccaccgggcauggcuagaggcaagccgggcagguuucucuuugcuuuccuuagcaccaaaguuucugaagcccuauccaguccaguggugacagaguauauacuaaacaggcuuuggcauaucuuagcgguauuuccaagccaggguggccucuggaguagggaggcucagcacuguggacauuugaagacuaaagaguucugguguggggcuguccuacauuuugaagggcauucagacacuagauagaggagcccacucagcugagcuugaacucuaagcggccaggcaagcuaaaugccccaagggagacauaaugccccucuaccccagauaacugugcacuaaguugauucuccugcaaacucagcagggggaccuguccuugccucucugcccagguggcuauggugugagggugauaugcuuaacacuggacagcugugcugccccacacaugcccugccuugcaacggaagugccaucucacaaauggcuuucuauuugugcagguuagugugcagguuaguguacacacacacacacacacacacacagagagagagagagagagagagagagagagagagagagagagagagagaggagagagagagagagagagagagagagagaaguguaucuacacacagcagguuucagauacauacuccuccaaucccuaguuuauuguuguuucuuuuauuuuuuucugccucuauccuuucuuucccuaccccuacccucuccugucccucucucagaagauguguagucuggggcucaggaaagacuguuuaaaugagcaggaaagcgggagggggcaucugcuccugaguuucuagagaagguacauaaagauguggcauuuguuguuuuaagaagauaaaauguauuaucauugugugugugugugugagagugugugcgcgcaugcgcgagcacaugcauggagacaugaguggaggucagaggagaaacugauggagucaguucucucuucccaccuacaguggguuguaggacuugaacucagguucucaggcuugcaugcacgugccuucuguccgcauccauucuccccagucugcuaucagcuccgcugugcgaagugcuccucacacauucaggggagagaugaguaagccccaggaggagcugucagggaccuggcucugcacacuccccuccuuccacaguuagggaacccgccaugcuugcucuccucugcuugcugauucaucgucucagccugacauuuccacaaggcuccuguuggcaaagaacucuccaaucucuagauuuucaguuucuaguuuuucuccuaucucagccucccagaaauacauuuuaaaaaaaaaugccaauugugugaaggagccaagguuuagaggggccagguuucuuggcuuagggcuugcaucugugaucagcuggcuugaaagcuaagcucugcagccagacagcauuaggcacagacagcagagaccucugcacuguaauggcgcaugaugaagucucuuuugcagucucugccacaucuacugagaaaacaaugaccguucucagaaauaagguugaccacauucuaggcccuugacacuuggaagucagagccacuagagggaucuugccgagggacuuaagccgcauccaaguagauucccaaguagauuccagucuccuugggaaggaaaaggaagagguucugacuugacaaauggcauagagauaauaagaugcuggcugucuuuuacuuugucuuuggcaauacauagaaggcaauuaggggugucaugccuggguucugucacaagacgccuuugcgacaacagguaaagacaggucugaggcuggagagauggagagauggcucagcauguucuugcagaggacuccccuuucaguuccuagcccacacugggcagcucacagccaccuguaacuccagcuccagggggucugauggccucuucuggccugugugggcacuacacucagcugagcaucacaugcgcacacgcacacagaaacacaccauacccccuuucuuguccuuccacucccucucacagucaugggccucuuauucuuuaaguauuauugcuauauauauacucacauauacauauacauuuauaaauacaaccuugcgagccucuuuagcaucaucauacacucguguguuuaaggcuauccccuugggauuggauaaugaucaaaggacucauuccuggagaagguagaguuucucguucucagcagccauuaauaaucuaaagcuucucaucuagggguaaagucuugcaauccuucccccaucuuucuuggcaugacaacugguauugucauuuuucaggucuuauuaggcagcuauauuuuugagacuucaccgaugcagccucucuggccuauauagaagauguuaucuuggcacagauguccugagccucugggucucacagucuucccguccccucuucuuugauguuucugagccuuaguuguaggggcugaaaaguaaaaucuuuuuuuuuuuuuuuaaagauuuauuuauugguuauauguaaguacacuguagcugucuucagacauuccagaagagggagucagaucuuguuacggaugguugugagccaccaugugguugcugggauuugaacucaggacaucuggaagagcaaccaguguuguuaaccucugagccaucucuccagccccccaaaaguagaaucuuaaaaaacaaacaaacagggggcuggugagauggcucaguggguaagagcacccgacugcucuuccaaagguccggaguucaaaucccagcaaccacaugguggcucacaaccauccguaacgagaucugacgcccucuucuggugugucugaagacagcuacagaguacuuacauauaauaaauaaauaaauaaauaaauaaauaaaucuuuaaaaaacaaacaaacaaacaaacaaacaaaacccaaagaacucagagaauuuaugcaggggugucugugucccagaaaaagaaacaguucaguaggggaugcauaauaucagagagcuacccaaugccagaaaaaggaaaaaaaucccagauucucagaacaauuugugacaguuuaaggacauaauagaaccucuacuaauuuugaagaaaacaaaaaccaaaccuuuuacacucaggugugaauguacaaacugccuacuguuguuuuaauuccuacagauggguguguuuuacuaagcaucgucuuucagcuacuucucaaggugaguggugucugccugagcagggaaggcagcccagcagaggggugggggcauggaggaauggggcccuagcagaggauguccgcagcagacaaggcaggagggcgucugucugugugggagguaaaggggacaaggaaccccugcuaaaugagaaaauuguuccaaagcagggcacaguggcagugugggcugcucagucauagaggagggcuucuuagcagguuguuugcacacaugugaauggugaaugaugggagccagguaccuuacugucguaggaggaaguuauaaauauggagagguugguaaagaugcauguguuuguguacacucacccacauuuuaugaaucugauuguaaguaccuggaugugauuguaaauuuauauauauauauauauauauauauauauauauuucaaauaaugaugaaaaauuagaagcaguugguauguucaagguuggaggauuagcagaaaauaaauacauuuuagagacuaccccgauaggaagaaauauaauauguuaucaaaugagaaaauguaugauaacaacccuuauccuagacugaucccaauuuaaaacaaacaaacaaacaaacaaaaauguguuugagccauuggaaaaaaaucuaagggacuauucugaguguuuaauaagguuaguuuugaguacuugucuuaugugugaaauuuccaaauauucugcuaugagaacauauuguuuuaugauaggaauaaaaggugauauaaauuaaaauccucccauuuuguaucauagcuaaguagcuuacagaggagcccauuaggauggcuuggagggggggggcuuuuacccagguaggaauggaagaaucuguccccaagggccacuccguuucuugaugacguuccuagaacucucuacauaggucauacugucuuccagcuuguaguaaucuuccucugugauuacuaauaugaacaucaagacagacuuucaauguagacagggcacaggaauccuggacccacccagacaagaucacaauuugaaaucaaucuuaggucuuagaaggcaaugagucccauccaucagggaacauggugccuucaagucgucaaauaggagggcuagaguagaagacaaaauguaagcacaagaagacuucugcaaggggugagaccugcagcggggugaggcagcagggcuuaggucgggguuucuggcucgcuggacccuguguuaguggugaguguugguccacuguccaaucucuccagcuuccauuugucugugaagugagaggcucugcuaaacuaguacuuugcucucuguugagugggacacaagcucagcuguuggcuggcagucaggagacuuggccaacucccugauuaggaucugugagcauuuucaggcuccacuaugcugcugcccagggcccggcagcugcugugaagcagucaugggugguggagccccugugagguugugccuugcagagaggcucuagcauaacuccuuccguuuccucccuguuagacgagggcuacgauggcuucccucccagccucucacauuggugagaguguccauaguuaggcagcaaagaaggggucuucggauguuaaagccuuaaugucugcacucugaugcuccaggaaacuucauucucccuaggaggcgcuuccaugaggaacagggaggagggagcgaaacucugugauccugccagagccacugacuaacugacuaacgaugccaccgaugccaccgagacugccccaagccucuagcccucuguccccaauugagguucccaccgcuguguuccccaccaagaccugccagccagguaaacaugcagucugcgacuccaguuacucuauaacgagaugauuugcuugucuggacaaagagccugcugucccagagcugggucuaccuggagacaggaaguggccccagaccagucagucaucccuccagggaggugaggccucucgucugggagcucaaugaugguguuugugggcuguugggaauguguggcuagaguaaauucugagccgccacuuuggcucugcucacaucgugcugugcauggucaaauaccccagcugcucacagcagaugugcaagacagcuaggagccugaggaggauagggacuggagagauggguacagagggccagcugguucccaggacucccaaacugcuacuggauagcuggaaauuccucuugauuaacauuugggaagugauuuuuuuuuuaaagcaauguguucauuuaaguaaaauuucacucuaacaacacgacggaaggauuauauucguuguuuuuagugauacuuaguuuuuguaauuuaacuauuugcauucuaaccccacgaucaaaauuagccugacugugcaguuugugaauuuuacccuaacucagaaaacaguauucauucccuaggaugcccugggcagaagggagugcuguuucucugggggaaagcagagguccaucugccucugccucccaaacacugggauuaaauguguguguaccaccaugcccagcuggccaaaaccauucauuuuguaguacugggauugagacaggaucuuacuacauaguccuggcuagcuuggagcucacuguguagaccaggcuggucuuggcuuuguaaugaucuuccugcuucagcuuccugacuguaaggauuacagacauaaacuauguccagcuaguagggacauucuguaccuccugguuuuaaugcuccuguccacaguguucuuuuuucuuaaaaugccuccccccaccuuguacuggcuaguuuugugucaacuuaacacagcuggaguuaucacagagaaaggagcuucaguuggggaaaugccuccaugagauccaacuguaaggcauuuucucaauuagugaucaagggggaaaggccccuuguggugccaucucugggcuggcagucuuggguucuauaagagagcaggcugaguaagccaggggaagcaagccaguaaagaacaucccuucauggcuucugcaucagcuccugcuuucugacgugcuugaguuucaguccugacuuccuuagugaugaacagcaguauggaaguguaagccgaauaaacccuuuucuccccaacuugcuucuuggucaugauguuugugcaggaauagaaacccugacuaagacacccccuuauucagcaaaugaacuccugcugaccuuucaaaccccagugauauaaggccucccuuaaaaccauguaaagcuauacuuugcugugugcuugccugguuuuggcaagcucuccuucauuccacucacagaacugaauuagauucuguucuuucuccccggcaaaacuacgccgugguucuuauuuuuaacacucuguacaaugacuuaaaauucaaucuugaaagaauggagaaagccuguuccaucaccacaaagagaaaucucuaacuauagaauuaaauaagguggguuugaguuuuuuaaaaaagacacgcaauugggcccaaaguguucaaaccgcuuucucaacucuuucugugaauuuaguuagaagcuuuuuugagaaagggagaaaaguugaacggggggguuggggugguggggugggugggaccuggaacauaaaaugaaagugugggacacacauuuucagaguaaggaggaacaggcugugaauuuagggcucuggaguaaggagaggggaggcaggcaggcacagugguggggaccccuugcaccccaugauuacaaucaaauaggagagcccucuuggcaagaaaccaagagcugauugccuuugaggcuggagggacuugaaacuugagccuugucugagacagcaggaugccccugucaccuuuccuaagaacacagcuuaggucugguuuuacacauuuccaguauuugguuugagucugcuccuaagaaguuagacuacccaucuuuguaugagacauuucguuuugugagcguuugaagccugagguguacuacaggguagccaccagucacccgcuccacacaggaaguguggcucgauguuaaacguguaucauuuccuacaggguggccauuggucaccugguccuguugagcacaggagauauggcacagcugcuagcguagaugcuacauguggaagacacauccuuuuuuuucaauuuuaauuucauauuggauaaaugauuaaaugcuauuuugaacucaucagguuaaauaaaauagagcaucagaauaaauuucuccgguuuauuuuugcuucuuuaaaaaauuauuuaauauuauuuggaugacuguuuugccugcauguauguauguauguauguaugcaugcaugcauguaugugcaccgccugcaugccuauaucugcagaggucagaagauggcaccagauucccccauugggaugcuuguaaaccacuggguaagugcugggaauugaaccugggucuucuguaagagcaauacauuuuuagccacugagccaucucucuagccccuauuuauuaauucuauuuuguaugugugagugauuuguucccauuuuugccuguauguauguuugugcaccauaugccagguguccuugaaggucagaauaggguguuggaucccuugagauuggaguuacaggcuguuuaggagcacccaugugggugcuggguguagaaccuggguccucuguaagagcaggaugucucuugccacugagccaucucuccaggaucuaaacuuucuacccacaaugucaagguuaugauuuguagcucucucuuuuuuauuuuauuuuauuuuauuuuauuuuauuuuauuuuauuuuauuauuucucucugugugcauucauaggcaugcagguacauauguauguagauggguauauuuauuuauggaggccugaaguuggucuugagagcuguuccucggcugcuuugcacuuuuuuuaaaaaauaggaucaauuacuggccuggaacuuuccacguagucuaggcugacuggccagaaagcucaaaggauuucucuaucucuucccagugcugagauuacaaaugugugucaucacaccuagcucuuaaaaauacauguuuuuauguguauaauuuuuuaucugcauguguguguauagaccacauguauacaguacccacagaagccagaagaggacgcuguauguaccagaacuggaauuacagauuaugagccucuacauggguucugggaacugaacccagguccucugcaagagaagcgagugcucuuaaucacugaaucaucacuccaggccccacaccuaggugguuuuuguuguuguuguuauuguuguuuauuuguuugcuuuuaaaauguggguuuaggggauccaacucauuuucuugugcuugcaaagaucacacuuuccuaacugagccacccucaccccucagcugucucuuucauuucaauucuugaaacuuucauacaucuuguuuguuugauuuaucuacagaaaaugaccugaagugacccagggcaagaacuccucauggaccagucaaauaugacaucccuugcugaagagaaagccaugaauaccuccagcagaaaugccucccuggggagcucacacccacccauucccauagugcacugggucaucaugagcaucuccccucugggcuuuguggagaaugggauccuccucugguuccucugcuuccggaugaggagaaaucccuucacggucuacauuacccacuuguccauugcugauaucucucuucuguucuguauuuuuauccuguccauugacuaugcuuuagacuaugaacucucuucuggccaucacuacacaaucgugacauuaucggugacuuuucuauuuggcuacaacacgggccucuaucugcugacagccaucaguguggagaggugccuaucgguccucuaccccauaugguacagaugccaccgccccaagcaccagucagcauucgucugugcccuucugugggcacuuucgugcuuggugaccaccauggaguaugucauguguauugacagcggagaagagagucauucucggagugacugccgggcggucaucaucuucauagccauccucagcuucuuggucuucacuccgcucauguuaguguccagcaccaucuugguggugaagauacggaagaacacgugggccucccauucuucgaagcuguacauugucaucauggucaccauuaucauauuccucaucuuugccaugcccaugcggguccucuacuugcuguacuacgaguacuggucagccuuugggaaccugcauaacaucuccuugcuuuucuccaccaucaacagcagcgccaacccuuucaucuacuuuuuugugggcagcaguaagaagaagcgcuucagggaguccuuaaaagucguccugaccagggcuuucaaagaugaaaugcaacccaggcgccaggagggcaacggcaacacuguauccauugagacuguggucugaggacagcaggggaaauuguggacagaaacaguggaaugcuggaggcuuuuagcuugugcuuggaaugcaauuuaagcacauuuaaaucuccuaacuaugauacagagggaagcauucuacaugcaugggggucaugcacugaugacuuuguauuguuaccuauauaugugauaugaugggcucugucuuuucuaucguuaucaaagacucauucuucucguagcugucugguagugaucaacagugaacuauaaagacugcucuagcaggaaguaucccaaaugugaccuggagaaccuggggagacuguguaaugacugcugugugcuccuaugugacaucaggcaaguggcuuuggggagccugguuuccuccacucaguggaaguagugacaaccuguagcucagguuauugucuagucugaugagguaggcaaagcacccagcucauugucaaaguucaauaaauauccaucucuccu

SEQ ID NO: 12233 - RNA, 36694 nt, Mus musculus
guacggguugcgcuuccggcagcugcccugggccgggggugugcgcccuucccugggugcaggaggaccugcgcgcgaaaggcgcgcgcggggugaguagcccuggaggcucugacugcuggggcggguugcgaugguuuguguggucgcgucgcgauggggugaggggaauuggucguucugauuccaauccuccgccgcucccaccgcugacaaguccuagcgcuucaagcccuccauugcgaaugugagcgggccucugcaucuauucacgcgacagcuccuccuuaaccuagggagaacuaauggcaaucaacaggcgggucgcuagaguaagccuauaccuccggaguugauuuguggcugaguuccuccugcauggaguugaguugccccagaggcuguaggaaggacagguuauugccuacccuugaccuaggauucuggagguucgccucgagggcagaagggagaaccuuuccugggguguaucaaauaauauguuuauuucuacacagagcaguucucuaguacugcccugcccaccauggccaaaccaacaagcaaagauuccggcuugaaggagaaguucaagauacuguugggauugggaacaucgaggccaaaucccaggugugcagaaggcaaacagacugaguuuaucaucacaucggaaaucuugagagugagugaguggccaaugucuuggcuagcccagcacaaaggcuaggaaggcuggguuugucugucauuggguucugugggagauggguugcugguaaccaucugcauagggcugcuguccccaguacuguggagacagauauaugccuguccucaggaucuugguguccugcuuuagcacacuugccuuagaaguuagguguuguaugaaaacuuauuuuguuuaguguuaugguagauagaugcccuguacucucucagcacgugagaggcagaggagauaggauuaugaaguuggaggcaacauaauuguaacccaccugagcuacaguagugagacuggguccuccucuccucaaagauguucguuuccuuuuuuaaauuggagauccacccuuucuuuuuaggaacuuuuaaaaaaagauuuauuuauuuaacauacacacacacacacacacacacacacacacacacacacacacacacacacacuguagaugacacaccagaagagggcaucagaucccaucacagaugguugugagccaccaugugguuacugggaauugaacucaggaccucuggaagagcagucagugcucuuaaccacugagcuaucucaccagccucgagauccagccuuaaaaaaccaaaccaaacacaacaaaacaaaaugcugggugaugguggugguugguguaugcugcuaauccugcccagcacuggggaaguucaguacagccagagauacacagagaaacgcuggagagacagaggaagggauggagcgagggagggagagagagagagaaaaaaaaacagagagaggaaagaaaccccauugguuuacaggggaaaugcagaacaacguuaggugguuuauggccaguggguaagaagaccucuuuuuaaaagcucagcccuuuuccucuuuucucuucucuaggaacugaguggugaaugcggccucaacaaucgcauccgaaugauagggcagaucugugauguggcaaaaacuaagaagcuugaggagguggguuugccucagcugcacugcuggaguagugcaugcccacugcaggcuguagagagucaugcccacugcaggcucuagagaaucuccagucugcggcugcugccuugagcugucuuuucuuguuuuugagaugugcuguguagcccugacuggccugguauugacugugugguucaggcugauacgcugugaacuugauguggucuuccuuccucagccucuucaguguagaucaggacuauaggcauagcccagaaagcuagcuuugugaugaggcaguuuuuaccauuuuagagaaauuuagcuuucaucuuaaugauguggaagcuucuagaaaugcccuaagugcaaccugagagacuuaccuuggugguagcaaaagaaaugagcuuucccugaauuccuggaaaagcuuauggcuauguacgucugcuuauccucuuugucgugguggugguugagacagggacuuaccauguagaccaggcuggccuuagauucagaaucccgugccuguguuuccagugcugggauuagaggcgugcgcugucgcugccaccuggcuuccgagcgagcagaucuggaacauuuagucggggcucacucacacaggaacaccuuggagugggugucuggggcagaugccuguuuaggguuccaucugugcugcuuguucuaagcaccauggugccucugagugcagcgagagcuaccagggacucccuggcaggcggcuucccuguccucccuggucuuuuccacgccgagauccagggcccauuaaacagacuuggcugggugucagauguggcggcaaaaaugucacgguuuuaagucagaaggcccuauuccgugcucuguguuguccuuugcggggcuaaggucccuggaggcuacacccuucucacuguccccuuuuugucauggcagcaugcaguggaggcacuuuggaaggcugucucagacuugcuacagccagagcggccaccagaggcccggcaugcaguucucaccuuauugaaggccauuguacagggacagguaagggguggagcugugugagccugugggaugaaggcagaccgucaccguuugagcuccugccuuugcuggugugccagggcaggguccagcgauuaacaggccugacugagugugagaacauucuggugucacgugucuggugaucgaccgugcccagucacuguagcuccugagccuccgucuuaugugggaguagagaaugacagcuauagcuacugggggugguacaaguaguuugugcaggauauuagguuauggugguuguuaguucgcuguuacugaccaguuguggccacucccugcccuucucuagccauuuaggucucaacuggcccuuuaacccucaugguccucugugcauucccggaagggucuuccucuaggccauucucuuccuugauagucuagccucuccaagagcugugguaucucuccuaagggcuguggcaccucuucuggggcuagaucuuuguccucccaauaugugggcacacuagucuagccugacucuugaguugggccagagcaagagcuuuacugucacacugugugccugucccuaaccauguccaagcuuaaugcauuaggugguauauacaugacauucagcuauuggcuggugccucuggccacugucugaaccugugauauugcuaaccugccuuccauaagguacuucuagaacaggcaugucuggagucuuggguccuuauguacuucuuggcuuuucgaaagcugcaugggaaaugcuggaaaggcucuauuguuuuugucuuuagggugaucguuugggaguucucagagcccucuucuucaaagugaucaaggacuaccccuccaaugaagaccuccaugaaaggcuagaaguuuuuaaggcccucacagacaaugggaggcacauuaccuauuuggaagaagaacuggguaggugucacacagagagaggaugagagaugccugagaugagaaaaggugcugcaguucacgggguggccugcagggggcacagggccauuuaccauuugccuugggagcuuaucagugcccuucugggauucacugcagaccugcugcuugaagucuuuggcuggcagggcccagaaggugccuuugaaaugaguggugcguuuaucuuuggagagggugccgaaucugcgugccuggguccgucuucuucccugucaccaguggaccuguguuguuacucuuugucaguguggcuugacaucccagccugguuucugcuugccuccugucaugugacaguaagagguuuuaguacguuuaagacuuccuuucccuuuggugagaaaaaaagaaagacuggggaguaagucagcuuggggcucugcuauucugaugcccagcaaugguccucgacugcugaucugccucugggacaggugcuguuacaguuugccaucagauucucugaggcuguauggccugcagccuugccuguaucuauguauucuuuauaucuucuagagauuuuuuaugggguuggggaucuccuaagaaccugcuuccugagcaagaauuuuaauguuugugugcccuguaauggagccaguccuugaauggaacguaugccucuuuuaucugcucaguuccaacacccaggcagagcaagugucugugcagggcuugcucagauuccugcugagccuccuuggguccaguauguugcagugauaggaugcagaccgaucuuccuggaggaggaggaggauauagccucaucuuuucuccuacagcagaguuuguccugcaguggauggauguuggcuuguccucagaauuccuucugguacuugucaaccuggucaaguucaacagcuguuaccuugacgaauacauugcaucaaugguucaguaaguaacaauguaacuaagggcugaagugaggcugagcaguagaguugcugcuagcauguaagagacccuggguuccacucccugccccagaagaaagaaagaacuuuaguggcucuuugauaucaguuccacggucuugggucucaagcuuagcucuuuaggauuaauaacguuagugaagcuaccagauaaaugagauugccaguggacaagugcacuuuauuuauauauuuauuuauuuauuuauuuggagacaggguuuuucuuuguaucuguggcuauccuggaacucagucuauagaccaggcuggcccugaacucacagagaucugccugccuuuaccuccugaaugcugggauuaaggugugugccaccaccaaccaccauaagcacauauuuuuauuuuuacacuuuacuuuguuauuguuuuuuuuuuccacgugcaccauggcauguguguggaggucaggggacggcuuuguggagucuguuuucuccuucccaccuuuacaugugaucugaggacaacacucacguuuuagauuuaugcagcaagcacuucaguugcaagugucucgccagcucccuuuuccuuauguuuuuccuuugugguuucuaggcagggucucacuauauagcucugacuggccuggaacucacucuguagaccaggcuggccuccaacuuaaagagaucccccugucucugcccccugaggacugggacuaaagguguguucuaccaugcccagccccuuuuugucaucauuuuuuauuguauuuuaauaauuuauucauguaccugaguauuuuucuugcauauaugucuguguaccauuauaugcccugccugcggaggccagaagguaucagauacccugguuaaagaugguugagagccacucuuuggguagugggaauugaaccugagucuccuagaagagcagauggugcucuuaaccacugagccguuucuccagcccuguguguguguguguuuuguguguguguguguguguguguguguguguguuuaaagccaucuugagaucucaguggaagcagagacuuuguuugcuuuacaccaugcacucagcgcugggcaugugguuggcacagaacaggcacacuguggacaagcacacuaugauaacugauaccauacaguggagaagcaauaaacuguagucacagagucuucuugagacgcuguuuaccugacuucaauguucuucuuccugcagcaugauuugucugcuaugcauccggacaguguccucuguggacauugaggucaguuacuccuggcuuuauuuguggaaggcugggguuugaggucaagcccugcugccauucucuggcuauguggguucuggagcugcucagcuucucugagcuguaggcauguacugucaggacaguugggugcucugcauaguguuguaauagccuaagaugggaagucgugcuuacgauggcugauggcagcuaacagccccucccagugcacgcuuacucucgcuuaccugcacugugguuccuacagguuccuaugcucaggcauagguaggaggauaagaauugggcaccagcaugaugcucuaccucucaugcagguguccuugcaagugcuggaugcuguggucugcuacaacugcuuaccagccgagagccugccucuguucauuaucacccugugccgcaccaucaaugucaaggagcugugugagccuugcuggaagguaggcuucccccaggcuguuucugcgaacuccuuccccagggcaagcucugcugccagcaccugacaggacagggcuguguuauagucagugaacgcugcuagacuuuugggaucaccagacagugaaacguugaggaaacacauccugguggccauuucccagguguuugaguugaggcccagguuugggagauguuuugagcguuugucuuaggguuuccauugcugagaagagacaccauaaccaaggcaacucuuuuuuuuuuuuuuuuuuuggcuuuuugagacaggguuucucuguguagcccugacuguccuggaacucacuuuguagaccaggcugccuuugaacuaagaaauucgccugccucugccuucaaaguacugggaucaaaggcgugcgcaaccaccacccggcuccaaggcaacucuuauaagggacaacauuuaauuggggcuggcuuauagguucagcaauucaacccguuaucauagugacaggaaguuuggcagugucuagguagauacagugcuggagaagaagccaagaauuuauaucuugaucuggcugcagucaggagaaacugccacauuggcagcuaggaguggggucucaaagcccacuccgcggugacacacuuccuuuaacaaggcuacaccuccuccaauaaggccacaccccuuaauagugccacuucccaugggcuaagcauauuacaacugccacagggcucugucgucuucuguguuuguaaggaggacgcagugaacuugggaucaagugggauugcagaacaguguccaugcaaggcaggcugaggcuagggcuccgcccuccuagagccuggggcuuauaucaccuaacccuaauggggucuguguguguguguucuguuuuccaguugaugcguaaccuucugggcacccaccugggccacagcgccaucuacaacaugugccgcaucauggaggacaggugagugcaugugugugugcaggaagacaggugagugcaugugugccaggggacaggugaguguguuaugugccaggaggacaggugaguguaugugugugugccaggaggacaggugagugcaugugugccaggggacaggugaguguguuaugugccaggaggauaggugacugcaugugugccaggggacaggugagugcaugugugccaggaggacaggugagugcaugugugugugccaggaggacaggugagugcaugugugccaggggacaggugagugcaugugugugcaggaggacaggugagugcaugugugugcaggaggacaggugagugcaugugugugcaggaggacaggugagugcaugugugugcaggaggacaggugagugcauaugugugugcaggaggacaggugaguguguguaugccaggaggauaggugaguguguaugugccaggacaggugagugcgugggugccaggugacaguggguggcuagggucaggaggagggcuuuagauacuuggcugguguugaugagauugagguuuucuugguaguuguucuccauucggauaugaccuuccaucuucugcuucuccuaguccagucaugguguucacauuuagacuuaccuucuguccuaagccucauggccauugugugggccuuucuagucugcuacagucuagacuuacggccugauguuguccguacuucacccuguagccaagccauuacaaguacugaugcuuuugucuccagagguggcucagguuugcccacugucuaguagacacccacaucagcgcuccccauuuugcgucucucugacguccaucauugccuccugagguauacuguuguagagcaaccuagugagauuucucuuucacagaccauguuagccuuuguuugagaucauaguggucuuaguccaaacagacccaguggaagucuuaggccuuagucccauaaaccucuuuugccuugucuuucuuggcauccucccuccugccaagggucuucacauauaccugucacuccugguaagauggucucacuuuuguugcauccugaguguucugugaggucccuacacgugcuuagcuaccuggcuuccuagguaguucucacuguguccauggcuucucagcugggguuucaggugcagccuuugcacuugugagauucuuuuuuuguuuguuuguuuuuucuugguuuuucgagacagguuuucucuguauagcccuggcuguccuggaacucacuuuguagaccaggcuggccuugaacucagaaaucugccugccucugccucccaagugcugcgccacuacgcccggcucaccugugagauucuuaagucugucuuccaccaggcuguuaguaccgugcugcccauggucuuguuacaugaguucugugucugaugacagccauaacccaugugaccaguagugacuggcugagcaaguugugaaggaaucacaguugcugcuggccucuuuguuccccgcccauuucaccaaccacacuucugcaccauaagugcaaggugucuccuggggacacugccagagcccagcucugccuuggguccaacucugagcgaggacucugcucacaucugucuuucuggggaacauuuucagauccuacauggaagaugccccacugcugagaggagcuguguucuuuguagggauggcacucuggggagcucaccggcucuacucucucaagaacucccccacaucugugcugccgucuuuuuaugagguaaggugcuuuguauaccacagcggauuggagaaagugggagagcuugcaucagguuugcccaccugucuggcuggggcugaugaggcugggucugagcagcuauuuccagucacuugcuuuuuaacuguggaugagagggcuuuaaagaggauuuauucucaagaaaauguuuuaucguaaaaauugcaucuccugcccaccagugcugagguacccaguguugccccuaggauagcauuccuucucucagugcuggcucccuucugucaaauagugaucguuccagcucucuggaugauguucacagcauagcuuuuguucugugguacccugugguguccagagaacuucccugugugcuuguauuuaguucucacggcucccugguaagcugaggucuucauuuuauagcagaguugcucagacaaagugccuuucaucugguuguacagucucccaaucuguagggguccugcaguucugugcaagcugugaucuuuauacauugcauugcuuacaccacaacuuagcacccaucaguuuggucugagacaguacuguacuuuuguucuggaauuuggaguuccugucuccuccuagucaggccuuuuggagguggggcccuugagccuuacauaacagauaccuuucugaguuccacacaugcuuugugggccugugugugaaaugcuacccauccaugcauuuacgcccaccucggagacaggacaggagacaggacaggagacaggaugcucucauccucuaugaggcauaacacugccccaugguacuguguuucaggcuaugaccugucccaaugagguggugucauaugagauuguucuguccauaacaagacucaucaagaaguauaggaaggagcuccaggcugugacaugggauauucugcuggacaucauugaacgacuacuucagcaacuccagguaagucaggaaugccagaaaggacuaagaucccagagaggcgggcuugucccugcugggagguguacaugcguucugugcgucugggcccuuucuuggggucugaagacuugauguggauguuuucuggugacucuuggugccaguuugucuuccacugaaggacagaauuuguuuuuccuggugugcuccauucuuuuggcucuagggauauucaguaggugagcaaggccugagcuaguuguccaaggcagaccaagugacaggacaggucaccuuccuggcuugaguaggccccagaggcaguuuacagagcaucuacacugccaucugugacuuuggaggacaguguaaguggcacagugcuagagaaaacaccagggccacaggcucucaggaaugcagggcucugugaggugaggccaguaucuggcuuagugcagccuggggcuguagaugaaaaggggacaggccaguggaaggaagacugugacugggagaagcaugcaaggguuugaagcugcaagauuuuaccuccuguuuguucaaccucuguuccuguaggaggaaaugggucauagcagugauuuccaccucucucucagauggccuagucagagaauaugagagagagagugcgcgcguauguguaugggauggugugggugucugguaggugguauguuuguaaguagcuccucucaagcuguguugaaaggguaaaggaaauuagguuauaugauguaucuugguacuguagaaccuggacagcccggaacucaagaccaucguccaugaccugcugaccacuguggaggagcuaugugaccagaacgaguuccauggcucgcaggaaagauacuaugaacugguggagagcuaugcagaccagagaccuguaaggacccuauccugguggagcuguggggaaugguucccacggagcugugguuucugauuuucaaguaaaagauggacaggcuccuguguuccuagcuuugugcuccagcaggaaagcuggcgggcaucagcucgcaggcuuguguggguuuguuaaagagcuuuguguuagccuaacagucagucucuucccaccugggugggggaauguucugggcuggcuccacagagcccagcuaucccagggggcggcagucauuuugccaggguuacucuguccacugccagacuaucacauagccuugacaggagucucucacuucuaggagacaguuguucuugcuaauuccgcacggggcugugagguagcuaaucucggagaaaacugccuuguagcagguuagcagcacuugccgaagggcaaagagcucucugaccuuagaacuguuuuccuuccacaggaauccucucucuuaaacuugauauccuacagagcccaguccauccacccugccaaggauggcuggauccagaacuugcaguuguugauggagagguucuucagguagcggagccucuauuauccccuugucuccagggcacuguuuauaguaagaucaggcuuuccuuucugagccuccaaaaucacggagugagggggaagguuggccuuuccgugggucauggccucuggcccacauggcgguggauuccaugagggugguccccgccagcuguguugggcccacagcagugugcugagggcgcugcagcgggccugcucuucccccaggaaugagugccgcagcgccgugcgcaucaagguguuggauguucuguccuucgugcugcugaucaacaggcaguucuaugaggugugcacucaggucuaaagcccaggcggggugugcucggguggggcuggcucuggguucugccugcucugggccuuguaccugcuccagccgagccaaggucugccuggggucuuaccggcuccccuuuaugcaugcuuucagcuggcuuucuuccucccuguacauuccauaguuuguuuauuuugucauguccugguggggcccuggguugggccuggaggcugaagaagcaagguagguacuuacuacacgcuccugaagcucuggccggagucccacuuggaacccaggaguuucugaacaaucuggaucaacuucagaaguccuccucucuguguuguucuggggaaggacucagguugcaugccuguugggcaggugcucugucacccuucggcacagucugguggguggugucugucucuguagucauuucuacuguccagcaucccuuaguccgauuaccagcugcagacugcccuaggccccaccagguggccuuguggugucgucucugccucugugcuuccucaagucugugguauucugguuuuggggagcacuauuagugcuugacauucuguguggccuuuuuugcaccucagacagcucuuucuccuucugcaugacuguugggccugacuucccagcuucuuuggcgccuccuucuuccccuuccagccuuucuguacugcacacugcacucugcucaucuccacuaugaucuggccccuccuccaucagggaagagcacaucuuuucaggaugguccucuggaugcucuacccucccuuaccaauugguguuuaaaugcucucuucccguuaucuucugccaguucugugaaagcgcuccuugcaauguuauaguaauuucuuugauaucagaguuuccauuugcccaacacgcacacgcacgcacacacacacgcucacguugauacauggcccuccacuuaggaggguucuuuguauauguguguguuagacauggaacccagggucucacacagacuacaggaaguauccuucacugucuagcuuuucugcaguuuuuuuuugggacaccuuaccugccucgggucugugucuugagggagucacagagucagugaaguguguccccugcccacugugggacugaauggagaccuucuccaccuuguguucgaugcaggaggagcugauuaacucgguggucaucucgcagcucucccacauucccgaggauaaggaccaucagguccgaaagcuggcuacucagcugcugguggaccuggcagaggggugccacacccaccacuucaacagucugcuggacaucauugaaaaggugagagccauuuagaggucugggcuggcauggacaaagcccuguggcuagaccucuuugucccguuuuuaucacugugacugauggcugucugcacgggcagcagaaguguguggugucagcaggccguguugagccaccuugcuuggcugguguacugccucagcaccuugcaaaugaguguccugucacucucaggggucugcgccaggcaucuggagaauagcacagagcagggauccagggcugcggcccacauccccccagggaggcugcuuuguccuuucaguuuugaacuguuugugagcagucacuugugagaaggcauaucuucccucccgagaaggacaggagggguaguccugguagucaggucuguggcgaacugccugugagccgugacuuggaccuuacaugcuggccucuuggaaggugauggcgcgcucacucucuccacccccggagcuggaagaaagggaccuggccaugcacucggccucccuggaggacgugaagaccgcgguccuggggcuccuggucauccuucaggugggugcucugcaaggguagaaggcuuguuggaagcuucucuaaagagauguguguccuggaaaccccagcucugacuggguuacagggauugggugguaccgcugaguggcaguaugaagaugugaccaagccgugagaggccugcggccugcagcaggugagccuucucugcucuaaaguuacucugcaguuacuccauccuugcugcucagagcucccucuguugccgccaguacuguuccuuagcugcugaguggagaagcugcucuugcccugcggcugcuugcuucugggagagcuuuauuaagauacuguggcacauaucauauggugcccuccauuauugucaauagccuauugacuaucaauauguccacaaggcugugcagcuguccccacaaccaauuuacuagauugguuuuucuguuuguuuguuuuacuuuuuuggggagagggccucacuauguagccuagucuggccuuugagagcuaggacuauaggaccgaaugaccauaugacacuguccaguuccagucagucagccuauaccugcugaccgcuguuccccacuuccuccaaggucccggggcugcugcucugucuguucccauggagacauugucuuguccuagcuguuucacauacauggccucgcaugugggccucugugguuggcuuucaccaagcauccacgcuauggcguguaucagagcuucguugcuuuucagaauguuccauugugugcauggcccacuugcugugguccguggcuccucccuguggcugccuuugcugggcuggauagcguugggcagaccuaggaggaauugcugagucacacuaagucuguaacaucugaggcaugucacaguuugugagcuuuucuuguaguguguucauguguguguccauacauuaguuugugugugugaggauagacacacucuugccacacugugcacuuggcaguuagggaacaaccucaggugcccguccucacugguuaccuauuugucagagacucuuguuuaccgcugacuacuauaggccaguaggccuaggagcugauagggauccuccugucucugccgccaaccuccccaugggagcacuggaguauagauaggugcuaccauguccugcuguggguggguucugcggauccaaaugcuguccuuacacuuguguaaaaaguccuuugccaccucaugcccagcccccuucuuaaagguaggacccgcccaggcuggacuggcucugaacucguggggcuccugcuuccguuuccgcgugcugcuguuagaggucugcagugcuguggucagcuugcuaggcugcugugcacucagacugcacccuuuuccacacuagccucguaugcguucuggcuuccccaucggaguauguaguuuuccauauccagaucacgucugggcuuugccauguuguuguuguuguuguuguugaaagaagcucucauuaucuuguuaaggcuauuuuaaauucacgaucuuccuccuccauuugauacacacuaugaugccuaccuccuagcauguagauuuguuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuucuuuccuuuuguauguaucgauacaggucucacuagguaguccagguuggccuggaacuuucuuuguagucaaaacugucugucuuuaggguucuaggauuacuagugugggccacuaucuuggcacaguguuuggcuuuuaguuuuaaaaaaauuguauuuauuuuaugugugugcucacgcaugcacuuaagugccguuuaggugggugucaggggacagacaacuugugggaguugguuuucuccuuucguuuuguauaucccaggaacuaaacugaggucaucgggcuugguggcacaccuuuagcuaugacgcccacucgccagcuuuguuuuugagugacagggucucuaugcuucucugggccuagaacucacucuguagaccaagcugaccucaaacucacagaaaucugccugccucugccucugccucugcaguguugggauuaagguccuguugcaguucaggcuggccuacgucuggagguccuauagcuucuaucuuacgagguuaugucaucggccaucacacccagcuggcauccaaauugucacuggcauaagcacagcgccacaguuccuggggucuuuuugggcuuucauccaaaagaguucagugcccuuucccucccugcucuguugaaaggagcacuuacucugugccacauuuucuggguagcgcaagagaaggauuucuuguccuaccuuagaagucuaguugugagaccaaguuccuggcuauaggcugaacuaugcuauauuggaggcaaagucuuggccuggucauucccugacaauagaaauggcaugguucucccugguucaaccccguggaaggguuagauucucugccaacaguagccgucugcccaucaugggugugguuuguguuagauuuggcgccucccauggucugcggcaggacuuugguggugugcuaugagacugggaaauagagucagugguacucaccuuucaccccagcgcuccggaggaaggccagagaacacagagagcgucaggccagacaggaaaacaaacaaacaaaacucacagaggugacuuuaucaguucccgcugcucacuuccaaggcucagggaccaugacagccccuguggcagcauggguccuuucuccugggucugccaggagagggcuagagcuguguugggaugguguggggcugggaggaagggugcucccaauucgcccuacccagccucucuuuguugaccuccuuagucuuggaggacugaaaucccaugcuagcacauguauguauuguggucacccuuucuggcacauggagagugggucacuacugugcagugcuagguguuucccugauuugcuaccugcuguccugcugguaagauggccacauagugagauggcuccuugacugaaagguguagagggaaauggcggcugcugcuggauagucuuuggagaacugaugcuguuuccucuggccugggccaggugccgucucucuggcugcugucauaggauugaugcacucuuucucggcagaccaagcucuacaccuugccugccagccacgccacucgaguguaugagagccucauuagucacauccagcuccauuacaagcacggcuacucccugcccauugcuagcagcauccgacuacagguaagacugccaggcgggugaccacuugggggccagcaugcugcccuaggcuugauggauguacaacggucuagagaggcaguuggcggucugggaaggguccugugcaaggcacauggcuccuucccaucugcugugucugcccugccaaggaccucugccuuuccuuggcuuacacuccuuguaccuguguggcguguuacucugaagucacacagucguccaaggucggggcaccuuggccuccaggcuuggcaacggucccagugcuucuggugcugaagagacccccaagaaccugaaagaggggcuccuuuggauguagcuaguggggagaggggaggacagggauggacagcugcugacagcuggucacccugauaccucugcugaguagaagucacuaagaaggaagcccugaggucuccaggcucaguggauaaccuguucuuuaaggaucccagccuagucagucacuguggggaagccguggggcugugagaauauuuugcuguuagaugucagcgacugucuauagcuccuggggagaaguuuccuucugugcaggacaccagcucagaggcucaggccuuguuguauauaaagugcuaagugacuaggaucuccccuccugcccuggagucaggcucguggccugacugaauggccacuguucucccugcuaggccuuugacuuccugcugcuacugcgggcugacucgcugcaucgacugggccugcccaacaaggauggggucgugagauucagcccuuacugccucugugacugcauguauguguggcaggcccucccucgggcuccagggugggcuggucacgagaugaagcuggguguugucugccuacucaggguuauuucauaggagggacuguacagaagggaugucagcggaagcuggggccaggaggggccgugucaguuuaacuuguccaguguccaucugccuccacagggaacuggauagagccucagagaagaaagccagugggccccuuucaccuccaacugggcccccuagcccugugccuaugggcccugcugugcggcucggcuaccuacccuacucccugcucuuccguguccuguugcaguguuugaagcaggugagaaguauaucagauucuugaagcaaacccaguuucucacccuuguaugagugaaguuuuacaacaggacuuaaauauguauccagauaacaguagcccuagaccagcaugcaccucauagggagggcacagguggacggacacuccugucuuaggagcaucuaccaggugagucugaagucaggccugagcaauagggaagguccagaaacaggagucagcaaagccuagaagugggugguaugguuuugugcagugagagguguuaaagaugccaggcaaaagaccagggcagugaaacugugggggcacuggagggaguagaaggcccagaguccuuggagaugcuggagcuggcagguugucuccugggaguaucuaggccuucugucacaagaguguugaugguuuucaggacugauuaagguuuggcugugggagugggcuaucucuaauggagauaugaccaggcagaagccaagagccauguccucucuguggcuguggccuuaggcugacacuggcucucugucagagaucuuggcugauggauuguugugugcucucuugcacccacagcuauggcuuagcuuucugccacagugucauuguuggagacgcuuagcugggauagaaguuguguguguguggggggcugcggggaguguuggcaggcagucacugggcccucacugggcaggugagggaugacagagcuagucugaggaagauguaaguuguacugagaagauggaggaggcacuggcucucugcugggucuccaugcagacuggccucuggaccacagccucuguuggcugucgaaggugcugcccauguccaaggcugucucugagcaguggcugcucgugcauuugagggacagaggucaaggcuccauacauaccuuguggcaaaguagcagcaauccaagccucguagcugugcagcagcacgcagcuucaaguauggauggacccuuguguuaccaaggucuagagagccccgccuccagcacgaaacccuucccuguaggagagcgacuggaaggugcugaagcuggugcucagcaggcugccggagucacugcgcuacaaaguccucaucuucaccucccccugcagugucgaccagcugucuucugcccucugcuccaugguaacgaacgcccucuguauuagucagggucucuauuccugcacaaacaucacgaccgagaagcaaguuggggaggaaaggguuuauucggcuuacacuuccauacugcuguucaucaccaaggaagucaggacuggaacucaagcaggucagaaagcaggagcugaugcagaggccauggaggaauguucuuuacuggcuugccuccccuggcuugcucagccugcucucuuauagaacccaagacuaccagcccagcgauggucccacccacaaggggccuuucccccuugaucacuaauugagaaaaugccuuagaguuggaacucauggaggcauuuccucaacugaagcuccuuucucugugauaaccccagcugugucaaguugacacaaaacuagccaguacaauugaccccuugucaacuugacacacaaacacaucacuaguaagccucaacccuuacauucuuauucauccccaagaucuaaauaacuuuaaaagucccacagucuuuccaaagucuuuuuacaauuaaaagucucuuaacugugggcuccacuaaaacaguuucuuccuucaagagggaaaauaucagggcacagucacaauccaaagcaaaagucaaucuccaaccguccagugucugggauccaacuuacgaucuucugggcuccuccaagggcuugggucacuucuccagccaugcccuuuguagcacacgcgucauccucuaggcuccagaugccuguacuccacugcugcugcugcucuugguggucaucucaugguacuggcaucuccaaaacacugcaugaccccuucaguccugggccaucaauugcaacugaggcugcacuaucaccaauggccuuccauggccucucacagugccaagccucagcugcucugcucaacuccuucaugccuucaaaaccaguaccaccugggugacccuuacacauuaccaagucuagccacagcacaagguacaacuuuggcuauaucuggaacacagccacugugcucucagaaaacacuucccagaagaugucaccucaaugaugcuggucucuucuuaaucaccgcuaauuucuuagcuccagcuaaccagcaucaauagucccaguaauguaaaguuuuugcuuuaguaguucugguaucuuguuaaucacagcugauucuucagccccagcuaaccagaacuacagaaucuucacaaucaaaauagcaauggcccugaaaagagacuuuaauuuucccucugaaauuucacaagccaggccuccaucuucugcacuguucucaacauuaucuuccaagcuccuacaaaacaucugacagagcucuuaacaacgaauggaucuucaagcccaaaguuccaaaguccuuccacagaccucuccaaaacauggucagguugucgcaggaauacccccacucugcugguaccaauuucuguauuagucagggucucuauuccugcacaaacaucacgaccgagaagcaaguuggggaggaaaggguuuauucggcuuacacuuccauacugcuguucaucaccaaggaagucaggacuggaacucaagcaggucagaaagcaggagcugaugcagaggccauggaggaauguucuuuacuggcuugccuccccuggcuugcucagccugcucucuuauagaacccaagacuaccagcccagcgauggucccacccacaaggggccuuucccccuugaucacuaauugagaaaaugccuuagaguuggaacucauggaggcauuuccucaacugaagcuccuuucucugugauaaccccagcugugucaaguugacacaaaacuagccaguacacccuccacccgcgccagcuccagugugcuacaauggcuuucuccuccauauaggcuguuccucacagauacuuauacuguuuaucugggguccuguguccuucagaauaagccuugacaccaggccaugcuccuggggcuauacugcccaaaaugcccuagggaucccacccaucccaucccagauaugagcauugguggucccuagucaaggauauugucuuaggguuccauugccaugaagagacacaguagccacagcagcucucauaaaggacaacauuucaaucggggcugccuuacaguucagagguuuaguccacuauuguggugggaagcaugcaggcagaugugaugcuggaaagcuagcuagagugccacaucuggaucugcaggccgcaggaagagauaagugagccacuaaacucaccccccaaugacucacuuccuccaguaaggccccacuuacuccaacaaggccacaccuccaguugugccauucucugucuaugggggccacuuugauucaaaccaccacagauaguuacugcuccugcauucccuagacuagagcacugugugugugugugugugugugugugugugugugugugugugugauauuguacuugggcuacauuguuacgaguugaggguuuucucacaaagaccucugccuggaaggggcuucccuagccaggacuccuggccuccuaagaguccugcgguggagcagagguuuuagggcugugucuuguauguuagcuuucagcuccaaagacccuugagcggcuccgagguaccccagaaggcuucucgagaacugaccugcacuuggcugugguucccgugcuaacagcauuaauaucuuaucacaacuauuuggacaagaccagacaggugagagaugggaagaggggcaaugggacaaaggggcucucagugagcuggcugcugggccagagugaagucaguuggcuuuguuccaugcugugggccacuaccugucagccagccagggagugugggcaucugaaacccaggcucuacagaaguugucgguucucugcaggcuccaggcuuugauaaugacccuuggcugugccuguuguccucuccucagcaggaccuccccauugagaagcaccccuugaacucuuucuguuagguuuggggaccugugaccagaccagcuuuaagaaguguggugguuggucaggaccccuggcuguuacuuccuuuaucagagccacauagugcccacuucuuguccugugcuguucucugccauccucccuguguccccuagauucugcuaugucuccaugacaaacuggugcuauugcugaggucaggagccuucucacagugcuggcagccaggagggggcugggcucaggccugucuucccugacugcggcacuacugggaacugaggcuccgugcgcaggcccagcuuaaagggaacgcccugcacauugggcugugcuccgcaguccucgcugccauuaugacuucucagcuagcucagaaggcucucugacucuacaauguuucugaggguuggcuccaggaaaguagaaauauucuaggacaauaagccccggucuguagccugaaaugccauuuuacuguugucuucauagaggauacuacccaggaggggcuugcuacaucaguuggugccugcccugaaggccaguucuuuagaaggcccagagugaugggguugugaguccaggacaucuaguuucaucauacgggcuauaggcugagguaccaucugugaagcugggcccacuuagacauugaggggcguuccacaugcucugauucuccucaagagucaucucaaagcaggcgaaaggaagggaaggaaggaaggaaggaaggaaggaaggaaggaaggaaggaaggaaggaagaaaggaaggaggggagggaagggaagggaagggaaggaaggaaggaaggaaggaaggaaggaaggaaggaaggaaggaaggagagagagagagagagagagagagagagagagagagagagagagagagagagagaaagaaagaaaagcaagcaggcaggcaggccuggggcagaacaugguauaacagagcagcuuggcccucuugggcaagggggcaggggaccuugccagcugauggcaggcagacccaguguaucuuguaucuugcuuuccucagcgugagaugguguacugccuggaacaaggccuuaucuaccgcugcgccagccagugcgugguagccuuggccaucugcaguguggagaugcccgacaucaucaucaaggcgcuuccuguccugguggugaagcucacacacauuucugccacagccagcauggccaucccgcuccuggaguuccugucuagugagugugugguucuguuacagagccugugcaugugugucugugaggcggacccuugaguauaagccuguacuggugagcacauccagugaugucuccagcccuccugacuguguacaguuuggccucccuggagaacaugggucuuaacacuucugaugccugcuuagugcuuugcuaucugcucuaggauaguccguccauuccuuuucuuucugcucauaagccugccugccauccccagccucugccccaugccuagacuggcucuuuuuuagccuucucucuccucuuagaacacauggauuuugccaauuuaaccugcuuugucccucccuuaucagaacucgcagaaguucggggcauuguacugguccccuuuccuaccucccuguguaucuggggcacacagggauguugagauacuagacagcugggucagcacuuggugggcauggccaggguggaaaggcaaugcugugagggccacaggaacuugguuuugcuuacuacccuguaaagauucuuagcauguuugcagcucaugacucacacggcugcaggucauaggcuagguuuggucugggaaccauaggucucgugucccugagauggggagcugagacccugauuucaaaggugauguuuagcuggcuguggauagccgcccugacuuuugggacuggagcacagugugcugaugucagucuguagcuguggccugggcuccccugauggcuguccuugugucacagcuuuggccaggcugccccaccucuacaggaacuuugcugcagagcaguaugccagcguguuugccaucuccuugccauacaccaaccccuccaaguaagucugcuugccugggccccccaaagccauggcccggucccagccucuugaaguauagucggcuccaagcuuaagagucucuugagaagcugggcggugucgggaggcagaggcaggcggauaucugaguucaaggccagccuggucuacagagugaguuccaggacagccagggcuacacugagaaauccugucucaaaaaacaacaacaacaaaaagucucuugagccucaugaugguuccccugaagccaagaggaagaccagaguaucugucucuccuuccaccagguucaaccaguacauugugugucuggcucaccacgucauagccaugugguucaucaggugccgacugcccuuucggaaggauuucgucccuuauaucacuaagguuaguccaagggacaugggggagugggaaacggcuggagcucugaccuaggagcuggcuauacugaacuggcuacugggcucaaccugaggugggcaugggaaaagaacugcagauuuggucucgcauggucccccucauggcuugugucucuaccccuacuccaggguuugcguuccaauguccuccugucuuuugaugauaccccugagaaggacaguuucagagcacggagcaccagucuuaaugagagacccaaaagguucgggggcugcuggggauauaccugaugucaagugggguggaacccugggcugugacaugugauuagugaccuaggccagugaacaugggacuaggaaugaaggggugucaucguacauagugacccgaggcucagaugcccugggcaggaccuaaaaggcugccggugcuucccuuuugcuagauugguuuauagucuccagcccuguggcgccugugccagcaucuuggccucucugggccaggauuacauacagggcuggcccuuacugcacuggaacacaaguaaaagauggcagcuaugccuugggccuggccagggagagcccagagacaucuccuuggucccauggucucugguuagcccagccuuuagccagagccaccucucuuccuccagagcuugcucaucagggacacgcucuucaccaucacagcugcuugugccaaaccugagagcagagcugugcuggcccucauuguuccauuugcccugccucauugcccugccgcccugcccgccccgcuuucugcgggcuaccucagcucuccuugggugggauacggcacuuuccagugcagccucuacucaagccccaugguuggggcugaagaaugucaguuugaccguccuuggccagagccuuguucucucaggggcuuugggccccucgggagcuuguguuaagaaguagccuuuguccacagugaguuccagggccuggccucaaggccucucuaugggguaagcggggcuaucuggucugccuagccuggaaucugccgugccgggcgauccacauuuaauuugcacugaugucuuuuguuuuggugucaugcgugaaaccuuacuuuuuuuucucagucgcauuuacaagcuguauuuuuaugcauuuuuguuuucuguuucucccucugcucacuguccuuuggcaugguucuguuguucaucucacccgcgggaccucuccaucuugacccuguggccugggaccuuuccuccucaccccuccaauggcuuguucucccauuccugggagcugggcucucuggggcuuggggcuuccuuccucgcccgguaguuugaggauagccagagcccccaaacaaggccugaauaacucuccaccugugaaagaauucaaagagagcugugcagccgaggccuuccggugccgcagcaucaguguaucugaacaugugguccgcagguaguggggcugugucggguggggggcacggaccuggagcuuggccccgugagcacccgggugguggugcauggggcugcaugcaugaccuccucgccugcuggcagcagcucucccugacaagagccggaggacaaccuggccccagccuagcagagccugguggcaaagggugggaagguugcauucuguccaagcccugauagcacaauuggcugcacagccuccucagagaucauccuccaagcccugacuagagcuagaguagcugcccugagaacauugggagccagugucagccccucagguugguaccacagaggagaggccacgagcuuugcagauccaaguugcuccugugcagguggcacacacacacuacccuaaguucggcaucgcauucugcagggcagauuuucuucuugggcuucauucuaagaggaacucgaggcuuuugcauagggaucugggguggaggccagccuggaggggugggggugaugcugggccccagagguagcuagcaucuuucugugaauugugucugucuagugauagggcaucuuucccucaccuuccagcccuuccuggguguggcuucagucacccugagaucuagccccgugugagugccugccuuggguuucuaccucuguauggcuucugagagcuggggacagugagugcccaguagaaccccaaucaccucuuucuuucugguagacuccuuauaaccaaaacguggcuaaagagcucagaaucaaaccuagaaaaggccuuccucugguuccugggcaugaguggaacuugaccaguuacuccaguucacucagccuguccuugcuaggagguggcccugugggcagaaugcaaucuugcucuguccuccuguggucucugaagucugcaugacuaagcugugggcugcagccauggcugacuccugugugcuuuggggagaggauguucugucuucccauucucucagcuaugcuccagacagcgggcucugcugugaggcuccugccucccuuccucucugggaugacgugguccacagggcuugugagguuguagcuccauuagccacugugaccugggccuggugggcuuucugagcaaggccaucuuggccaugcaugcauugagcuuuggcuccuggugguaggugacucggcaugguccuucccuuaguccugaccucaaaccuaggcaugguuucucccucuagcagaauacagacaucccuuacgagcgccagccuggggucugcggaugagaacucuauggcccaggcugaugacaacuugaagaaucuccacuuggagcucacagaaacaugucuggacaugauggcccgauauguguucuccaauuucacugcaguccccaagaggugugagggccuccaggacugggguggguggggcagcugucuacuuguucucuguggcugaacuggaugcccaggguggcagcugcucuggguuccugagguccugcuggccuucaggagcugagagccugcacauacaagcaggagauagacacucuuacucuuuuagguccccugugggagaguuccuccuggcaggggguaggaccaaaaccuggcugguuggaaacaagcuugucacugugacaacaagugugggaacugguacacggucgcugcugggccuggacucuggggaccugcaggguggcucggauucaaggugacugucccucccuucuggguauacugugcuccuagaaacccugggggaccaugguugacucuguauggucacuucuguccuuagcucugauccuagcacacaugugaggcagacaaaggaagcaccggccaaacuggagucccaggcugggcagcaggugucccguggggcccgggaccggguccgcuccaugucagguaagacuauacccaagccaucuccugacacgugcccauuaucccucaccuaccucucaguuugccccagugugcagaagagcugaaagacuguuggcuagcuuugugacuggccacuuccugaugacucuuggauguggucuuuguggcauaccagucuguguauagaggcaugguaacucugcucaucggggagcgaggcuccugcaguucaagagccuggaagucagcucacccagggcacucucuguugugauugaggaguugugggucagugggugagcaucggggcucuuugcugcuugguucacaggaggcccccacuccuccuccuccuccucucccuccuccuccuccucuucuuccuccuccuccucuucuuccuccucuuccuccuuucucuuucucuuccuucuuccuccuuccuuuuccuguucuuuuguuuucuuuuuuguuuguuuguuuuguuuuguuuuucuuaagacagaguuucuuuguguagccuuggcugucuuagaauuugcucuguagaccaggcuggccuugaacucacaaagauccaccugccuuugccuccccagugcugggauuaaagacaugcaccaauacugccugguuuuuuguuuuguuuuguuuuguuuuguuuuuuaacuuuuuagugacuuauuuauuuuuauuuuaugugcauugguguucucccugcaugugggucugugugagggugucaggucuccuggaacuggaauuaaauauaauuguaaauugccaugugggugcugggaauugaaccuggguccucucaaagaacauccaauguucuuaaccacugagccaucucucugaggcuaccacucuugaagggccaaacccagggccuggggcuguccuguuucagcuuuccuugggcaugggccaggugcuuccagacuggcuggacuuugugucugcucugugcuggagacuuuacugggcaaguggucaccaauucuaaacucccuuguuuuuagggggccauggccuucgaguugguguccuggauacuucagcucccuauuccccagguggcucugcuucucugggaccacagacggcgguggcagcgaagcccgagaagcccccugcaggagcccagcuuccaacagcagagaagacgaaucuggcagccuaugugccuuuguuaacccagggcugggcagaaaucuuaguccgcagacccacagguacugagagagcaggcagccuggagagugcccaguggucuucagagcauaggggcauugagacauucgcucugaggcugcucuucagaggggugguggcugaggcacuugcaaaagugccaaacagggcagcucacacuucagacauuuagucuccggguguagaagaccagaagaugagacugaaugugggcagggcagauuccuucugaguccugagccugcagguggcucgcgucucucugcccuugugcuugagcccauacccuuuauuaugugcacacaggcuuuagacagggccaacuuucauacccuuuauuaugugcacacaggcauugacagggccaacuuucauacccuuuauuaugugcacacaggcauuagacaggaccaacuuucagguagucucauuugaccuuguuaacuucuuuaccauuuccacagucauguucugagguccucucugagcuuagcauaugaauuuagcuugcagcaggggcaugccagucaccaagaggggcuuaacaaagacccuaagcccaggaauagucgugggugccguguggaugugguacaaggagaaggcucugggcgccaggcugucugaggagccccagcccugaggugugucugagccuggccugccuggccucagucuagugcugcucugaaccgacacagggugugaguggguauaggcuguuggugauagugcuaagaguggggcaugacugggagguauggccuacagcuuagguaccacccaccccaccccaccccacccccaggaaacaccagcuggcugaugagcuuggagaacccgcucagccccuucuccucagacaucaacaacaugccccugcaagagcuguccaaugcccuuauggcugcugaacguuucaaggagcaccgggacacggcccuguacaagucauugucagugccagcggcuggcaccgccaagccuccuacucucccacgcucuaauacaggugagcacagagcaugcauggguagccgagcucagaugcccagucugacugcagcaaggcuuccucuaucgaggccucucacguguaguuuucaggguguuuggggaagauacuaguguucuggucccuaaaguuuaggagcaggcucaugccugcugaagaacucucuuccuuggagacugguaccugcugccaccaucaggacgcugcugaagguuggcagugucuggauggagcucucuggagccuuugacggcacuuccaugacgggcuuggccuggggugagaaggcacugugggcagcugagcacacccugggccuggggugggaugccugagccugccugccugccugggugcucccggccugccaacccugcccagcuaggcccuuaaucacaugugaccacagauggcacuuggaggcugaggacauccauaugucagcagcuggccagcaguaaccucccaaaggcugugcaugcaguuuggagagcugggagcccugugugccggcccuggccgccgcugguccuccccucuguccucuccaggcccggggcuaugcccguccucucugcucggccuugugcagucucugccgcugacgaggcuacucgcgugguucccuugcaguggcuucuuucuccucccuguaccagcccagcugccaaggacagcugcacaggagcguuuccugggcagguauuggcgcgucccugcgaggaaaccaugugcucugccucauagaugcuguucuccucgccccccccccccaucugcucaccuuuccauggcuggcugggccucucaucgcccuuggggaguaggguccuggcugacaugaggacaucuuguguaggacaccugugcuuagcccauggggacccuuugacacguguccugagcugagcucugcuucugagcuauuguggccucuggcugauggguuggguaggucuccuuuuucccuguggguggcagcuguugggguugagccuggcccuagggcccaggugagccccuuuccuggcuacugaugaucugauuguuuugugcaucuccuuucgucauagcaguucucucauguguacuggagccaguuuuggaagggcauuguauacauggcugcuggggugugggcaguugcuaggggaggugucagucaggcugcacugacccuugauugcuucuuacacauccccugcccuggcaugcucugcccagggacuucaucccuccccucaaguaccacacuugaagcuucuguuuucagaguagguugcaagucuacauauggggacauccugucagcuucuuucugagguccaaagccagagcuggcuucaggcccugcaccccucccaugcuggagcccuguucuccuccuugccuugcuagugaugcagggguggguggagcugcugcacacuggccugcuggagguguuagagccagggcuccccaggccugcagaguucaucucagccugcuccaguggcagcgggcagaggguggacagcucugcaggcgcugcccuuccagcagggagaagcugguguucugaggucacaugagcguccgcccugcccagcacacagcaagcuucccugucuguguccucccagacucagccaugguccuugaggagggaaguccaggagagacucaggugccaguggagccccccgaauuggaggauuucgaggcggcguuagguacagacaggcacugccagcggccugacaccuacagccgggugagcaucaugggagccauagggaaagcuggggcaggcagcagcgucuaacucagaccuccuggcucuguacugacuugcugugugagcuggauaggccuuccccccaugucgcuucugcucccacccucugggucucucacccucuaucuggguggcauuuauuguggucuuuuucaguuugucagaaucgggauggcaggugcugccagaggccugaaggggaagccagaggcccuaauguuucagugccuccuaacaguguuucuuccaaauugucuuugcagucauccucagcaucuagccaggaagaaaagucccauuuggaggagcuugcugcaggggguauccccauugagcgggccaucuccucugagggggcucggccugccguggaccucuccuuccaacccucacagccuuugagcaagucuagcucuucuccggaguugcagaccuuacaggacauccuuggagaccuaggggacaagauugauauuggacggcugaguccugaggcuaagguccggucccagucagggauccuggauggggaagcagcuaccuggucagcuacgggugaagagagccguaucacagucccaccugaagguccucugccuuccaguucuccccgcucccccaguggccuccggccccgaggcuauaccaucucugauuccgcuccaucacgaaggggaaagaggguagaaagggauaacuucaagagcagagcugcggccuccagugcugagaaggugccaggcaucaacccuaggugggcacaaaucccagguugcuaccaacuccaggggauacacuuucuucuuggcuggagcucccauacacugcacgggagaacaggcagucaugaauugugucuuccuguagcuggugggagccauaaggaggguggguccuuggccguagaguuuagguccugccaucggccccgcccugaccaaugcuuucucuguagcuuuguguuccuacagcucuaccauucgcccuuuuuuggugaugaguccaauaagcccauccuauugcccaaugagguaggccggccuucucucugccacaguagggguggggucacagagggucuguccccucuuggguggagacaaucauccugaggacuggugcuauguagcugucuggguugguggcugguggcaggguagugucugcccugaacucacauagacucugugugccugcaguccuuugaacggucaguacagcugcuugaccagauuccauccuaugacacucacaagauugcuguccuguaugugggagaaggccagguaaggcccuggggucagcauaggacuacugaggcucagcaguaggucagaguucagucucugauucuuugauacuuuggaggacugggagcuuguugaguccugagccagaaacacagccaugacaggccaauggguugauaugcagagcugugagaacugcagggugcauacaugcaauagcagaguucugaggucccaggaugggccacugaaugaguguagcuaaguggcaggacagagggucaucauggacaaucucacagcccaauauauaaacaugagccauacuuuucuuaugagguagggacccuggacuacuuugagccaccguuauuaaugccggcauuuugaaaaguaucccucugcuguguagugccuugauggaguuaggugaucacuauccuagcgagaggaauaggauuggguuugguugcaaggauaugaagcagugcuaagguucuggguauguugauuuugcuagcugaauguauuacggguagagaagggagggaggccagguggcacccaggucuauagacuggacagcuguaagcaugacaguauugagugggggauggcuuuccauccgugccgagccugccaggugacucugaacuguuaacuauucucauucccuggauuuccccacagagcagcagugagcuggccauccugucaaaugagcauggcucuuacagguacacggaguuucugacaggccugggucggcuuauugagcucaaggacugccaaccagacaagguguacuuagguggacuggauguauguggcgaggauggacaguucaccuacugcuggcaugaugacaucaugcaagguguguacuccucuagguaggccugcuuccaagcccugccucuggaaaaaaaucaggaaaucuggagggauacagaggucugagccugggcccuaaaguccagcauuugguguccuguccuggcacccaguccagugucacccacucuacagcuguuuuccacauugccacccugaugcccaccaaggauguggacaagcaccgcugugacaagaaacggcaccugggcaaugacuuuguuucuaucaucuacaaugauucuggugaggacuucaaacugggcaccauuaaggugagugagauuuccaugugcgauugccuaggcaauggcugugcucugccacugccaucaccagacucagcagcagcccaggcggucuacaaaaaugccugcugauguauuuugaaguggccuugagugucuugggaggguacacuuuugggagccccaugcacugggacaggcuaucagagacacaggagacaugaucacaaaaccuuccuucauauauaggaugagcuguggcccucaagacuaacuaggugaauauguccugguggguguacagugcucaacaggaguguacugucugcuuacaguggcuuuuaaggguccuuguuggacacauuguagcacacuugggucugcacguaucacaacugagaggagaugaggcagggcucugggaagcuaguguaagggcccaugggcaguaucguccugggagaacacccucagcucuguccuuaggcacagucggaagccugcaaggcaggguguauguuuuaugcuaaacacauaaaccugcauguuuagccagagaugucaaaggcaaguggggaagcagcguggccuucagcacaugcucaugccgggugacuuuccucuccuuugggcagggccaguucaacuuuguccaugugaucaucacaccgcuggacuacaagugcaaccuauugacccugcagugcaggaaaggugaggcccaggcuggguaggguggcaguuuuggccugagcuggguaugagcauugugucuccacagacauggaaggccucguggacaccaguguggccaagauugugucugaccgcaaccuguccuuuguggcccgacagauggcccugcaugcaaaugugagugguggcggcagccuggggagauagucgugugggcgcucccuguugugauggagcucacugucaccauccugcucugucaccuccagauggccucacagguacaccacagccgauccaaccccacugacaucuaucccuccaaguggaucgcaagacuccgccacauuaagcgucuccgccagaggguagggaggacaggcuucagagaugcgaugucugagucugguugaacagaacuuccggacucacugccagagcuuucucucucucuagauccgugaagaggugcacuauuccaacccaagcuugccucugaugcacccuccagcccacaccaaagccccagcucaagccccugaggcuacacccaccuaugaaacaggccagcggaagcgccucauuuccuccguggaugacuucacagaguuugugugaggccagcagauccaugacuagaguccuguggccagccauguagcuauccugacuguacuccuacaugaaauaaacugcacacgcacaucuggcccguggaguucagagagcagcacagacagcagucagacagcuucuuuauuugacuuugucuugucuguuugggguuggggcagaauccaggcuagagcugcagaugagcccacagaagcaggcaggugccaucacauacauucucuuucccccacccgccaugggggcaagccccauuggugggcuuguccaguaacuucuuggcaucuuucaucccacaguaguccugcccuugcucagaucugaaaccagcagaucugcgugcugccuggccccagacaagggaggaaaacaaggccacgguggccccaauugcuguccagcaccugcccgaggccagacucggauccaguaauagcugcagcuuccccuguaccccugcccuggguaacaauggacccauuuucagcccaaguagaaaauacugacauacaaaaauauauacauuuuaaccccauauaaauuauugaugguggacauagaaagcagaugguagcuagagggcaaguaugcugcagaaacaagagagguaauaacuuaggggacggauaaaggagaaguguagcuuagcccucc
